United States Patent 12,569,549 (FLAVIVIRUS VACCINE) - sequence listing, part 55

SEQ ID NO: 19540 - RNA, 9876 nt, synthetic construct
  misc_feature 1..9876: note = derived and/or modified CDS sequence (opt5) from DENV-2__KF744408__SS-prME
  source 1..9876: mol_type = other RNA
accgccggcatgatcattatgctgatccccacggtgatggctttccacctcacgacccggaacggggaacctcatatgattgtctcccggcaggaaaagggaaaatccctgctttttaagacagaagacggcgttaatatgtgcaccctgatggccatggatctcggggaactgtgtgaagacacaatcacctacaaatgcccgcttctgagacaaaacgaacccgaggatattgactgttggtgcaattctacaagcacctgggtgacgtatggaacctgtacaaccacaggcgagcacagacgggaaaagcgctccgtggcgctcgtccctcatgtggggatgggactggagaccagaacggaaacatggatgtctagcgagggcgcttggaaacacgcccagcggatcgagacctggatcctgcgccatcccggcttcacactcatggccgctattctggcctacaccatcgggaccacaaactttcagagagctcttattttcatcctgctcacggccgttgcgccttccatgaccatgcggtgcattggaatctctaatcgcgattttgtggaaggcgtcagcgggggatcctgggtggacattgttctggagcacggcagctgtgtgacaaccatggccaagaacaagcccacacttgatttcgaactgatcaaaaccgaggctaagcaccctgccacgctcagaaaatattgcatcgaagctaagctgacaaataccaccacagcctctcggtgtccgacccagggggagccctccctgaacgaggaacaagacaaacgctttgtctgcaagcatagcatggtggatagaggatggggcaatggctgtgggcttttcggaaagggcgggattgtgacatgcgcgatgtttacgtgcaaaaagaacatggagggaaaaatcgtccagcctgaaaatctggagtacaccattgttatcacaccccactctggcgaagaacatgccgtggggaacgacaccggaaagcacggcaaagagattaagatcacacctcagtccagcatcaccgaagctgagcttacgggctatgggaccgtgacaatggaatgttctccccggaccggactgggcttcaatgagatggtcctcctgcagatggaagataaagcctggcttgtgcaccgccaatggtttctggacctcccgctgccttggctgcccggggctgatacacagggatccaactggattcagaaggagaccctcgttacgttcaagaatcctcatgccaaaaagcaggacgtggtcgtgctgggcagccaagagggggccatgcacacagctcttaccggcgcgacagaaatccagatgtcctctggaaacctgctctttaccggccatctgaaatgcagacttcggatggacaagctgcagctcaaagggatgagctactccatgtgtaccggaaagttcaaggttgtgaaagagattgccgaaacacaacacggcacgatcgtcgtgagagtccagtatgagggggatggaagcccctgcaagattcccttcgagatcatggacctggaaaaacgccatgtgctgggccggctcatcaccgttaaccctattgtgacagagaaggattctccggtcaatatcgaagctgagcccccttttggggactcctacgtgattatcggcgttgaacccggacagctgaaacttagctggttcaagaagggctctagcattgggcagatgtttgagaccacaatgagaggagccaaacgcatggccatcctgggcgataccgcttgggacttcgggtccctcggaggcgtgtttacgtctattgggaaggccctgcaccaagtcttcggcgcgatctacggagctgcctttagcggcgtgtcctggacaatgaaaatcctgattggggtgatcattacctggatcggaatgaacagccggtctacctcccttagcgtttctctcgtcctggtgggcgtggtcacactgtatctcggggtggttgtgcaggccgattccggatgtgtcgtgagctggagaaataaggagctgaaatgcggctccgggattttcatcaccgacaacgttcacacatggacggaacagtacaagtttcagcctgagtctcccagcaaacttgcttccgccatccaaaaagctcatcaggaaggcatttgtggaatccgctctgtgacccggctggagaatctcatgtggaagcagattacaccggaactgaaccacatcctgagcgagaatgaggtcaaacttaccattatgacaggcgatatcaaggggatcatgcaggccggaaaaagatccctccgccctcaacccaccgaactgcggtatagctggaagacgtggggcaaagcgaagattctgtctaccgagtcccataaccagacattcctcatcgacgggcctgaaaccgccgagtgccccaatacaaacagagcttggaatagcctggaagtggaggattacggatttggcgttttcaccacaaacatttggcttcgcctgcgggagaagcaggacgccttttgtgactctaaactcatgtccgctgccatcaaggataatagagcggtgcacgccgacatgggctattggattgaaagcgctctgaacgatacctggaaaatcgagaaggcctctttcatcgaagtcaaaagctgccactggcctaagtcccatacgctgtggagcaatggggtgcttgagtctgagatgattatccccaagaacttcgctggaccggtgtcccagcacaactaccggcctggctatcatacacaaaccgccgggccctggcacctcggaaaactggaaatggactttgatttctgtaagggcaccacagtcgttgtgaccgaggactgcgggaatcgcggacccagcctgagaacgacaaccgcctccggcaaactcattacagaatggtgctgtcggtcttgcaccctgcctccgcttagataccgcggcgaggatgggtgttggtacggaatggaaatccggcccctgaaggagaaagaggaaaacctcgtgaatagcctggtcacagctggccatgggcagattgacaacttttccctgggagtgcttggcatggccctcttcctggaggaaatgctgagaacccgcgttgggacgaagcacgccatcctcctggtggctgtctcttttgtgacccttattacaggaaatatgagcttcagagatctgggccgggttatggtgatggtcggcgccaccatgacagacgatatcgggatgggagtgacctatctcgccctgctggctgcctttaaggttcgccctacgttcgcggctggccttctgctcagaaaactgacatccaaggagctcatgatgaccacaatcgggattgtgctgctttctcagagcaccatccccgaaaccattctggagctcacagacgccctggccctgggaatgatggtccttaaaatcgtgcggaacatggagaagtaccaactggctgtgacgattatggccatcctctgcgtccctaatgcggttatcctgcagaacgcttggaaagtgtcctgtaccattctcgccgtggtcagcgtgtctcccctgcttctgacatccagccagcagaaggccgattggatccctctcgctctgaccattaagggcctgaatcccacagccatctttcttaccacgctgtctcgcacatccaaaaagagaagctggccgctcaacgaagctattatggccgttgggatggtgtctatcctggcgtccagcctcctgaaaaatgacatccctatgaccggaccccttgtcgccggcggcctgctgaccgtgtgctatgttctcacagggcggtccgctgacctggagcttgaaaaggccgctgatgtgcgctgggaggaccaagccgaaattagcggatctagccctatcctgtccattatcatttctgaggatggcagcatgtccatcaaaaacgaggaagaggaacagaccctcacaattctgatcagaacggggctcctggtcatctctggacttttccccgtgagcattccgatcaccgccgctgcgtggtacctgtgggaggtcaagaaacagcgggccggcgtgctgtgggacgttccttctccccctcccgtggggaaggctgagctcgaagatggagcctatcgcattaagcagaaaggcatcctgggctacagccaaattggggccggagtctataaggagggcacatttcacaccatgtggcatgtgacaagaggggctgttcttatgcacaaaggaaagcggatcgaacccagctgggccgacgtgaaaaaggatctgatctcctacggcgggggatggaagctcgagggcgaatggaaagagggcgaggaagtccaggtgctggcgctcgagcctgggaagaatccgagagctgtgcagaccaaacccggactgttcaagacgaacgccggcaccattggggccgttagccttgacttttctcctggaacatccggcagccccatcattgataaaaaggggaaggtcgtgggactgtacggcaatggcgtggtcacccgcaacgggtcttatgtgtccgctatcgcccagacagaaaagagcattgaggacaaccctgagatcgaggatgacatcttccggaagaaaagactgaccattatggatctccatcccggagcgggcaagacaaaacgctacctgcctgctatcgttcgggaggccattaagagagggcttcgcacgctgatcctcgccccgacccgggtggtcgctgccgaaatggaggaagctctgagaggactccccattcgctatcaaacgcctgcgatccgggcggagcacaccggcagagaaattgtggacctgatgtgtcatgccaccttcacaatgcggcttctgtcccccatccgcgttcctaattacaacctgatcattatggacgaggctcactttacggatcccgcctctatcgctgccagagggtatattagcacccgggtggagatgggcgaagccgctggaatcttcatgacagcgaccccgcctggctcccgcgacccctttccccagagcaatgcccctattatggatgaggaaagagagatccccgagcggtcttggaactccgggcacgaatgggtcacagacttcaagggaaaaaccgtgtggtttgttcctagcatcaaggctggcaatgatattgccgcctgcctccgcaagaacgggaagaaagtgatccagctgtctcgcaagacgttcgacagcgagtacgtcaagacacggaccaatgattgggactttgtggtgaccacagatatttccgaaatgggagctaacttcaaagccgagagagtcatcgacccgcgccggtgtatgaagcccgttattcttaccgatggcgaagagagagtgatcctggcggggcctatgcccgtgacacattctagcgctgcccaacgccggggcagaatcggacgcaatcctaaaaacgagaatgaccagtatatttacatgggcgaacccctcgagaacgacgaagattgcgcccactggaaggaggctaaaatgctgctggacaatatcaacaccccggaagggattatcccttccatgtttgagcccgagagagaaaaggtcgatgccattgacggagagtaccggctccgcggcgaagcgagaaaaacgttcgtggatcttatgcggcgcggggacctgcctgtttggctggcctataaggtggctgccgagggaatcaattacgctgatagacggtggtgttttgacggcattagaaacaaccagatcctcgaagagaatgtcgaggtggaaatctggacaaaggagggggaacgcaaaaagctgaaaccccggtggcttgatgccagaatttattctgaccctctggctctcaaggagttcaaagagttcgccgcgggccgcaagagcctgaccctgaacctcatcacagaaatgggacggcttcccacctttatgacgcagaaggccagaaatgctctggataacctggccgttctccataccgctgaggccggcgggcgggcctacaatcacgctctgtccgaacttccggagacactggaaaccctcctgctgctcacacttctggcgaccgtgacaggaggcattttcctgtttctcatgagcgggaaaggaatcggcaagatgaccctgggcatgtgctgcattatcacggcctctgtccttctgtggtatgctcaaatccagcctcactggattgccgcctccatcattctcgagttctttctgatcgtgctgctcattcccgagcccgaaaaacagcgcacacctcaggacaaccaacttacctacgtcgtgatcgctatcctgaccgttgtggccgcgacaatggccaatgagatggggttcctggaaaagaccaaaaaggatctcggactgggcagcattacaacgcagcagccggagtccaacatccttgacattgacctgagacccgcttctgcctggaccctctatgctgtggccacaacctttatcacacctatgctgcggcatagcattgaaaattcctctgtcaacgttagcctgaccgcgatcgccaatcaggctacggtgctcatggggcttggaaagggctggcccctgtccaaaatggatattggggtgcctctgctcgccatcggatgttacagccaagtcaaccccatcaccctgacagctgcccttctgctcctggtggctcactacgccattatcggccctggcctgcaggcgaaggccacccgcgaggctcagaaaagagccgctgccgggattatgaagaatccgacagttgacggaatcaccgtgattgatctcgaccccatcccttatgatcccaaattcgagaagcagcttggccaagtcatgctgctggtgctctgcgtcacacaggtgctgatgatgcggacaacctgggccctttgtgaagcgctgacactcgctaccgggcctatctctaccctgtgggagggaaaccccggccgcttttggaatacaacgattgccgtttccatggctaacatcttcagagggagctacctggccggagccggcctcctcttttctattatgaagaataccacaaacacccggcgcggcacagggaacatcggagaaaccctgggcgagaaatggaagtccagactgaatgctctcgggaaaagcgagttccagatttataagaaatctggaatccaagaggtggaccggacgctggccaaggagggcatcaaaagaggggaaacagatcatcacgcggtcagccgcggatccgccaaacttcggtggtttgtggagagaaacatgattaccccggaaggcaaggttgtggacctgggctgcgggcgcggaggctggtcttactattgtgggggactcaaaaatgtccgggaggtgaagggcctgaccaaagggggacctggccatgaggaacccatccccatgagcacatacggctggaacctggtgagactccagtccggggttgatgtcttcttcacccctcccgagaagtgcgacacacttctgtgtgatattggagaaagctcccctaatccgacggtggaggctggccgcaccctgcgggtgctcaacctggtcgaaaattggcttaacaataacacacagttttgcatcaaagttctgaatccctatatgccttctgtgattgagaagatggaggccctccagagaaagtacgggggagctctggtgcgcaaccccctgagcagaaattccacccacgaaatgtactgggtctctaacgccagcggcaatatcgtgtcctctgttaacatgatcagcagaatgctcattaaccgcttcacaatgaaacacaagaaagcgacctatgagcctgacgtggatcttgggtccggaacgcggaatatcggcattgaaagcgaggtccccaacctggacatcattggcaagagaatcgagaagattaagcaagagcatgagacctcttggcactacgaccaggatcatccgtataagacatgggcctaccacgggtcctatgaaaccaaacagacaggaagcgcttcttccatggtgaatggcgttgtgcgcctgctcaccaagccttgggacgtcatccccatggtgacacagatggccatgaccgatacgacaccttttgggcaacagagagtgttcaaagagaaggtcgacacccggacccaggaacccaaagagggaacaaagaagctgatgaaaatcacggctgaatggctttggaaggagctgggcaaaaagaaaacccctcgcatgtgtacaagagaggaatttacccggaaggttagaagcaacgccgctctcggggccattttcacagatgagaataaatggaagtctgcgcgggaagccgtggaggactcccgcttttgggagctggtggataaggaaagaaacctgcacctcgagggaaaatgcgaaacctgtgtctacaatatgatgggcaagcgggagaaaaagctgggcgagttcgggaaagctaagggaagccgcgccatctggtatatgtggcttggcgctagatttctggagttcgaggccctcgggtttctgaacgaagaccattggttctcccgggagaatagcctttctggagtggaaggcgaggggctgcacaagctcggctacattctgcgcgatgttagcaaaaaggaaggaggcgccatgtacgcggacgatacagctgggtgggacaccagaatcacgctggaggacctcaaaaacgaggaaatggtgaccaatcatatggagggagaacacaagaaactggccgaggccatttttaaacttacatatcagaacaaggtcgtgcgggttcaacgccccaccccgagaggcacagtgatggatatcatctcccggcgcgaccagagagggtctggacaggtcggcacctacgggctgaatacgttcacaaacatggaagctcaactcattcggcagatggagggcgagggagtgttcaaaagcatccagcatctgaccgccacagaagagattgctgttcagaattggcttgcccgcgtgggcagagaacggctgtccagaatggcgatctctggggatgactgcgtcgtgaagcctctcgatgaccgctttgccagcgctctgaccgccctgaacgatatgggaaaagtccggaaggacattcaacagtgggagccctccaaaggctggaacgattggacacaggtgcccttctgctctcaccactttcatgagctcatcatgaaggacgggagagttctggtggtcccttgtcgcaatcaggatgaacttatcggacgggctagaattagccaaggcgccgggtggtccctgcgcgagaccgcgtgcctcggcaagagctatgcccagatgtggtctctgatgtacttccaccggagagaccttcgcctggctgccaacgctatctgttccgccgtgccgagccattgggtgcccacatctcggaccacatggtccattcacgctaaacacgaatggatgaccacagaggatatgctcaccgtttggaatagagtgtggatccaggaaaacccttggatggaggacaagacgcccgtcgagagctgggaagagattccttatctgggaaaacgcgaagaccagtggtgcggctccctgatcgggctcacatctcgggccacctgggcgaagaatattcaaaccgccatcaaccaggtgagaagcctgatcggaaatgaggaatacacagattatatgccctccatgaaacggtttagacgcgaggaggaagaggctggcgttctttggtga

SEQ ID NO: 19541 - RNA, 9876 nt, synthetic construct
  misc_feature 1..9876: note = derived and/or modified CDS sequence (opt5) from DENV-2__JX669476__SS-prME
  source 1..9876: mol_type = other RNA
accgccggcgtgatcgtcatgctcattcccacagctatggccttccacctcacgaccagaaatggggaacctcatatgatcgttggacggcaggaaaagggcaagagcctgctttttaagacagaagacggggtgaatatgtgcaccctgatggcgattgatctcggagaactgtgtgaagacacaatcacctacaagtgcccgcttctgcgccaaaatgaacccgaggatattgactgttggtgcaattccacatctacctgggtgacgtatggcacctgtacaaccacaggggagcacagacgggaaaagcgcagcgttgctctcgtgcctcatgttggaatgggcctggagaccagaacggaaacatggatgtcctctgagggcgcctggaaacacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaagaacaggacaaacgctttatctgcaagcattccatggtggatagaggctggggcaacgggtgtggactgttcggcaaagggggaattgtcacatgcgccatgtttacgtgcaaaaagaatatggaaggcaaaatcgttcagagcgagaacctcgaatacaccattgtgatcacacctcactctggggaggagcatgcggtgggaaatgacaccggcaagcacggcaaagaaatcaagattacaccccagtccagcaccacggaggccgaactgaccgggtatggaacagtcaccatggagtgttctcctcggacaggccttgatttcaacgaaatggtgctgctccaaatggaggacaaggcttggctggttcaccgccagtggtttcttgatctgcccctcccgtggctgcctggggccgacacccagggatccaattggatccagaaggagacgctggtgacattcaagaacccccatgctaaaaagcaagacgtcgtggttctcggcagccaggaaggggccatgcacaccgccctgacaggcgctaccgagattcagatgtcctctggaaatcttctgtttaccggccatctcaaatgcagactgcggatggataaacttcaactgaaagggatgagctactccatgtgtacaggaaagttcaagatcgtgaaagaaattgcggagacgcagcacggcaccatcgtcatcagagtgcagtatgagggggacggaagcccttgcaagattcccttcgaaatcacagatctcgagaaacgccatgtcctgggccggctgattaccgtgaaccccatcgttacagaaaaggactctcctgtgaacattgaggccgaaccgccctttggggattcctacatcattgtcggcgtggagcctggacagctcaaactgaattggttcaagaagggcagctctatcgggcaaatgtttgagaccacgatgagaggagctaaacgcatggccatccttggcgacacagcctgggatttcgggagcctgggaggcgtttttacctccattgggaaggctctccaccaggtgttcggcgccatctacggagcggctttttctggcgtcagctggaccatgaaaattctgatcggggtgattatcacatggatcggaatgaactcccggagcacctctctgtccgtgagccttgttctcgtcggcgtggtgacactgtatctgggggccatggtccaggccgactctggatgtattgtgtcctggaagaataaagaactcaagtgcggcagcgggatcttcattacggataacgttcacacctggacagagcagtacaagtttcaacccgagttcccttccaaactggcttctgccatccagaaggctcatgaggaaggcatttgtggaatcagaagcgtgacccgccttgagaatctgatgtggaaacagatcacacccgagctcaaccacattctgtccgaaaatgaggtcaagctgaccatcatgacgggcgacattaaagggatcatgcaggccggaaagcggtctcttagaccgcaacctaccgaactcaaatatagctggaagacatggggcaaggcgaaaatgctgtccaccgagagccataaccagacatttctgattgatgggcccgaaaccgccgagtgccctaatacaaaccgcgcttggaactctctcgaggtggaagactacggattcggcgtttttaccacgaacatctggctgaaacttcgggagaaacaggacgtgttctgtgattccaagctgatgagcgccgctatcaaagacaatagagccgtccacgcggatatgggctattggattgaatctgccctcaacgacacatggaaggtggagaaggcttccttcatcgaggttaaaagctgccactggcccaagtctcataccctgtggagcaatggggtgctggaatccgagatgattatccctaaaaactttgccggacccgtcagccagcacaactaccgcccgggctatcatacccaaacagctgggccttggcaccttggaaagctcgaaatggatttcgacttttgtgagggcaccacggtggtggtcacagaagattgcgggaatcggggaccctctctgagaaccacaaccgcctccggcaaactgattacagagtggtgctgtcggagctgcaccctgccccctctgcgctacagaggcgaggacgggtgttggtacggaatggaaatccggccgcttaaggagaaggaagagaacctggttaattccctcgtgacggccggccatgggcagattgataacttctctctgggagtgctgggcatggctctttttctcgaagagatgctgagaacccgcgtcgggacaaaacacgcgatcctgctcgtggccctgagcttcgttacccttatcacaggaaatatgtcctttcgggacctgggcagagtgatggtcatggtgggcgctaccatgacggatgacattgggatgggagttacatatctcgccctgctggccgctttcaaggtgcgccccacctttgccgcgggccttctgctcagaaaactgacatctaaggagctcatgatggctaccatcgggattgccctgcttagccagtccaccctgcctgaaacaatcctcgagctgacggatgccctggctcttggaatgatggccctgaaaattgtccggaacatggaaaagtaccaactcgcggtgaccatcatggctatctcttgcgttcccaatgccgtgattctgcagaacgcctggaaggtcagctgtacaatcctcgctgccgtgtccgtgagccctctgcttctgacctcttcccagcagaaaacagactggattcccctcgctctgaccatcaagggcctgaatcctacggccattttccttacaaccctgagccgcacctctaaaaagagatcctggcccctcaacgaggcgatcatggccgtcgggatggttagcatcctggcttcttccctcctgaaaaatgacattccgatgacaggacctcttgtggccggcggcctgctgaccgtgtgctatgtcctcacagggcggagcgctgatctggaacttgagcgcgccgccgacgtgaagtgggaggatcaagctgaaatctccggaagctctcccattctgagcatcacgatttccgaggacggctctatgagcatcaaaaacgaagaggaggaacagaccctcacaattctgatcagaaccgggctcctggttatctccggagtgtttcctgtctctattcccatcacagcggccgcttggtacctttgggaggtgaagaagcagcgggccggcgttctgtgggatgtgccgagccctccccctgtcgaaaaagccgagctggaagacggggcttatcgcattaagcagagaggaatcctcggctactcccaaattggcgccggggtgtataaagagggaaccttccacacgatgtggcatgtcacccggggcgcggtgctgatgcaccgcgggaagagaatcgagccctcttgggctgatgttaaaaaggaccttatcagctacggaggcgggtggaagctggaaggagagtggaaagaaggcgaggaagtgcaggtcctcgccctggagcccggcaagaatcctcgggccgtgcagacaaaaccggggatttttaagaccaacacaggaaccatcggcgctgtttccctcgatttcagccccgggacatctggatcccctattgtggacagaaaaggcaaggtcgtggggctgtacggaaatggcgtggttacgcgcagcggcgcctatgtctctgcgatcgctcagaccgagaagtccattgaagataaccccgagatcgaagacgatatcttccggaaaaagagacttacaattatggacctgcatcctggggccggaaaaaccaagcgctacctgcccgccatcgtgcgggaggctattaaaagaggcctccgcaccctgatccttgcccctacacgggtggtcgctgccgaaatggaggaggcgctgagagggctcccgattcgctatcaaacgcccgccatccgggctgaacacaccggaagagagattgtggacctgatgtgtcatgccacatttaccatgcggctcctgagccctgttcgcgtgcccaactacaatcttatcatcatggatgaagctcacttcacagaccctgcctccattgccgctagaggctatatctctacccgggtcgagatgggggaggcggccggcatttttatgacggctacacccccgggaagccgcgatcctttcccccagtccaacgcccccatcatggacgaagagagagaaattcctgagcggagctggaactctggccacgaatgggtgaccgattttaaggggaagaccgtttggttcgtgccctccatcaaagccggaaacgacatcgctgcctgcctgagaaagaatggcaaaaaggtcattcagctgagccgcaaaacatttgattctgagtacgtgaagacccgggcgaacgactgggatttcgttgtgacaaccgacatcagcgagatgggggctaattttaaggccgaaagagtcattgatcctcgccggtgtatgaaaccggtgatcctcacggacggagaggaaagagtgattctggccggccccatgcctgtcacacattcctctgctgcccaacgccgggggagaatcggccgcaaccccaagaatgagaacgaccagtatatctacatgggagaacctcttgagaatgatgaggactgcgcgcactggaaagaagccaagatgctgctcgataacattaatacccccgagggcatcattccgagcatgttcgaacctgagagagaaaaagttgacgctatcgatggggagtaccggctgcgcggagaggccagaaagacatttgtggacctgatgcggcgcggcgatctccccgtgtggcttgcttataaagtcgccgctgaagggattaactacgccgacagaaagtggtgtttcgatggaatcaagaataaccagattctggaggaaaacgtggaggttgagatctggaccaaagaaggcgagcggaagaaactgaagcctagatggctcgacgcgcgcatctattccgatcccctggcccttaaagagttcaaggagtttgctgccgggcggaagtctctgacgctcaatctgattaccgaaatgggcagactgcctacattcatgacccagaaagctcgcaacgccctcgacaatcttgccgtgctgcatacagctgaggtcggaggccgggcgtacacccacgccctgagcgagctccccgaaacactggagacccttctgctcctgacgctgctcgctgccgtgacagggggaatctttcttttcctgatgtccggcaaggggattggaaaaatgaccctgggcatgtgctgcatcattaccgccagcatcctcctgtggtatgctcaaatccagccgcactggattgccgcgtctatcattcttgaatttttcctgatcgttctcctgattcctgagcccgaaaagcagagaacaccccaggataaccaactgacctacgtggtcatcgccatcctcacagtggtcgctgccacgatggctaatgagatgggctttcttgagaaaaccaagaaggacctggggttcggatccattacaacccaggaaagcgagtccaacatcctggacattgatctccggcctgcctctgcgtggacactgtatgccgtggctaccacgtttgttaccccgatgcttcgccatagcatcgaaaattcctctgtgaacgtgagcctgacagccattgctaatcaggccaccgtcctcatgggcctggggaaaggatggcccctgtccaagatggacatcggcgttcctctccttgctattgggtgttacagccaggtgaaccccatcacactgaccgccgcgctgctcctgcttgtggcccactacgctatcattggacctggcctgcaagccaaagctacgagagaggcccagaagcgggccgcggctggcatcatgaaaaatcccacagtcgatgggattaccgtgatcgacctcgaacctattccgtatgatcccaagttcgagaagcagctgggacaggttatgctgctcatcctttgcgtgacacaagtcctgatgatgcgcaccacctgggccctgtgtgaggctctcacactggccacgggccctatctctaccctttgggaagggaaccccggaagattttggaatacaaccattgccgtgtccatggctaacatcttccggggcagctacctggccggggcgggactcctgttttctattatgaaaaatacaaccaacacgcgcagaggcacaggcaatgtcggggagaccctgggagaaaagtggaaatcccggctcaacgcccttggcaagagcgagttccagatctataaaaagtctgggattcaggaggtggaccgcaccctggctaaagaaggaatcaagagaggcgagacagatcatcacgccgttagccgggggtccgctaagctgagatggttcgtggaacgcaacatggtcacccctgagggaaaagtggttgacctcggctgcggcagagggggatggtcttactattgtggcgggctgaagaatgtgcgggaagtcaaaggacttacaaagggcgggcccggacatgaggagccgatccctatgagcacgtacggctggaacctggtgcgcctccaatccggcgtggatgtctttttcacccctcccgaaaaatgcgacacactgctgtgtgatattggggagagctcccccaatcccaccatcgaagccggacggacactcagagtccttaacctggtggagaattggctgaacaataacacccagttttgcattaaggtgctcaatccttatatgccgtctgtcatcgaaaagatggagacgctgcagcgcaaatacggcggggcgcttgttcggaaccccctgagcagaaattccacccacgagatgtactgggtgtctaacgccacaggaaatattgtgagctccgtcaacatgatctctcgcatgctcatcaatcggttcaccatgaagcacaaaaaggctacatatgaacctgacgtggatctgggcagcgggaccagaaacattggaatcgagtccgaaattcccaacctggacatcattggcaaacgcatcgagaagattaagcaggaacatgagatcagctggcactacgaccaagatcatccttataaaacatgggcctaccacggctcttatgagaccaagcagacggggtccgctagctctatggttaatggagtggtccggctccttacaaaaccctgggacgtggttccgatggtgacccagatggccatgaccgatacaacgccttttggccagcaaagagtcttcaaggaaaaagtggacacccgcacacaggagcccaaggaagggaccaagaaactgatgaagatcacagctgagtggctgtggaaagagctcggaaaggagaagacccctagaatgtgtacacgggaggaatttacccgcaaggtgagatccaacgccgcgctgggcgccgtcttcacggatgagaataaatggaaaagcgctcgggaagccgttgaggacgatagattttgggagcttgtggaccgggaacgcaacctgcacctcgaggggaagtgcgaaacctgtgtgtacaatatgatgggaaaaagagagaagaaactgggcgagttcggcaaggctaaagggtctcgggccatttggtatatgtggctgggagcccgctttctcgagttcgaggcgctgggctttcttaacgaagatcattggttctccagagggaatagcctgtccggagtcgagggcgaagggctccaccggctgggctacatccttcgcgaggtgggaaagaaggaaggcggggctatgtacgccgacgatacagccggatgggacaccagaattacactggaggacctcaaaaacgaggaaatggttaccaatcatatgaagggcgagcacaaaaagctggctgaagccatcttcaaactgacgtatcagaacaaggtggtccgggtgcagcgccccacacctagagggaccgttatggatattatcagccggaaggaccaacgcggatctggccaggtggggacatacggcctcaatacctttacgaacatggaggctcagctgatcagacaaatggagggagaaggcattttcaaaagcatccagcatcttaccgccacagaggaaattgcggtccagaattggctggcccgggtggggcgcgagagactctcccggatggctatctctggagatgactgcgttgtgaagcccattgatgacagatttgccagcgctctgaccgcccttaacgatatgggcaaagtccgcaaggacatccagcaatgggaaccgtcccgggggtggaatgattggacacaggtgcctttctgctctcaccactttcatgagctggtcatgaaagacggaagagtgctcgttgtgccctgtcgcaaccaggatgagctgatcggccgggcgagaattagccagggggccggctggtccctgaaggaaaccgcttgcctcggaaagtcttatgcccaaatgtggacactgatgtacttccaccgccgggaccttagactggctgccaacgctatctgtagcgccgtcccctcccattgggtgcctaccagccgcacgacatggtctattcacgcgaaacacgagtggatgaccaccgaagatatgctcacagtgtggaatcgggtttggatccaggagaacccgtggatggaagacaagacccccgtggagtcctgggaggaagtcccttatctgggcaaaagagaggaccagtggtgcgggagccttattggactgacatctcgcgccacgtgggctaagaatatccagaccgccattaaccaagtgcggtccctcatcggcaatgaagggtacacagattatatgcccagcatgaaaagatttcggagagaggaagaggaggccggagttctgtggtga

SEQ ID NO: 19542 - RNA, 9876 nt, synthetic construct
  misc_feature 1..9876: note = derived and/or modified CDS sequence (opt5) from DENV-2__JX475906__SS-prME
  source 1..9876: mol_type = other RNA
accgtgggaatgatcattatgctgatccccaccgccatggctttccacctcacgaccagaaatggggaacctcatatgattgtcagccggcaggaaaagggaaaatccctgctttttaagacagaagacggcgttaatatgtgcaccctgatggccatggatctcggggaactgtgtgaggacaccgtgacctacaactgcccccttctgcgccaaaatgaacccgaggatatcgactgttggtgcaactctacaagcacctgggtgacgtatggaacctgtacagcgaccggcgagcacagacgggaaaaacgctccgtcgctctcgtgcctcatgttgggatgggactggagacaagaaccgaaacgtggatgtctagcgagggcgcctggaagcacgcccagcggattgagacatggatcctgcgccatcccggcttcaccatcatggctgccattctcgcttacacaatcgggaccacctattttcagagagtgctgattttcatccttctgacagccgtcgcgccttccatgacgatgcggtgcattggaatctctaatcgcgattttgtggaaggcgttagcgggggatcctgggtggacattgtcctcgagcacggcagctgtgtgaccacaatggccaaaaacaagcccaccctggatttcgaacttatcaagacagaggctaaacagcctgccaccctgagaaagtactgcatcgaagctaaactcacgaatacaaccaccgcctctcggtgtccgacacaaggggagccctccctgaacgaggaacaggacaagcgctttgtgtgcaaacacagcatggtcgatagaggatggggcaatggctgtgggctgttcggaaagggcgggattgttacctgcgcgatgtttacatgcaagaaaaacatggagggaaagatcgtgcagcctgaaaatctcgagtatacgattgtgatcacaccccattctggcgaagagaacgccgtcgggaatgacacaggaaaacacggcaaggaggtgaaagttacccctcagtccagcattacagaagctgagctgaccggctacgggacggtgaccatggaatgttctccccggacaggacttgatttcaacgagatggtcctgctccaaatggaaaataaggcctggctggtgcatcgccagtggtttcttgacctgccgctcccttggctgcccggcgctgatacccaggggtccaactggatccagaaagagacactggttaccttcaagaaccctcacgccaagaaacaagacgtggtcgtgctcggaagccaggagggcgccatgcacacggctctgacaggggcgaccgaaatccagatgtcctctggcaatcttctgtttacaggacatctcaagtgcagactgcggatggacaaacttcaactgaagggcatgagctattccatgtgtaccgggaaattcaaggtcgtgaaggagattgccgaaacccagcacggaacaatcgttattagagtgcagtacgagggcgatgggagcccctgcaaaatccccttcgagattatggacctcgaaaagcgccatgtcctgggacggctgatcacggtgaaccctatcgttaccgagaaagattctccggtgaatattgaagctgagcccccttttggcgactcctacatcattatcggggtcgaacccggccagctcaagctgagctggttcaaaaagggatctagcattggccaaatgtttgagacaaccatgagaggggccaagcgcatggccatccttggagatacagcttgggacttcggctccctcgggggagtgtttacctctattggcaaagccctccaccaggtgttcggggcgatctatggcgctgcctttagcggagtttcctggacgatgaagatcctgattggcgtcgtgatcacatggattgggatgaacagccggtctacctccctgagcgtgtctcttgtcctcgtgggagttgtgaccctgtacctgggcgtcatggtgcaggccgattccgggtgtgttgtgagctggaaaaataaggagctcaaatgcggatccggcatcttcattacagacaacgtccatacctggacagaacagtataagtttcaacctgagtctcccagcaagctggcttccgccatccagaaagctcacgaagaggggatctgtggcattagatctgtgacgcgccttgaaaatctgatgtggaagcagatcaccccggagctcaaccacattctgagcgagaatgaagttaaactgacaatcatgaccggagatattaagggcatcatgcaggccgggaaacggtcccttagacctcaacccacagagctcaagtacagctggaaaacctggggaaaggcgaagatgctgtctacggaacctcataaccagaccttcctgatcgacggccccgagacagccgaatgccctaataccaaccgcgcttggaactccctcgaggtggaggattatgggtttggagtcttcacaaccaacatttggctgaaacttaaggaacggcaggacgtgttttgtgacagcaaactgatgtctgccgctatcaaggataatagagccgtgcacgcggacatgggctactggattgagtccgccctcaacgatacatggaaaatcgaaaaggctagcttcattgaggtcaagtcttgccattggcccaaaagccacaccctgtggtccaacggcgttctggagagcgaaatgatcatcccgaagaatttcgccgggcctgtgtctcagcacaactatcgccccggataccatacgcaaacagctggcccctggcaccttgggaaactcgagatggactttgatttctgtgaaggaaccaccgtggtcgtgacagaggactgcggcaatcgggggccttccctgagaaccacgacagccagcggaaagctgattaccgaatggtgctgtcggtcctgcacactcccgcccctgcgctacagaggcgaggatggctgttggtatgggatggagatccggcctcttaaagaaaaggaggaaaacctggttaattctctcgtgaccgccggacatggccagattgacaactttagcctgggggtcctgggaatggctcttttcctcgaggaaatgctgagaacacgcgtgggcaccaagcacgcgctgctcctggttgccgtgtcctttatgacgcttatcaccgggaatatgtctttccgggatctgggaagagtcatggtgatggttggcgctgccatgacagacgatattggcatgggggtgacctacctcgccctgctggctgcctttaaagtccgccccacattcgcggctggacttctgctcagaaagctgaccagcaaagagctcatgatgacgacaatcggcattgtgctgctttcccagtctaccatccctgagacaatcctggaactcaccgacgccctggccctggggatgatgattcttaagatcgtgcggaacatggagaaatatcaactggctgtcaccattatggccatcctctgcgttcccaatgcggtgattctgcagaacgcttggaaggtgagctgtacaatcctcgccgtcgtgtccgttagccctctgcttctgacgtcttcccgccagaaggccgattggatccccctcgctctgaccattaaaggactgaatccgacagccatctttcttaccacactgagcagaaccaacaagaaacggtcttggcctctcaatgaagctattatggccgtgggcatggtctccatcctggcgagctctctcctgaagaacgacattcccatgacggggcctcttgtggccggaggcctgctgacagtttgctacgtgctcaccggccgctccgctgacctggagcttgaaagagccgctgatgtccggtgggaggaccaggccgagatcagcgggtccagccccatcctgtctattaccatcagcgaagatggatccatgtctattaaaaatgaggaagaggagcaaacactcaccatcctgattcgcacaggcctcctggtgatcagcgggcttttcccggtctccattcctatcacggccgctgcgtggtatctgtgggaagtgaagaaacagagagccggagttctgtgggacgtgccctctcctccgcccgtcggcaaggctgagctcgaagatggggcctaccggatcaagcagaaaggcattctgggctatagccagatcggcgccggggtgtacaaggagggaacctttcatacaatgtggcacgttacccgcggcgctgtgcttatgcacaaagggaagagaattgaaccttcctgggccgacgtccggaaagatctgatctcttacggaggcgggtggaagctcgagggagagtggaaggaaggcgaggaagtgcaagtgctggcgctcgagccgggcaaaaaccccagagctgttcagacaaagcctgggctgttcaaaaccaacacgggaaccattggcgccgtcagccttgacttttcccccgggacaagcggatctcctatcgtggataagaaaggcaaggtggtcgggctgtatggaaatggcgtggttacccgctccggcacatacgtgagcgccatcgctcaggccgaaaagtctattgaggacaaccccgagatcgaagatgacattttccggaaaagacgcctgaccatcatggatctccatcctggggcgggaaagacaaaacggtatctgccggctattgtcagagaggccatcaagcgcggccttcggacgctgatcctcgcccccaccagagtggttgctgccgaaatggaggaagctctgcgcgggctccctattcggtaccagacacccgccatcagagcggagcacaccggacgggagattgtggacctgatgtgtcatgccaccttcacaatgcgccttctgtcccctgtcagagtgcccaattataacctgatcattatggacgaagctcactttacggatccggccagcatcgctgcccggggctacatttccacccgcgttgagatgggggaagccgctggcatcttcatgacagcgacccctcccggatctagagacccctttcctcaaagcaatgcccccatcatggatgaggagcgggaaattcctgagagatcctggaacagcggccatgaatgggtgacagacttcaaagggaagaccgtctggtttgtgccgtctatcaaggctggaaatgatattgccgcctgcctccgcaaaaacggcaagaaagtgatccagctgtcccggaagacgttcgacagcgagtatattaaaacaagaaccaatgattgggactttgtcgttaccacagatatctctgaaatgggggctaacttcaaggccgagcgcgtgatcgacccccggagatgtatgaagcctgtgattcttaccgatggagaggaacgcgtcatcctggcgggccccatgcctgtgacacacagctccgctgcccagcggagagggcgcattggcagaaatcccaaaaacgagaatgaccaatacatctacatgggagaaccgctcgagaacgacgaagattgcgcccactggaaggaggctaaaatgctgctggacaatattaacacccctgagggcatcatcccctctatgtttgaacctgagcgggaaaaggttgatgccattgacggggagtatcgcctcagaggagaagcgcggaaaacgttcgtggatcttatgcgcagaggcgacctgcccgtctggctggcctaccgggtggctgccgaggggatcaactatgctgatagacgctggtgttttgacggagttaagaataaccagattctcgaggaaaatgtggaggtcgaaatctggacaaaagagggcgagcggaagaagctgaaacctagatggcttgatgcccgcatttacagcgaccccctggctctcaaggagttcaaagagttcgccgcggggcggaagtccctgaccctgaacctcatcacagaaatgggcagacttccgacctttatgacgcagaaagcccggaatgctctggataacctggccgtgctccataccgctgaggccggaggccgcgcctataatcacgctctgtctgaacttcctgagacactggagaccctcctgctgctcacacttctggcgaccgtcacagggggaattttcctgtttctcatgagcggcaaggggatcggaaagatgaccctgggcatgtgctgcatcattacggcctccatccttctgtggtacgctcagattcaaccccattggatcgccgccagcattatcctcgagttctttctgatcgtgctgctcattcccgagcctgaaaaacagagaacaccgcaggacaaccagcttacctatgttgtgatcgctattctgaccgtggtcgccgcgacaatggccaatgagatgggcttcctggaaaagaccaaaaaggattttgggctcggatctatcgctacacaacagcccgagtccaacattctggacatcgaccttcggcctgccagcgcttggacgctgtacgccgttgcgaccacattcatcacccccatgctccgccactccattgaaaattctagcgtgaacgtgtccctgacagccatcgctaatcaggccaccgtcctgatgggcctcgggaaaggatggcctctttctaagatggatattggcgtgcccctgctggctatcgggtgttacagccaggttaaccctattacgctcaccgccgctctgcttctgctcgtggcccactatgcgatcattggaccgggcctgcaagccaaggctacaagagaagcccagaaacgggctgccgccggcatcatgaagaatcccaccgtcgacgggatcacagtgattgatctggaccctatcccctacgatcctaaatttgagaagcagctcggacaggtcatgcttctggtgctgtgcgttacccaagtgctcatgatgcgcacgacatgggcgctgtgtgaagctcttaccctggccacaggccccatttccaccctctgggaggggaacccgggaagattctggaataccacaatcgctgtcagcatggccaacatttttcggggctcttatctggccggggctggactgctgttctccatcatgaaaaacacgaccaatacacgcagaggcaccggcaacacaggggaaacccttggagagaagtggaagaatcggctgaacgccctgggcaaaagcgagtttcagatctacaagaaatctgggattcaggaagtggacagaacgctcgcgaaggagggaatcaaacgcggcgaaacagatcatcacgccgtttcccgggggagcgctaagctgagatggttcgtggagcgcaatcttgtcacccctgagggaaaagtggtggacctgggctgcggcagagggggatggtcttattactgtggcgggctcaagaacgttcgggaagtcaagggactgaccaaaggcgggcccggacatgaggaacccattcctatgagcacatatggctggaatctggtgcgcctccaatccggcgtggatgtcttctttacaccccctgagaagtgcgacacacttctgtgtgatatcggggaatctagcccgaaccccacggttgaggccggacggaccctgagagtgctcaatctggtggagaactggcttaataacaatacacagttctgcattaaagtcctgaacccttacatgccctccgtgatcgaaaagatggaggctctccagcgcaaatacggcggggccctggttcggaatcctctgagcagaaactccacccacgaaatgtattgggtgtctaacgcgagcggaaatatcgtctcctctgtgaacatgattagccgcatgctcatcaatcggtttacaatgagacataagaaggccacctacgagcccgacgttgatcttggctccgggacgcgcaacattggaatcgaatctgagaccccgaatctggacattatcggcaaaagaatcgagaagattaaacaggaacacgagacaagctggcactatgaccaagatcatccttacaagacctgggcttatcacggctcctacgaaacaaaacagaccgggagcgcctcttccatggtgaacggagtcgtgcggctgctcacaaagccctgggacgtgatccctatggtcacccagatggctatgacggatacaacccccttcggccagcaacgcgtttttaaggagaaagtggacaccagaacacaggaacctaaggaggggacgaaaaagctgatgaaaattaccgccgagtggctttggaaggaactgggaaagaaaaagacaccccggatgtgtaccagagaggagttcacacggaaagtgcgcagcaatgctgccctcggcgcgatctttaccgatgagaacaagtggaaatctgccagagaggctgtcgaagactcccggttctgggagctggtggataaggaacgcaatctgcatctcgaggggaaatgcgaaacatgtgtttataacatgatgggaaagagagagaagaaactgggcgagtttggcaaggccaaagggagccgggctatttggtacatgtggcttggagcccgcttcctggaatttgaggccctcggcttcctgaatgaagaccactggttttctagagagaactcccttagcggggtggaaggagagggcctgcacaagctcgggtacatcctgcgggatgtctccaaaaaggagggcggagcgatgtatgctgacgataccgccggctgggacacgcgcattaccctggaagacctcaagaatgaggaaatggtgacaaaccatatggagggggaacacaaaaagctggccgaggctatcttcaaacttacctaccagaataaggttgtgagagtccagcggccgacacctcgcggaaccgtgatggatatcattagcagacgggaccaacgcggctctgggcaggttggaacgtatggcctgaacacattcaccaacatgggggcccagctcatcagacaaatggagggcgaaggagtgtttaaaagcattcagcatctgacagctaccgaggaaatcgccgtccaggattggcttgcgcgggtgggcagagagcgcctgtcccggatggccatttctggggacgattgcgtcgtgaagcccctcgacgatagattcgctagcgccctgacggctctgaatgacatgggaaaggttcgcaaagatatccagcaatgggagccctcccggggctggaacgactggacccaggtgcctttttgctctcaccatttccacgaactcatcatgaaggatgggagagtcctggtggtgccgtgtcgcaatcaggacgagcttattggacgggccagaatcagccagggcgcggggtggtccctgcgcgaaacagcctgcctcggcaaatcttacgctcaaatgtggagcctgatgtattttcaccggagagatcttcgcctggccgctaacgccatttgttccgctgttcccagccattgggtgcctacctctcggacaacctggtccatccacgccaagcatgagtggatgacaaccgaagacatgctcacggtctggaatagagtgtggattcaggagaacccctggatggaggacaaaacacctgttgaaagctgggaggaaatcccctacctgggaaagcgggaggatcagtggtgcggctctctgatcgggctcacctccagagcgacctgggccaagaatattcagacagctatcaaccaagtgcgcagcctgattggaaatgaagagtataccgactacatgccttccatgaaacggttcagacgcgaggaagaggaagccggcgtcctttggtga

SEQ ID NO: 19543 - RNA, 9876 nt, synthetic construct
  misc_feature 1..9876: note = derived and/or modified CDS sequence (opt5) from DENV-2__JX669477__SS-prME
  source 1..9876: mol_type = other RNA
accgccggagtgatcgtcatgctgattcccacagctatggccttccacctcacgacccggaatggggagcctcatatgatcgttggacggcaggaaaagggcaagagcctgctttttaagacagaggacggggtgaatatgtgcaccctgatggcgattgatctcggagaactgtgtgaggacacaatcacctacaaatgcccgcttctgcgccaaaatgaacccgaggatattgactgttggtgcaattccacatctacctgggtgacgtatggcacctgtacaaccacaggggagcaccggcgggaaaagcgcagcgtcgctctcgtgcctcatgttggaatgggcctggagaccagaacggaaacatggatgtcctctgagggcgcctggaaacacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaagaacaggacaaacgctttatctgcaagcattccatggtggatagaggctggggcaacgggtgtggactgttcggcaaagggggaattgtcacatgcgccatgtttacgtgcaaaaagaatatggaaggcaaaatcgttcagcctgagaacctcgaatacaccattgtgatcacaccccacagcggggaggagcatgcggtgggaaatgacaccggcaagcacggcaaagaaatcaagattacacctcagtcttccaccacggaggccgaactgaccgggtatggaacagtcaccatggagtgtagcccccggacaggccttgatttcaacgaaatggtgctgctccaaatggaggacaaggcttggctggttcaccgccagtggtttcttgatctgccgctcccttggctgcccggggccgacacccagggatctaattggatccagaaggagacgctggtgacattcaagaaccctcatgctaaaaagcaagacgtcgtggttctcggctcccaggaaggggccatgcacaccgccctgacaggcgctaccgagattcagatgagctccggaaatcttctgtttaccggccatctcaaatgcagactgcggatggataaacttcaactgaaagggatgtcttacagcatgtgtacaggaaagttcaagatcgtgaaagaaattgcggagacgcagcacggcaccatcgtcatcagagtgcagtatgagggggacggatccccctgcaagattcccttcgaaatcacagatctcgagaaacgccatgtcctgggccggctgattaccgtgaaccctatcgttacagaaaaggacagcccggtgaacattgaggccgaacccccttttggggattcttacatcattgtcggcgtggagcccggacagctcaaactgaattggttcaagaagggctccagcatcgggcaaatgtttgagaccacgatgagaggagctaaacgcatggccatccttggcgacacagcctgggatttcgggtctctgggaggcgtttttaccagcattgggaaggctctccaccaggtgttcggcgccatctacggagcggctttttccggcgtctcttggaccatgaaaattctgatcggggtgattatcacatggatcggaatgaacagccggtccaccagcctgtctgtgtcccttgttctcgtcggcgtggtgacactgtatctgggggccatggtccaggccgacagcggatgtattgtgtcttggaagaataaagaactcaagtgcggctccgggatcttcattacggataacgttcacacctggacagagcagtacaagtttcaacctgaaagcccctccaaactggcttctgccatccagaaggctcatgaggaaggcatttgtggaatcagaagcgtgacccgccttgagaatctgatgtggaaacagatcacaccggagctcaaccacattctgtccgaaaatgaggtcaagctgaccatcatgacgggcgacattaaagggatcatgcaggccggaaagcggtctcttagacctcaacccaccgaactcaaatatagctggaagacatggggcaaggcgaaaatgctgtccaccgagagccataaccagacattcctgattgatgggcctgaaaccgccgagtgccccaatacaaaccgcgcttggaactctctcgaggtggaagactacggatttggcgttttcaccacgaacatctggctgaaacttcgggagaaacaggacgtgttttgtgattccaagctgatgagcgccgctatcaaagacaatagagccgtccacgcggatatgggctattggattgaatctgccctcaacgacacatggaagatggagaaggcttccttcatcgaggtgaaaagctgccactggcctaagtctcataccctgtggagcaatggggttctggaatccgagatgattatccccaaaaacttcgccggaccggtgagccagcacaactaccgccctggctatcatacccaaacagctgggccctggcaccttggaaagctcgaaatggattttgacttctgtgagggcaccacggtcgtggtgacagaagattgcgggaatcggggaccctctctgagaaccacaaccgcctccggcaaactgattacagagtggtgctgtcggagctgcaccctccctccgctgcgctacagaggcgaggacgggtgttggtacggaatggaaatccggccccttaaggagaaggaagagaacctggtcaattccctcgttacggccggccatgggcagattgataacttttctctgggagtgctgggcatggctcttttcctcgaagagatgctgagaacccgcgtggggacaaaacacgcgatcctgctcgtcgccctgagctttgtgacccttatcacaggaaatatgtccttccgggacctgggcagagttatggtgatggtcggcgctaccatgacggatgacattgggatgggagtgacatatctcgccctgctggccgcttttaaggttcgccctaccttcgccgcgggccttctgctcagaaaactgacatctaaggagctcatgatggctaccatcgggattgccctgcttagccagtccaccctgcccgaaacaatcctcgagctgacggatgccctggctcttggaatgatggccctgaaaattgtgcggaacatggaaaagtaccaactcgcggtcaccatcatggctatctcttgcgtgcctaatacagttattctgcagaacgcctggaaggtgagctgtaccatcctcgccgctgtctccgtgagccccctgcttctgacatcttcccagcagaaagccgactggattcctctcgctctgaccatcaagggcctgaatcccacggccatttttcttacaaccctgagccgcacctctaaaaagagatcctggccgctcaacgaggcgatcatggccgtggggatggtcagcatcctggcttcttccctcctgaaaaatgacattcctatgacaggaccccttgttgccggcggcctgctgaccgtgtgctatgtgctcacagggcggagcgctgatctggaacttgagcgcgccgccgacgtcaagtgggaggatcaagctgaaatctccggaagctctcctattctgagcatcacgatttccgaggacggctctatgagcatcaaaaacgaagaggaggaacagaccctcacaattctgatcagaaccgggctcctggtgatctccggagttttccccgtgtctattccgatcacagcggccgcttggtacctttgggaggtcaagaagcagcgggccggcgtgctgtgggatgttccttctccccctcccgtggggaaagccgaactggaggacggagcttatcgcattaagcagagaggcatcctcggctactcccaaattggggccggagtctataaagaaggcacctttcacacgatgtggcatgtgaccagaggggcggtcctgatgcaccgcggaaagagaatcgagccctcctgggctgatgtgaaaaaggaccttatcagctacggcgggggatggaagctggagggcgaatggaaagagggcgaagaggttcaggtgctcgccctggaacctgggaagaatccgcgggccgtccagacaaaacccggaattttcaagaccaacacaggcaccatcggggctgtgtccctcgattttagccctggaacatctggctcccccattgttgacagaaaagggaaggtggtcggactgtacggcaatggcgtggtgacgcgcagcggggcctatgtttctgcgatcgctcagaccgagaagtccattgaggataaccctgaaatcgaggacgatatcttccggaaaaagagacttacaattatggacctgcatcccggagccggcaaaaccaagcgctacctgcctgccatcgtccgggaagctattaaaagagggctccgcaccctgatccttgccccgacacgggtggtggctgccgagatggaagaggcgctgagaggactccccattcgctatcaaacgcctgccatccgggctgagcacaccggcagagaaattgtcgacctgatgtgtcatgccacattcaccatgcggctcctgagccccgtgcgcgttcctaactacaatcttatcatcatggatgaggctcactttacagaccccgcctccattgccgctagagggtatatctctacccgggtggaaatgggcgaggcggccggaattttcatgacggctacaccgcctggcagccgcgatccctttccccagtccaacgcccctatcatggacgaggaaagagagattcccgaacggagctggaactctgggcacgagtgggtcaccgatttcaagggaaagaccgtgtggtttgttccttccatcaaagccggcaacgacatcgctgcctgcctgagaaagaatgggaaaaaggtgattcagctgagccgcaaaacattcgattctgaatacgtcaagacccgggcgaacgactgggattttgtggttacaaccgacatcagcgagatgggagctaatttcaaggccgagagagtgattgatccgcgccggtgtatgaaacccgtcatcctcacggacggcgaagagagagtgattctggccgggcctatgcccgtgacacattcctctgctgcccaacgccggggcagaatcggacgcaaccctaagaatgaaaacgaccagtatatctacatgggcgagccccttgaaaatgatgaggactgcgcgcactggaaagaggccaagatgctgctcgataacattaataccccggaagggatcattcctagcatgtttgagcccgaaagagagaaagtcgacgctatcgatggagaataccggctgcgcggcgaggccagaaagacattcgttgacctgatgcggcgcggggatctccctgtgtggcttgcttataaagtggccgctgagggaattaactacgccgacagaaagtggtgttttgatggcatcaagaataaccagattctggaagagaacgtcgaagtggagatctggaccaaagagggggaacggaagaaactgaagcccagatggctcgacgcgcgcatctattccgatcctctggcccttaaagagttcaaggagttcgctgccggccggaagtctctgacgctcaatctgattaccgagatgggaagactgcccacatttatgacccagaaagctcgcaacgccctcgacaatcttgccgttctgcatacagctgaagtgggcgggaaggcgcacacccacgccctgagcgagctcccggagacactggaaacccttctgctcctgacgctgctcgctgccgtcacaggaggcatcttcctttttctgatgtccgggaaaggaattggcaagatgaccctgggcatgtgctgcatcattaccgccagcatcctcctgtggtacgctcaaatccagcctcattggattgccgcgtctatcattcttgagttctttctgatcgtgctcctgattcccgaacccgagaaacagcggacacctcaggataaccaactgacctatgttgtgatcgccatcctcacagtcgtggctgccacgatggctaatgaaatggggttccttgagaagaccaagaaagacctgggatttggctccattacaacccaggagagcgaatccaacatcctggacattgatctcagaccggcctctgcgtggacactgtacgccgtcgctaccacgttcgtgacccccatgcttcggcacagcatcgaaaatagctctgttaacgtgagcctgacagccattgctaatcaggccaccgtgctcatggggctgggaaagggctggcctctgtccaaaatggacatcggggtccccctccttgctattggatgttatagccaggttaaccctatcacactgaccgccgcgctgctcctgcttgtggcccattacgctatcattggccccggcctgcaagccaaggctacgcgcgaagcccagaaaagagccgcggctgggatcatgaagaatcctacagtggatggaattaccgtcatcgacctcgagccgattccctacgatcctaagtttgaaaaacagctgggccaggtgatgctgctcatcctttgcgttacacaagtgctgatgatgcggaccacctgggccctgtgtgaggctctcacactggccacggggcccatctctaccctttgggagggaaaccctggccgcttctggaatacaaccattgccgtctccatggctaacatctttagagggagctatctggccggagcgggcctcctgttctctattatgaagaatacaaccaacacgcggcgcggcacagggaatgtgggagaaaccctgggcgagaaatggaagtccagactcaacgcccttgggaaaagcgaatttcagatctacaagaaatctggcattcaggaggtcgaccggaccctggctaaggagggcatcaagcgcggggaaacagatcaccatgccgtgagcagaggatccgctaaactgcggtggttcgttgagagaaacatggtgacccccgaaggcaaggtcgtggacctcggctgcgggcgcggaggctggtcttattactgtgggggactgaaaaatgttcgggaggtgaagggccttacaaaagggggaccgggccacgaggaacctatccccatgagcacgtatggctggaacctggtcagactccaatccggggtggatgtgttctttacaccccctgagaagtgcgacaccctgctgtgtgatattggagaaagctcccccaatcctaccatcgaggccggccgcacactccgggttcttaacctggtcgaaaattggctgaacaataacacccagttctgcattaaggtgctcaatccgtacatgccctctgtgatcgagaaaatggaaacgctgcagagaaagtatgggggagcgcttgtccgcaaccctctgagcagaaattccacccacgagatgtactgggtttctaacgccacaggcaatattgtgagctccgtgaacatgatctctagaatgctcatcaatcgctttaccatgaaacataagaaagctacatacgagcccgacgtcgatctggggagcggaacccggaacattggcatcgaatccgagattcctaacctggacatcattggcaagagaatcgaaaagattaaacaggagcacgaaacaagctggcattatgaccaagatcacccctacaagacctgggcctatcacgggtcttacgagacgaaacagacaggatccgctagctctatggtgaatggcgttgtgcgcctccttaccaagccgtgggacgtcgtgcctatggttacccagatggccatgacagatacgacccccttcgggcagcaacgggtgtttaaagagaaggtcgacacaagaacccaggaacctaaggagggaaccaagaagctgatgaaaatcaccgctgaatggctgtggaaggagctcggcaaagagaagacaccccgcatgtgtaccagagaagagttcacgcggaaagtgcgctccaacgccgcgctgggggccgtgtttaccgatgaaaataagtggaaaagcgctagagaggccgtcgaagacggacggttctgggagcttgttgatagagagcggaacctgcatctcgaaggcaaatgcgagacatgtgtgtataatatgatgggcaagcgcgagaagaagctgggggagtttggaaaagctaagggctctagagccatctggtacatgtggctgggggcccggttcctcgaatttgaggcgctgggattccttaacgaggaccactggttttcccgcgaaaatagcctgtccggcgtggagggggaaggcctccatagactgggatatattcttcgggatgtcagcaagaaagagggcggggctatgtacgccgacgataccgccggatgggacacacgcatcaccctggaagacctcaagaacgaggagatggtgacgaatcacatgaaaggcgaacataagaaactggctgaggccattttcaagctgacataccagaacaaggttgtgagagtccagcggcctacaccccgcgggacagtgatggatatcatttctagaaaagaccaacggggaagcggccaggttgggacctatggcctcaatacgttcaccaacatggaagctcagctgatccgccaaatggagggagagggcatctttagatccattcagcaccttacagccaccgaagagatcgcggtgcagaattggctggcccgggtcgggcgcgaaagactctctcggatggctattagcggagatgactgcgtggttaagccgatcgatgacagattcgcctccgctctgacagcccttaacgatatgggcaaagtgcgcaaggacattcagcaatgggagccttctcgggggtggaatgattggacccaggtccccttttgcagccaccatttccacgaactggtgatgaaagacggaagagtcctcgtggttccctgtcgcaaccaggatgagctgatcggccgggcgagaatctcccagggggccggctggtctctgaaggagacagcttgcctcggaaagagctacgcccaaatgtggaccctgatgtattttcatcgccgggaccttagactggctgccaacgctatttgttccgccgtgcctagccactgggtcccgacgtctcgcacaacctggtccatccacgcgaaacatgaatggatgaccacagaggatatgctcgccgtgtggaatcgggtgtggattcaggaaaacccctggatggaggacaagacccctgttgaaagctgggaggaggtgccctacctgggcaaaagagaagaccagtggtgcgggtctcttatcggactgacatcccgcgctacgtgggccaagaatattcagaccgccatcaaccaagtccggagcctcattggcaatgaggggtatacagattacatgccttccatgaaaagattccggagagaagaggaagaggctggagtgctgtggtga

SEQ ID NO: 19544 - RNA, 9876 nt, synthetic construct
  misc_feature 1..9876: note = derived and/or modified CDS sequence (opt5) from DENV-2__JX669478__SS-prME
  source 1..9876: mol_type = other RNA
accgccggagtgatcgtcatgctgattcccacagctatggccttccacctcacgacccggaatggggagcctcatatgatcgttggacggcaggaaaagggcaagagcctgctttttaagacagaggacggggtgaatatgtgcaccctgatggcgattgatctcggagaactgtgtgaggacacaatcacctacaagtgcccgcttctgcgccaaaatgaacccgaggatattgactgttggtgcaattccacatctacctgggtgacgtatggcacctgtacaaccacaggggagcaccggcgggaaaagcgcagcgtcgctctcgtgcctcatgttggaatgggcctggagaccagaacggaaacatggatgtcctctgagggcgcctggaagcacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaagaccgaggctaagcagcctgccacgctgagaaaatattgcattgaagctaagctcacaaacaccaccacagagagccggtgtccgacccaaggagagccctctctgaatgaagaacaggacaaacgctttatctgcaagcattccatggtggatagaggctggggcaacgggtgtggactgttcggcaaagggggaattgtcacatgcgccatgtttacgtgcaaaaagaatatggaaggcaaaatcgttcagcctgagaacctcgaatacaccattgtgatcacaccccacagcggggaggagcatgcggtgggaaatgacaccggcaagcacggcaaagaaatcaagattacacctcagtcttccaccacggaggccgaactgaccgggtatggaacagtcaccatggagtgtagcccccggacaggccttgatttcaacgaaatggtgctgctccaaatggaggacaaggcttggctggttcaccgccagtggtttcttgatctgccgctcccttggctgcccggggccgacacccagggatctaattggatccagaaggagacgctggtgacattcaagaaccctcatgctaaaaagcaagacgtcgtggttctcggctcccaggaaggggccatgcacaccgccctgacaggcgctaccgagattcagatgagctccggaaatcttctgtttaccggccatctcaaatgcagactgcggatggataaacttcaactgaaagggatgtcttacagcatgtgtacaggaaagttcaagatcgtgaaagaaattgcggagacgcagcacggcaccatcgtcatcagagtgcagtatgagggggacggatccccctgcaagattcccttcgaaatcacagatctcgagaaacgccatgtcctgggccggctgattaccgtgaaccctatcgttacagaaaaggacagcccggtgaacattgaggccgaacccccttttggggattcttacatcattgtcggcgtggagcccggacagctcaaactgaattggttcaagaagggctccagcatcgggcaaatgtttgagaccacgatgagaggagctaaacgcatggccatccttggcgacacagcctgggatttcgggtctctgggaggcgtttttaccagcattgggaaggctctccaccaggtgttcggcgccatctacggagcggctttttccggcgtctcttggaccatgaaaattctgatcggggtgattatcacatggatcggaatgaacagccggtccaccagcctgtctgtgtcccttgttctcgtcggcgtggtgacactgtatctgggggccatggtccaggccgacagcggatgtattgtgtcttggaagaataaagaactcaagtgcggctccgggatcttcattacggataacgttcacacctggacagagcagtacaagtttcaacctgaaagcccctccaaactggcttctgccatccagaaggctcatgaggaaggcatttgtggaatcagaagcgtgacccgccttgagaatctgatgtggaaacagatcacaccggagctcaaccacattctgtccgaaaatgaggtcaagctgaccatcatgacgggcgacattaaagggatcatgcaggccggaaagcggtctcttagacctcaacccaccgaactcaaatatagctggaagacatggggcaaggcgaaaatgctgtccaccgagagccataaccagacattcctgattgatgggcctgaaaccgccgagtgccccaatacaaaccgcgcttggaactctctcgaggtggaagactacggatttggcgttttcaccacgaacatctggctgaaacttcgggagaaacaggacgtgttttgtgattccaagctgatgagcgccgctatcaaagacaatagagccgtccacgcggatatgggctattggattgaatctgccctcaacgacacatggaagatggagaaggcttccttcatcgaggtgaaaagctgccactggcctaagtctcataccctgtggagcaatggggttctggaatccgagatgattatccccaaaaacttcgccggaccggtgagccagcacaactaccgccctggctatcatacccaaacagctgggccctggcaccttggaaagctcgaaatggattttgacttctgtgagggcaccacggtcgtggtgacagaagattgcgggaatcggggaccctctctgagaaccacaaccgcctccggcaaactgattacagagtggtgctgtcggagctgcaccctccctccgctgcgctacagaggcgaggacgggtgttggtacggaatggaaatccggccccttaaggagaaggaagagaacctggtcaattccctcgttacggccggccatgggcagattgataacttttctctgggagtgctgggcatggctcttttcctcgaagagatgctgagaacccgcgtggggacaaaacacgcgatcctgctcgtcgccctgagctttgtgacccttatcacaggaaatatgtccttccgggacctgggcagagttatggtgatggtcggcgctaccatgacggatgacattgggatgggagtgacatatctcgccctgctggccgcttttaaggttcgccctaccttcgccgcgggccttctgctcagaaaactgacatctaaggagctcatgatggctaccatcgggattgccctgcttagccagtccaccctgcccgaaacaatcctcgagctgacggatgccctggctcttggaatgatggccctgaaaattgtgcggaacatggaaaagtaccaactcgcggtcaccatcatggctatctcttgcgtgcctaatgccgttattctgcagaacgcctggaaggtgagctgtacaatcctcgctgccgtctccgtgagccccctgcttctgacctcttcccagcagaaagctgactggattcctctcgccctgacaatcaagggcctgaatcccaccgcgatttttcttacgacactgagccgcacctctaaaaagagatcctggccgctcaacgaggccatcatggctgtggggatggtcagcatcctggcctcttccctcctgaaaaatgacattcctatgaccggaccccttgttgctggcggcctgctgacagtgtgctatgtgctcaccgggcggagcgccgatctggaacttgagcgcgccgctgacgtcaagtgggaggatcaagcggaaatctccggaagctctcctattctgagcatcacaatttccgaggacggctctatgagcatcaaaaacgaagaggaggaacagacgctcaccattctgatcagaacagggctcctggtgatctccggagttttccccgtgtctattccgatcaccgccgctgcctggtacctttgggaggtcaagaagcagcgggccggcgtgctgtgggatgttccttctccccctcccgtggggaaagctgaactggaggacggagcctatcgcattaagcagagaggcatctttggctactcccaaattggggcgggagtctataaagaaggcacattccacaccatgtggcatgtgacgagaggggctgtcctcatgcaccgcggaaagagaatcgagccctcctgggccgatgtgaaaaaggacctgatcagctacggcgggggatggaaacttgagggcgaatggaaagagggcgaagaggttcaggtgctggccctcgaacctgggaagaatccgcgggctgtccagaccaaacccggaatttttaagacaaacaccggcacaatcggggccgtgtccctggatttcagccctggaacctctggctcccccattgttgacagaaaagggaaggtggtcggactctacggcaatggcgtggtgacacgcagcggggcgtatgtttctgctatcgcccagacggagaagtccattgaggataaccctgaaatcgaggacgatatcttccggaaaaagagactgaccattatggaccttcatcccggagccggcaaaacaaagcgctacctgcctgctatcgtccgggaagccattaaaagagggctgcgcaccctcatcctggctccgacccgggtggtggccgcggagatggaagaggcccttagaggactgcccattcgctatcaaacccctgctatccgggccgagcacacgggcagagaaattgtcgacctcatgtgtcatgctacctttacaatgcggctgctcagccccgtgcgcgttcctaactacaatctgatcatcatggatgaggcccacttcaccgaccccgcctccattgctgcgagagggtatatctctacacgggtggaaatgggcgaggccgctggaatttttatgaccgccacgccgcctggcagccgcgatcccttcccccagtccaacgcccctatcatggacgaggaaagagagattcccgaacggagctggaactctgggcacgagtgggtcacagattttaagggaaagaccgtgtggttcgttccttccatcaaagctggcaacgacatcgccgcgtgccttagaaagaatgggaaaaaggtgattcagctgagccgcaaaacctttgattctgaatacgtcaagacacgggctaacgactgggatttcgtggttaccacagacatcagcgagatgggagccaattttaaggccgagagagtgattgatccgcgccggtgtatgaaacccgtcatcctgaccgacggcgaagagagagtgattctcgctgggcctatgcccgtgacgcattcctctgccgcgcaacgccggggcagaatcggacgcaaccctaagaatgaaaacgaccagtatatctacatgggcgagcccctggaaaatgatgaggactgcgcccactggaaagaggctaagatgcttctggataacattaatacaccggaagggatcattcctagcatgttcgagcccgaaagagagaaagtcgacgccatcgatggagaataccggctccgcggcgaggctagaaagacctttgttgacctgatgcggcgcggggatctgcctgtgtggctcgcctataaagtggctgccgagggaattaactacgcggacagaaagtggtgtttcgatggcatcaagaataaccagattcttgaagagaacgtcgaagtggagatctggacaaaagagggggaacggaagaaactgaagcccagatggctggacgcccgcatctattccgatcctctcgctctgaaagagttcaaggaatttgccgctggccggaagtctcttaccctgaatctcattacggagatgggaagactgcccaccttcatgacacagaaagcccgcaacgccctggacaatctcgctgttcttcataccgcggaagtgggcgggaaggcctacacacacgctctgagcgagctgccggagaccctcgaaacactgcttctgctcaccctgctggccgccgtcacgggaggcatctttctcttccttatgtccgggaaaggaattggcaagatgacactgggcatgtgctgcatcattaccgctagcatcctgctctggtatgcccaaatccagcctcactggattgcggcctctatcattctggagtttttccttatcgtgctgctcattcccgaacccgagaaacagcggacccctcaggataaccaactgacatacgttgtgatcgctatcctgaccgtcgtggccgctacaatggccaatgaaatggggtttctcgagaagacgaagaaagaccttggattcggctccattaccacacaggagagcgaatccaacatcctggacattgatctgagaccggcgtctgcctggaccctctatgctgtcgccacaacctttgtgacgcccatgctgcggcatagcatcgaaaatagctctgttaacgtgagccttaccgctattgccaatcaggctacagtgctgatggggctcggaaagggctggcctctgtccaaaatggacatcggggtccccctgctcgccattggatgttacagccaggttaaccctatcacccttacagcggccctgctgctcctggtggctcactacgccatcattggccccggccttcaagctaaggccacccgcgaagcccagaaaagagcggctgccgggatcatgaagaatcctacggtggatggaattacagtcatcgacctggagccgattccctatgatcctaagttcgaaaaacagctcggccaggtgatgctgctgatcctctgcgttacccaagtgcttatgatgcggacaacctgggctctgtgtgaggccctgaccctcgccacagggcccatctctacgctgtgggagggaaaccctggccgcttttggaataccacaattgctgtctccatggccaacatcttcagagggagctaccttgcgggagccggcctgctcttttctattatgaagaataccacaaacacccggcgcggcacggggaatgtgggagaaacactgggcgagaaatggaagtccagactgaacgctctcgggaaaagcgagttccagatctataagaaatctggcattcaggaggtcgaccggacccttgccaaggagggcatcaagcgcggggaaaccgatcatcacgctgtgagcagaggatccgccaaactgcggtggttcgttgagagaaacatggtgacacccgaaggcaaggtcgtggacctgggctgcgggcgcggaggctggtcttactattgtgggggactcaaaaatgttcgggaggtgaagggcctgaccaaagggggaccgggccatgaagaacctatccccatgagcacatacggctggaaccttgtcagactgcaatccggggtggatgtgtttttcacgccccctgagaagtgcgacaccctcctgtgtgatattggagaaagctcccccaatcctacaatcgaggcgggccgcaccctgcgggttctcaaccttgtcgaaaattggctgaacaataacacacagttttgcattaaggtgctgaatccgtatatgccctctgtgatcgagaaaatggaaaccctccagagaaagtacgggggagccctggtccgcaaccctcttagcagaaattccacgcacgagatgtactgggtttctaacgctaccggcaatattgtgagctccgtgaacatgatctctagaatgctgatcaatcgcttcacaatgaaacacaagaaagccacctatgagcccgacgtcgatctcgggagcggaacacggaacattggcatcgaatccgagattcctaacctggacatcattggcaagagaatcgaaaagattaaacaggagcatgaaaccagctggcactacgaccaagatcatccctataagacatgggcttaccacgggtcttatgagaccaaacagacgggatccgccagctctatggtgaatggcgttgtgcgcctgctcacaaagccgtgggacgtcatccctatggtgacccagatggctatgaccgatacaacgccctttgggcagcaacgggttttcaaagagaaggtggacaccagaacacaggaacctaaggagggaaccaagaaacttatgaaaatcacagccgaatggctgtggaaagagctgggcaaagagaagacaccccgcatgtgtacaagagaagagtttacccggaaagtccgctccaacgcggccctcggggctgtgttcacggatgaaaataagtggaaaagcgccagagaggctgtggaagacggacggttttgggagctggtcgatagagagcggaaccttcacctggaaggcaaatgcgagacctgtgtttacaatatgatgggcaagcgcgagaagaagctcggggagttcggaaaagccaagggctctagagccatttggtatatgtggctgggggcgcggtttctggagttcgaggctctcggatttctgaacgaggaccattggttctcccgcggcaatagcctttccggggtggaaggcgagggactgcacagactcggctacatcctgcgggaagtggggaagaaagagggaggcgccatgtacgccgatgacacagctgggtgggatacccgcattacacttgaagacctgaagaacgaggagatggtcaccaatcatatgaaaggagaacacaagaaactcgccgaggctatcttcaagctgacgtatcagaacaaggtggttagagtgcagcggcctacaccccgcggcaccgtcatggacattatcagcagaaaagatcaacgggggtctggccaggtgggaacatacggcctgaatacctttacgaacatggaagcccagctcatccgccaaatggagggggagggaattttcaagagcatccagcatctgaccgcgacagaagagattgccgttcagaattggcttgctagagtgggccgggaacgcctgtccagaatggccatctctggggacgattgcgtcgtgaaaccgattgacgatcggtttgctagcgccctcaccgcgctgaacgacatgggaaaggttagaaaagatatccagcaatgggagccttcccgcggctggaatgactggacacaggtgcccttctgctctcaccactttcatgaacttgtcatgaaggatgggcgggtgctggtcgtgccctgtagaaaccaggacgagctcatcggccgcgcccggattagccagggagctggctggtccctgaaggagaccgcctgcctggggaaatcttatgctcaaatgtggacactcatgtacttccacagacgcgatctgcggcttgccgctaacgccatctgtagcgcggttccttcccattgggtgccgaccagcagaacgacatggtctattcacgccaagcacgaatggatgaccaccgaggacatgctggctgtctggaatcgcgtgtggatccaggaaaacccctggatggaggataaaacacctgtggaatcctgggaggaggttccctatctcggaaagcgggaagaccagtggtgcggcagcctgattgggcttacctctagagccacatgggccaaaaatatccagacggctattaaccaagtgcgctccctgatcggaaatgagggctacatcgactatatgcctagcatgaagcggtttagacgggaagaggaagaggccggggtcctctggtga

SEQ ID NO: 19545 - RNA, 9876 nt, synthetic construct
  misc_feature 1..9876: note = derived and/or modified CDS sequence (opt5) from DENV-2__JX669480__SS-prME
  source 1..9876: mol_type = other RNA
accgcgggagtgatcattatgctgatccccaccgctatggccttccacctcacgacccggaatggggagcctcatatgattgtgggacggcaggaaaagggcaagagcctgctttttaagaccgaggacggggttaatatgtgcaccctgatggcgatcgatctcggagaactgtgtgaggacacaattacctacaagtgcccgcttctgcgccaaaatgaacccgaggatatcgactgttggtgcaattccacatctacctgggtgacgtatggcacctgtacaaccacaggggagcacagacgggaaaagcgcagcgtggctctcgtccctcatgtgggaatgggcctggagaccagaacggaaacatggatgtcctctgagggcgcctggaagcacgttcagcggatcgagacctggattctgcgccatcccgggttcgccatcatggctgccattctcgcttacacaatcggaaccacccactttcagagagccctgattttcatccttctgacagcggtggcccctagcatgacgatgcggtgcattggcatctccaaccgcgattttgtcgaaggggtgtctggaggcagctgggttgacatcgtgctcgagcacgggtcctgtgtcaccacaatggctaagaataagcccaccctggatttcgaacttattaaaacagaggccaagcagcctgctaccctgagaaaatattgcatcgaagccaagctcacgaacacaaccaccgagagccggtgtccgacacaaggagagccctctctgaatgaagaacaggacaaacgctttatttgcaagcattccatggtggatagaggctggggcaacgggtgtggactgttcggcaaaggcgggatcgtgacctgcgcgatgtttacatgcaaaaagaatatggaagggaaagtcgttctccctgagaacctggaatacacgattgtgatcacaccccacagcggggaggagcatgccgtgggaaatgacacaggcaagcacggcgaagagatcaaaattacccctcagtcttccatcacagaagctgagcttaccgggtatggaacggtcaccatggaatgtagcccccggacaggcctggatttcaacgagatggtgctcctgcagatggaggaaaaggcctggcttgttcaccgccaatggtttctggacctcccgctgccttggctgcccggggctgatacccagggatctaattggattcagaaagagacactcgtgaccttcaagaaccctcatgccaagaaacaggacgtcgtggttctgggctcccaagaaggggccatgcacacggctcttacaggcgcgaccgagatccagatgagctccggaaatctgctctttacaggccatctgaagtgcagacttcggatggacaaactgcagctcaaggggatgtcttacagcatgtgtaccggaaaattcaagattgtgaaggagatcgccgaaacccaacacggcacaatcgtcattagagtgcagtatgagggggatggatccccctgcaaaatccccttcgaaattatggacctggagaagcgccatgtcctgggccggctcatcacggtgaaccctattgttaccgaaaaagatagcccggtgaacatcgaggctgagcccccttttggggactcttacattatcatcggcgtcgaacccggacagctgaaacttaattggttcaaaaagggctccagcattgggcagatgtttgagacaaccatgagaggagccaagcgcatggccatcctgggcgatacagcttgggacttcgggtctctcggaggcgtgtttaccagcattgggaaagccctgcaccaagttttcggcgcgatctacggagctgccttttccggcgtgtcttggacgatgaagattctgatcggggtcatcattacatggatcggaatgaacagccggtccaccagcctttctgtgtccctcgtgctggttggcgtcgtgaccctgtatctcggggccatggtgcaggctgatagcggatgtgtcgtgtcttggaaaaataaggaactgaaatgcggctccgggattttcatcacagacaacgttcacacctggacagagcagtacaagtttcagcctgaaagcccctccaaacttgcctctgctattcaaaaagcccatgaggagggcatctgtggaatcagaagcgtgacgcgcctggaaaatctcatgtggaagcagattaccccggagctgaaccacatcctgtccgaaaatgaggtcaaacttacaattatgaccggcgatatcaaggggattatgcaggcgggaaaacggtctctcagacctcagcccacagaactgaagtatagctggaaaacctggggcaaggccaagatgctgtccacggagagccataaccaaaccttcctcatcgacgggcctgagacagctgaatgccccaataccaaccgcgcctggaactctctggaggtggaagattacggatttggcgttttcacaaccaacatctggcttaaactgcgggagaagcaggacgtgttttgtgactccaaactcatgagcgctgccattaaggataatagagcggtccacgccgacatgggctattggatcgagtctgctctgaacgatacatggaaaatggaaaaggcctccttcattgaggtcaagagctgccactggcctaaatctcataccctgtggagcaatggggttcttgaatccgagatgatcattcccaagaacttcgctggaccggtgagccagcacaactaccgccctggctatcatacgcagacagccgggccctggcacctcggaaaactggaaatggactttgatttctgtgagggcaccaccgtcgtggtgacagaggactgcgggaatcggggaccctctctgagaaccacgacagcctccggcaagctcatcaccgaatggtgctgtcggagctgcacactgcctccgcttcgctacagaggcgaggatgggtgttggtacggaatggaaattcggcccctgaaagagaaggaagagaacctcgtcaattccctggttaccgctggccatgggcaaatcgacaacttttctctgggagtgcttggcatggccctcttcctggaggaaatgctgagaacacgcgtggggaccaagcacgccatcctcctggtcgctgtgagctttgttacgcttattaccggaaatatgtccttccgggatctgggcagagtgatggtcatggtgggcgttacaatgaccgacgatatcgggatgggagtgacatatctcgccctgctggccgcttttaaagtccgccctaccttcgccgcgggccttctgctcagaaagctgacgtctaaagagctcatgatggctacaattgggatcaccctgcttagccagtccacaattcccgaaaccatcctggagctcaccgacgccctggccctgggaatgatggtgcttaagatcgttcggaacatggaaaaataccagctggctgtgacaattatggccatctcttgcgtccctaatgcggtgattctcctgaacgcttggaaggtgagctgtacgatcctcgccgccgtctccgttagccccctgcttctgacctcttcccaacagaagacagattggattcctctcgctctgaccatcaaaggcctgaatcccacagccatctttcttaccacgctgagccgcacatctaagaaaagatcctggccgctcaacgaggctgtgatggccgtggggatggtcagcattctggcgtcttccctcctgaagaatgacatccctatgaccggaccccttgtggccggcggcctgctgaccgtttgctatgtgctcacagggcggagcgctgacctggagcttgaacgcgccgctgatgtcaaatgggaggaccaggccgaaatttccggaagctctcctatcctgagcattaccatctccgaggatggctctatgagcattaagaacgaggaagaggaacagacactcacgatcctgatcagaaccgggctcctggtgatttccggagttttccccgtgtctatcccgattacagccgctgcgtggtacctttgggaggtcaaaaagcaacgggccggcgtgctgtgggacgtcccttctccccctcccgtggggaaggctgaactggaggatggagcctatcgcatcaaacagagaggcattctcggctactcccagatcggggccggagtttataaggagggcacctttcacacaatgtggcatgtgaccagaggggctgtcctgatgcaccgcggaaaaagaatcgaaccctcctgggccgacgtgaagaaagatcttattagctacggcgggggatggaagctggagggcgaatggaaggagggcgaagaggttcaggtgctcgcgctggagcctgggaaaaatccgcgggctgtccaaacgaagcccggactcttcaaaaccaacacaggcaccatcggggccgtgtccctggactttagccctggaacatctggctcccccattgtggatagaaaggggaaagttgtcggactttacggcaatggcgtggtgacccgcagcggggcctatgtctctgctatcgcccagacagaaaagtccattgaggacaaccctgaaatcgaggatgacatcttccggaagaaaagactgacgattatggatctgcatcccggagcgggcaagaccaaacgctacctccctgctatcgtgcgggaagccattaagagagggctgcgcacacttatcctggccccgacccgggttgtggctgccgagatggaggaagctctcagaggactgcccattcgctatcagacccctgccatccgggcggagcacacaggcagagaaattgtcgacctcatgtgtcatgccacgttcaccatgcggctgcttagccccgtgcgcgttcctaactacaatctgatcatcatggacgaggctcactttacagatcccgcctccattgctgccagagggtatatctctacccgggtggagatgggcgaagccgctggaattttcatgacagcgaccccgcctggcagccgcgacccctttccccagtccaacgcccctatcatggatgaggaaagagagattcccgaacggagctggaactctgggcacgagtgggtcacggacttcaaaggaaagacagtgtggtttgttccttccatcaaggctggcaacgatatcgccgcctgcctgcgcaagaatgggaagaaagtgattcaactcagccgcaagaccttcgactctgagtacgtcaaaacccgggctaacgattgggactttgtggtgacaaccgatatcagcgaaatgggagccaatttcagagcggagcgcgtcattgacccgcggagatgtatgaagcccgttatcctgacagatggcgaagaaagagtgattcttgctgggcctatgcccgtgacccattcctctgccgcccagcggagaggccgcgtcggaagaaaccctaagaatgaaaacgaccagtatatctacatgggcgagcccctggagaatgacgaagattgcgctcactggaaagaggccaagatgctcctggacaacatcaatacgccggaagggattatccctagcatgtttgagcccgaacgggagaaagtggatgcgattgacggagagtaccgcctgagaggcgaagcccggaagacattcgttgatctcatgcgcagaggggaccttcctgtgtggctggcttatcgggtcgccgctgagggaatcaactacgccgatagacgctggtgttttgacggcattaaaaataaccaaatcctggaagagaacgtggaggttgaaatttggaccaaggagggggaacggaaaaagctcaagcccagatggctggatgctcgcatctattccgaccctcttgccctgaaagagttcaaggagttcgcggccggccggaaatctctcacactgaatctgatcaccgagatgggaagactccccacgtttatgacccagaagacacgggatgctcttgacaacctggccgtgctgcataccgctgaggccggcgggcgcgcctacaatcacgctctcagcgaactgccggagacacttgaaaccctgctcctgctgacactccttgcgaccgtcacgggaggcattttcctgtttctgatgtccgggaaaggaatcggcaagatgacactcggcatgtgctgcattatcaccgccagcattctgctttggtatgctcagatccagcctcactggatcgccgcctctattatcctggagttctttctcattgtgctgctgatccccgaacccgagaagcaaagaacccctcaggataaccagctcacatacgtcgtgattgctatccttaccgttgtggccgcgacaatggccaatgagatggggttcctggagaaaacgaagaaagacctgggactcggctccatcaccacacaggaaagcgaatccaacattctggacatcgatcttcggccggcttctgcctggaccctgtatgctgtggccacaacctttgtcacgcccatgctccgccatagcattgagaatagctctgttaacgtgagcctgaccgcgatcgccaatcaagctacagtgctgatggggctcggaaagggctggcctctttccaaaatggacattggggtccccctgctggccatcggatgttacagccaggtgaaccctattaccctcacagctgccctgcttctgctcgttgctcactacaccatcatcggccccggcctgcaggccaaggcgacgagagaagcccagaagcgggctgccgctgggattatgaaaaatcctacagtggatggaatcaccgtcattgacctggagccgatcccctatgatcctaagttcgagaaacaactcggccaggtgatgcttctgattctgtgcgtcacacaggtgctcatgatgcgcaccacctgggccctgtgtgaagcccttacactggcgacggggcccatctctaccctctgggagggaaaccctggcagattttggaatacaaccatcgctgtttccatggccaacattttccgggggagctacctggctggagccggcctgctcttttctatcatgaagaatacaaccaacacgcgcagaggcacagggaatattggagaaacccttggcgagaaatggaagtcccggctgaacgccctgggaaagagcgagttccagatctataaaaagtctggcattcaagaagtggacagaaccctcgctaaagagggcatcaagcgcggggaaacagatcatcacgccgtcagccggggatccgcgaaactgagatggtttgtggagcgcaacatggttacccccgaaggcaaggtggtcgaccttggctgcgggcggggaggctggtcttactattgtgggggactgaaaaatgtgagagaggtgaagggcctcacaaaagggggaccgggccatgaggaacctatccccatgagcacgtacggctggaacctggttcgcctgcagtccggggtcgatgtgttcttcacaccccctgagaaatgcgacacactcctttgtgatattggagaaagctcccccaatcctaccatcgaggccggccggacactgagagtgctgaacctcgtcgaaaattggctgaacaataacacccagttttgcattaaggttcttaatccgtatatgccctctgtgatcgagaaaatggagacgctgcaacgcaagtacgggggagctctcgtgcggaaccctctgagcagaaattccacccacgaaatgtactgggtctctaacgccacaggcaatattgtgagctccgttaacatgatctctcgcatgctgatcaatcggttcaccatgaaacacaagaaggctacatatgagcccgacgtggatctcgggagcggaaccagaaacattggcatcgaatccgagattcctaaccttgacatcattggcaaacgcatcgaaaagattaaacaggagcatgagacaagctggcactacgaccaggatcatccctataagacctgggcctaccacgggtcttatgaaacgaaacagacaggatccgcgagctctatggtcaatggcgtggttagactgctgaccaagccgtgggacgtggtccctatggtgacccaaatggccatgacagatacgaccccctttgggcagcagcgggtgttcaaggagaaagtcgacacacgcacccaggaacctaaggagggaaccaagaagctcatgagaatcaccgctgagtggctgtggaaagaacttggcaagaagaaaacaccccggatgtgtaccagagaggaatttacgcggaaggttcgctccaacgccgctctgggggccatcttcaccgatgagaataaatggaaaagcgctagagaagccgtggaggactctcggttttgggagctcgtggatcgcgaaagaaacctgcacctggagggaaaatgcgaaacatgtgtctacaatatgatgggcaagcgggagaaaaagctcggcgagttcgggaaggcgaaaggatcccgcgccatttggtatatgtggctgggcgctagatttcttgagttcgaggccctggggtttctcaacgaagaccattggttcagccggggaaattccctgagcggcgtggagggggaaggccttcaccgcctgggatacatcctcagagatgtttctaagaaagagggcggggctatgtacgccgacgataccgccggatgggacacacggattaccctggaagacctgaagaacgaggagatggtgacgaatcatatgaaaggcgaacacaagaagctcgcggaggctatctttaaactgacatatcaaaacaaggtcgtgcgcgttcagagacctacaccccgggggacagtgatggatattatcagccgcagagaccagcggggatccggccaggtcgggacctacggccttaatacgttcaccaacatggaagcccaactgatcagacagatggagggagagggcattttcaaatctatccagcatctcacagtgaccgaagagattgccgttcaaaattggctggctcgcgtggggcgggaaagacttagccgcatggccatctccggagatgactgcgtcgtgaagccgctggatgaccggtttgcttctgccctcacagcgctgaacgatatgggcaaagtcagaaaggacattcagcagtgggagcctagccgcgggtggaatgattggacccaggtgcccttctgctcccaccactttcatgaactggttatgaaggacggacgggtgctcgtcgtgccctgtagaaaccaagatgagctgatcggccgcgcccggatctctcagggggctggctggagccttaaagagacagcctgcctgggaaagtcctatgctcagatgtggaccctcatgtacttccacagacgcgacctgcggcttgccgcgaacgccatttgtagcgctgtgccttctcattgggttccgacgtccagaacaacctggagcatccacgccaaacacgaatggatgaccacagaggatatgctggctgtgtggaatcgggtctggattcaggaaaacccctggatggaggacaagacccctgtggaatcttgggaggaggttccctatctcggcaaaagagaagaccaatggtgcgggtccctgatcggactgacaagccgcgccacgtgggctaagaatattcagaccgccatcaaccaggtgcggtccctcattggcaatgaggaatacacagattatatgccttctatgaagagatttcgcagagaggaagaggaggcgggggtcctgtggtga

SEQ ID NO: 19546 - RNA, 9876 nt, synthetic construct
  misc_feature 1..9876: note = derived and/or modified CDS sequence (opt5) from DENV-2__JX669483__SS-prME
  source 1..9876: mol_type = other RNA
accgcgggagtgatcattatgctgatccccaccgctatggccttccacctcacgacccggaatggggaacctcatatgattgtcggacggcaggaaaagggcaagagcctgctttttaagacagaggacggggttaatatgtgcaccctgatggcgatcgatctcggagaactgtgtgaggacaccattacctacaaatgcccgcttctgcgccaaaatgaacccgaggatatcgactgttggtgcaattccacatctacctgggtgacgtatggcacctgtacaaccacaggggagcacagacgggaaaagcgcagcgtggctctcgtccctcatgtgggaatgggcctggagaccagaacggaaacatggatgtcctctgagggcgcctggaaacacgttcagcggatcgagacctggattctgcgccatcccgggttcgccatcatggctgccattctcgcttacacaatcggaaccacccactttcagagagccctgattttcatccttctgacagcggtggcccctagcatgacgatgcggtgcattggcatctccaaccgcgattttgtcgaaggggtgtctggaggcagctgggttgacatcgtgctcgagcacgggtcctgtgtcaccacaatggctaagaataagcccaccctggatttcgaacttattaaaacagaggccaagcagcctgctaccctgagaaaatattgcatcgaagccaagctcacgaacacaaccaccgagagccggtgtccgacacaaggagagccctctctgaatgaagaacaggacaaacgctttatttgcaagcattccatggtggatagaggctggggcaacgggtgtggactgttcggcaaagggggaatcgtgacctgcgcgatgtttacatgcaaaaagaatatggaaggcaaagtcgttctccctgagaacctggaatacacgattgtgatcacaccccacagcggggaggagcatgccgtgggaaatgacacaggcaagcacggcgaagagatcaaaattacccctcagtcttccatcacagaagctgagcttaccgggtatggaacggtcaccatggaatgtagcccccggacaggcctggatttcaacgagatggtgctcctgcagatggaggaaaaggcctggcttgttcaccgccaatggtttctggacctcccgctgccttggctgcccggggctgatacccagggatctaattggattcagaaagagacactcgtgaccttcaagaaccctcatgccaagaaacaggacgtcgtggttctgggctcccaagaaggggccatgcacacggctcttacaggcgcgaccgagatccagatgagctccggaaatctgctctttacaggccatctgaagtgcagacttcggatggacaaactgcagctcaaggggatgtcttacagcatgtgtaccggaaaattcaagattgtgaaggagatcgccgaaacccaacacggcacaatcgtcattaaagtgcagtatgagggggatggatccccctgcaagatccccttcgaaattatggacctggagaaaagacatgtcctgggccgcctcatcacggtgaaccctattgttaccgaaaaggatagcccggtgaacatcgaggctgagcccccttttggggactcttacattatcatcggcgtcgaacccggacagctgaaacttaattggttcaagaagggctccagcattgggcagatgtttgagacaaccatgcggggagccaaaagaatggccatcctgggcgatacagcttgggacttcgggtctctcggaggcgtgtttaccagcattgggaaggccctgcaccaagttttcggcgcgatctacggagctgccttttccggcgtgtcttggacgatgaaaattctgatcggggtcatcattacatggatcggaatgaacagccgctccaccagcctttctgtgtccctcgtgctggttggcgtcgtgaccctgtatctcggggccatggtgcaggctgatagcggatgtgtcgtgtcttggaagaataaagaactgaagtgcggctccgggattttcatcacagacaacgttcacacctggacagagcagtacaagtttcagcctgaaagcccctccaaacttgcctctgctattcaaaaggcccatgaggagggcatctgtggaatccggagcgtgacgagactggaaaatctcatgtggaaacagattaccccggagctgaaccacatcctgtccgaaaatgaggtcaaacttacaattatgaccggcgatatcaaagggattatgcaggcgggaaagcgctctctccggcctcagcccacagaactgaaatatagctggaagacctggggcaaggccaaaatgctgtccacggagagccataaccaaaccttcctcatcgacgggcctgagacagctgaatgccccaataccaacagagcctggaactctctggaggtggaagattacggatttggcgttttcacaaccaacatctggcttaagctgcgcgagaaacaggacgtgttttgtgactccaagctcatgagcgctgccattaaagataatcgggcggtccacgccgacatgggctattggatcgagtctgctctgaacgatacatggaagatggaaaaggcctccttcattgaggtgaaaagctgccactggcctaagtctcataccctgtggagcaatggggttcttgaatccgagatgatcattcccaaaaacttcgctggaccggtgagccagcacaactacagacctggctatcatacgcagacagccgggccctggcacctcggaaagctggaaatggactttgatttctgtgagggcaccaccgtcgtggtgacagaggactgcgggaatcgcggaccctctctgcggaccacgacagcctccggcaaactcatcaccgaatggtgctgtagaagctgcacactgcctccgcttcggtaccgcggcgaggatgggtgttggtacggaatggaaattagacccctgaaggagaaggaagagaacctcgtcaattccctggttaccgctggccatgggcaaatcgacaacttttctctgggagtgcttggcatggccctcttcctggaggaaatgctgcggacaagagtggggaccaaacacgccatcctcctggtcgctgtgagctttgttacgcttattaccggaaatatgtccttccgcgatctgggccgggtgatggtcatggtgggcgttacaatgaccgacgatatcgggatgggagtgacatatctcgccctgctggccgcttttaaggtcagacctaccttcgccgcgggccttctgctccgcaaactgacgtctaaggagctcatgatggctacaattgggatcaccctgcttagccagtccacaattcccgaaaccatcctggagctcaccgacgccctggccctgggaatgatggtgcttaaaatcgttagaaacatggaaaagtaccagctggctgtgacaattatggccatctcttgcgtccctaatgcggtgattctcctgaacgcttggaaggtgagctgtacgatcctcgccgccgtctccgttagccccctgcttctgacctcttcccaacagaaaacagattggattcctctcgctctgaccatcaagggcctgaatcccacagccatctttcttaccacgctgagccggacatctaaaaagcgctcctggccgctcaacgaggctgtgatggccgtggggatggtcagcattctggcgtcttccctcctgaaaaatgacatccctatgaccggaccccttgtggccggcggcctgctgaccgtttgctatgtgctcacagggagaagcgctgacctggagcttgaacgggccgctgatgtcaagtgggaggaccaggccgaaatttccggaagctctcctatcctgagcattaccatctccgaggatggctctatgagcattaaaaacgaggaagaggaacagacactcacgatcctgatccgcaccgggctcctggtgatttccggagttttccccgtgtctatcccgattacagccgctgcgtggtacctttgggaggtcaagaagcaaagagccggcgtgctgtgggacgtcccttctccccctcccgtggggaaagctgaactggaggatggagcctatcggatcaagcagcgcggcattctcggctactcccagatcggggccggagtttataaagagggcacctttcacacaatgtggcatgtgaccagaggggctgtcctgatgcaccggggaaagcgcatcgaaccctcctgggccgacgtgaaaaaggatcttattagctacggcgggggatggaagctggagggcgaatggaaagagggcgaagaggttcaggtgctcgcgctggagcctgggaagaatccgagagctgtccaaacgaaacccggactcttcaagaccaacacaggcaccatcggggccgtgtccctggactttagccctggaacatctggctcccccattgtggatcggaaagggaaggttgtcggactttacggcaatggcgtggtgaccagaagcggggcctatgtctctgctatcgcccagacagaaaagtccattgaggacaaccctgaaatcgaggatgacatcttccgcaaaaagcggctgacgattatggatctgcatcccggagcgggcaaaaccaagagatacctccctgctatcgtgcgcgaagccattaaacgggggctgagaacacttatcctggccccgacccgcgttgtggctgccgagatggaggaagctctccggggactgcccattagatatcagacccctgccatccgcgcggagcacacaggccgggaaattgtcgacctcatgtgtcatgccacgttcaccatgagactgcttagccccgtgcgggttcctaactacaatctgatcatcatggacgaggctcactttacagatcccgcctccattgctgcccgcgggtatatctctaccagagtggagatgggcgaagccgctggaattttcatgacagcgaccccgcctggcagccgggacccctttccccagtccaacgcccctatcatggatgaggaacgcgagattcccgaaagaagctggaactctgggcacgagtgggtcacggacttcaagggaaagacagtgtggtttgttccttccatcaaagctggcaacgatatcgccgcctgcctgcggaagaatgggaaaaaggtgattcaactcagcagaaaaaccttcgactctgagtacgtcaagacccgcgctaacgattgggactttgtggtgacaaccgatatcagcgaaatgggagccaatttccgggcggagagagtcattgacccgcgccggtgtatgaagcccgttatcctgacagatggcgaagagagagtgattcttgctgggcctatgcccgtgacccattcctctgccgcccagcgccggggcagagtcggacgcaaccctaaaaatgaaaacgaccagtatatctacatgggcgagcccctggagaatgacgaagattgcgctcactggaaggaggccaaaatgctcctggacaacatcaatacgccggaagggattatccctagcatgtttgagcccgaaagagagaaggtggatgcgattgacggagagtaccggctgcgcggcgaagccagaaaaacattcgttgatctcatgcggcgcggggaccttcctgtgtggctggcttatagagtcgccgctgagggaatcaactacgccgatcggagatggtgttttgacggcattaagaataaccaaatcctggaagagaacgtggaggttgaaatttggaccaaagagggggaacgcaagaagctcaaaccccggtggctggatgctagaatctattccgaccctcttgccctgaaggagttcaaagagttcgcggccggccgcaagtctctcacactgaatctgatcaccgagatgggacggctccccacgtttatgacccagaaaacaagagatgctcttgacaacctggccgtgctgcataccgctgaggccggcgggcgggcctacaatcacgctctcagcgaactgccggagacacttgaaaccctgctcctgctgacactccttgcgaccgtcacgggaggcattttcctgtttctgatgtccgggaagggaatcggcaagatgacactcggcatgtgctgcattatcaccgccagcattctgctttggtatgctcagatccagcctcactggatcgccgcctctattatcctggagttctttctcattgtgctgctgatccccgaacccgagaaacaacgcacccctcaggataaccagctcacatacgtcgtgattgctatccttaccgttgtggccgcgacaatggccaatgagatggggttcctggaaaagacgaaaaaggacctgggactcggctccatcaccacacaggagagcgaatccaacattctggacatcgatcttagaccggcttctgcctggaccctgtatgctgtggccacaacctttgtcacgcccatgctccggcatagcattgaaaatagctctgttaacgtgagcctgaccgcgatcgccaatcaagctacagtgctgatggggctcggaaaaggctggcctctttccaagatggacattggggtccccctgctggccatcggatgttacagccaggtgaaccctattaccctcacagctgccctgcttctgctcgttgctcactacaccatcatcggccccggcctgcaggccaaggcgacgcgcgaagcccagaaaagagctgccgctgggattatgaagaatcctacagtggatggaatcaccgtcattgacctggagccgatcccctatgatcctaaattcgagaagcaactcggccaggtgatgcttctgattctgtgcgtcacacaggtgctcatgatgcggaccacctgggccctgtgtgaagcccttacactggcgacggggcccatctctaccctctgggagggaaaccctggccgcttttggaatacaaccatcgctgtttccatggccaacattttcagagggagctacctggctggagccggcctgctcttttctatcatgaaaaatacaaccaacacgcggcgcggcacagggaatattggagaaacccttggcgagaagtggaagtccagactgaacgccctggggaaaagcgagttccagatctataagaaatctggcattcaagaagtggaccggaccctcgctaaggagggcatcaaaagaggggaaacagatcatcacgccgtcagccgcggatccgcgaagctgcggtggtttgtggagagaaacatggttacccccgaaggcaaagtggtcgaccttggctgcgggcgcggaggctggtcttactattgtgggggactgaagaatgtgcgggaggtgaagggcctcacaaaagggggaccgggccatgaggaacctatccccatgagcacgtacggctggaacctggttagactgcagtccggggtcgatgtgttcttcacaccccctgagaagtgcgacacactcctttgtgatattggagaaagctcccccaatcctaccatcgaggccggccgcacactgcgggtgctgaacctcgtcgaaaattggctgaacaataacacccagttttgcattaaagttcttaatccgtatatgccctctgtgatcgagaagatggagacgctgcaaagaaaatacgggggagctctcgtgcgcaaccctctgagcagaaattccacccacgaaatgtactgggtctctaacgccacaggcaatattgtgagctccgttaacatgatctctagaatgctgatcaatcgcttcaccatgaagcacaagaaagctacatatgagcccgacgtggatctcgggagcggaacccggaacattggcatcgaatccgagattcctaaccttgacatcattggcaagagaatcgagaagattaagcaggagcatgagacaagctggcactacgaccaggatcatccctataaaacctgggcctaccacgggtcttatgaaacgaagcagacaggatccgcgagctctatggtcaatggcgtggttcgcctgctgaccaagccgtgggacgtggtccctatggtgacccaaatggccatgacagatacgaccccctttgggcagcagagagtgttcaaagagaaggtcgacacacggacccaggaacctaaagagggaacaaagaaactcatgcgcatcaccgctgagtggctgtggaaggaacttggcaagaaaaagacacccagaatgtgtacccgggaggaatttacgagaaaagttcggtccaacgccgctctgggggccatcttcaccgatgagaataagtggaaaagcgctcgcgaagccgtggaggactctagattttgggagctcgtggatcgggaacgcaacctgcacctggagggaaagtgcgaaacatgtgtctacaatatgatgggcaaaagagagaagaagctcggcgagttcgggaaagcgaagggatcccgggccatttggtatatgtggctgggcgctcgctaccttgagtttgaggccctggggttcctcaacgaagaccattggtttagcagaggaaattccctgagcggcgtggagggggaaggccttcaccggctgggatacatcctccgcgatgtttctaaaaaggagggcggggctatgtatgccgacgataccgccggatgggacacaagaattaccctggaagacctgaaaaacgaggagatggtgacgaatcatatgaagggcgaacacaagaaactcgcggaggctatcttcaagctgacataccaaaacaaagtcgtgcgggttcagcgccctacccccagagggacagtgatggatattatcagccggcgcgaccagagaggatccggccaggtcgggacctatggccttaatacgtttaccaacatggaagcccaactgatccggcagatggagggagagggcattttcaagtctatccagcatctcacagtgaccgaagagattgccgttcaaaattggctggctagagtggggcgcgaacggcttagcagaatggccatctccggagatgactgcgtcgtgaaaccgctggatgaccgcttcgcttctgccctcacagcgctgaacgatatgggcaaggtccggaaggacattcagcagtgggagcctagcagagggtggaatgattggacccaggtgcccttttgctcccaccacttccatgaactggttatgaaagacggacgcgtgctcgtcgtgccctgtcggaaccaagatgagctgatcggcagagcccgcatctctcagggggctggctggagccttaaggagacagcctgcctgggaaaatcctacgctcagatgtggaccctcatgtattttcaccggagagacctgcgccttgccgcgaacgccatttgtagcgctgtgccttctcattgggttccgacgtcccggacaacctggagcatccacgccaagcacgaatggatgaccacagaggatatgctggctgtgtggaatagagtctggattcaggaaaacccctggatggaggacaaaacccctgtggaatcttgggaggaggttccctacctcggcaagcgggaagaccaatggtgcgggtccctgatcggactgacaagcagagccacgtgggctaagaatattcagaccgccatcaaccaggtgcgctccctcattggcaatgaggaatatacagattacatgccttctatgaaacggttcagacgcgaggaagaggaggcgggggtcctgtggtga

SEQ ID NO: 19547 - RNA, 9876 nt, synthetic construct
  misc_feature 1..9876: note = derived and/or modified CDS sequence (opt5) from DENV-2__JX669484__SS-prME
  source 1..9876: mol_type = other RNA
accgcgggagtgatcattatgctgatccccacagctatggccttccacctcacgaccagaaatggggaacctcatatgattgtcggacggcaggaaaagggcaaaagcctgctttttaagacagaggacggggttaatatgtgcaccctgatggcgatcgatctcggagaactgtgtgaggacacaattacctacaaatgcccgcttctgcgccaaaatgaacccgaggatatcgactgttggtgcaattccacatctacctgggtgacgtatggcacctgtacaaccacaggggagcacagacgggaaaagcgcagcgtggctctcgtccctcatgtgggaatgggcctggagaccagaacggaaacatggatgtcctctgagggcgcctggaaacacgttcagcggatcgagacctggattctgcgccatcccgggttcgccatcatggctgccattctcgcttacacaatcggaaccacccactttcagagagccctgattttcatccttctgacagcggtggcccctagcatgacgatgcggtgcattggcatctccaaccgcgattttgtcgaaggggtgtctggaggcagctgggttgacatcgtgctcgagcacgggtcctgtgtcaccacaatggctaagaataagcccaccctggatttcgaacttattaaaacagaggccaagcagcctgctaccctgagaaaatattgcatcgaagccaagctcacgaacacaaccaccgagagccggtgtccgacacaaggagagccctctctgaatgaagaacaggacaaacgctttatttgcaagcattccatggtggatagaggctggggcaacgggtgtggactgttcggcaaaggcgggatcgtgacctgcgcgatgtttacatgcaaaaagaatatggaagggaaagtcgttctccctgagaacctggaatacacgattgtgatcacaccccacagcggggaggagcatgccgtgggaaatgacacaggcaagcacggcaaagaaatcaagattacccctcagtcttccatcacagaggctgaacttaccgggtatggaacggtcaccatggagtgtagcccccggacaggcctggatttcaacgaaatggtgctcctgcagatggaggagaaagcctggcttgttcaccgccaatggtttctggacctcccgctgccttggctgcccggggctgatacccagggatctaattggattcagaaggaaacactcgtgaccttcaagaaccctcatgccaaaaagcaggacgtcgtggttctgggctcccaagagggggccatgcacacggctcttacaggcgcgaccgaaatccagatgagctccggaaatctgctctttacaggccatctgaaatgcagacttcggatggacaagctgcagctcaaagggatgtcttacagcatgtgtaccggaaagttcaagattgtgaaagagatcgccgagacccaacacggcacaatcgtcattagagtgcagtatgaaggggatggatccccctgcaagatccccttcgagattatggacctggaaaaacgccatgtcctgggccggctcatcacggtgaaccctattgttaccgagaaggatagcccggtgaacatcgaagctgagcccccttttggggactcttacattatcatcggcgtcgagcccggacagctgaaacttaattggttcaagaagggctccagcattgggcagatgtttgaaacaaccatgagaggagccaaacgcatggccatcctgggcgatacagcttgggacttcgggtctctcggaggcgtgtttaccagcattgggaaggccctgcaccaagttttcggcgcgatctacggagctgccttttccggcgtgtcttggacgatgaaaattctgatcggggtcatcattacatggatcggaatgaacagccggtccaccagcctttctgtgtccctcgtgctggttggcgtcgtgaccctgtatctcggggccatggtgcaggctgatagcggatgtgtcgtgtcttggaagaataaagagctgaagtgcggctccgggattttcatcacagacaacgttcacacctggacagaacagtacaagtttcagcctgagagcccctccaaacttgcctctgctattcaaaaggcccatgaagagggcatctgtggaatcagaagcgtgacgcgcctggagaatctcatgtggaaacagattaccccggaactgaaccacatcctgtccgagaatgaagtcaaacttacaattatgaccggcgatatcaaagggattatgcaggcgggaaagcggtctctcagacctcagcccacagagctgaaatatagctggaagacctggggcaaggccaaaatgctgtccacggaaagccataaccaaaccttcctcatcgacgggcctgagacagctgagtgccccaataccaaccgcgcctggaactctctggaagtggaggattacggatttggcgttttcacaaccaacatctggcttaagctgcgggaaaaacaggacgtgttttgtgactccaagctcatgagcgctgccattaaagataatagagcggtccacgccgacatgggctattggatcgagtctgctctgaacgggacatggaagatggagaaggcctccttcattgaagtgaaaagctgccactggcctaagtctcataccctgtggagcaatggagttcttgagtccgaaatgatcattcccaaaaacttcgctggcccggtgagccagcacaactaccgccctgggtatcatacgcagacagccggaccctggcacctcggcaagctggagatggattttgacttctgtgaagggaccaccgtcgtggtgacagaggattgcggaaatcggggcccctctctgagaaccacgacagcctccggcaaactcatcaccgagtggtgctgtcggagctgcacactgcctccgcttcgctacagaggggaagacggatgttggtacggcatggagattcggcccctgaaggaaaaggaggaaaacctcgtcaattccctggttaccgctgggcatggacaaatcgataacttttctctgggcgtgcttgggatggccctcttcctggaggagatgctgagaacacgcgtgggaaccaaacacgccatcctcctggtcgctgtgagctttgttacgcttattaccggcaatatgtccttcaaggacctgggccgggtgatggtcatggtgggggttgccatgacagatgacatcggaatgggcgtgacctatctcgccctgctggctgcctttaaagtcagacctacattcgcggctgggcttctgctccgcaagctgacctctaaagaactcatgatggccacgattggaatcacactgcttagccagtccaccattcccgagacaatcctggaactcaccgatgccctggctctgggcatgatggtgcttaagatcgttagaaacatggagaagtaccagctggccgtgaccattatgacaatctcttgcgtccctaatgcggtgattctcctgaacgcttggaaagtgagctgtacgatcctcgccgccgtctccgttagccccctgcttctgacctcttcccaacagaagacagactggattcctctcgctctgaccatcaaagggctgaatcccacagccatctttcttaccacgctgagccggacatctaagaaacgctcctggccgctcaacgaagctgtgatggccgtgggaatggtcagcattctggcgtcttccctcctgaagaatgatatccctatgaccggcccccttgtggccggcgggctgctgaccgtttgctatgtgctcacaggaagaagcgctgacctggagcttgagcgggccgctgacgtcaaatgggaagatcaggccgagatttccggcagctctcctatcctgagcattaccatctccgaagacgggtctatgagcattaagaacgaggaggaagaacagacactcacgatcctgatccgcaccggactcctggtgatttccggcgttttccccgtgtctatcccgattacagccgctgcgtggtacctttgggaagtcaagaaacaaagagccggggtgctgtgggatgtcccttctccccctcccgtgggaaaggctgagctggaagacggcgcctatcggatcaaacagcgcggcattctcgggtactcccagatcggagccggcgtttataaggaggggacctttcacacaatgtggcatgtgaccagaggagctgtcctgatgcaccggggcaaacgcatcgagccctcctgggccgatgtgaagaaggaccttattagctacgggggaggctggaaactggaaggcgagtggaaggaaggggaggaagttcaggtgctcgcgctggagcctggcaagaatccgagagctgtccaaacgaagcccggcctcttcaaaaccaacacagggaccatcggagccgtgtccctggattttagccctggcacatctgggtcccccattgtggaccggaagggaaaggttgtcggcctttacggcaatggggtggtgaccagaagcggagcctatgtctctgctatcgcccagacagagaaatccattgaagataaccctgagatcgaagacgatatcttccgcaagaaacggctgacgattatggacctgcatcccggcgcggggaagaccaaaagatacctccctgctatcgtgcgcgaggccattaagcggggactgagaacacttatcctggccccgacccgcgttgtggctgccgaaatggaggaggctctccggggcctgcccattagatatcagacccctgccatccgcgcggaacacacagggcgggagattgtcgatctcatgtgtcatgccacgttcaccatgagactgcttagccccgtgcgggttcctaactacaatctgatcatcatggacgaagctcactttacagaccccgcctccattgctgcccgcggctatatctctaccagagtggagatgggagaggccgctggcattttcatgacagcgaccccgcctgggagccgggatccctttccccagtccaacgcccctatcatggacgaagaacgcgaaattcccgagagaagctggaactctggacacgaatgggtcacggatttcaagggcaaaacagtgtggtttgttccttccatcaaggctgggaacgacatcgccgcctgcctgcggaaaaatggaaagaaagtgattcaactcagcagaaagaccttcgattctgagtacgtcaagacccgcgctaacgactgggattttgtggtgacaaccgacatcagcgagatgggcgccaatttccgggcggaaagagtcattgatccgcgccggtgtatgaaacccgttatcctgacagacggggaggaaagagtgattcttgctggccctatgcccgtgacccattcctctgccgcccagcgccggggaagagtcggccgcaaccctaagaatgagaacgatcagtatatctacatgggggaacccctggagaatgacgaggactgcgctcactggaaagaagccaagatgctcctggataacatcaatacgccggagggaattatccctagcatgtttgaacccgagagagaaaaagtggacgcgattgatggcgagtaccggctgcgcggggaggccagaaagacattcgttgacctcatgcggcgcggagatcttcctgtgtggctggcttatagagtcgccgctgaaggcatcaactacgccgaccggagatggtgttttgatgggattaaaaataaccaaatcctggaggaaaacgtggaggttgagatttggaccaaggaaggcgagcgcaagaaactcaagccccggtggctggacgctagaatctattccgatcctcttgccctgaaagagttcaaggagttcgcggccggacgcaaatctctcacactgaatctgatcaccgaaatgggccggctccccacgtttatgacccagaaggctagagacgcccttgataacctggctgtgctgcatacagccgaggccgggggacgggcttacaatcacgcgctcagcgagctgccggaaacccttgagacactgctcctgctgaccctccttgccacagtcaccggcgggattttcctgtttctgatgtccggaaagggcgtgggcaaaatgacgctcgggatgtgctgcatcattacagctagcatcctgctttggtatgcccagattcagcctcactggatcgccgcttctatcattctggagttctttctcatcgtcctgctgattcccgagcccgaaaagcaacgcacccctcaggacaaccagctcacctacgtggttatcgccattcttacagtggtggcggccaccatggctaatgagatgggattcctggagaaaacaaagaaagatctgggcctcgggtccatcacgacccaggaaagcgagtccaacatcctggacattgaccttagaccggcctctgcttggacactgtatgccgtcgcgaccacatttgttacccccatgctccggcatagcatcgaaaattcctctgtgaacgtgagcctgacggccattgctaatcaagccaccgtcctgatgggactcggcaaggggtggcctctttccaagatggatatcggagtgcccctgctggctattggctgttacagccaggttaaccctatcacactcaccgccgctctgcttctgctcgtggcccactacgcgattatcggccccgggctgcaggccaaagctacacgcgaggcccagaagagagctgccgccggaatcatgaaaaatcctaccgtcgacggcattacggtgatcgatctggaaccgattccctatgaccctaagttcgagaaacaactcgggcaggtcatgcttctgatcctgtgcgtgacacaggttctcatgatgcggaccacatgggcgctgtgtgaggctcttaccctggccaccggacccatttctacactctgggaaggcaaccctgggcgcttttggaatacgaccatcgctgtgtccatggccaacatcttcagaggaagctacctggccggcgctggcctgctcttttctattatgaagaatacaaccaacacacggcgcgggaccggaaatatcggcgagacgcttggggaaaagtggaaatccagactgaacgccctgggaaagagcgagttccagatttataaaaagtctggcatccaagaggtcgatcggacactcgcgaaagaagggattaagagaggagagaccgaccatcacgccgtgagccgcggctccgctaaactgcggtggtttgttgaaagaaacatggtgacccccgagggcaaggtcgtggatcttgggtgcggacgcggcgggtggtcttactattgtggaggcctgaagaatgtgcgggaagttaaagggctcacaaagggaggcccgggccatgaggagcctatccccatgagcacctacgggtggaacctggtcagactgcagtccggagtggacgtgttcttcacaccccctgaaaaatgcgatacgctcctttgtgacatcggcgagagctcccccaatcctaccattgaagccgggcgcacactgcgggtcctgaacctcgttgagaattggctgaacaataacacccagttttgcatcaaggtgcttaatccgtatatgccctctgtgattgagaagatggagacactgcaaagaaagtacggaggcgctctcgtccgcaaccctctgagccggaatagcacccacgagatgtactgggtgtctaacgccacggggaatatcgttagctccgtgaacatgatttctagaatgctgatcaatcgcttcaccatgaagcacaaaaaggcgacatatgaacccgatgtcgacctcggaagcggcacccggaacatcggcattgagtccgaaatccctaaccttgatattatcgggaaaagaattgagaagatcaaacaggaacatgagacaagctggcactacgaccaggaccatccctataagacctgggcctaccacggatcttatgagacaaagcagaccggctccgctagctctatggtgaatggggttgtgcgcctgctgacgaaaccgtgggatgtcgtgcctatggtgacacaaatggccatgaccgacaccacaccctttggacagcagagagtcttcaaggaaaaagttgatacgcggacccaggagcctaaggaaggcaccaagaagctcatgcgcattaccgctgagtggctgtggaaggagcttgggaaaaagaaaacacccagaatgtgtacccgggaagagtttacaagaaaggtgcggtccaacgccgctctgggagccatcttcaccgacgaaaataaatggaaaagcgcgcgcgaggccgtggaagattctagattttgggagctcgtcgaccgggagcgcaacctgcacctggaaggcaaatgcgagacgtgtgtgtacaatatgatgggcaagagagaaaagaaactcggggagttcggaaaggctaaaggctcccgggccatctggtatatgtggctgggggctcgctttcttgagttcgaggccctgggatttctcaacgaggatcattggttcagcagaggcaattccctgagcggggttgaaggcgagggacttcaccggctgggctacattctccgcgacgtgtctaagaaagaagggggagccatgtacgcggatgacaccgctggctgggatacaagaatcaccctggaggacctgaagaacgaagagatggtcattaatcatatgaagggggagcacaaaaagctcgccgaagccatctttaaactgacatatcaaaacaaggtggttcgggtgcagcgccctacccccagaggaacggtcatggacattatcagccggcgcgatcagagaggctccggacaggtgggcacatacggacttaataccttcacaaacatggaggctcaactgatccggcagatggaaggcgaggggattttcaaatctatccagcatctcaccgttacggaggaaattgccgtgcaaaattggctggctagagtcggacgcgagcggcttagcagaatggccatctccggcgacgattgcgtggtcaagccgctggacgatcgctttgcgtctgccctcaccgctctgaacgacatggggaaggtgcggaaagatattcagcagtgggaacctagcagaggatggaatgactggacacaggttcccttctgctcccaccactttcatgagctggtgatgaaggatggccgcgtcctcgtggtgccctgtcggaaccaagacgaactgatcgggagagcccgcatctctcagggcgctggatggagccttaaagagaccgcctgcctgggcaagtcctatgcgcagatgtggacactcatgtacttccaccggagagatctgcgccttgccgctaacgccatttgtagcgctgttccttctcattgggtgccgacctcccggacaacctggagcatccacgccaaacacgagtggatgacgacagaagacatgctggctgtctggaatagagtgtggattcaggagaacccctggatggaagataagacccctgttgagtcttgggaagaggtgccctatctcgggaagcgggaggaccaatggtgcggatccctgatcggcctgaccagcagagccacatgggcgaaaaatattcagaccgccatcaaccaggtccgctccctcattgggaatgaagagtacacagactatatgccttctatgaagcggtttagacgcgaagaggaagaggctggagtgctgtggtga

SEQ ID NO: 19548 - RNA, 9876 nt, synthetic construct
  misc_feature 1..9876: note = derived and/or modified CDS sequence (opt5) from DENV-2__JX669485__SS-prME
  source 1..9876: mol_type = other RNA
accgcgggcgtgatcattatgctgatccccaccgctatggccttccacctcacgacccggaatggggagcctcatatgattgtgggaaagcaggaaaaaggcaagagcctgctttttaaaacagaggacggggttaatatgtgcaccctgatggcgatcgatctcggagaactgtgtgaggacacaattacctacaagtgcccgcttctgcggcaaaatgaacccgaggatatcgactgttggtgcaattccacatctacctgggtgacgtatggcacctgtacaaccacaggggagcacagacgggaaaaacggagcgtggctctcgtccctcatgtgggaatgggcctggagacccgcacggaaacatggatgtcctctgagggcgcctggaagcacgttcagagaatcgagacctggattctgcggcatcccgggttcgccatcatggctgccattctcgcttacacaatcggaaccacccactttcagcgcgccctgattttcatccttctgacagcggtggcccctagcatgacgatgagatgcattggcatctccaaccgggattttgtcgaaggggtgtctggaggcagctgggttgacatcgtgctcgagcacgggtcctgtgtcaccacaatggctaagaataaacccaccctggatttcgaacttattaagacagaggccaaacagcctgctaccctgcgcaagtattgcatcgaagccaaactcacgaacacaaccaccgagagcagatgtccgacacaaggagagccctctctgaatgaagaacaggacaagcggtttatttgcaagcattccatggtggatcgcggctggggcaacgggtgtggactgttcggcaaagggggaatcgtgacctgcgcgatgtttacatgcaagaaaaatatggaaggcaaggtcgttctccctgagaacctggaatacacgattgtgatcacaccccacagcggggaggagcatgccgtgggaaatgacacaggcaaacacggcaaggaaatcaaaattacccctcagtcttccatcacagaggctgaacttaccgggtatggaacggtcaccatggagtgtagccccagaacaggcctggatttcaacgaaatggtgctcctgcagatggaggagaaggcctggcttgttcaccggcaatggtttctggacctcccgctgccttggctgcccggggctgatacccagggatctaattggattcagaaggaaacactcgtgaccttcaaaaaccctcatgccaagaaacaggacgtcgtggttctgggctcccaagagggggccatgcacacggctcttacaggcgcgaccgaaatccagatgagctccggaaatctgctctttacaggccatctgaagtgccgccttagaatggacaaactgcagctcaaggggatgtcttacagcatgtgtaccggaaagttcaaaattgtgaaggagatcgccgagacccaacacggcacaatcgtcattcgggtgcagtatgaaggggatggatccccctgcaaaatccccttcgagattatggacctggaaaagagacatgtcctgggccgcctcatcacggtgaaccctattgttaccgagaaagatagcccggtgaacatcgaagctgagcccccttttggggactcttacattatcatcggcgtcgagcccggacagctgaaacttaattggttcaagaaaggctccagcattgggcagatgtttgaaacaaccatgcggggagccaagagaatggccatcctgggcgatacagcttgggacttcgggtctctcggaggcgtgtttaccagcattgggaaagccctgcaccaagttttcggcgcgatctacggagctgccttttccggcgtgtcttggacgatgaagattctgatcggggtcatcattacatggatcggaatgaacagccgctccaccagcctttctgtgtccctcgtgctggttggcgtcgtgaccctgtatctcggggccatggtgcaggctgatagcggatgtgtcgtgtcttggaaaaataaggagctgaagtgcggctccgggattttcatcacagacaacgttcacacctggacagaacagtacaaatttcagcctgagagcccctccaaacttgcctctgctattcaaaaagcccatgaagagggcatctgtggaatccggagcgtgacgagactggagaatctcatgtggaagcagattaccccggaactgaaccacatcctgtccgagaatgaagtcaaacttacaattatgaccggcgatatcaaggggattatgcaggcgggaaaacgctctctccggcctcagcccacagagctgaagtatagctggaagacctggggcaaagccaagatgctgtccacggaaagccataaccaaaccttcctcatcgacgggcctgagacagctgagtgccccaataccaacagagcctggaactctctggaagtggaggattacggatttggcgttttcacaaccaacatctggcttaaactgcgcgaaaagcaggacgtgttttgtgactccaaactcatgagcgctgccattaaggataatcgggcggtccacgccgacatgggctattggatcgagtctgctctgaacgggacatggaagatggagaaagcctccttcattgaagtcaagagctgccactggcctaaatctcataccctgtggagcaatggagttcttgagtccgaaatgatcattcccaagaacttcgctggcccggtgagccagcacaactacagacctgggtatcatacgcagacagccggaccctggcacctcggcaaactggagatggattttgacttctgtgaagggaccaccgtcgtggtgacagaggattgcggaaatcgcggcccctctctgcggaccacgacagcctccggcaagctcatcaccgagtggtgctgtagaagctgcacactgcctccgcttcggtaccgcggggaagacggatgttggtacggcatggagattagacccctgaaggaaaaagaggaaaacctcgtcaattccctggttaccgctgggcatggacaaatcgataacttttctctgggcgtgcttgggatggccctcttcctggaggagatgctgcggacaagagtgggaaccaagcacgccatcctcctggtcgctgtgagctttgttacgcttattaccggcaatatgtccttccgcgacctgggccgggtgatcgtcatggtgggggttacaatgaccgatgacattggaatgggcgtgacatatctcgccctgctggccgcttttaaagtcagacctaccttcgccgcggggcttctgctccgcaagctgacgtctaaagaactcatgatggctacaatcggaattaccctgcttagccagtccacaatccccgagaccatcctggaactcaccgatgccctggccctgggcatgatggtgcttaagattgttagaaacatggagaagtaccagctggctgtgacaatcatggccatttcttgcgtccctaatgcggtgatcctcctgaacgcttggaaagtgagctgtacgattctcgccgtcgtttccgtgagccccctgcttctgacctcttcccaacagaagacagactggatccctctcgccctgaccatcaaagggctgaatcccacagctatttttcttaccacgctgagccggacatctaagaaacgctcctggccgctcaacgaagccgtgatggctgtcggaatggtgagcatcctggcctcttccctcctgaagaatgatattcctatgaccggcccccttgttgcgggcgggctgctgaccgtgtgctatgtcctcacaggaagaagcgccgacctggagcttgagcgggctgccgacgtgaaatgggaagatcaggctgagatctccggcagctctcctattctgagcatcaccatttccgaagacgggtctatgagcatcaagaacgaggaggaagaacagacactcacgatcctgattcgcaccggactcctggttatctccggcgtgttccccgtctctattccgatcacagccgccgcttggtacctttgggaagtgaagaaacaaagagcgggggtcctgtgggatgtgccttctccccctcccgttgagaaggccgaactggaggacggagcttatcggattaaacagcgcggcatcctcggctactcccagatcggggccggagtgtataaggagggcacctttcacacaatgtggcatgtcaccagaggggccgtgctgatgcaccggggaaaacgcattgaaccctcctgggctgatgttaagaaggaccttatcagctacggcgggggatggaaactggagggcgaatggaaggagggcgaagaggtgcaggtcctcgccctggagcctgggaaaaatccgagagcggtgcaaacgaagcccggactcttcaaaaccaacacaggcaccattggggctgtgtccctggattttagccctggaacatctggctcccccatcgttgaccggaaggggaaggtcgtgggactttacggcaatggcgtggtcaccagaagcggggcctatgtgtctgccattgctcagacagaaaaatccatcgaggataaccctgaaatcgaggacgatattttccgcaagaaacggctgacgatcatggacctgcatcccggagccggcaagaccaaaagatacctccctgcgattgttcgcgaagctatcaagcgggggctgagaacacttattctggccccgacccgcgtggtcgccgctgagatggaggaagccctccggggactgcccatcagatatcagacccctgctattcgcgccgagcacacaggccgggaaatcgtggatctcatgtgtcatgcgacgttcaccatgagactgcttagccccgttcgggtgcctaactacaatctgatcattatggacgaggcccactttacagaccccgcttccatcgccgctcgcgggtatatttctaccagagtcgagatgggcgaagccgccggaatcttcatgacagctaccccgcctggcagccgggatccctttccccagtccaacgcgcctattatggacgaggaacgcgagatccccgaaagaagctggaactctgggcacgagtgggtgacggatttcaagggaaaaacagtttggtttgtgccttccatcaaggccggcaacgacattgctgcctgcctgcggaaaaatgggaagaaagtcatccaactcagcagaaagaccttcgattctgagtacgtgaagacccgcgccaacgactgggattttgtggtcacaaccgacattagcgaaatgggagctaatttcaaagccgagcgggttatcgatccgagacgctgtatgaagcccgtgattctgacagacggcgaagaacgggtgatccttgcggggcctatgcccgtcacccattcctctgctgcccagagacgcggccgggtgggaagaaaccctaaaaatgaaaacgatcagtatatctacatgggcgagcccctggagaatgacgaagactgcgcccactggaaggaggctaaaatgctcctggataacattaatacgccggaagggatcattcctagcatgtttgagcccgaacgcgagaaggttgacgccatcgatggagagtacagactgcggggcgaagcgcgcaaaacattcgtggacctcatgagaagaggggatcttcctgtctggctggcctatcgcgtggctgccgagggaattaactacgctgacagacggtggtgttttgatggcatcaagaataaccaaattctggaagagaacgttgaggtggaaatctggaccaaggagggggaacgcaagaagctcaaaccccgctggctggacgcccggatctattccgatcctcttgctctgaaggagttcaaagagttcgccgcgggcagaaagtctctcacactgaatctgattaccgagatgggacgcctccccacgtttatgacccagaaggcccgggacgctcttgataacctggccgtcctgcatacagctgaggccggcgggagagcctacaatcacgctctcagcgaactgccggagacccttgaaacactgctcctgctgaccctccttgcgacagtgaccggaggcatcttcctgtttctgatgtccgggaaaggaattggcaagatgacgctcggcatgtgctgcatcattacagccagcatcctgctttggtatgctcagatccagcctcactggattgccgcctctatcattctggagttctttctcatcgtcctgctgattcccgaacccgagaaacaacggacccctcaggacaaccagctcacctacgtggttatcgctatccttacagtggtggccgcgaccatggccaatgagatggggttcctggaaaagacaaagaaggatctgggactcggctccattacgacccaggagagcgaatccaacatcctggacattgaccttcgcccggcttctgcctggacactgtatgctgtcgccaccacatttgttacccccatgctcagacatagcatcgagaatagctctgtgaacgtgagcctgacggcgattgccaatcaagctaccgtcctgatggggctcggaaagggctggcctctttccaaaatggatatcggggtgcccctgctggccattggatgttacagccaggttaaccctatcacactcaccgctgccctgcttctgctcgtggctcactacgccatcattggccccggcctgcaggcgaaggccacacgggaagctcagaaacgcgccgctgccgggatcatgaagaatcctaccgtcgacggaattacggtgatcgatctggagccgattccctatgaccctaaattcgagaagcaactcggccaggtcatgcttctgatcctgtgcgtgacacaggttctcatgatgagaaccacatgggccctgtgtgaagcgcttaccctggctaccgggcccatctctacactctgggagggaaaccctggccggttttggaatacgaccattgccgtgtccatggctaacatcttccgcgggagctacctggccggagccggcctgctcttttctattatgaagaatacaaccaacacaagacggggcaccgggaatatcggagaaacgcttggcgagaaatggaagtcccgcctgaacgctctggggaaaagcgagttccagatttataagaaatctggaatccaagaagtcgatagaacactcgccaaggagggcatcaaaagaggggaaaccgaccatcacgcggtgagcagaggatccgccaagctgcgctggtttgttgagcggaacatggtgacccccgaaggcaaggtcgtggatcttggctgcgggagaggaggctggtcttactattgtgggggactgaaaaatgtgcgcgaggttaagggcctcacaaaagggggaccgggccatgaggaacctattcccatgagcacctacggctggaacctggtccggctgcagtccggggtggacgtgttcttcacaccccctgagaagtgcgatacgctcctttgtgacatcggagaaagctcccccaatcctaccattgaggctggcagaacactgcgcgtcctgaacctcgttgaaaattggctgaacaataacacccagttttgcatcaaagtgcttaatccgtatatgccctctgtgattgagaagatggagacactgcaacggaagtacgggggagccctcgtcagaaaccctctgagccgcaattccacccacgaaatgtactgggtgtctaacgctacgggcaatatcgttagctccgtgaacatgatctctcggatgctgattaatagattcaccatgaaacacaagaaagccacatatgagctcgatgtcgaccttgggagcggaacccgcaacatcggcattgaatccgagacacccaacctggatatcattggcaagcggatcgagaagattaagcaggagcatgagaccagctggcactacgaccaggaccatccttataagacatgggcgtaccacgggtcttatgaaaccaaacagacgggatccgccagctctatggtgaatggcgttgtgagactgctcacaaagccctgggatgtcgtgccgatggtgacccaaatggctatgaccgacacaacgccttttgggcagcagcgcgtcttcaaagagaaggttgataccagaacacaggaacccaaagagggaaccaagaagctgatgcggatcacagccgagtggctttggaaagaactgggcaagaaaaagacccctcgcatgtgtacaagagaggaatttacccggaaagtgagatccaacgctgccctcggggctatcttcacggacgagaataagtggaaaagcgcccgggaagcggtggaggattctcgcttttgggagctggtcgacagagaacggaacctgcacctcgagggaaagtgcgaaacctgtgtgtacaatatgatgggcaagcgcgagaaaaagctgggcgagttcgggaaagccaagggatccagagctatttggtatatgtggcttggcgcccggtttctggagttcgaggctctcgggtttctgaacgaagatcattggttcagccgcggaaattcccttagcggcgttgagggggaaggcctgcacagactcggatacatcctgcgggacgtgtctaaaaaggagggcggggccatgtacgccgatgacacagcgggatgggatacccgcattacactggaagacctcaagaacgaggagatggtcaccaatcatatgaaaggcgaacacaagaaactggctgaggccatctttaaacttacgtatcaaaacaaagtggttagagtgcagcggcccacacctcgcgggaccgtcatggacattatcagcagacgggatcagcgcggatccggccaggtggggacatacggcctgaataccttcacgaacatggaagcccaactcatcagacagatggagggagagggcattttcaagtctatccagcatctgaccgttacagaagagattgctgtgcaaaattggcttgcccgggtcgggagagaacgcctgagccggatggctatctccggagacgattgcgtggtcaagcccctcgacgatagatttgcctctgcgctgaccgccctgaacgacatgggcaaagtgcgcaaggatattcagcagtgggagccgagccgggggtggaatgactggacacaggttcctttctgctcccaccactttcatgaactcgtgatgaaagatggaagagtcctggtggtgccctgtcgcaaccaagacgagcttatcggccgggctagaatctctcagggggccggctggagcctgaaggagaccgcttgcctcggaaaatcctatgcccagatgtggacactgatgtacttccaccgccgggatcttagactggcggccaacgctatttgtagcgccgttccctctcattgggtgcctacctcccgcacgacatggagcatccacgctaagcacgaatggatgaccaccgaggacatgctcgccgtctggaatcgggtgtggattcaggaaaacccgtggatggaggataagacacccgttgaatcttgggaggaggtgccttatctgggcaaaagagaagaccaatggtgcgggtccctgatcggactcaccagccgggctacatgggccaagaatattcagacggcgatcaaccaggtcagatccctgattggcaatgaggaatacaccgactatatgccctctatgaaacgctttcggagagaggaagaggaggccggggtgctttggtga

SEQ ID NO: 19549 - RNA, 9876 nt, synthetic construct
  misc_feature 1..9876: note = derived and/or modified CDS sequence (opt5) from DENV-2__JX669486__SS-prME
  source 1..9876: mol_type = other RNA
accgccggcgtgatcattatgctgatccccacagctatggccttccacctcacgaccagaaacggggagcctcatatgattgtcggacggcaggaaaagggcaaaagcctgctttttaagacagaggacggggttaatatgtgcaccctgatggcgatcgatctcggagaactgtgtgaggacacaattacctacaaatgcccgcttctgcgccaaaacgaacccgaggatatcgactgttggtgcaattccacatctacctgggtgacgtatggcacctgtacaaccacaggggagcacagacgggaaaagcgcagcgtggctctcgtccctcatgtgggaatgggcctggagaccagaacggaaacatggatgtcctctgagggcgcctggaaacacgttcagcggatcgagacctggattctgcgccatcccgggttcgccatcatggctgccattctcgcttacacaatcggaaccacccactttcagagagccctgattttcatccttctgacagcggtggcccctagcatgacgatgcggtgcattggcatctccaaccgcgattttgtcgaaggggtgtctggaggcagctgggttgacatcgtgctcgagcacgggtcctgtgtcaccacaatggctaagaataagcccaccctggatttcgaacttattaaaacagaggccaagcagcctgctaccctgagaaaatattgcatcgaagccaagctcacgaacacaaccaccgagagccggtgtccgacacaaggagagccctctctgaatgaagagcaggacaaacgctttatttgcaagcattccatggtggatagaggctggggcaacgggtgtggactgttcggcaaggggggaatcgtgacctgcgcgatgtttacatgcaaaaagaatatggaaggcaaagtcgttctccctgagaacctggaatacacgattgtgatcaccccccacagcggggaggagcatgccgtgggaaatgacacaggcaagcacggcgaagagatcaaaattacccctcagtcttccatcacagaagctgagcttaccgggtatggaacggtcaccatggaatgtagcccccggacaggcctggatttcaacgagatggtgctcctgcagatggaggaaaaggcctggcttgttcaccgccaatggtttctggacctcccgctgccttggctgcccggggctgatacccagggatctaattggattcagaaagagacactcgtgaccttcaagaaccctcatgccaagaaacaggacgtcgtggttctgggctcccaagaaggggccatgcacacggctcttacaggcgcgaccgagatccagatgagctccggaaatctgctctttacaggccatctgaagtgcagacttcggatggacaaactgcagctcaaggggatgtcttacagcatgtgtaccggaaaattcaagattgtgaaggagatcgccgaaacccaacacggcacaatcgtcattagagtgcagtatgagggggatggatccccctgcaaaatccccttcgaaattatggacctggagaagcgccatgtcctgggccggctcatcacggtgaaccctattgttaccgaaaaagatagcccggtgaacatcgaggctgagcccccttttggggactcttacattatcatcggcgtcgaacccggacagctgaagcttaattggttcaaaaagggctccagcattgggcagatgtttgagacaaccatgagaggagccaagcgcatggccatcctgggcgatacagcttgggacttcgggtctctcggaggcgtgtttaccagcattgggaaagccctgcaccaagttttcggcgcgatctacggagctgccttttccggcgtgtcttggacgatgaagattctgatcggggtcatcattacatggatcggaatgaacagccggtccaccagcctttctgtgtccctcgtgctggttggcgtcgtgaccctgtatctcggggccatggtgcaggctgatagcggatgtgtcgtgtcttggaaaaataaggaactgaaatgcggctccgggattttcatcacagacaacgttcacacctggacagagcagtacaagtttcagcctgaaagcccctccaagcttgcctctgctattcaaaaagcccatgaggagggcatctgtggaatcagaagcgtgacgcgcctggaaaatctcatgtggaagcagattaccccggagctgaaccacatcctgtccgaaaatgaggtcaaacttacaattatgaccggcgatatcaaggggattatgcaggcgggaaaacggtctctcagacctcagcccacagaactgaagtatagctggaaaacctggggcaaggccaagatgctgtccacggagagccataaccaaaccttcctcatcgacgggcctgagacagctgaatgccccaataccaaccgcgcctggaattctctggaggtggaagattacggatttggcgttttcacaaccaacatctggcttaaactgcgggagaagcaggacgtgttttgtgactccaaactcatgagcgctgccattaaggataatagagcggtccacgccgacatgggctattggatcgagtctgctctgaacgatacatggaaaatggaaaaggcctccttcattgaggtgaagagctgccactggcctaaatctcataccctgtggagcaatggggttcttgaatccgagatgatcattcccaagaacttcgctggaccggtgagccagcacaactaccgccctggctatcatacgcagacagccgggccctggcacctcggaaaactggaaatggactttgatttctgtgagggcaccaccgtcgtggtgacagaggactgcgggaatcggggaccctctctgagaaccacgacagcctccggcaagctcatcaccgaatggtgctgtcggagctgcacactgcctccgcttcgctacagaggcgaggatgggtgttggtacggaatggaaattcggcccctgaaagagaaggaagagaacctcgtcaattccctggttaccgctggccatgggcaaatcgacaacttttctctgggagtgcttggcatggcgctcttcctggaggaaatgctgagaacacgcgtggggaccaagcacgccatcctcctggtcgctgtgagctttgttacgcttattaccggaaatatgtccttccgggatctgggcagagtgatggtcatggtgggcgttacaatgaccgacgatatcgggatgggagtgacatatctcgccctgctggccgcttttaaagtccgccctaccttcgccgcgggccttctgctcagaaagctgacgtctaaagagctcatgatggctacaattgggatcaccctgcttagccagtccacaacccccgaaaccattctggagctcacagacgccctggccctgggaatgatggtgcttaagatcgttcggaacatggaaaaataccagctggctgtgacgatcatgaccattctctgcgtccctaatgccgtgatcctgctcaacgcgtggaaggtgtcttgtacaattctggctgtcgttagcgtgtccccccttctgctcaccagctctcaacagaagacagattggatccctctggccctgaccattaaaggccttaatcccacggccatctttctgacaaccctctcccgcaccagcaagaaaagatcttggccgctgaacgaggctgtgatggccgtcgggatggtgtccatcctcgctagctctctgcttaagaatgacattcctatgacaggacccctggttgccggcggcctgctcaccgtgtgctatgtcctgacagggcggtccgcggaccttgagctggaacgcgccgctgatgtgaaatgggaggaccaggccgaaatcagcggatccagccctattctctctatcacgattagcgaggatggctccatgtctatcaagaacgaggaagaggaacagaccctgacaattctcatcagaaccgggctgcttgttatcagcggagtgttccccgtctccattccgatcacagctgccgcctggtacctgtgggaggtgaaaaagcaacgggctggcgtcctgtgggacgtgccttctccccctcccgttgaaaaggcggagctcgaggatggggcctatcgcattaaacagagaggaatcctgggctacagccagattggcgctggggtgtataaggaaggaacctttcacacgatgtggcatgtcacccggggcgccgtgcttatgcaccgcgggaaaagaatcgagccctcctgggccgacgttaagaaagatctgatctcttacggaggcgggtggaagctcgaaggagagtggaaggaaggcgaggaggtgcaggtcctggctctcgaacctggcaaaaatccgcgggccgtgcaaacaaagcccgggctgttcaaaaccaacacaggaaccattggcgcggtgagccttgacttttcccctgggacaagcggatctcccatcgttgatagaaagggcaaagtcgtggggctgtacggaaatggcgtggtcacgcgctccggcgcttatgtgagcgccattgcccagaccgagaagtctatcgaagacaaccctgagattgaagatgacatcttccggaagaaaagactgacaatcatggatctccatcccggggctggaaagaccaaacgctacctgcctgccattgttcgggaggcgatcaagagaggccttcgcaccctgattctcgctccgacacgggtggtcgccgccgagatggaagaggctctgagagggctccccatccgctatcagacgcctgccattcgggctgaacacaccggaagagagatcgtggacctgatgtgtcatgccacattcaccatgcggcttctgtcccccgttcgcgtgcctaactacaatctgattatcatggacgaggcgcactttacagatcccgccagcatcgctgccagaggctatatttccacccgggtcgaaatgggggaggctgccggcatcttcatgacggccacaccgcctggatctcgcgacccctttccccagagcaacgctcctattatggatgaagagagagaaatccccgagcggtcctggaatagcggccacgagtgggtgaccgacttcaaagggaagaccgtttggtttgtgccttctattaaggcgggaaacgatatcgccgcttgcctcagaaaaaatggcaagaaagtcatccaactgtcccgcaagacattcgacagcgaatacgtgaaaacccgggccaacgattgggactttgtggtcacaaccgatatttctgagatgggggccaatttcagagctgaacgcgttatcgacccgcggagatgtatgaagcccgtgattcttacggatggagaggaacgcgtgatcctggccggccctatgcccgtcacacatagctccgcggctcagcggagagggcgcgtgggcagaaaccctaagaatgagaacgaccagtatatttacatgggagagcccctcgaaaatgacgaggattgcgcccactggaaagaagccaagatgctgctggacaacatcaataccccggagggcatcattccttctatgtttgaacccgagcgggagaaagttgatgctatcgacggggaataccgcctcagaggagaggcccggaagacattcgtggatcttatgcgcagaggcgacctgcctgtctggctggcgtatcgggtggccgctgaagggattaactacgccgatagacgctggtgttttgacggaatcaaaaataaccaaattctcgaggagaacgttgaagtggagatctggaccaaggaaggcgagcggaaaaagctgaagcccagatggcttgatgctcgcatttatagcgaccctctggccctcaaagaattcaaggagttcgctgccgggcggaaatccctgacgctgaatctcatcaccgagatgggcagacttcccacatttatgacccagaaggcgcggaacgccctggataatctggctgtcctccatacagccgaagctggaggccgcgcctacaaccacgccctgtctgagcttccggaaaccctggagacactcctgctgctcacccttctggctacggtgacagggggaatcttcctgtttctcatgagcggcaaagggattggaaagatgaccctgggcatgtgctgcatcattaccgcgtccgtccttctgtggtatgcccagatccagcctcactggattgctgccagcatcatcctcgaattctttctgattgtgctgctcatccccgagcccgagaagcaaagaacacctcaggacaatcagcttacctacgttgtgattgccatcctgacagtggtcgctgccacgatggcgaacgaaatgggcttcctggagaaaaccaagaaagatctcgggctgggatctattacaacccaggaatccgagagcaatatccttgacatcgacctgcggccggcctccgcttggacactctatgccgttgctaccacgtttgtgacccccatgctgcgccattctattgaaaacagctccgtgaatgtctctctgacagccatcgcgaaccaagccaccgtgctcatgggccttgggaagggatggcctctgagcaaaatggatattggcgttcccctgctcgctatcgggtgttactcccaggtgaatcctattacactgaccgccgctcttctgctcctggtcgcccactacgctatcattggacccggcctgcaggccaaggcgacgagagaggcccagaagcgggctgccgctggcatcatgaaaaaccctacagtggacgggatcaccgtcgtggatctcgagccgattccctatgaccctaagttcgaaaaacaacttggacaggttatgctgctgatcctctgcgtgacacaggtcctgatgatgcgcaccacctgggccctttgtgaggccctgacactcgcgacgggccccattagcaccctgtgggaagggaatcctggaagattttggaacacaaccatcgctgtgtctatggccaatattttccggggctcctacctggctggggccggactcctttttagcatcatgaagaacacaaccaatacgcgcagaggcacaggcaacatcggggagaccctgggagagaaatggaagtctcggctgaacgccctcggcaagtccgaattccagatttataaaagaagcgggatccaagaggttgatcgcaccctggctaaggaaggaattaaacggggcgagacagaccatcacgccgtgtctagagggagcgcgaagcttcgctggtttgtcgaacggaatatggtgacccccgagggaaaagtggttgatctgggctgcggcagagggggatggtcctactattgtggcgggctcaagaacgtccgcgaggtgaaaggactgacaaagggcgggccgggacatgaagagcctatccccatgtctacgtacggctggaatctggtgcggctccagagcggcgtcgacgttttcttcaccccccctgaaaagtgcgatacacttctgtgtgacattggggagtccagccccaaccctaccatcgaagccggaagaacactgcgcgtgctcaatctggtggagaactggcttaataacaatacccagttttgcatcaaagtcctgaacccgtatatgccctccgtgattgagaagatggaaacgctccaacggaaatacggcggggctctggttagaaatcctctgtctcgcaacagcacccacgagatgtactgggtgtccaatgccacaggaaacatcgtctctagcgtgaatatgatttcccggatgctcatcaacagattcaccatgaagcacaaaaaggctacatatgaacccgatgttgaccttggctctgggacccgcaacattggaatcgagagcgaaatccctaatctggatattatcggcaagagaattgagaaaatcaagcaggagcatgaaacatcctggcactacgaccaggaccatccctataaaacctgggcctaccacggcagctatgagacgaagcagacagggtctgcgtccagcatggtgaacggagtcgtgcggctgctcaccaaaccgtgggatgtggtccctatggttacccaaatggccatgacagacacgaccccctttggccagcagcgcgtgttcaaggaaaaggtggatacaagaacccaggagcctaaagaggggacaaagaaactgatgcggattaccgctgaatggctttggaaggagctgggaaaaaagaagacacccagaatgtgtacccgggaagagtttacgcgcaaagtcagatctaatgccgctctcggcgccatcttcaccgacgaaaacaagtggaaatccgctcgggaggccgtggaggatagccgcttttgggaactggttgacagagagcggaatctgcacctcgaagggaagtgcgagacatgtgtgtacaacatgatgggaaaacgcgaaaagaaactgggcgagttcggcaaggcgaaggggtctagagccatttggtatatgtggcttggagctcggtttctggagttcgaagccctcggctttctgaatgaggatcattggttctcccgcgggaacagcctttccggagtcgaaggcgaggggctgcacagactcggctacatcctgcgggacgtgagcaaaaaggaaggaggcgctatgtacgccgatgacaccgccgggtgggatacacgcatcaccctggaggacctcaaaaatgaggaaatggttacgaaccatatgaagggagagcacaaaaagctggcggaagctgtgtttaagcttacatatcaaaataaagtcgtgagagttcagcggcctaccccccgcggcacagtgatggacattatctctagacgggatcagagagggagcggacaggtcggcacctacgggctgaacacgttcaccaatatggaggcccaactcattcgccagatggagggcgaaggaatcttcaagtccattcagcatctgacagtgaccgaggaaatcgccgtccaaaactggcttgctcgggtgggcagagagcgcctgtctcggatggccatcagcggggacgattgcgttgtgaaaccgctcgacgatagatttgcttccgccctgacagcgctgaatgacatgggaaaggtccgcaaagatattcagcagtgggaaccttctcggggctggaacgactggacccaggtgcccttctgcagccaccactttcatgagctcgtgatgaaggatgggagagttctggtggtcccctgtcgcaaccaagacgagcttatcggacgggccagaatttcccagggcgctgggtggtctctgaaggaaacagcctgcctcggcaaaagctatgctcagatgtggaccctgatgtacttccaccgccgggatcttagactggccgcgaatgccatctgttccgctgtgcctagccattgggttccgacgtctcggacaacctggtccattcacgccaagcacgagtggatgaccacagaagacatgctcgctgtgtggaacagagtctggatccaggagaatccctggatggaagataaaacccctgtggagagctgggaggaagtcccctatctgggaaagcgcgaggaccaatggtgcggctctctgatcgggctcacatcccgggccacgtgggctaaaaacattcagaccgccatcaatcaggtgagaagcctgattggaaacgaagagtacacagactatatgccttccatgaagcgctttagacgggaagaggaggaagcgggcgttctttggtga

SEQ ID NO: 19550 - RNA, 9876 nt, synthetic construct
  misc_feature 1..9876: note = derived and/or modified CDS sequence (opt5) from DENV-2__JX669487__SS-prME
  source 1..9876: mol_type = other RNA
accgcgggagtgatcattatgctgatccccaccgctatggccttccacctcacgaccagaaatggggagcctcatatgattgttggacggcaggaaaagggcaaaagcctgctttttaagacagaggacggggttaatatgtgcaccctgatggcgatcgatctcggagaactgtgtgaggacaccattacctacaaatgcccgcttctgcgccaaaatgaacccgaggatatcgactgttggtgcaattccacatctacctgggtgacgtatggcacctgtacaaccacaggggagcacagacgggaaaagcgcagcgtggctctcgtccctcatgtgggaatgggcctggagaccagaacggaaacatggatgtcctctgagggcgcctggaaacacgttcagcggatcgagacctggattctgcgccatcccgggttcgccatcatggctgccattctcgcttacacaatcggaaccacccactttcagagagccctgattttcatccttctgacagcggtggcccctagcatgacgatgcggtgcattggcatctccaaccgcgattttgtcgaaggggtgtctggaggcagctgggttgacatcgtgctcgagcacgggtcctgtgtcaccacaatggctaagaataagcccaccctggatttcgaacttattaaaacagaggccaagcagcctgctaccctgagaaaatattgcatcgaagccaagctcacgaacacaaccaccgagagccggtgtccgacacaaggagagccctctctgaatgaagaacaggacaaacgctttatttgcaagcattccatggtggatagaggctggggcaacgggtgtggactgttcggcaaaggcgggatcgtgacctgcgcgatgtttacatgcaaaaagaatatggaagggaaagtcgttctccctgagaacctggaatacacgattatgatcacaccccacagcggggaggagcatgccgtgggaaatgacacaggcaagcacggcaaagaaatcaagattacccctcagtcttccatcacagaggctgaacttaccgggtatggaacggtgaccatggagtgtagcccccggacaggcctggatttcaacgaaatggtcctcctgcagatggaggagaaagcctggcttgtgcaccgccaatggtttctggacctcccgctgccttggctgcccggggctgatacccagggatctaattggattcagaaggaaacactcgttaccttcaagaaccctcatgccaaaaagcaggacgtggtcgtgctgggctcccaagagggggccatgcacacggctcttacaggcgcgaccgaaatccagatgagctccggaaatctgctctttacaggccatctgaaatgcagacttcggatggacaagctgcagctcaaagggatgtcttacagcatgtgtaccggaaagttcaagattgttaaagagatcgccgagacccaacacggcacaatcgtgattagagtccagtatgaaggggatggatccccctgcaagatccccttcgagattatggacctggaaaaacgccatgtgctgggccggctcatcacggtcaaccctattgtgaccgagaaggatagcccggttaacatcgaagctgagcccccttttggggactcttacattatcatcggcgtggagcccggacagctgaaacttaattggttcaagaagggctccagcattgggcagatgtttgaaacaaccatgagaggagccaaacgcatggccatcctgggcgatacagcttgggacttcgggtctctcggaggcgtctttaccagcattgggaaggccctgcaccaagtgttcggcgcgatctacggagctgccttttccggcgtttcttggacgatgaaaattctgatcggggtgatcattacatggatcggaatgaacagccggtccaccagcctttctgtctccctcgtgctggtgggcgttgtcaccctgtatctcggggccatggtgcaggctgatagcggatgtgtggtctcttggaagaataaagagctgaagtgcggctccgggattttcatcacagacaacgtgcacacctggacagaacagtacaagtttcagcctgagagcccctccaaacttgcctctgctattcaaaaggcccatgaagagggcatctgtggaatcagaagcgttacgcgcctggagaatctcatgtggaaacagattaccccggaactgaaccacatcctgtccgagaatgaagtgaaacttacaattatgaccggcgatatcaaagggattatgcaggcgggaaagcggtctctcagacctcagcccacagagctgaaatatagctggaagacctggggcaaggccaaaatgctgtccacggaaagccataaccaaaccttcctcatcgacgggcctgagacagctgagtgccccaataccaaccgcgcctggaactctctggaagtcgaggattacggatttggcgtgttcacaaccaacatctggcttaagctgcgggaaaaacaggacgtcttttgtgactccaagctcatgagcgctgccattaaagataatagagcggtgcacgccgacatgggctattggatcgagtctgctctgaacgatacatggaagatggagaaggcctccttcattgaagtcaaaagctgccactggcctaagtctcataccctgtggagcaatggggtgcttgagtccgaaatgatcattcccaaaaacttcgctggaccggttagccagcacaactaccgccctggctatcatacgcagacagccgggccctggcacctcggaaagctggagatggactttgatttctgtgaaggcaccaccgtggtcgtgacagaggactgcgggaatcggggaccctctctgagaaccacgacagcctccggcaaactcatcaccgagtggtgctgtcggagctgcacactgcctccgcttcgctacagaggcgaagatgggtgttggtacggaatggagattcggcccctgaaggaaaaggaggaaaacctcgtgaatagcctggtcaccgctggccatgggcaaatcgacaacttttctctgggagttcttggcatggccctcttcctggaggagatgctgagaacacgcgtggggaccaaacacgccatcctcctggtggctgtcagctttgtgacgcttattaccggaaatatgtccttccgggatctgggcagagttatggtgatggtcggcgtgacaatgaccgacgatatcgggatgggagttacatatctcgccctgctggccgcttttaaggtgcgccctaccttcgccgcgggccttctgctcagaaaactgacgtctaaggaactcatgatggctacaattgggatcgccctgcttagccagtccaccattcccgagacaatcctggaactcaccgacgccctggctctgggaatgatggtccttcggatcgtgcgcaacatggagaaataccagctggccgttaccattatggcgatctcttgcgtgcctaatgctgtcattctcctgaacgcctggaaggtgagctgtacaatcctcgccgctgtgtccgtcagccccctgcttctgacgtcttcccaacagaagaccgattggattcctctcgccctgacaatcaaaggcctgaatcccaccgctatctttcttacaaccctgagcagaacgtctaagaaacggtcctggccgctcaacgaagccgttatggcggtggggatggtgagcattctggcctcttccctcctgaagaatgacatccctatgacaggaccccttgtcgctggcggcctgctgaccgtgtgctatgttctcaccgggcgcagcgccgacctggagcttgagagagctgccgatgtgaaatgggaagaccaggccgagatttccggaagctctcctatcctgagcattacaatctccgaagatggctctatgagcattaagaacgaggaggaagaacagaccctcacaatcctgatccggacggggctcctggtcatttccggagtgttccccgtttctatcccgattaccgctgcggcctggtacctttgggaagtgaaaaagcaacgcgctggcgtcctgtgggacgtgccttctccccctcccgtcgagaaggccgaactggaggatggggcctatagaatcaaacagcggggcattctcggctactcccagatcggcgctggggtgtataaggagggaacatttcacaccatgtggcatgttacacgcggcgccgtgctgatgcacagagggaaacggatcgaaccctcctgggcggacgtcaagaaagatcttattagctacggaggcgggtggaagctggagggagaatggaaggagggcgaagaggtgcaggttctcgctctggagcctggcaaaaatccgagagccgtgcaaaccaagcccggactcttcaaaacgaacaccggaacaatcggcgccatttccctggactttagccctgggacctctggatcccccatcgtcgatcgcaagggcaaagtggtggggctttacggaaatggcgttgtcacacggagcggcgcttatgtgtctgccattgcgcagaccgaaaagtccatcgaggacaaccctgaaatcgaggatgacattttcagaaagaaacgcctgacaatcatggatctgcatcccggggctggaaagacgaaacggtacctccctgccattgtgagagaagccatcaagcgcggcctgcggacccttattctggctccgacaagagtcgtggccgctgagatggaggaagccctccgcgggctgcccatccggtatcagacccctgcgattagagccgagcacaccggacgggaaatcgttgacctcatgtgtcatgctacattcacgatgcgcctgcttagccccgtgagagtccctaactacaatctgatcattatggacgaggcccactttaccgatcccgcttccatcgccgcccggggctatatttctacacgcgtggagatgggggaagctgcgggcatcttcatgaccgccacaccgcctggaagcagagacccctttccccagtccaacgctcctattatggatgaggaacgggagatccccgaaagaagctggaactctggccacgagtgggttaccgacttcaaagggaagacggtgtggtttgtcccttccatcaaggccggaaacgatattgccgcttgcctgcgcaaaaatggcaagaaagtgatccaactcagccggaagacattcgactctgagtacgttaaaaccagagccaacgattgggactttgtggtcaccacagatattagcgaaatgggggcgaatttccgcgctgagcgggtgatcgacccgagacgctgtatgaagcccgtgattctgaccgatggagaagaacgggtcatccttgccggccctatgcccgttacacattcctctgccgctcagagacgcgggagaatcggccggaaccctaagaatgaaaacgaccagtatatttacatgggagagcccctggagaatgacgaagattgcgcccactggaaagaggcgaagatgctcctggacaacatcaataccccggaaggcattatccctagcatgtttgagcccgaacgcgagaaagtggatgccattgacggggagtacagactgcggggagaagctcgcaagacgttcgtggatctcatgagacggggcgaccttcctgtctggctggcctatagagtggctgccgaggggatcaactacgctgatcgccggtggtgttttgacggaattaaaaataaccaaatcctggaagagaacgttgaggtggaaatctggacaaaggagggcgaacgcaagaagctcaagccccgctggctggatgcccggatttattccgaccctcttgcgctgaaagagttcaaggagttcgccgctgggagaaaatctctcaccctgaatctgatcacagagatgggccggctccccacctttatgacgcagaaggcccgcgatgctcttgacaacctggccgtcctgcataccgccgaggctggaggcagagcgtacaaacacgccctcagcgaactgccggagacacttgaaaccctgctcctgctgacactccttgctaccgtgacagggggaattttcctgtttctgatgtccggcaaggggatcggaaagatgaccctcggcatgtgctgcattatcacggccagcatcctgctttggtatgcccagattcagcctcactggatcgctgcctctattatcctggagttctttctcattgttctgctgatccccgaacccgagaaacaacggacacctcaggataatcagctcacctacgtggtcatcgcgattcttaccgtggtcgccgctacaatggccaacgagatgggcttcctggaaaagaccaaaaaggacctggggctcggatccatcacaacgcaggagagcgaatccaatattctggacatcgatcttcgcccggcttctgcctggaccctgtatgcggtggccacaacctttgttacacccatgctcagacatagcattgagaactcctctgtgaatgtgagcctgaccgctatcgccaaccaagctacggtcctgatgggcctcgggaaaggatggcctctttccaagatggacattggcgttcccctgctggccatcgggtgttacagccaggtgaatcctatcaccctcacagctgccctgcttctgctcgtggcgcactacgccattatcggacccggcctgcaggctaaggccacccgggaagctcagaaacgcgccgccgcgggcattatgaagaaccctacagtcgatgggatcaccgtgattgacctggagccgatcccctatgatcctaaattcgagaagcaactcggacaggttatgcttctgatcctgtgcgtgacgcaggtcctcatgatgagaacaacctgggctctgtgtgaagcccttacactggctaccggccccatttctaccctctgggaggggaatcctggacggttttggaacacaacgatcgccgtgtccatggccaatattttccgcggcagctacctggctggggccggactgctcttttctatcatgaaaaacaccacaaataccagacggggcacaggcaacattggggaaacccttggagagaagtggaagtccagactgaatgcgctgggcaaaagcgagttccagatctataagaaatctgggatccaagaagtcgaccgcacgctcgccaaggagggaattaaacggggcgaaacagatcatcacgctgtgagcagagggtccgccaagctgcgctggtttgttgagcggaacatggtgacccccgaaggaaaagtcgtggaccttggctgcggcagagggggatggtcttactattgtggcgggctgaagaacgttcgcgaggtgaagggactcaccaaaggcgggccgggacatgaggaacctatccccatgagcacatacggctggaatctggtccggctgcagtccggcgtggatgtgttcttcacaccccctgagaagtgcgacacactcctttgtgatattggggaaagctcccccaaccctacgatcgaggctggaagaaccctgcgcgttctgaatctcgccgaaaactggctgaataacaatacacagttttgcattaaagtccttaacccgtatatgccctctgtgatcgagaagatggagaccctgcaacggaaatacggcggggcgctcgtgagaaatcctctgagccgcaactccacacacgaaatgtactgggtctctaatgccaccggaaacatcgttagctccgtgaatatgatttctcggatgctgatcaacagattcacgatgaagcacaagaaagctacctatgagcccgacgtggatctcggcagcgggacacgcaatattggaatcgaatccgagattcctaaccttgacatcattggcaagagaatcgagaagatcaagcaggagcatgagaccagctggcactacgaccaggatcatccctataaaacatgggcctaccacggctcttatgaaaccaagcagacagggtccgctagctctatggtcaacggagtggttcggctgctgaccaagccgtgggacgtggtccctatggtgacgcaaatggccatgacagataccaccccctttggccagcagcgcgttttcaaagagaaggtggacacaagaacgcaggaacctaaagaggggaccaagaaactcatgcggattacagctgagtggctgtggaaggaacttggaaagaaaaagacccccagaatgtgtacacgggaggaatttacccgcaaagtcagatccaatgccgcgctgggcgccatcttcacagatgagaacaagtggaaaagcgctcgggaagccgtggaggactctcgcttttgggagctcgtggatagagaacggaatctgcacctggaggggaagtgcgaaacctgtgtctacaacatgatgggaaaacgcgagaagaagctcggcgagttcggcaaagctaaggggtccagagccatttggtatatgtggctgggagcccggtttcttgagttcgaggcgctgggctttctcaatgaagaccattggttcagccgcgggaactccctgagcggagttgagggcgaagggcttcacagactgggctacatcctccgggatgtgtctaaaaaggagggaggcgctatgtacgccgacgatacggccgggtgggacacccgcattacactggaagacctgaaaaatgaggagatggtgaccaaccatatgaagggagaacacaagaaactcgctgaggccatctttaagctgacatatcaaaataaagtcgtgagagttcagcggcctacccccagaggcacggtgatggatatcattagcagaaaggaccagcgggggtccggacaggtcggcacatacgggcttaacaccttcacaaatatggaagctcaactgatcagacagatggagggcgagggaattttcaaatctatccagcatctcaccgtgacggaagagattgccgttcaaaactggctggcgcgcgtgggccgggaaagacttagccgcatggccatctccggggatgactgcgtcgtgaagccgctggatgaccggtttgcttctgccctcaccgctctgaatgatatgggaaaggttagaaaagacatccagcagtgggagcctagccgcggctggaacgattggacacaggtgcccttctgctcccaccactttcatgaactggtcatgaaggacgggcgggtgctcgtcgtgccctgtagaaatcaagatgagctgattggacgcgcccggatctctcagggcgcggggtggagccttaaagagaccgcctgcctgggcaagtcctatgctcagatgtggacactcatgtacttccacagacgcgacctgcggcttgccgctaacgccatttgtagcgctgttccttctcattgggtgccgacctccagaacaacctggagcatccacgccaaacacgaatggatgacgacagaggatatgctggcggtctggaaccgggtgtggattcaggaaaatccctggatggaggacaagacccctgtggaatcttgggaggaggttccctatctcggaaagagagaagaccaatggtgcggctccctgatcgggctgaccagccgcgccacatgggctaaaaacattcagaccgccatcaatcaggtgcggtccctcatcggaaacgaggaatacacagattatatgccttctatgaagagatttcgcagagaggaagaggaggccggcgtcctgtggtga

SEQ ID NO: 19551 - RNA, 9876 nt, synthetic construct
  misc_feature 1..9876: note = derived and/or modified CDS sequence (opt5) from DENV-2__JX669488__SS-prME
  source 1..9876: mol_type = other RNA
accgcgggagtgatcattatgctgatccccaccgctatggccttccacctcacgaccagaaatggggagcctcatatgattgtcggacggcaggaaaagggaaagagcctgctttttaagacggaggacggggttaatatgtgcaccctgatggcgatcgatctcggagaactgtgtgaggacacaattacctacaaatgcccgcttctgcgccaaaatgaacccgaggatatcgactgttggtgcaatagcacatctacctgggtgacgtatggcacctgtacaaccacaggggagcacagacgggaaaagcgcagcgtggctctcgtccctcatgtgggaatgggcctggagaccagaacggaaacatggatgtcctctgagggcgcctggaaacacgttcagcggatcgagacctggattctgcgccatcccgggttcgccatcatggctgccattctcgcttacacaatcggaaccacccactttcagagagccctgattttcatccttctgacagcggtggcccctagcatgacgatgcggtgcattggcatctccaaccgcgattttgtcgaaggggtgtctggaggcagctgggttgacatcgtgctcgagcacgggtcctgtgtcaccacaatggctaagaataagcccaccctggatttcgaacttattaaaacagaggccaagcagcctgctaccctgagaaaatattgcatcgaagccaagctcacgaacacaaccaccgagagccggtgtccgacacaaggagagccctctctgaatgaagaacaggacaaacgctttatttgcaagcattccatggtggatagaggctggggcaacgggtgtggactgttcggcaaaggagggatcgtgacctgcgcgatgtttacatgcaaaaagaatatggaaggcaaagtcgttctccctgagaacctggaatacacgattgtgatcacaccccacagcggggaggagcatgccgtgggaaatgacacaggcaagcacggcaaagaaatcaagattacccctcagtcttccatcacagaggctgaacttaccgggtatggaacggtcaccatggagtgtagcccccggacaggcctggatttcaacgaaatggtgctcctgcagatggaggagaaagcctggcttgttcaccgccaatggtttctggacctcccgctgccttggctgcccggggctgatacccagggatctaattggattcagaaggaaacactcgtgaccttcaagaaccctcatgccaaaaagcaggacgtcgtggttctgggctcccaagagggggccatgcacacggctcttacaggcgcgaccgaaatccagatgagctccggaaatctgctctttacaggccatctgaaatgcagacttcggatggacaagctgcagctcaaagggatgtcttacagcatgtgtaccggaaagttcaagattgtgaaagagatcgccgagacccaacacggcacaatcgtcattagagtgcagtatgaaggggatggatccccctgcaagatccccttcgagattatggacctggaaaaacgccatgtcctgggccggctcatcacggtgaaccctattgttaccgagaaggatagcccggtgaacatcgaagctgagcccccttttggggactcttacattatcatcggcgtcgagcccggacagctgaaacttaattggttcaagaagggctccagcattgggcagatgtttgaaacaaccatgagaggagccaaacgcatggccatcctgggcgatacagcttgggacttcgggtctctcggaggcgtgtttaccagcattgggaaggccctgcaccaagttttcggcgcgatctacggagctgccttttccggcgtgtcttggacgatgaaaattctgatcggggtcatcattacatggatcggaatgaacagccggtccaccagcctttctgtgtccctcgtgctggttggcgtcgtgaccctgtatctcggggccatggtgcaggctgatagcggatgtgtcgtgtcttggaagaataaagagctgaagtgcggctccgggattttcatcacagacaacgttcacacctggacagaacagtacaagtttcagcctgagagcccctccaaacttgcctctgctattcaaaaggcccatgaagagggcatctgtggaatcagaagcgtgacgcgcctggagaatctcatgtggaaacagattaccccggaactgaaccacatcctgtccgagaatgaagtcaaacttacaattatgaccggcgatatcaaagggattatgcaggcgggaaagcggtctctcagacctcagcccacagagctgaaatatagctggaagacctggggcaaggccaaaatgctgtccacggaaagccataaccaaaccttcctcatcgacgggcctgagacagctgagtgccccaataccaaccgcgcctggaactctctggaagtggaggattacggatttggcgttttcacaaccaacatctggcttaagctgcgggaaaaacaggacgtgttttgtgactccaagctcatgagcgctgccattaaagataatagagcggtccacgccgacatgggctattggatcgagtctgctctgaacgatacatggaagatggagaaggcctccttcattgaagtgaaaagctgccactggcctaagtctcataccctgtggagcaatggggttcttgagtccgaaatgatcattcccaaaaacttcgctggaccggtgagccagcacaactaccgccctggctatcatacgcagacagccgggccctggcacctcggaaagctggagatggactttgatttctgtgaaggcaccaccgtcgtggtgacagaggactgcgggaatcggggaccctctctgagaaccacgacagcctccggcaaactcatcaccgagtggtgctgtcggagctgcacactgcctccgcttcgctacagaggcgaagatgggtgttggtacggaatggagattcggcccctgaaggaaaaggaggaaaacctcgtcaattccctggttaccgctggccatgggcaaatcgacaacttttctctgggagtgcttggcatggccctcttcctggaggagatgctgagaacacgcgtggggaccaaacacgccatcctcctggtcgctgccagctttgtgacgcttattaccggaaatatgtccttccgggatctgggcagagttatggtgatggtcggcgccacaatgaccgacgatatcgggatgggagtgacatatctcgctctgctggccgcgtttaaggttcgccctaccttcgctgccggccttctgctcagaaaactgacgtctaaggaactcatgatggccacaattgggatcgctctgcttagccagtccaccattcccgagacaatcctggaactcaccgacgccctggcgctgggaatgatggtgcttcggatcgtccgcaacatggagaaataccagctggctgtgaccattatggccatctcttgcgttcctaatgccgtgattctcctgaacgcttggaaggtcagctgtacaatcctcgccgctgtgtccgtgagccccctgcttctgacgtcttcccaacagaagaccgattggattcctctcgccctgacaatcaaaggcctgaatcccaccgcgatctttcttacaaccctgagcagaacgtctaagaaacggtcctggccgctcaacgaagccgtcatggctgttgggatggtgagcattctggcctcttccctcctgaagaatgacatccctatgacaggaccccttgtggctggcggcctgctgaccgtctgctatgtgctcaccgggcgcagcgccgacctggagcttgagagagccgctgatgttaaatgggaagaccaggcggagatttccggaagctctcctatcctgagcattacaatctccgaagatggctctatgagcattaagaacgaggaggaagaacagaccctcacaatcctgatccggacggggctcctggtgatttccggagtcttccccgtgtctatcccgattaccgccgctgcctggtacctttgggaagttaaaaagcaacgcgccggcgtgctgtgggacgtcccttctccccctcccgtggagaaggctgaactggaggatggggcctatagaatcaaacagcggggcattctcggctactcccagatcggcgcgggggtctataaggagggaacatttcacaccatgtggcatgtgacacgcggcgctgttctgatgcacagagggaaacggatcgaaccctcctgggccgacgtgaagaaagatcttattagctacggaggcgggtggaagctggagggagaatggaaggagggcgaagaggtccaggtgctcgccctggagcctggcaaaaatccgagagctgttcaaaccaagcccggactcttcaaaacgaacaccggaacaatcggcgccatttccctggactttagccctgggacctctggatcccccatcgtggatcgcaagggcaaagtcgtggggctttacggaaatggcgtggttacacggagcggcgcgtatgtctctgctattgcccagaccgaaaagtccatcgaggacaaccctgaaatcgaggatgacattttcagaaagaaacgcctgacaatcatggatctgcatcccggggccggaaagacgaaacggtacctccctgctattgtgagagaagccatcaagcgcggcctgcggacccttattctggctccgacaagagtggtcgccgcggagatggaggaagccctccgcgggctgcccatccggtatcagacccctgctattagagccgagcacaccggacgggaaatcgtggacctcatgtgtcatgctacattcacgatgcgcctgcttagccccgttagagtgcctaactacaatctgatcattatggacgaggcccactttaccgatcccgcctccatcgctgcgcggggctatatttctacacgcgtcgagatgggggaagccgctggcatcttcatgaccgccacaccgcctggaagcagagacccctttccccagtccaacgcccctattatggatgaggaacgggagatccccgaaagaagctggaactctggccacgagtgggtgaccgacttcaaagggaagacggtttggtttgtgccttccatcaaggctggaaacgatattgccgcgtgcctgcgcaaaaatggcaagaaagtcatccaactcagccggaagacattcgactctgagtacgtgaaaaccagagctaacgattgggactttgttgtgaccacagatattagcgaaatgggggccaatttccgcgccgagcgggtcatcgacccgagacgctgtatgaagcccgtgattctgaccgatggagaagaacgggtgatccttgctggccctatgcccgtcacacattcctctgccgcgcagagacgcgggagaatcggccggaaccctaagaatgaaaacgaccagtatatttacatgggagagcccctggagaatgacgaagattgcgcccactggaaagaggctaagatgctcctggacaacatcaataccccggaaggcattatccctagcatgtttgagcccgaacgcgagaaagttgatgccattgacggggagtacagactgcggggagaagctcgcaagacgttcgtggatctcatgagacggggcgaccttcctgtgtggctggcctataaagtcgctgccgaggggatcaactacgcggatagacgctggtgttttgacggaattaagaataaccaaatcctggaagagaacgtggaggttgaaatctggacaaaagagggcgaacggaagaagctcaaacccagatggctggatgcccgcatttattccgaccctcttgctctgaaggagttcaaagagttcgccgctgggcggaagtctctcaccctgaatctgatcacagagatgggcagactccccacctttatgacgcagaaagcccgggatgcccttgacaacctggctgtgctgcataccgcggaggccggaggccgcgcttacaagcacgccctcagcgaactgccggagacacttgaaaccctgctcctgctgacactccttgccaccgtcacagggggaattttcctgtttctgatgtccggcaaggggatcggaaaaatgaccctcggcatgtgctgcattatcacggctagcatcctgctttggtatgcccagattcagcctcactggatcgcggcctctattatcctggagttctttctcattgtgctgctgatccccgaacccgagaagcaaagaacacctcaggataatcagctcacctacgttgtgatcgctattcttaccgtcgtggccgctacaatggccaacgagatgggcttcctggagaagaccaagaaagacctggggctcggatccatcacaacgcaggagagcgaatccaatattctggacatcgatcttcggccggcgtctgcctggaccctgtatgctgtcgccacaacctttgtgacacccatgctccgccatagcattgagaactcctctgttaatgtgagcctgaccgctatcgccaaccaagctacggtgctgatgggcctcgggaagggatggcctctttccaagatggacattggcgtccccctgctggccatcgggtgttacagccaggttaatcctatcaccctcacagcggccctgcttctgctcgtggctcactacgccattatcggacccggcctgcaggctaaagccaccagagaagcccagaagcgggcggctgccggcattatgaaaaaccctacagtggatgggatcaccgtcattgacctggagccgatcccctatgatcctaagttcgagaaacaactcggacaggtgatgcttctgatcctgtgcgttacacaggtgctcatgatgcgcacaacctgggctctgtgtgaagcccttacactggccaccggccccatttctaccctctgggaggggaatcctggaagattttggaacacaacgatcgctgtctccatggccaatattttccggggcagctacctggcgggggccggactgctcttttctatcatgaagaacaccgctaatacacgcagaggcaccggcaacattggggaaacacttggagagaagtggaaatcccggctgaatgccctgggcaagagcgagttccagatctataaaaagtctgggatccaagaagtggacagaaccctcgctaaagagggaattaagcgcggcgaaacggatcatcacgccgtcagccgggggtccgcgaaactgagatggtttgtggagcgcaacatggttacacccgaaggaaaggtggtcgaccttggctgcggcagagggggatggtcttactattgtggcgggctgaagaacgtgcgggaggttaaaggactcaccaagggcgggccgggacatgaggaacctatccccatgagcacctacggctggaatctggtgcgcctgcagtccggcgtcgatgtgttcttcacaccccctgagaaatgcgacaccctcctttgtgatattggggaaagctcccccaaccctacaatcgaggccggacggacgctgagagtgctgaatctcgctgaaaactggctgaataacaatacccagttttgcattaaggttcttaacccgtatatgccctctgtcatcgagaaaatggagacactgcaacgcaagtacggcggggccctcgtgcggaatcctctgagcagaaactccacccacgaaatgtactgggtgtctaatgctacaggaaacatcgtcagctccgttaatatgatttctcgcatgctgatcaaccggttcaccatgaagcacaaaaaggccacgtatgagcccgacgtggatctcggcagcgggaccagaaatattggaatcgaatccgagattcctaaccttgacatcattggcaaacgcatcgaaaagatcaaacaggagcatgagacaagctggcactacgaccaggatcatccctataagacctgggcttaccacggctcttatgaaacaaagcagaccgggtccgccagctctatggtgaacggagtcgtgagactgctgacaaaaccgtgggacgttgtgcctatggtcacccaaatggcgatgacggatacaaccccctttggccagcagcgggtgttcaaggagaaagttgacacccgcacacaggaacctaaggaggggacgaaaaagctcatgagaattaccgccgagtggctgtggaaggaacttggcaagaagaaaacaccccggatgtgtaccagagaggaatttacacggaaggtgcgctccaatgctgccctgggcgctatcttcaccgatgagaacaaatggaaaagcgccagagaagccgtcgaggactctcggttttgggagctcgtggatcgcgaaagaaatctgcacctggaggggaaatgcgaaacatgtgtgtacaacatgatgggaaagcgggagaagaaactcggcgagttcggcaaggcgaaagggtcccgcgctatttggtatatgtggctgggagccagatttcttgagttcgaggccctgggctttctcaatgaagaccattggttcagccgggggaactccctgagcggagtcgagggcgaagggcttcaccgcctgggctacatcctcagagatgtttctaagaaagagggaggcgctatgtacgccgacgataccgctgggtgggacacgcggattaccctggaagacctgaagaatgaggagatggtgacaaaccatatggaaggagagcacaagaaactcgccgaagcgatctttaagctgacctatcaaaataaagtggtccgcgtgcagagacctacaccccggggcaccgttatggatatcattagccgcaaggaccagagagggtccggacaggtgggcacgtacgggcttaacacattcaccaatatggaggcccaactgatccggcagatggagggcgaaggaattttcaaatctatccagcatctcacagtcaccgaggaaattgctgtgcaaaactggctggccagagttggccgcgagcggcttagcagaatggctatctccggggatgactgcgtggtcaagccgctggatgaccgctttgcctctgcgctcacggccctgaatgatatgggaaaggtgcggaaagacatccagcagtgggaacctagcagaggctggaacgattggacccaggttcccttctgctcccaccactttcatgagctggtgatgaaggacgggcgcgtcctcgtggtcccctgtcggaatcaagatgagctgattgggagagctcgcatctctcagggcgccgggtggagccttaaagaaacagcttgcctgggcaagtcctatgcccagatgtggaccctcatgtacttccaccggagagacctgcgccttgctgccaacgcgatttgtagcgccgtgccttctcattgggttccgacatcccggaccacatggagcatccacgctaaacacgagtggatgaccacggaagatatgctggccgtgtggaacagagtctggattcaggagaatccctggatggaagacaagacacctgtggagtcttgggaggaagtgccctatctcggaaagcgggaggaccaatggtgcggctccctgatcgggctgaccagcagagccacctgggctaaaaacattcagacagccatcaatcaggttcgctccctcatcggaaacgaagagtacaccgattatatgccttctatgaagcggtttagacgcgaagaggaggaagcgggcgtgctgtggtga

SEQ ID NO: 19552 - RNA, 9876 nt, synthetic construct
  misc_feature 1..9876: note = derived and/or modified CDS sequence (opt5) from DENV-2__JX669479__SS-prME
  source 1..9876: mol_type = other RNA
accgccggcgtgatcgtcatgctcattcccaccgctatggccttccacctcacgacccggaatggggaacctcatatgatcgttggacggcaggaaaagggcaagagcctgctttttaagacggaagacggggtgaatatgtgcaccctgatggcgattgatctcggagaactgtgtgaggacacaatcacctacaaatgcccgcttctgcgccaaaatgaacccgaggatattgactgttggtgcaattccacatctacctgggtgacgtatggcacctgtacaaccacaggggagcacagacgggaaaagcgcagcgtcgctctcgtgcctcatgttggaatgggcctggagaccagaacggaaacatggatgtcctctgagggcgcctggaaacacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaagaacaggacaaacgctttatctgcaagcattccatggtggatagaggctggggcaacgggtgtggactgttcggcaaagggggaattgtcacatgcgccatgtttacgtgcaaaaagaatatggaaggcaaaatcgttcagagcgagaacctcgaatacaccattgtgatcacacctcactctggggaggagcatgcggtgggaaatgacaccggcaagcacggcaaagaaatcaagattacaccccagtccagcaccacggaggccgaactgaccgggtatggaacagtcaccatggagtgttctcctcggacaggccttgatttcaacgaaatggtgctgctccaaatggaggacaaggcttggctggttcaccgccagtggtttcttgatctgcccctcccgtggctgcctggggccgacacccagggatccaattggatccagaaggagacgctggtgacattcaagaacccccatgctaaaaagcaagacgtcgtggttctcggcagccaggaaggggccatgcacaccgccctgacaggcgctaccgagattcagatgtcctctggaaatcttctgtttaccggccatctcaaatgcagactgcggatggataaacttcaactgaaagggatgagctactccatgtgtacaggaaagttcaagatcgtgaaagaaattgcggagacgcagcacggcaccatcgtcatcagagtgcagtatgagggggacggaagcccttgcaagattcccttcgaaatcacagatctcgagaaacgccatgtcctgggccggctgattaccgtgaaccccatcgttacagaaaaggactctcctgtgaacattgaggccgaaccgccctttggggattcctacatcattgtcggcgtggagcctggacagctcaaactgaattggttcaagaagggcagctctatcgggcaaatgtttgagaccacgatgagaggagctaaacgcatggccatccttggcgacacagcctgggatttcgggagcctgggaggcgtttttacctccattgggaaggctctccaccaggtgttcggcgccatctacggagcggctttttctggcgtcagctggaccatgaaaattctgatcggggtgattatcacatggatcggaatgaactcccggagcacctctctgtccgtgagccttgttctcgtcggcgtggtgacactgtatctgggggccatggtccaggccgactctggatgtattgtgtcctggaagaataaagaactcaagtgcggcagcgggatcttcattacggataacgttcacacctggacagagcagtacaagtttcaacccgaatccccttctaaactggctagcgccatccagaaggctcatgaggaaggcatttgtggaatcagatccgtgacccgccttgagaatctgatgtggaaacagatcacacccgagctcaaccacattctgtctgaaaatgaggtcaagctgaccatcatgacgggcgacattaaagggatcatgcaggccggaaagcggagccttagaccgcaacctaccgaactcaaatattcctggaagacatggggcaaggcgaaaatgctgagcaccgagtctcataaccagacattcctgattgatgggcccgaaaccgccgagtgccctaatacaaaccgcgcttggaactccctcgaggtggaagactacggatttggcgttttcaccacgaacatctggctgaaacttcgggagaaacaggacgtgttttgtgatagcaagctgatgtctgccgctatcaaagacaatagagccgtccacgcggatatgggctattggattgaatccgccctcaacgacacatggaagatggagaaggctagcttcatcgaggtgaaatcttgccactggcccaagagccataccctgtggtccaatggggttctggaaagcgagatgattatccctaaaaacttcgccggacccgtgtctcagcacaactaccgcccgggctatcatacccaaacagctgggccttggcaccttggaaagctcgaaatggattttgacttctgtgagggcaccacggtcgtggtgacagaagattgcgggaatcggggaccctccctgagaaccacaaccgccagcggcaaactgattacagagtggtgctgtcggtcctgcaccctgccccctctgcgctacagaggcgaggacgggtgttggtacggaatggaaatccggccgcttaaggagaaggaagagaacctggtcaattctctcgttacggccggccatgggcagattgataactttagcctgggagtgctgggcatggctcttttcctcgaagagatgctgagaacccgcgtggggacaaaacacgcgatcctgctcgtcgccctgtcctttgtgacccttatcacaggaaatatgtctttccgggacctgggcagagttatggtgatggtcggcgctaccatgacggatgacattgggatgggagtgacatatctcgccctgctggccgcttttaaggttcgccccaccttcgccgcgggccttctgctcagaaaactgacaagcaaggagctcatgatggctaccatcgggattgccctgctttcccagtctaccctgcctgaaacaatcctcgagctgacggatgccctggctcttggaatgatggccctgaaaattgtgcggaacatggaaaagtaccaactcgcggtcaccatcatggctatcagctgcgtgcccaatgccgttattctgcagaacgcctggaaggtgtcctgtacaatcctcgctgccgtcagcgtgtctcctctgcttctgacctccagccagcagaaagctgactggattcccctcgccctgacaatcaagggcctgaatcctaccgcgatttttcttacgacactgtctcgcacctccaaaaagagaagctggcccctcaacgaggccatcatggctgtggggatggtctctatcctggcctccagcctcctgaaaaatgacattccgatgaccggacctcttgttgctggcggcctgctgacagtgtgctatgtgctcaccgggcggtccgccgatctggaacttgagcgcgccgctgacgtcaagtgggaggatcaagcggaaatcagcggatctagccccattctgtccatcacaatttctgaggacggcagcatgtccatcaaaaacgaagaggaggaacagacgctcaccattctgatcagaacagggctcctggtgatctctggagttttccctgtgagcattcccatcaccgccgctgcctggtacctttgggaggtcaagaagcagcgggccggcgtgctgtgggatgttccgtcccctccccctgtggaaaaagctgagctggaagacggggcctatcgcattaagcagagaggaatcctcggctactctcaaattggcgcgggggtctataaagagggaacatttcacaccatgtggcatgtgacgcggggcgctgtcctgatgcaccgcgggaagagaatcgagcccagctgggccgatgtgaaaaaggaccttatctcctacggaggcgggtggaagctggaaggagagtggaaagaaggcgaggaagttcaggtgctcgccctggagcccggcaagaatcctcgggctgtccagaccaaaccggggattttcaagacaaacaccggaacaatcggcgccgtgagcctcgatttttctcccgggacctccggaagccctattgttgacagaaaaggcaaggtggtcgggctgtacggaaatggcgtggtgacacgctctggcgcgtatgtttccgctatcgcccagacggaaaagagcattgaagataaccccgagatcgaagacgatatcttccggaaaaagagacttaccattatggacctgcatcctggggccggaaaaacaaagcgctacctgcccgctatcgtccgggaggccattaaaagaggcctccgcaccctgatccttgctcctacccgggtggtggccgcggaaatggaggaggccctgagagggctcccgattcgctatcaaacacccgctatccgggccgaacacacgggaagagagattgtcgacctgatgtgtcatgctaccttcacaatgcggctcctgtcccctgtgcgcgttcccaactacaatcttatcatcatggatgaagcccactttaccgaccctgcctctattgctgcgagaggctatatcagcacacgggtggagatgggggaggccgctggcattttcatgaccgccacgcccccgggatcccgcgatccttttccccagagcaacgcccccatcatggacgaagagagagaaattcctgagcggtcttggaactccggccacgaatgggtcacagatttcaaggggaagaccgtgtggtttgttcccagcatcaaagctggaaacgacatcgccgcgtgcctgagaaagaatggcaaaaaggtgattcagctgtctcgcaaaaccttcgatagcgagtacgtcaagacacgggctaacgactgggattttgtggttaccacagacatctccgagatgggggccaatttcaaggccgaaagagtgattgatcctcgccggtgtatgaaaccggtcatcctcaccgacggagaggaaagagtgattctggctggccccatgcctgtgacgcattctagcgccgcgcaacgccgggggagaatcggccgcaaccccaagaatgagaacgaccagtatatctacatgggagaacctcttgagaatgatgaggactgcgcccactggaaagaagctaagatgctgctcgataacattaatacacccgagggcatcattccgtccatgtttgaacctgagagagaaaaagtcgacgccatcgatggggagtaccggctgcgcggagaggctagaaagaccttcgttgacctgatgcggcgcggcgatctccccgtgtggcttgcctataaagtggctgccgaagggattaactacgcggacagaaagtggtgttttgatggaatcaagaataaccagattctggaggaaaacgtcgaggtggagatctggacaaaagaaggcgagcggaagaaactgaagcctagatggctcgacgcccgcatctattctgatcccctggctcttaaagagttcaaggagttcgccgctgggagaaagagcctgaccctcaatctgattacggaaatgggcagactgcctacctttatgacacagaaagcccgcaacgccctcgacaatcttgctgttctgcataccgcggaggtgggaggccgggcctacacacacgctctgtccgagctccccgaaaccctggagacacttctgctcctgaccctgctcgccgccgtcacagggggaatcttcctttttctgatgagcggcaaggggattggaaaaatgacactgggcatgtgctgcatcattaccgcttctatcctcctgtggtatgcccaaatccagccgcactggattgcggcctccatcattcttgagttctttctgatcgtgctcctgattcctgagcccgaaaagcagagaacaccccaggataaccaactgacatacgttgtgatcgctatcctcaccgtcgtggccgctacaatggccaatgagatgggcttccttgagaaaacgaagaaggacctggggtttggaagcattaccacacaggaatccgagtctaacatcctggacattgatctccggcctgcgagcgcctggaccctgtatgctgtcgccacaaccttcgtgacgccgatgcttcgccattccatcgaaaattctagcgttaacgtgtccctgaccgctattgccaatcaggctacagtgctcatgggcctggggaaaggatggcccctgagcaagatggacatcggcgtccctctccttgccattgggtgttactctcaggttaaccccatcaccctgacagcggccctgctcctgcttgtggctcactacgccatcattggacctggcctgcaagctaaagccaccagagaggcccagaagcgggcggctgccggcatcatgaaaaatcccacggtggatgggattacagtcatcgacctcgaacctattccgtatgatcccaagtttgagaagcagctgggacaggtgatgctgctcatcctttgcgttacccaagtgctgatgatgcgcacaacctgggctctgtgtgaggccctcaccctggccacaggccctatctccacgctttgggaagggaaccccggaagattctggaataccacaattgctgtcagcatggccaacatctttcggggctcttacctggcgggggccggactcctgttctccattatgaaaaataccacaaacacccgcagaggcacgggcaatgtgggggagacactgggagaaaagtggaaaagccggctcaaggctcttggcaaatctgagtttcagatctataagaaaagcgggattcaggaggtcgaccgcaccctggccaaggaaggaatcaagagaggcgagaccgatcatcacgctgtgtcccgggggtctgccaaactgagatggttcgttgaacgcaacatggtgacacctgagggaaaggtcgtggacctcggctgcggcagagggggatggagctactattgtggcgggctgaaaaacgttcgggaagtgaagggacttaccaaaggcgggcccggacatgaggagccgatccctatgtccacatacggctggaatctggtccgcctccaaagcggcgtggatgtgttctttacgcctcccgaaaagtgcgacaccctgctgtgtgatattggggagtcctctcccaaccccacaatcgaagcgggacggaccctcagagttcttaatctggtcgagaactggctgaataacaatacacagttctgcattaaggtgctcaacccttatatgccgagcgtgatcgagaagatggagaccctgcagcgcaagtacggcggggcccttgtccggaatcccctgtccagaaactctacgcacgagatgtactgggttagcaatgctaccggaaacattgtgtcctctgtgaatatgatcagccgcatgctcatcaaccggtttacaatgaaacacaagaaagccacctatgaacctgacgtcgatctgggctccgggacaagaaatattggaatcgagagcgaaattcccaacctggacatcattggcaagcgcatcgagaagattaaacaggaacatgagacctcttggcactacgaccaagatcatccttataagacatgggcttaccacggctcctatgagaccaaacagacggggagcgcctcttccatggtgaacggagttgtgcggctccttacaaagccctgggacgtcgtgccgatggttacccagatggctatgaccgatacaacgcctttcggccagcaaagagtgtttaaagaaaaggtcgacacccgcacacaggagcccaaggaagggaccaaaaagctgatgaaaatcacagccgagtggctgtggaaggagctcggaaaagaaaagacccctagaatgtgtacacgggaggagttcacccgcaaagtgagaagcaatgcggccctgggcgctgtgtttacggatgagaacaagtggaagtctgcccgggaagctgtcgaggacgggagattctgggagcttgttgatcgggaacgcaatctgcacctcgagggaaaatgcgaaacctgtgtgtacaacatgatgggcaagagagagaaaaagctgggcgaatttgggaaagccaagggatcccgggccatctggtatatgtggctgggcgcgcgcttcctcgagtttgaggctctggggttccttaatgaagaccattggtttagcagaggaaactccctgagcggcgtggagggggaaggcctccaccggctgggatacattcttcgcgaggtcggcaagaaagaagggggagccatgtacgccgatgacacagctggctgggataccagaatcacactggaggacctcaagaatgaggaaatggtgaccaaccatatgaaaggggagcacaagaaactggccgaagctattttcaagctgacgtatcagaataaggttgtgcgggtccagcgccccacacctagaggaaccgtgatggacatcatttctcggaaagatcaacgcggcagcgggcaggttggcacatacggactcaacaccttcacgaatatggaggcccagctgatcagacaaatggagggcgaagggatctttaagtccattcagcatcttaccgcgacagaggaaatcgccgtgcagaactggctggctcgggtcggacgcgagagactctctcggatggccattagcggcgacgattgcgtggttaaacccatcgacgatagattcgcttccgccctgaccgcgcttaatgacatggggaaggtgcgcaaagatattcagcaatgggaaccgtctcggggatggaacgactggacacaggtccctttttgcagccaccacttccatgagctggtgatgaaggatggcagagtcctcgtggttccctgtcgcaatcaggacgagctgatcgggcgggccagaatctcccagggcgctggatggtctctgaaggaaaccgcctgcctcggcaaaagctatgctcaaatgtggacactgatgtactttcaccgccgggatcttagactggccgctaacgccatttgttccgcggtgcccagccattgggtccctacctctcgcacgacatggtccatccacgccaagcacgagtggatgaccaccgaagacatgctcgctgtgtggaaccgggtgtggattcaggagaatccgtggatggaagataaaacacccgttgagagctgggaggaagtgccttatctggggaagagagaggaccagtggtgcggatctcttatcggcctgacctcccgcgccacatgggccaaaaacattcagacggctatcaatcaagtccggagcctcattgggaacgaaggatacaccgactatatgccctccatgaagagattccggagagaggaagaggaggccggcgtgctgtggtga

SEQ ID NO: 19553 - RNA, 9876 nt, synthetic construct
  misc_feature 1..9876: note = derived and/or modified CDS sequence (opt5) from DENV-2__KF744403__SS-prME
  source 1..9876: mol_type = other RNA
acagctggaatgatcattatgctgatccccacagtgatggctttccacctcacgaccagaaatggggagcctcatatgattgtcagccggcaggaaaaggggaaatccctgctttttaagacagaggacggcgttaatatgtgcaccctgatggccatggatctcggggaactgtgtgaggacacaatcacctacaaatgcccgcttctgcgccaaaacgaacccgaggatattgactgttggtgcaattctacaagcacctgggtgacgtatggaacctgtacaaccacaggcgagcacagacgggaaaagcgctccgtggcgctcgtccctcatgtggggatgggactggagaccagaacggaaacatggatgtctagcgagggcgcttggaaacacgcccagcggatcgagacctggatcctgcgccatcccggcttcacactcatggccgctattctggcctacaccatcgggaccacaaactttcagagagctcttattttcatcctgctcacggccgttgcgccttccatgaccatgcggtgcattggaatctctaatcgcgattttgtggaaggcgtcagcgggggatcctgggtggacattgttctggagcacggcagctgtgtgacaaccatggccaagaacaagcccacacttgatttcgaactgatcaaaaccgaggctaagcagcctgccacgctcagaaaatattgcatcgaagctaagctgacaaataccaccacagagtctcggtgtccgacccaaggggagccctccctgaacgaagaacaggacaaacgctttgtctgcaagcacagcatggtggatagaggatggggcaatggctgtgggcttttcggaaagggcgggattgtgacatgcgccatgtttacgtgcaaaaagaacatggaaggaaaaatcgtccagcctgagaatctggaatacaccattgttatcacaccccattctggcgaggagcacgcggtggggaacgacaccggaaagcatggcaaagaaattaagatcacacctcagtccagcatcaccgaggccgaacttacgggctatgggaccgtgacaatggagtgttctccccggaccggactggatttcaatgaaatggtcctcctgcaaatggagaacaaggcttggcttgtgcaccgccagtggtttctggacctcccgctgccttggctgcccggcgccgatacacaggggtccaattggattcagaaggagaccctcgttacgttcaagaaccctcacgctaaaaagcaagacgtggtcgtgctgggaagccaggaaggcgccatgcatacagcccttaccggggctacagagatccagatgtcctctggcaacctgctctttaccggacacctgaaatgcagacttcggatggacaagctgcaactcaaaggcatgagctactccatgtgtaccgggaagttcaaggttgtgaaagaaattgcggagacacagcatggaacgatcgtcgtgagagtccagtatgagggcgatgggagcccctgcaagattcccttcgaaatcatggacctggagaaacgccacgtgctgggacggctcatcaccgttaatcctattgtgacagaaaaggattctccggtcaacatcgaggccgaacccccttttggcgactcctacgtgattatcggggttgagcccggccagctgaaacttaattggttcaagaagggaagctctattggccaaatgtttgagaccacaatgagaggggctaaacgcatggccatcctgggagataccgcctgggacttcggcagcctcgggggagtgtttacgtccattggcaaggctctgcatcaggtcttcggggccatctacggcgcggctttttctggagtgagctggacaatgaaaatcctgattggcgtgatcattacctggatcgggatgaactcccggagcacctctctttccgttagcctcgtcctggtgggagtggtcacactgtatctcggcgtggttgtgcaggccgattctgggtgtgtcgtgtcctggagaaataaggaactgaaatgcggaagcggcattttcatcaccgacaacgttcacacatggacggagcagtacaagtttcaacctgaatccccctctaaacttgccagcgctatccagaaagcccaccaggaggggatttgtggcatccgctccgtgacccggctggaaaatctcatgtggaagcagattacaccggagctgaaccatatcctgtctgagaatgaagtcaaacttaccattatgacaggagatatcaagggcatcatgcacgctgggaaaagaagcctccgccctcaacccaccgagctgcggtattcctggaagacgtggggaaaagccaagattctgagcaccgaatctcataaccagacattcctcatcgacggccctgagaccgcggaatgccccaatacaaacagagcctggaactccctggaggtggaggattacgggtttggagttttcaccacaaacatttggcttcgcctgcgggaaaagcaggacgctttttgtgacagcaaactcatgtctgccgctatcaaggataatagagccgtgcacgcggacatgggctattggattgagtccgccctgaacgatacctggaaaatcgaaaaggctagcttcatcgaggtcaaatcttgccactggcctaagagccatacgctgtggtccaacggcgtgcttgagagcgaaatgattatccccaagaatttcgccgggccggtgtctcagcacaactaccggcctggatatcatacacaaaccgctggcccctggcacctcgggaaactggagatggactttgatttctgtaagggaaccacagtcgttgtgaccgaagactgcggcaatcgcgggccctccctgagaacgacaaccgccagcggaaaactcattacagagtggtgctgtcggtcctgcaccctgcctccgcttagataccgcggcgaagatggctgttggtacgggatggagatccggcccctgaaggagaaagaagagaacctcgtgtctagcctggtcacagccggacatggccagattgacaatttttccctgggggtgcttggaatggctctcttcctggaagagatgctgagaacccgcgttggcacgaagcacgcgatcctcctggtggccgtctcttttgtgacccttattacagggaacatgagcttcagagatctgggacgggttatggtgatggtcggcgctaccatgacagacgatatcggcatgggggtgacctatctcgccctgctggccgcttttaaggttcgccctacgttcgccgcgggacttctgctcagaaaactgacatccaaggaactcatgatgaccacaatcggcattgtgctgctttctcagagcaccatccccgagaccattctggagctcacagacgctctggccctggggatgatggtccttaaaatcgtgcggaagatggaacgctaccaactggccgtgacgattatggctatcctctgcgtccctaatgccgttatcctgcagaacgcgtggaaagtgtcctgtaccattctcgctgtggtcagcgtgtctcccctgcttctgacatccagccagcagaaggccgattggatccctctcgccctgaccattaagggactgaatcccacagctatctttcttaccacgctgtctagaacatccaaaaagcggagctggccgctcaacgaggccattatggctgttggcatggtgtctatcctggcctccagcctcctgaaaaatgacatccctatgaccgggccccttgtcgcgggaggcctgctgaccgtgtgctatgttctcacaggccgctccgccgacctggaacttgagaaggctgccgatgtgagatgggaagaccaagctgagattagcgggtctagccctatcctgtccattatcatttctgaggatggaagcatgtccatcaaaaacgaagaggaggaacagaccctcacaattctgatccggacgggcctcctggtcatctctgggcttttccccgtgagcattccgatcaccgccgccgcttggtacctgtgggaggtcaagaaacagcgcgcgggagtgctgtgggacgttccttctccccctcccgtgggcaaggccgaactcgaggatggggcttatagaattaagcagaaaggaatcctgggctacagccaaattggcgccggggtctataaggaaggaacatttcacaccatgtggcatgtgacacggggcgccgttcttatgcacaaagggaagagaatcgagcccagctgggctgacgtgaaaaaggatctgatctcctacggaggcgggtggaagctcgaaggagagtggaaagagggcgaagaggtccaggtgctggccctcgaacctggcaagaatccgcgcgcggtgcagaccaaacccgggctgttcaagacgaacgctggaaccattggcgccgttagccttgacttttctcctgggacatccggaagccccatcattgataaaaagggcaaggtcgtggggctgtacggaaatggcgtggtcacccggaacggctcttatgtgtccgccatcgctcagacagagaaaagcattgaagacaaccctgagatcgaggatgacatcttcagaaagaaacgcctgaccattatggatctccatcccggggccggaaagacaaaacggtacctgcctgcgatcgttagagaagctattaagcgcggccttcggacgctgatcctcgccccgaccagagtggtcgccgctgagatggaagaggccctgcgcgggctccccattcggtatcaaacccctgctatcagagccgaacacaccggacgggagattgtggacctgatgtgtcatgcgaccttcacaatgcgccttctgtcccccatcagagttcctaattacaacctgatcattatggacgaggcccactttacggatcccgcttctatcgccgctcggggctatattagcacccgcgtggaaatgggggaggccgccggcatcttcatgacagctaccccgcctggatccagagacccctttccccagagcaatgcgcctattatggatgaggaacgggagatccccgaaagatcttggaactccggccacgagtgggtcacagacttcaaggggaaaaccgtgtggtttgttcctagcatcaaggccggaaatgatattgctgcctgcctccgcaaaaacggcaagaaagtgatccagctgtctcggaagacgttcgacagcgaatacgtcaagacaagaaccaatgattgggactttgtggtgaccacagatatttccgagatgggggccaacttcaaagctgaacgcgtcatcgacccgcggagatgtatgaagcccgttattcttaccgatggagaggagcgcgtgatcctggccggccctatgcccgtgacacattctagcgcggctcaacggagagggcgcatcggcagaaatcctaaaaacgaaaatgaccagtatatttacatgggagagcccctcgaaaacgacgaggattgcgcccactggaaggaagccaaaatgctgctggacaatatcaacaccccggagggcattatcccttccatgtttgagcccgaacgggagaaggtcgatgctattgacggggaataccgcctcagaggagaggcccggaaaacgttcgtggatcttatgcgcagaggcgacctgcctgtttggctggcgtataaggtggccgctgaagggatcaattacgccgatcggagatggtgttttgacggcattcgcaacaaccagatcctcgaggagaatgtcgaagtggagatctggacaaaggaaggcgagcggaaaaagctgaaacccagatggcttgatgctcgcatttattctgaccctctggccctcaaggagttcaaagagttcgctgccgggagaaagagcctgaccctgaacctcatcacagagatgggccggcttcccacctttatgacgcagaaggcgcgggatgccctggacaatctggctgttctccataccgccgaagctggaggccgcgcctacaaccacgccctgtccgagcttccggaaacactggagattctcctgctgctcacccttctggctacagtgaccgggggaatcttcctgtttctcatgagcggcagagggattggaaaaatgacactgggcatgtgctgcatcatcaccgcgtctattcttctgtggtatgcccaaatccagcctcactggattgctgcctccatcattctcgagttctttctgatcgtcctgctcatccccgaacccgagaagcagcggacgcctcaggataatcaacttacatacgtggtcattgccatcctgaccgtggttgctgccaccatggcgaacgaaatgggcttcctggagaaaacaaagaaagacctcgggctgggaagcattaccacacagcagccggaatccaatatccttgacattgatctgcgccccgcctctgcttggacgctctatgccgtggctaccacatttatcacccctatgctgagacatagcattgagaactcctctgtgaatgtcagcctgacagccatcgcgaaccaggccaccgttctcatgggccttgggaagggatggcccctgtccaagatggacatcggcgtgcctctgctcgctattgggtgttacagccaagtgaatcccatcacgctgaccgccgcccttctgctcctggtcgcccactacgctattatcggacctggcctgcaggccaaagcgacacgggaggcccagaagcgcgctgccgctggcattatgaaaaacccgaccgtggatgggatcacagttatcgacctcgatcccattccttatgaccccaagttcgaaaaacagcttggacaagtgatgctgctggtcctctgcgtgacccaggtcctgatgatgagaacgacatgggccctttgtgaggccctgaccctcgcgacaggccctatctctaccctgtgggaagggaatcccggacggttttggaacaccacaattgctgtgtccatggccaatatcttccgcggcagctacctggctggggccggactcctcttttctattatgaagaacacgaccaatacaagacggggcaccggcaacatcggggagacactgggagaaaagtggaaatccagactgaacgccctcggcaagagcgagttccagatctataaaaagtctgggattcaagaggttgatcgcaccctggctaaagaaggaatcaagcggggcgagacggaccatcacgccgtgagcagagggtccgcgaaacttcgctggtttgtcgaacggaatatgattacaccggagggaaaggtggttgatctgggctgcggcagagggggatggtcttactattgtggcgggctcaagaacgtgcgcgaggtcaaaggactgaccaagggcgggcctggacatgaggaacccatccccatgagcacctacggctggaatctggtgcggctccagtccggcgtggacgttttcttcacacctcccgaaaaatgcgatacccttctgtgtgacattggggagagctcccctaacccgacagtcgaagccggaagaacgctgcgcgtgctcaatctggtggagaactggcttaataacaatacccagttttgcatcaaggtcctgaacccctatatgccttctgttatcgagaaaatggaagctctccagcggaagtacggcggggccctggtgagaaatcccctgagccgcaactccacacacgagatgtactgggtgtctaatgctagcggaaacattgtctcctctgtgaatatgatcagccggatgctcattaacagattcaccatgaagcacaaaaaggccacatatgaacctgatgttgaccttggctccgggacccgcaacatcggaattgagagcgaagtgcccaatctggacatcattggcaaaagaatcgagaagatcaaacaagagcatgaaacgtcttggcactacgatcaggaccatccgtataagacctgggcgtaccacggctcctatgagacaaagcagaccgggagcgcctcttccatggtcaacggagtggttcggctgctcacaaaaccttgggatgtgattcccatggtcacccagatggctatgacagacaccacgccttttggccaacagcgcgtgttcaaggaaaaagtggatacaagaacccaggagcccaaggaagggaccaaaaagctgatgaagatcacagccgagtggctttggaaagagctgggaaagaaaaagacgcctcggatgtgtaccagagaagagtttacacggaaagtccgcagcaatgctgccctcggcgctattttcaccgacgaaaacaagtggaaatctgccagagaggcggttgaggattcccggttttgggaactggtggacaaggagcgcaatctgcacctcgaagggaagtgcgagacatgtgtgtacaacatgatgggaaaaagagaaaagaaactgggcgagttcggcaaggccaaagggagccgggctatctggtatatgtggcttggagcccgctttctggagttcgaagctctcggctttctgaatgaggatcattggttctccagagaaaacagcctttctggggtcgagggagaaggcctgcacaagctcgggtacattctgcgggacgtgagcaagaaagagggcggagccatgtacgccgatgacaccgcgggctgggacacacgcatcaccctggaggatctcaagaatgaagagatggttacgaaccatatggaaggggagcacaaaaagctggctgaagccatctttaaacttacctatcagaataaggtggtcagagtgcaacggcccacaccgcgcggaaccgttatggacattatctccagacgggatcagcgcggctctggacaggtgggaacatacggcctgaacaccttcacgaatatggaggcccaactcattagacagatggagggggaaggcgtcttcaagagcatccagcatctgacagctaccgaggaaattgccgtgcagaactggcttgctcgggttggaagagagcgcctgtcccggatggccatctctggcgacgattgcgtggtcaaacctctcgacgatagatttgcgagcgccctgacagctctgaatgacatggggaaggtgcgcaaagatatccaacagtgggagccctccaagggatggaacgactggacccaggtccccttctgctctcaccactttcatgaactcattatgaaagatggccgggtgctggttgtgccttgtagaaaccaggacgagcttatcgggcgcgcccggattagccaaggagctggctggtccctgagagaaacggcctgcctcgggaagtcctatgcgcagatgtggtctctgatgtacttccaccgccgggatcttagactggccgctaatgccatctgttccgctgtcccgagccattgggtgcccacctctcgcacaacctggtccattcacgccaagcacgagtggatgacaaccgaagacatgctcacagtgtggaaccgggtttggatccaggagaatccttggatggaggacaaaacccccgtggaaagctgggaggaaattccttatctgggcaagagagaggatcagtggtgcggatccctgatcggcctcacgtctcgggctacatgggccaaaaacatccaaaccgcgattaatcaggtcagaagcctgatcgggaacgaagagtacaccgactatatgccctccatgaagcgctttcggagagaggaagaggaagccggagtgctttggtga

SEQ ID NO: 19554 - RNA, 9876 nt, synthetic construct
  misc_feature 1..9876: note = derived and/or modified CDS sequence (opt5) from DENV-2__KF744406__SS-prME
  source 1..9876: mol_type = other RNA
acagccggaatgatcattatgctgatccccacagtgatggctttccacctcacgaccagaaatggggagcctcatatgattgtctcccggcaggaaaaggggaaatccctgctttttaagacagaggacggcgttaatatgtgcaccctgatggccatggatctcggggaactgtgtgaggacacaatcacctacaaatgcccgcttctgcgccaaaacgaacccgaggatattgactgttggtgcaattctacaagcacctgggtgacgtatgggacctgtacaaccacaggcgagcacagacgggaaaagcgctccgtggcgctcgtccctcatgtggggatgggactggagaccagaacggaaacatggatgtctagcgagggcgcttggaaacacgcccagcggatcgagacctggatcctgcgccatcccggcttcacactcatggccgctattctggcctacaccatcgggaccacaaactttcagagagctcttattttcatcctgctcacggccgttgcgccttccatgaccatgcggtgcattggaatctctaatcgcgattttgtggaaggcgtcagcgggggatcctgggtggacattgttctggagcacggcagctgtgtgacaaccatggccaagaacaagcccacacttgatttcgaactgatcaaaaccgaggctaagcagcctgccacgctcagaaaatattgcatcgaagctaagctgacaaataccaccacagagtctcggtgtccgacccaaggggagccctccctgaacgaagaacaggacaaacgctttgtctgcaagcacagcatggtggatagaggatggggcaatggctgtggactcttcggaaagggcgggattgtgacatgcgccatgtttacgtgcaaaaagaacatggaaggaaaaatcgtccagcctgagaatctggaatacaccattgttatcacaccccattctggcgaggagcacgcggtggggaacgacaccggaaagcatggcaaagaaattaagatcacacctcagtccagcatcaccgaggccgaacttacgggctatgggaccgtgacaatggagtgttctccccggaccggactggatttcaatgaaatggtcctcctgcaaatggagaacaaggcttggcttgtgcaccgccagtggtttctggacctcccgctgccttggctgcccggcgccgatacacaggggtccaattggattcagaaggagaccctcgttacgttcaagaaccctcacgctaaaaagcaagacgtggtcgtgctgggaagccaggaaggcgccatgcatacagcccttaccggggctacagagatccagatgtcctctggcaacctgctctttaccggacacctgaaatgcagacttcggatggacaagctgcaactcaaaggcatgagctactccatgtgtaccgggaagttcaaggttgtgaaagaaattgcggagacacagcatggaacgatcgtcgtgagagtccagtatgagggcgatgggagcccctgcaagattcccttcgaaatcatggacctggagaaacgccacgtgctgggacggctcatcaccgttaatcctattgtgacagaaaaggattctccggtcaacatcgaggccgaacccccttttggcgactcctacgtgattatcggggttgagcccggccagctgaaacttaattggttcaagaagggaagctctattggccaaatgtttgagaccacaatgagaggggctaaacgcatggccatcctgggagataccgcctgggacttcggcagcctcgggggagtgtttacgtccattggcaaggctctgcatcaggtcttcggggccatctacggcgcggctttttctggagtgagctggacaatgaaaatcctgattggcgtgatcattacctggatcgggatgaactcccggagcacctctctttccgttagcctcgtcctggtgggagtggtcacactgtatctcggcgtggttgtgcaggccgattctgggtgtgtcgtgtcctggagaaataaggaactgaaatgcggaagcggcattttcatcaccgacaacgttcacacatggacggagcagtacaagtttcaacctgaatccccctctaaacttgccagcgctatccagaaagcccaccaggaggggatttgtggcatccgctccgtgacccggctggaaaatctcatgtggaagcagattacaccggagctgaaccatatcctgtctgagaatgaagtcaaacttaccattatgacaggagatatcaagggcatcatgcacgctgggaaaagaagcctccgccctcaacccaccgagctgcggtattcctggaagacgtggggaaaagccaagattctgagcaccgaatctcataaccagacattcctcatcgacggccctgagaccgcggaatgccccaatacaaacagagcctggaactccctggaggtggaggattacgggtttggagttttcaccacaaacatttggcttcgcctgcgggaaaagcaggacgctttttgtgacagcaaactcatgtctgccgctatcaaggataatagagccgtgcacgcggacatgggctattggattgagtccgccctgaacgatacctggaaaatcgaaaaggctagcttcatcgaggtcaaatcttgccactggcctaagagccatacgctgtggtccaacggcgtgcttgagagcgaaatgattatccccaagaatttcgccgggccggtgtctcagcacaactaccggcctggatatcatacacaaaccgctggcccctggcacctcgggaaactggagatggactttgatttctgtaagggaaccacagtcgttgtgaccgaagactgcggcaatcgcgggccctccctgagaacgacaaccgccagcggaaaactcattacagagtggtgctgtcggtcctgcaccctgcctccgcttagataccgcggcgaagatggctgttggtacgggatggagatccggcccctgaaggagaaagaagagaacctcgtgtctagcctggtcacagccggacatggccagattgacaatttttccctgggggtgcttggaatggctctcttcctggaagagatgctgagaacccgcgttggcacgaagcacgcgatcctcctggtggccgtctcttttgtgacccttattacagggaacatgagcttcagagatctgggacgggttatggtgatggtcggcgctaccatgacagacgatatcggcatgggggtgacctatctcgccctgctggccgcttttaaggttcgccctacgttcgccgcgggacttctgctcagaaaactgacatccaaggaactcatgatgaccacaatcggcattgtgctgctttctcagagcaccatccccgagaccattctggagctcacagacgctctggccctggggatgatggtccttaaaatcgtgcggaagatggaacgctaccaactggccgtgacgattatggctatcctctgcgtccctaatgccgttatcctgcagaacgcgtggaaagtgtcctgtaccattctcgctgtggtcagcgtgtctcccctgcttctgacatccagccagcagaaggccgattggatccctctcgccctgaccattaagggactgaatcccacagctatctttcttaccacgctgtctagaacatccaaaaagcggagctggccgctcaacgaggccattatggctgttggcatggtgtctatcctggcctccagcctcctgaaaaatgacatccctatgaccgggccccttgtcgcgggaggcctgctgaccgtgtgctatgttctcacaggccgctccgccgacctggaacttgagaaggctgccgatgtgagatgggaagaccaagctgagattagcgggtctagccctatcctgtccattatcatttctgaggatggaagcatgtccatcaaaaacgaagaggaggaacagaccctcacaattctgatccggacgggcctcctggtcatctctgggcttttccccgtgagcattccgatcaccgccgccgcttggtacctgtgggaggtcaagaaacagcgcgcgggagtgctgtgggacgttccttctccccctcccgtgggcaaggccgaactcgaggatggggcttatagaattaagcagaaaggaatcctgggctacagccaaattggcgccggggtctataaggaaggaacatttcacaccatgtggcatgtgacacggggcgccgttcttatgcacaaagggaagagaatcgagcccagctgggctgacgtgaaaaaggatctgatctcctacggaggcgggtggaagctcgaaggagagtggaaagagggcgaagaggtccaggtgctggccctcgaacctggcaagaatccgcgcgcggtgcagaccaaacccgggctgttcaagacgaacgctggaaccattggcgccgttagccttgacttttctcctgggacatccggaagccccatcattgataaaaagggcaaggtcgtggggctgtacggaaatggcgtggtcacccggaacggctcttatgtgtccgccatcgctcagacagagaaaagcattgaagacaaccctgagatcgaggatgacatcttcagaaagaaacgcctgaccattatggatctccatcccggggccggaaagacaaaacggtacctgcctgcgatcgttagagaagctattaagcgcggccttcggacgctgatcctcgccccgaccagagtggtcgccgctgagatggaagaggccctgcgcgggctccccattcggtatcaaacccctgctatcagagccgaacacaccggacgggagattgtggacctgatgtgtcatgcgaccttcacaatgcgccttctgtcccccatcagagttcctaattacaacctgatcattatggacgaggcccactttacggatcccgcttctatcgccgctcggggctatattagcacccgcgtggaaatgggggaggccgccggcatcttcatgacagctaccccgcctggatccagagacccctttccccagagcaatgcgcctattatggatgaggaacgggagatccccgaaagatcttggaactccggccacgagtgggtcacagacttcaaggggaaaaccgtgtggtttgttcctagcatcaaggccggaaatgatattgctgcctgcctccgcaaaaacggcaagaaagtgatccagctgtctcggaagacgttcgacagcgaatacgtcaagacaagaaccaatgattgggactttgtggtgaccacagatatttccgagatgggggccaacttcaaagctgaacgcgtcatcgacccgcggagatgtatgaagcccgttattcttaccgatggagaggagcgcgtgatcctggccggccctatgcccgtgacacattctagcgcggctcaacggagagggcgcatcggcagaaatcctaaaaacgaaaatgaccagtatatttacatgggagagcccctcgaaaacgacgaggattgcgcccactggaaggaagccaaaatgctgctggacaatatcaacaccccggagggcattatcccttccatgtttgagcccgaacgggagaaggtcgatgctattgacggggaataccgcctcagaggagaggcccggaaaacgttcgtggatcttatgcgcagaggcgacctgcctgtttggctggcgtataaggtggccgctgaagggatcaattacgccgatcggagatggtgttttgacggcattcgcaacaaccagatcctcgaggagaatgtcgaagtggagatctggacaaaggaaggcgagcggaaaaagctgaaacccagatggcttgatgctcgcatttattctgaccctctggccctcaaggagttcaaagagttcgctgccgggagaaagagcctgaccctgaacctcatcacagagatgggccggcttcccacctttatgacgcagaaggcgcgggatgccctggacaatctggctgttctccataccgccgaagctggaggccgcgcctacaaccacgccctgtccgagcttccggaaacactggagattagcctcctgctgaccctccttgctacagtgaccgggggaatcttcctgtttctgatgtctggcagagggattggaaaaatgacactcggcatgtgctgcatcatcaccgcgtccattctgctttggtatgcccaaatccagcctcactggattgctgccagcatcattctggagttctttctcatcgtcctgctgatccccgaacccgagaagcagcggacgcctcaggataatcaactcacatacgtggtcattgccatccttaccgtggttgctgccaccatggcgaacgaaatgggcttcctggagaaaacaaagaaagacctggggctcggatccattaccacacagcagccggaatctaatatcctggacattgatcttcgccccgccagcgcttggacgctgtatgccgtggctaccacatttatcacccctatgctcagacattccattgagaactctagcgtgaatgtctccctgacagccatcgcgaaccaggccaccgttctgatgggcctcgggaagggatggccccttagcaagatggacatcggcgtgcctctgctggctattgggtgttactctcaagtgaatcccatcacgctcaccgccgctctgcttctgctcgtcgcccactacgctattatcggacctggcctgcaggccaaagcgacacgggaggcccagaagcgcgctgccgctggcattatgaaaaacccgaccgtggatgggatcacagttatcgacctggatcccattccttatgaccccaagttcgaaaaacagctcggacaagtgatgcttctggtcctgtgcgtgacccaggtcctcatgatgagaacgacatgggccctgtgtgaggcccttaccctggcgacaggccctatctccaccctctgggaagggaatcccggacggttttggaacaccacaattgctgtgagcatggccaatatcttccgcggctcttacctggctggggccggactgctcttttccattatgaagaacacgaccaatacaagacggggcaccggcaacatcggggagacacttggagaaaagtggaaaagcagactgaacgccctgggcaagtctgagttccagatctataaaaagagcgggattcaagaggttgatcgcaccctcgctaaagaaggaatcaagcggggcgagacggaccatcacgccgtgtccagagggtctgcgaaactgcgctggtttgtcgaacggaatatgattacaccggagggaaaggtggttgatcttggctgcggcagagggggatggagctactattgtggcgggctgaagaacgtgcgcgaggtcaaaggactcaccaagggcgggcctggacatgaggaacccatccccatgtccacctacggctggaatctggtgcggctgcagagcggcgtggacgttttcttcacacctcccgaaaaatgcgataccctcctttgtgacattggggagtcctctcctaacccgacagtcgaagccggaagaacgctgcgcgtgctgaatctcgtggagaactggctgaataacaatacccagttttgcatcaaggtccttaacccctatatgcctagcgttatcgagaaaatggaagctctgcagcggaagtacggcggggccctcgtgagaaatcccctgtcccgcaactctacacacgagatgtactgggtgagcaatgcttccggaaacattgtctctagcgtgaatatgatctcccggatgctgattaacagattcaccatgaagcacaaaaaggccacatatgaacctgatgttgacctcggcagcgggacccgcaacatcggaattgagtctgaagtgcccaatcttgacatcattggcaaaagaatcgagaagatcaaacaagagcatgaaacgtcctggcactacgatcaggaccatccgtataagacctgggcgtaccacggcagctatgagacaaagcagaccgggtctgcctccagcatggtcaacggagtggttcggctgctgacaaaaccttgggatgtgattcccatggtcacccagatggctatgacagacaccacgccttttggccaacagcgcgtgttcaaggaaaaagtggatacaagaacccaggagcccaaggaagggaccaaaaagctcatgaagatcacagccgagtggctgtggaaagagcttggaaagaaaaagacgcctcggatgtgtaccagagaagagtttacacggaaagtccgctctaatgctgccctgggcgctattttcaccgacgaaaacaagtggaaatccgccagagaggcggttgaggatagccggttttgggaactcgtggacaaggagcgcaatctgcacctggaagggaagtgcgagacatgtgtgtacaacatgatgggaaaaagagaaaagaaactcggcgagttcggcaaggccaaagggtcccgggctatctggtatatgtggctgggagcccgctttcttgagttcgaagctctgggctttctcaatgaggatcattggttcagcagagaaaactctctgagcggggtcgagggagaaggccttcacaagctggggtacattctccgggacgtgtccaagaaagagggcggagccatgtacgccgatgacaccgcgggctgggacacacgcatcaccctggaggatctgaagaatgaagagatggttacgaaccatatggaaggggagcacaaaaagctcgctgaagccatctttaaactgacctatcagaataaggtggtcagagtgcaacggcccacaccgcgcggaaccgttatggacattatctctagacgggatcagcgcggcagcggacaggtgggaacatacggccttaacaccttcacgaatatggaggcccaactgattagacagatggagggggaaggcgtcttcaagtccatccagcatctcacagctaccgaggaaattgccgtgcagaactggctggctcgggttggaagagagcgcctttctcggatggccatcagcggcgacgattgcgtggtcaaacctctggacgatagatttgcgtccgccctcacagctctgaatgacatggggaaggtgcgcaaagatatccaacagtgggagccctctaagggatggaacgactggacccaggtccccttctgcagccaccactttcatgaactgattatgaaagatggccgggtgctcgttgtgccttgtagaaaccaggacgagctgatcgggcgcgcccggatttcccaaggagctggctggagccttagagaaacggcctgcctggggaagtcttatgcgcagatgtggtccctcatgtacttccaccgccgggatctgagacttgccgctaatgccatctgtagcgctgtcccgtctcattgggtgcccacctcccgcacaacctggagcattcacgccaagcacgagtggatgacaaccgaagacatgctgacagtgtggaaccgggtttggatccaggagaatccttggatggaggacaaaacccccgtggaatcctgggaggaaattccttatctcggcaagagagaggatcagtggtgcggatctctgatcggcctgacgagccgggctacatgggccaaaaacatccaaaccgcgattaatcaggtcagatccctcatcgggaacgaagagtacaccgactatatgcccagcatgaagcgctttcggagagaggaagaggaagccggagtgctgtggtga

SEQ ID NO: 19555 - RNA, 9876 nt, synthetic construct
  misc_feature 1..9876: note = derived and/or modified CDS sequence (opt5) from DENV-2__KF744404__SS-prME
  source 1..9876: mol_type = other RNA
acagccggaatgatcattatgctgatccccacagtgatggctttccacctcacgaccagaaatggggagcctcatatgattgtctcccggcaggaaaaggggaaatccctgctttttaagacagaggacggcgttaatatgtgcaccctgatggccatggatctcggggaactgtgtgaggacacaatcacctacaaatgcccgcttctgcgccaaaacgaacccgaggatattgactgttggtgcaattctacaagcacctgggtgacgtatggaacctgtacaaccacaggcgagcacagacgggaaaagcgctccgtggcgctcgtccctcatgtggggatgggactggagaccagaacggaaacatggatgtctagcgagggcgcttggaaacacgcccagcggatcgagacctggatcctgcgccatcccggcttcacactcatggccgctattctggcctacaccatcgggaccacaaactttcagagagctcttattttcatcctgctcacggccgttgcgccttccatgaccatgcggtgcattggaatctctaatcgcgattttgtggaaggcgtcagcgggggatcctgggtggacattgttctggagcacggcagctgtgtgacaaccatggccaagaacaagcccacacttgatttcgaactgatcaaaaccgaggctaagcagcctgccacgctcagaaaatattgcatcgaagctaagctgacaaataccaccacagagtctcggtgtccgacccaaggggagccctccctgaacgaagaacaggacaaacgctttgtctgcaagcacagcatggtggatagaggatggggcaatggctgtggactcttcggaaagggcgggattgtgacatgcgccatgtttacgtgcaaaaagaacatggaaggaaaaatcgtccagcctgagaatctggaatacaccattgttatcacaccccattctggcgaggagcacgcggtggggaacgacaccggaaagcatggcaaagaaattaagatcacacctcagtccagcatcaccgaggccgaacttacgggctatgggaccgtgacaatggagtgttctccccggaccggactggatttcaatgaaatggtcctcctgcaaatggagaacaaggcttggcttgtgcaccgccagtggtttctggacctcccgctgccttggctgcccggcgccgatacacaggggtccaattggattcagaaggagaccctcgttacgttcaagaaccctcacgctaaaaagcaagacgtggtcgtgctgggaagccaggaaggcgccatgcatacagcccttaccggggctacagagatccagatgtcctctggcaacctgctctttaccggacacctgaaatgcagacttcggatggacaagctgcaactcaaaggcatgagctactccatgtgtaccgggaagttcaaggttgtgaaagaaattgcggagacacagcatggaacgatcgtcgtgagagtccagtatgagggcgatgggagcccctgcaagattcccttcgaaatcatggacctggagaaacgccacgtgctgggacggctcatcaccgttaatcctattgtgacagaaaaggattctccggtcaacatcgaggccgaacccccttttggcgactcctacgtgattatcggggttgagcccggccagctgaaacttaattggttcaagaagggaagctctattggccaaatgtttgagaccacaatgagaggggctaaacgcatggccatcctgggagataccgcctgggacttcggcagcctcgggggagtgtttacgtccattggcaaggctctgcatcaggtcttcggggccatctacggcgcggctttttctggagtgagctggacaatgaaaatcctgattggcgtgatcattacctggatcgggatgaactcccggagcacctctctttccgttagcctcgtcctggtgggagtggtcacactgtatctcggcgtggttgtgcaggccgattctgggtgtgtcgtgtcctggagaaataaggaactgaaatgcggaagcggcattttcatcaccgacaacgttcacacatggacggagcagtacaagtttcaacctgaatccccctctaaacttgccagcgctatccagaaagcccaccaggaggggatttgtggcatccgctccgtgacccggctggaaaatctcatgtggaagcagattacaccggagctgaaccatatcctgtctgagaatgaagtcaaacttaccattatgacaggagatatcaagggcatcatgcacgctgggaaaagaagcctccgccctcaacccaccgagctgcggtattcctggaagacgtggggaaaagccaagattctgagcaccgaatctcataaccagacattcctcatcgacggccctgagaccgcggaatgccccaatacaaacagagcctggaactccctggaggtggaggattacgggtttggagttttcaccacaaacatttggcttcgcctgcgggaaaagcaggacgctttttgtgacagcaaactcatgtctgccgctatcaaggataatagagccgtgcacgcggacatgggctattggattgagtccgccctgaacgatacctggaaaatcgaaaaggctagcttcatcgaggtcaaatcttgccactggcctaagagccatacgctgtggtccaacggcgtgcttgagagcgaaatgattatccccaagaatttcgccgggccggtgtctcagcacaactaccggcctggatatcatacacaaaccgctggcccctggcacctcgggaaactggagatggactttgatttctgtaagggaaccacagtcgttgtgaccgaagactgcggcaatcgcgggccctccctgagaacgacaaccgccagcggaaaactcattacagagtggtgctgtcggtcctgcaccctgcctccgcttagataccgcggcgaagatggctgttggtacgggatggagatccggcccctgaaggagaaagaagagaacctcgtgtctagcctggtcacagccggacatggccagattgacaatttttccctgggggtgcttggaatggctctcttcctggaagagatgctgagaacccgcgttggcacgaagcacgcgatcctcctggtggccgtctcttttgtgacccttattacagggaacatgagcttcagagatctgggacgggttatggtgatggtcggcgctaccatgacagacgatatcggcatgggggtgacctatctcgccctgctggccgcttttaaggttcgccctacgttcgccgcgggacttctgctcagaaaactgacatccaaggaactcatgatgaccacaatcggcattgtgctgctttctcagagcaccatccccgagaccattctggagctcacagacgctctggccctggggatgatggtccttaaaatcgtgcggaagatggaacgctaccaactggccgtgacgattatggctatcctctgcgtccctaatgccgttatcctgcagaacgcgtggaaagtgtcctgtaccattctcgctgtggtcagcgtgtctcccctgcttctgacatccagccagcagaaggccgattggatccctctcgccctgaccattaagggactgaatcccacagctatctttcttaccacgctgtctagaacatccaaaaagcggagctggccgctcaacgaggccattatggctgttggcatggtgtctatcctggcctccagcctcctgaaaaatgacatccctatgaccgggccccttgtcgcgggaggcctgctgaccgtgtgctatgttctcacaggccgctccgccgacctggaacttgagaaggctgccgatgtgagatgggaagaccaagctgagattagcgggtctagccctatcctgtccattatcatttctgaggatggaagcatgtccatcaaaaacgaagaggaagaacagaccctcacaattctgatccggacgggcctcctggtcatctctgggcttttccccgtgagcattccgatcaccgccgccgcttggtacctgtgggaggtcaagaaacagcgcgcgggagtgctgtgggacgttccttctccccctcccgtgggcaaggccgaactcgaggatggggcttatagaattaagcagaaaggaatcctgggctacagccaaattggcgccggggtctataaggaaggaacatttcacaccatgtggcatgtgacacggggcgccgttcttatgcacaaagggaagagaatcgagcccagctgggctgacgtgaaaaaggatctgatctcctacggaggcgggtggaagctcgaaggagagtggaaagagggcgaagaggtccaggtgctggccctcgaacctggcaagaatccgcgcgcggtgcagaccaaacccgggctgttcaagacgaacgctggaaccattggcgccgttagccttgacttttctcctgggacatccggaagccccatcattgataaaaagggcaaggtcgtggggctgtacggaaatggcgtggtcacccggaacggctcttatgtgtccgccatcgctcagacagagaaaagcattgaagacaaccctgagatcgaggatgacatcttcagaaagaaacgcctgaccattatggatctccatcccggggccggaaagacaaaacggtacctgcctgcgatcgttagagaagctattaagcgcggccttcggacgctgatcctcgccccgaccagagtggtcgccgctgagatggaagaggccctgcgcgggctccccattcggtatcaaacccctgctatcagagccgaacacaccggacgggagattgtggacctgatgtgtcatgcgaccttcacaatgcgccttctgtcccccatcagagttcctaattacaacctgatcattatggacgaggcccactttacggatcccgcttctatcgccgctcggggctatattagcacccgcgtggaaatgggggaggccgccggcatcttcatgacagctaccccgcctggatccagagacccctttccccagagcaatgcgcctattatggatgaagaacgggagatccccgaaagatcttggaactccggccacgagtgggtcacagacttcaaggggaaaaccgtgtggtttgttcctagcatcaaggccggaaatgatattgctgcctgcctccgcaaaaacggcaagaaagtgatccagctgtctcggaagacgttcgacagcgaatacgtcaagacaagaaccaatgattgggactttgtggtgaccacagatatttccgagatgggggccaacttcaaagctgaacgcgtcatcgacccgcggagatgtatgaagcccgttattcttaccgatggagaggagcgcgtgatcctggccggccctatgcccgtgacacattctagcgcggctcaacggagagggcgcatcggcagaaatcctaaaaacgaaaatgaccagtatatttacatgggagagcccctcgaaaacgacgaggattgcgcccactggaaggaagccaaaatgctgctggacaatatcaacaccccggagggcattatcccttccatgtttgagcccgaacgggagaaggtcgatgctattgacggggaataccgcctcagaggagaggcccggaaaacgttcgtggatcttatgcgcagaggcgacctgcctgtttggctggcgtataaggtggccgctgaagggatcaattacgccgatcggagatggtgttttgacggcattcgcaacaaccagatcctcgaggagaatgtcgaagtggagatctggacaaaggaaggcgagcggaaaaagctgaaacccagatggcttgatgctcgcatttattctgaccctctggccctcaaggagttcaaagagttcgctgccgggcggaaaagcctgaccctgaacctcatcacagagatgggcagacttcccacctttatgacgcagaaggcgcgggatgccctggacaatctggctgttctccataccgccgaagctggaggccgcgcctacaaccacgccctgtccgagcttccggaaacactgcaaattagcctcctgctgaccctccttgctacagtgaccgggggaatcttcctgtttctgatgtctggcagagggattggaaaaatgacactcggcatgtgctgcatcatcaccgcgtccattctgctttggtatgcccagatccagcctcactggattgctgccagcatcattctggagttctttctcatcgtcctgctgatccccgagcccgaaaagcagcggacgcctcaagataatcagctcacatacgtggtcattgccatccttaccgtggttgctgccaccatggcgaacgagatgggcttcctggaaaagacaaagaaagacctggggctcggatccattaccacacagcagccggagtctaatatcctggacattgatcttcgccccgccagcgcttggacgctgtatgccgtggctaccacatttatcacccctatgctcagacattccattgaaaactctagcgtgaatgtctccctgacagccatcgcgaaccaagccaccgttctgatgggcctcgggaagggatggccccttagcaagatggacatcggcgtgcctctgctggctattgggtgttactctcaggtgaatcccatcacgctcaccgccgctctgcttctgctcgtcgcccactacgctattatcggacctggcctgcaggccaaagcgacacgggaggcccagaagcgcgctgccgctggcattatgaaaaacccgaccgtggatgggatcacagttatcgacctggatcccattccttatgaccccaagttcgagaaacaactcggacaggtgatgcttctggtcctgtgcgtgacccaggtcctcatgatgagaacgacatgggccctgtgtgaagcccttaccctggcgacaggccctatctccaccctctgggaggggaatcccggacggttttggaacaccacaattgctgtgagcatggccaatatcttccgcggctcttacctggctggggccggactgctcttttccattatgaagaacacgaccaatacaagacggggcaccggcaacatcggggaaacacttggagagaagtggaaaagcagactgaacgccctgggcaagtctgagttccaaatctataaaaagagcgggattcaggaggttgatcgcaccctcgctaaagagggaatcaagcggggcgaaacggaccatcacgccgtgtccagagggtctgcgaaactgcgctggtttgtcgagcggaatatgattacaccggaaggaaaggtggttgatcttggctgcggcagagggggatggagctactattgtggcgggctgaagaacgtgcgcgaggtcaaaggactcaccaagggcgggcctggacatgaggaacccatccccatgtccacctacggctggaatctggtgcggctgcagagcggcgtggacgttttcttcacacctcccgagaaatgcgataccctcctttgtgacattggggaatcctctcctaacccgacagtcgaggccggaagaacgctgcgcgtgctgaatctcgtggaaaactggctgaataacaatacccagttttgcatcaaggtccttaacccctatatgcctagcgttatcgagaaaatggaggctctgcaacggaagtacggcggggccctcgtgagaaatcccctgtcccgcaactctacacacgaaatgtactgggtgagcaatgcttccggaaacattgtctctagcgtgaatatgatctcccggatgctgattaacagattcaccatgaagcacaaaaaggccacatatgagcctgatgttgacctcggcagcgggacccgcaacatcggaattgaatctgaggtgcccaatcttgacatcattggcaaaagaatcgaaaagatcaaacaggagcatgagacgtcctggcactacgatcaggaccatccgtataagacctgggcgtaccacggcagctatgaaacaaagcagaccgggtctgcctccagcatggtcaacggagtggttcggctgctgacaaaaccttgggatgtgattcccatggtcacccaaatggctatgacagacaccacgccttttggccagcagcgcgtgttcaaggagaaagtggatacaagaacccaggaacccaaggaggggaccaaaaagctcatgaagatcacagccgaatggctgtggaaagagcttggaaagaaaaagacgcctcggatgtgtaccagagaggaatttacacggaaagtccgctctaatgctgccctgggcgctattttcaccgacgagaacaagtggaaatccgccagagaagcggttgaggatagccggttttgggagctcgtggacaaggaacgcaatctgcacctggaggggaagtgcgaaacatgtgtgtacaacatgatgggaaaaagagagaagaaactcggcgagttcggcaaggccaaagggtcccgggctatctggtatatgtggctgggagcccgctttcttgagttcgaggctctgggctttctcaatgaagatcattggttcagcagagagaactctctgagcggggtcgaaggagagggccttcacaagctggggtacattctccgggacgtgtccaagaaagaaggcggagccatgtacgccgatgacaccgcgggctgggacacacgcatcaccctggaggatctgaagaatgaggaaatggttacgaaccatatggagggggaacacaaaaagctcgctgaggccatctttaaactgacctatcaaaataaggtggtcagagtgcagcggcccacaccgcgcggaaccgttatggacattatctctagacgggatcagcgcggcagcgggcaagtgggaacatacggccttaacaccttcacgaatatggaagcccagctgattagacagatggagggggagggcgtcttcaagtccatccagcatctcacagctaccgaagagattgccgtgcaaaactggctggctcgggttggaagagaacgcctttctcggatggccatcagcggcgacgattgcgtggtcaaacctctggacgatagatttgcgtccgccctcacagctctgaatgacatggggaaggtgcgcaaagatatccagcagtgggagccctctaagggatggaacgactggacccaggtccccttctgcagccaccactttcatgagctgattatgaaagatggccgggtgctcgttgtgccttgtagaaaccaagacgaactgatcgggcgcgcccggatttcccagggagctggctggagccttagagagacggcctgcctggggaagtcttatgcgcagatgtggtccctcatgtacttccaccgccgggatctgagacttgccgctaatgccatctgtagcgctgtcccgtctcattgggtgcccacctcccgcacaacctggagcattcacgccaagcacgaatggatgacaaccgaggacatgctgacagtgtggaaccgggtttggatccaggaaaatccttggatggaggacaaaacccccgtggagtcctgggaagagattccttatctcggcaagagagaagatcaatggtgcggatctctgatcggcctgacgagccgggctacatgggccaaaaacatccagaccgcgattaatcaggtcagatccctcatcgggaacgaggaatacaccgactatatgcccagcatgaagcgctttcggagagaggaggaagaggccggagtgctgtggtga

SEQ ID NO: 19556 - RNA, 9876 nt, synthetic construct
  misc_feature 1..9876: note = derived and/or modified CDS sequence (opt5) from DENV-2__KF744407__SS-prME
  source 1..9876: mol_type = other RNA
acagccggaatgatcattatgctgatccccacagtgatggctttccacctcacgaccagaaatggggaacctcatatgattgtcagccggcaggaaaaggggaaatccctgctttttaagacagaggacggagttaatatgtgcaccctgatggccatggatctcggggaactgtgtgaggacacaatcacctacaaatgcccgcttctgagacaaaatgaacccgaggatattgactgttggtgcaattctacaagcacctgggtgacgtatgggacctgtacaaccacaggcgagcacagacgggaaaagcgctccgtggcgctcgtccctcatgtggggatgggactggagaccagaacggaaacatggatgtctagcgagggcgcttggaaacacgcccagcggatcgagacctggatcctgcgccatcccggcttcacactcatggccgctattctggcctacaccatcgggaccacaaactttcagagagctcttattttcatcctgctcacggccgttgcgccttccatgaccatgcggtgcattggaatctctaatcgcgattttgtggaaggcgtcagcgggggatcctgggtggacattgttctggagcacggcagctgtgtgacaaccatggccaagaacaagcccacacttgatttcgaactgatcaaaaccgaggctaagcaccctgccacgctcagaaaatattgcatcgaagctaagctgacaaataccaccacagcctctcggtgtccgacccagggggagccctccctgaacgaggaacaagacaaacgctttgtctgcaagcatagcatggtggatagaggatggggcaatggctgtggactgttcggaaagggcgggattgtgacatgcgcgatgtttacgtgcaaaaagaacatggagggaaaagtcgttcagcctgaaaatctggagtacaccatcgtgattacaccccactctggcgaagaacatgccgtggggaacgacaccggaaagcacggcaaagagatcaagattacacctcagtccagcatcaccgaagctgagcttacgggctatgggaccgtcacaatggaatgttctccccggaccggactggatttcaatgagatggtgctcctgcagatggaaaacaaagcctggcttgttcaccgccaatggtttctggacctcccgctgccttggctgcccggcgctgatacacaggggtccaattggatccagaaggagaccctcgtgacgttcaagaaccctcatgccaaaaagcaggacgtcgtggttctgggaagccaagagggcgccatgcacacagctcttaccggggcgacagaaattcagatgtcctctggcaacctgctctttaccggacatctgaaatgcagacttcggatggacaagctgcagctcaaaggcatgagctactccatgtgtaccgggaagttcaaggtggtcaaagagatcgccgaaacacaacacggaacgattgtggtcagagtgcagtatgagggcgatgggagcccctgcaagatccccttcgagattatggacctggaaaaacgccatgttctgggacggctcatcaccgtgaatcctatcgtcacagagaaggattctccggtgaacattgaagctgagcccccttttggcgactcctacgttatcattggggtggaacccggccagctgaaacttaattggttcaagaagggaagctctatcggccagatgtttgagaccacaatgagaggggccaaacgcatggccattctgggagataccgcttgggacttcggcagcctcgggggagtctttacgtccatcggcaaggccctgcaccaagtgttcggggcgatttacggcgctgccttttctggagtgagctggacaatgaaaatcctgatcggcgttattatcacctggattgggatgaactcccggagcacctctctttccgtcagcctcgtgctggtgggagtcgtgacactgtatctcggcgttatggtgcaggccgattctgggtgtgtcgcttcctggaagaataaagagctgaagtgcggaagcggcatcttcattaccgacaacgtgcacacatggacggaacagtacaagtttcagcctgagtccccctctaaacttgccagcgctatccaaaaggcccatcaggaagggatctgtggcattagatccgttacccgcctggagaatctcatgtggaaacagatcacaccggaactgaaccacattctgtctgagaatgaggtgaaacttaccatcatgacaggagatattaaaggcatcatgcatgcggggaagcggagcctcagacctcagcccaccgaactgcgctattcctggaaaacgtggggaaaggccaagatcctgagcaccgagtctcacaaccaaacattcctcattgacggccctgaaaccgctgagtgccccaatacaaaccgggcctggaactccctggaagtcgaggattacgggtttggagtgttcaccacaaacatctggcttagactgcgcgagaaacaggacgctttttgtgacagcaagctcatgtctgccgcgattaaagataatcgggccgttcacgctgacatgggctattggatcgaatccgccctgaacgatacctggaagattgagaaagctagcttcatcgaagtgaagtcttgccattggcctaagagccacacgctgtggtccaacggcgtccttgagagcgagatgatcattcccaaaaatttcgccgggccggtgtctcagcataactacagacctggatatcacacacagaccgccggcccctggcatctcgggaagctggaaatggactttgatttctgtgagggaaccacagtggtcgttaccgaagactgcggcaatcgggggccctccctgcgcacgacaaccgctagcggaaaactcatcacagagtggtgctgtagatcctgcaccctgcctccgcttcggtacagaggcgaagatggctgttggtacgggatggagattcgccccctgaaggagaaagaagagaacctcgtgtctagcctggtgacagcgggacacggccaaatcgacaatttttccctgggggtccttggaatggccctcttcctggaagagatgctgcggaccagagtgggcacgaagcacgctattctcctggttgccgtgtcttttgtcacccttatcacagggaacatgagcttccgcgatctgggaagagtgatggttatggtgggcgccaccatgacagacgatattggcatgggggtcacctatctcgctctgctggccgcgtttaaggtgcggcctacgttcgctgccggacttctgctccgcaaactgacatccaaggaactcatgatgaccacaatcggcatcgttctgctttctcagagcaccattcccgagaccatcctggagctcacagacgccctggctctggggatgatggtgcttaaaattgtcagaaatatggaaaagtaccagctggccgtgacgatcatggcgattctctgcgtgcctaacgctgtcatcctgcaaaatgcctggaaagtttcctgtaccatcctcgccgtggtgagcgtctctcccctgcttctgacatccagccagcagaaggctgattggattcctctcgccctgaccatcaagggactgaaccccacagctatttttcttaccacgctgtctcggacatccaaaaagcgcagctggccgctcaatgaggccatcatggcggtgggcatggtttctattctggcctccagcctcctgaaaaacgacatccctatgaccgggccccttgtggctggaggcctgctgaccgtctgctatgtgctcacaggcagatccgccgacctggaacttgagaaggctgccgatgttcggtgggaagaacaggccgagatcagcgggtctagccctattctgtccatcattatctctgaagacggaagcatgtccattaaaaatgaggaagaggagcaaaccctcacaatcctgattcgcacgggcctcctggtgatctctgggcttttccccgtcagcatcccgattaccgctgcggcctggtacctgtgggaagtgaagaaacagagagctggagtcctgtgggatgtgccttctccccctcccgttggcaaggccgagctcgaagacggggcctatcggatcaagcagaaaggcattctgggctacagccagatcggcgctggggtgtataaggagggaacatttcataccatgtggcacgtcacacgcggcgccgtgcttatgcataaagggaagagaattgaacccagctgggcggatgttaaaaaggacctgatctcctacggaggcgggtggaagctcgagggagagtggaaagaaggcgaggaagtgcaagtcctggctctcgagcctggcaagaacccgcgggccgtgcagaccaaacccgggctgttcaagacgaatgccggaaccatcggcgctgtgagccttgatttttctcctgggacatccggaagccccattatcgacaaaaagggcaaggttgtcgggctgtacggaaacggcgtggtgaccagaaacggctcttatgtctccgccattgcgcagacagaaaagagcatcgaggataatcctgagattgaggacgatatcttccgcaagaaacggctgaccatcatggacctccaccccggggctggaaagacaaaaagatacctgcctgccattgtgcgcgaggccatcaagcggggccttagaacgctgattctcgctccgacccgcgttgtggccgctgaaatggaggaagccctgcgggggctccccatcagatatcagacccctgcgattcgcgccgagcataccggacgggagatcgtcgatctgatgtgtcacgctaccttcacaatgagacttctgtcccccattcgggtgcctaactacaatctgatcatcatggacgaagcccactttacggaccccgcttctattgccgcccgcggctatatcagcaccagagttgagatgggggaagctgcgggcattttcatgacagccaccccgcctggatcccgggatccctttccccaaagcaacgctcctatcatggacgaggagcgcgaaattcccgagagatcttggaactccggccatgaatgggtgacagatttcaaggggaaaaccgtctggtttgtgcctagcatcaaggccggaaacgacatcgccgcttgcctccggaaaaatggcaagaaagttattcagctgtctagaaagacgttcgatagcgagtacgtgaagacacgcaccaacgactgggattttgtcgtgaccacagacatctccgaaatgggggccaatttcaaagcggagcgggtgattgatccgagacgctgtatgaagcccgtcatccttaccgacggagaggaacgggttattctggctggccctatgcccgtgacacactctagcgccgcccagagacgcgggcggatcggcagaaaccctaaaaatgagaacgatcaatatatctacatgggagaacccctcgagaatgacgaagactgcgctcattggaaggaggccaaaatgctgctggataacattaataccccggagggcatcattccttccatgtttgaacccgagcgcgaaaaggtggacgcgatcgatggggagtacagactccggggagaagcccgcaaaacgttcgtcgaccttatgagacggggcgatctgcctgtgtggctggcttataaggttgccgctgaggggattaactacgccgaccgcagatggtgttttgatggaatccggaacaatcagattctcgaggaaaacgtggaggtcgaaatctggacaaaggagggcgagcgcaaaaagctgaaaccccgctggcttgacgctcggatctattctgatcctctggccctcaaggagttcaaagagttcgcggccgggagaaagagcctgaccctgaatctcattacagaaatgggccgccttcccacctttatgacgcagaaggctcgggacgccctggataacctggctgtgctccacaccgccgaggccggaggcagagcttacaatcacgcgctgtccgaacttccggagacactggagaccctcctgctgctcacacttctggccaccgttacagggggaatcttcctgtttctcatgagcggcaaagggattggaaagatgaccctgggcatgtgctgcatcattacggcttctgtgcttctgtggtatgcccagatccaacctcattggatcgccgcttccattatcctcgagttctttctgattgtcctgctcatccccgagcccgaaaaacagcggacacctcaggacaaccagcttacctacgtggtcattgccatcctgaccgtggttgcggccacaatggctaatgagatgggcttcctggaaaagaccaaaaaggattttgggctcggaagcatcgccacacaacagccggagtccaacattctggacatcgaccttcgccccgcttctgcctggacgctgtatgcggtggccaccacattcattacccctatgctcagacacagcatcgaaaattcctctgtgaacgtcagcctgacagctattgccaatcaggctaccgttctgatgggcctcgggaagggatggcccctttccaaaatggatatcggcgtgcctctgctggccattgggtgttacagccaggtgaaccccatcacgctcaccgctgccctgcttctgctcgtcgcgcattacgccatcattggacctggcctgcaagctaaggccacacgggaagctcagaaacgcgccgccgcgggcatcatgaagaatccgaccgtggacgggattacagttatcgatctggaccccattccttatgatcccaaatttgagaagcagctcggacaggtgatgcttctggtcctgtgcgtgacccaagtcctcatgatgagaacgacatgggctctgtgtgaagcccttaccctggctacaggccctatctctaccctctgggaggggaaccccggacggttctggaataccacaatcgccgtgtccatggccaacatttttcgcggcagctacctggctggggccggactcctcttctctatcatgaagaatacgaccaacacaagacggggcaccggcaacattggggaaacacttggagagaaatggaagtcccgcctgaatgcgctgggcaaaagcgagtttcagatctataagaaatctgggattcaggaagttgacagaaccctcgccaaggagggaatcaaacggggcgaaacggatcaccatgctgtgagcagagggtccgccaagctgcgctggttcgtcgagcggaacatgatcacaccggagggaaaggtggttgaccttggctgcggcagagggggatggtcttactattgtggcgggctgaaaaatgtgcgcgaagtcaagggactcaccaaaggcgggcctggacacgaggaacccattcccatgagcacctacggctggaacctggtgcggctgcaatccggcgtggatgttttctttacacctcccgagaagtgcgacaccctcctttgtgatatcggggaaagctcccctaatccgacagtcgaggctggaagaacgctgcgcgtgctgaacctcgtggagaattggctgaacaataacacccagttctgcattaaagtccttaatccctatatgccttctgttatcgaaaagatggaggccctgcagcggaagtacggcggggcgctcgtgagaaaccccctgagccgcaattccacacacgaaatgtactgggtgtctaacgccagcggaaatattgtctcctctgtgaacatgatcagccggatgctgatcaacagatttaccatgaaacataagaaagctacatatgagcctgacgttgatctcggctccgggacccgcaatattggaatcgaaagcgaggtgcccaaccttgacattatcggcaagcggattgagaaaatcaagcaggaacacgagacgtcttggcattacgaccaagatcacccgtataagacctgggcctaccacggctcctatgaaacaaaacagaccgggagcgcttcttccatggtcaatggagtggttagactgctgacaaagccttgggacgtgattcccatggtcacccagatggccatgacagataccacgcctttcggccagcaacgcgtgtttaaagagaaggtggacacaagaacccaggaacccaaagaggggaccaagaagctcatgaaaatcacagctgagtggctgtggaaggaacttggcaaaaagaaaacgcctcggatgtgtacccgcgaggagttcacaagaaaggtccggagcaacgccgcgctgggcgccatctttaccgatgagaataaatggaagtctgctagagaggccgttgaagactcccggttctgggagctcgtggataaggaacgcaacctgcatctggaggggaaatgcgaaacatgtgtgtacaatatgatgggaaagagagagaaaaagctcggcgagtttggcaaagctaaggggagccgggccatttggtatatgtggctgggagcccgcttccttgaatttgaggcgctgggcttcctcaacgaagaccactggttttccagagagaatagcctgtctggggtcgaaggagagggccttcataagctggggtacatcctccgggatgtgagcaaaaaggagggcggagctatgtacgccgacgataccgccggctgggacacacgcattaccctggaagacctgaaaaacgaggaaatggttacgaatcacatggagggggaacataagaaactcgctgaggccatcttcaagctgacctatcagaacaaggtggtcagagtgcagcggcccacaccgcgcggaaccgttatggatattatctccagacgggaccaacgcggctctggacaggtgggaacatacggccttaataccttcacgaacatggaggctcagctgatcagacaaatggaaggggagggcgtctttaaaagcattcagcacctcacagccaccgaagagatcgcggtgcagaattggctgacacgggttggacgcgagagactttcccggatggccatttctggcgatgactgcgtggtcaagcctctggatgacagattcgctagcgccctcaccgctctgaacgatatggggaaagtgcgcaaggacatccagcaatgggaaccctccaaaggatggaacgattggacgcaggtccccttttgctctcaccatttccacgagctgattatgaaggacggccgggtgctcgttgtgccttgtagaaatcaggatgaactgatcgggcgcgcccggatcagccagggagcgggctggtcccttagagagaccgcctgcctggggaagtcctatgctcaaatgtggtctctcatgtactttcatcgccgggacctgagacttgccgctaacgccatttgttccgctgtcccgagccactgggtgcccacatctcgcaccacatggtccatccacgccaaacatgaatggatgaccacagaggatatgctgaccgtgtggaatcgggtttggattcaggagaacccttggatggaagacaagacgcccgtggagagctgggaagagatcccttatctcggcaaaagagaagaccagtggtgcggatccctgattggcctgacatctcgcgcgacctgggccaagaatatccagaccgctattaaccaagtccggagcctcatcgggaatgaggagtacacagattatatgccctccatgaaaagattccggagagaagaggaagaggccggagtgctgtggtga

SEQ ID NO: 19557 - RNA, 9876 nt, synthetic construct
  misc_feature 1..9876: note = derived and/or modified CDS sequence (opt5) from DENV-2__KF744399__SS-prME
  source 1..9876: mol_type = other RNA
acagccggaatgatcattatgctgatccccacagtgatggctttccacctcacgacccggaatggggaacctcatatgattgtcagccggcaggaaaagggaaaatccctgctttttaagacagaggacggcgttaatatgtgcaccctgatggccatggatctcggggaactgtgtgaggacacaatcacctacaaatgcccgcttctgagacaaaacgaacccgaggatattgactgttggtgcaattctacaagcacctgggtgacgtatggaacctgtacaaccacaggcgagcacagacgggaaaagcgctccgtggcgctcgtccctcatgtggggatgggactggagaccagaacggaaacatggatgtctagcgagggcgcttggaaacacgcccagcggatcgagacctggatcctgcgccatcccggcttcacactcatggccgctattctggcctacaccatcgggaccacaaactttcagagagctcttattttcatcctgctcacggccgttgcgccttccatgaccatgcggtgcattggaatctctaatcgcgattttgtggaaggcgtcagcgggggatcctgggtggacattgttctggagcacggcagctgtgtgacaaccatggccaagaacaagcccacacttgatttcgaactgatcaaaaccgaggctaagcaccctgccacgctcagaaaatattgcatcgaagctaagctgacaaataccaccacagagtctcggtgtccgacccagggggagccctccctgaacgaagaacaagacaaacgctttgtctgcaagcatagcatggtggatagaggatggggcaatggctgtggactcttcggaaagggcgggattgtgacatgcgccatgtttacgtgcaaaaagaacatggaaggaaaaatcgtccagcctgagaatctggaatacaccattgttatcacaccccactctggcgaggagaacgcggtggggaatgacaccggaaagcatggcaaagaaattaaggtgacacctcagtccagcatcaccgaggccgaacttacgggctatgggaccgtcacaatggagtgttctccccggaccggactgggcttcaacgaaatggtgctcctgcagatggagaataaggcttggcttgttcaccgccaatggtttctggatctcccgctgccttggctgcccggggccgacacacagggatccaactggatccagaaggagaccctcgtgacgttcaagaaccctcacgctaaaaagcaggatgtcgtggttctgggcagccaagaaggggccatgcatacagcccttaccggcgctacagagattcagatgtcctctggaaatctgctctttaccggccacctgaaatgcagacttcggatggacaagctgcagctcaaagggatgagctactccatgtgtaccggaaagttcaaggtggtcaaagaaatcgcggagacacaacatggcacgattgtggtcagagtgcagtatgagggggacggaagcccctgcaagatccccttcgaaattatggatctggagaaacgccacgttctgggccggctcatcaccgtgaaccctatcgtcacagaaaaggactctccggtgaatattgaggccgaacccccttttggggattcctacgttatcattggcgtggagcccggacagctgaaacttagctggttcaagaagggctctagcatcgggcagatgtttgagaccacaatgagaggagctaaacgcatggccattctgggcgacaccgcctgggatttcgggtccctcggaggcgtctttacgtctatcgggaaggctctgcatcaagtgttcggcgccatttacggagcggcttttagcggcgtgtcctggacaatgaaaatcctgatcggggttgtcattacctggatcggaatgaacagccggtctacctcccttagcgtgtctctcgtgctggtcggcgtggttacactgtatctcggggtgatggtccaggccgactccggatgtgtggttagctggaagaataaagaactgaagtgcggctccgggattttcatcaccgataacgtgcacacatggacggagcagtacaagtttcagcctgaatctcccagcaaacttgcctccgctattcaaaaggcccaccaggagggcatctgtggaatcagatctgtcacccgcctggaaaatctcatgtggaaacagattacaccggagctgaaccatatcctgagcgagaatgaagtgaaacttaccattatgacaggcgacatcaaagggattatgcacgctggaaagcggtccctcagacctcagcccaccgagctgcgctatagctggaaagcctggggcaaggcgaagatcctgtctacggaactccataaccaaaccttcctgatcgatgggcctgagacagccgaatgccccaataccaaccgggcttggaatagccttgaggttgaggactacggatttggcgtgttcacaaccaacatttggctgaaactcagagaaaagcaggatgccttttgtgacagcaaactgatgtctgctgccatcaaggacaatcgcgcggtccacgccgatatgggctattggattgagtccgctctgaacgacacatggaaaatcgaaaaggccagcttcattgaggtgaagtcttgccactggcctaaaagccataccctttggtccaacggggtgctcgagagcgaaatgatcatccccaagaatttcgctggaccggtctctcagcacaactaccggcctggctatcatacgcagacagccgggccctggcacctgggaaaactggagatggattttgacttctgtaagggcaccaccgttgtggtgacagaagattgcgggaatagaggaccctccctccggaccacgacagccagcggcaaactgattaccgagtggtgctgtcgctcctgcacacttcctccgctgagataccggggcgaagacgggtgttggtacggaatggagatcagacccctcaaggagaaggaagagaacctggtcaattctctggtgaccgctggccatgggcaaattgataactttagccttggagttctcggcatggcgctgttcctggaagagatgctccgcacacgggtggggaccaaacacgccatcctgcttgtcgctgtgtcctttgttacgctgattaccggaaatatgtctttcagagacctcggccgcgtgatggtcatggtgggcgccacaatgaccgatgacatcgggatgggagttacatatctggccctgcttgctgcctttaaggtgagacctaccttcgcggctggcctgctcctgcggaaactcacgagcaaggaactgatgatgacaaccattgggatcgtccttctgtcccagtctacaatccccgagaccattctcgagctgaccgatgccctggcccttggaatgatggtgctgaaaatcgtgcgcaagatggaaagataccagctcgctgtcacaattatggccatcctgtgcgttcctaacgcggtgattctccaaaatgcttggaaggtgagctgtacgatcctggccgtcgtgtccgttagcccccttctgctcacctcttcccagcagaaagccgactggatccctctggctctgacaattaagggccttaaccccaccgccatctttctgacaaccctcagccggacgtctaaaaagcgctcctggccgctgaatgaggctattatggccgtggggatggtcagcatcctcgcgtcttccctgcttaaaaacgatattcctatgacaggacccctggtggccggcggcctgctcaccgtttgctatgtgctgaccgggagaagcgctgaccttgaactggagaaggccgctgacgtccggtgggaagaacaggccgagatctccggaagctctcctatcctcagcattatcatttccgaagatggctctatgagcatcaaaaatgaggaagaggagcaaacactgaccattctcatccgcacagggctgcttgtgatttccggactgttccccgtctctatcccgatcacggccgctgcgtggtacctgtgggaagtgaagaagcagagagccggcgttctctgggacgtgccttctccccctcccgtcgggaaagctgagctggaagatggagcctatcggattaagcagaaaggcatccttggctactcccagattggggccggagtgtataaggagggcacctttcacacaatgtggcatgttacccgcggggctgtgctgatgcacaaaggaaagagactcgaaccctcctgggccgacgtcaagaaagatctgatcagctacggcgggggatggaagctcgagggcgagtggaaagaaggcgaggaagtgcaagtgctggcgcttgagcctgggaagaacccgcgggctgttcagacaaaacccggactgttcaagaccaatacgggcaccattggggccgtctccctggactttagccctggaacatctggctcccccatcatcgataagaaagggaaggtggtgggactctacggcaacggcgtcgtgaccagaaacgggagctatgtttctgccattgctcagacagaaaaatccatcgaggacaatcctgagattgaagatgacatcttccgcaagaaacggctgaccattatggatcttcatcccggagccggcaagacaaagagatacctgcctgcgatcgtgcgcgaggctatcaaacgggggctcagaacgctgattctcgccccgacccgcgtcgtggccgctgaaatggaggaagccctgcggggacttcccatcagatatcagacccctgctattcgcgccgagcacaccggccgggagatcgttgacctgatgtgtcatgcgaccttcacaatgagactgctcagccccattcgggtgcctaactacaatctgatcattatggatgaagcccactttacggaccccgcttccatcgccgctcgcgggtatatctctaccagagtcgagatgggcgaagccgccggaattttcatgacagctaccccgcctggcagccgggacccctttccccaatccaacgcgcctatcatggatgaggagcgcgaaattcccgagagaagctggaactctgggcacgaatgggtgacagacttcaagggaaaaaccgtttggtttgtgccttccatcaaggccggcaacgatattgctgcctgccttcggaaaaatgggaagaaggtcatccagctgagcagaaaaacgttcgactctgagtacgtgaagacacgcaccaacgattgggactttgtggtcaccacagatatcagcgaaatgggagccaatttcaaagctgagcgggttattgacccgagacgctgtatgaagcccgtgatcctcaccgatggcgaggaacgggtgattctggccgggcctatgcccgtcacacattcctctgcggctcagagacgcggccggatcggaagaaaccctaaaaatgagaacgaccaatatatttacatgggcgaacccctggagaatgatgaagactgcgcccactggaaggaggccaaaatgctccttgacaacatcaataccccggaggggatcattcctagcatgtttgaacccgagcgcgaaaaggtggatgctatcgacggagagtacagactgcggggcgaagcccgcaagacgttcgttgatctgatgagaagaggggacctccctgtgtggctggcgtataaagtcgccgctgagggaattaactacgccgatcgcagatggtgttttgacggcatccggaacaatcagattcttgaggaaaacgtggaggttgaaatctggacaaaggagggggagcgcaagaagctgaaaccccgctggctcgatgctcggatttattccgaccctctggccctgaaggagttcaaggagttcgctgccggcagaaaatctctcacccttaatctgatcacagaaatgggacgcctgcccacctttatgacgcagaaggcgcgggatgccctcgacaacctggctgtgcttcataccgccgaggctggcgggagagcctacaatcacgccctgagcgaactcccggagacactggagaccctgctccttctgacactgctcgctaccgtcacaggaggcatcttcctgtttcttatgtccgggaaaggaattggcaagatgaccctgggcatgtgctgcatcattacggcgagcgtgctcctgtggtatgcccagatccaacctcactggattgctgcctctatcatcctggagttctttctcattgtccttctgatccccgagcccgaaaaacagcggacacctcaggataaccagctgacctacgtggttattgccatcctcaccgtggtggctgccacaatggcgaatgagatggggttcctggaaaagaccaagaaagactttggacttggctccattgccacacaacagccggagagcaacatcctggatatcgacctccgccccgcttccgcctggacgctgtatgctgtcgccaccacattcattacccctatgctgagacattctatcgagaatagctccgttaacgtgtctctcacagcgattgccaatcaggctaccgtgcttatggggctgggaaagggctggcccctgagcaaaatggacatcggggtccctctcctggccattggatgttactcccaggtgaaccccatcacgcttaccgctgccctgctcctgctggttgctcactacgccattatcggccctggcctccaagcgaaggccacacgggaagctcagaaacgcgccgctgccgggatcatgaagaatccgaccgtggatggaattacagtcatcgaccttgatcccattccttatgaccccaagtttgagaaacagctgggccaggtgatgctgctcgtcctgtgcgtgacccaagttcttatgatgagaacgacatgggccctgtgtgaagcgctcaccctggctacagggcctatcagcaccctgtgggagggaaaccccggccggttctggaataccacaattgccgtgtctatggctaacatctttcgcgggtcctacctcgccggagccggccttctgttcagcatcatgaagaatacgaccaacacaagacggggcaccgggaacattggagaaacactgggcgagaaatggaagtctcgcctcaatgctctggggaaatccgagtttcagatctataagaaaagcggcattcaggaagtcgatagaacccttgccaaggagggcatcaagagaggggaaacggaccatcacgcggtgtctagaggaagcgccaaactgcgctggttcgttgagcggaacatggtgacaccggagggcaaggtcgtggatctcggctgcgggagaggaggctggtcctactattgtgggggactgaaaaatgtgcgcgaagttaagggcctgaccaaagggggacctggccatgaggaacccattcccatgtctacctacggctggaacctcgtccggcttcaaagcggggtggacgtgttctttacacctcccgagaagtgcgataccctgctgtgtgacatcggagaatccagccctaatccgacagtcgaggctggcagaacgctccgcgttctgaaccttgtggagaattggctgaacaataacacccagttctgcatcaaggtgctcaatccctatatgccttccgtcattgagaagatggaggccctgcagcggaagtacgggggagctctggtgagaaaccccctctctcgcaatagcacacacgaaatgtactgggtttccaacgcctctggcaatatcgtgagctccgtcaacatgatttctcggatgcttatcaacagatttaccatgcgccacaaaaaggcgacatatgagcctgatgtggacctggggagcggaacccggaatattggcatcgaatccgagatccccaacctggatattatcggcaaaagaattgagaagatcaagcaggaacatgagacgagctggcactacgaccaagaccatccgtataaaacctgggcctaccacgggtcttatgaaacaaagcagaccggatccgctagctctatggttaatggcgtggtccgcctcctgacaaaaccttgggatgtgattcccatggtgacccagatggccatgacagacaccacgcctttcgggcagcaaagagtctttaaggagaaagttgatacacggacccaggaacccaaggagggaaccaagaaacttatgaagatcacagctgagtggctgtggaaagaactcggcaagaaaaagacgcctcgcatgtgtaccagagaggagttcacacggaaagtgagatccaacgccgctctgggggccatttttaccgacgagaataagtggaaaagcgcgcgggaggccgtggaagattctcgcttctgggagctggtcgacaaagaaagaaacctccacctggagggaaagtgcgaaacatgtgtgtacaatatgatgggcaaacgggagaagaaacttggcgagtttgggaaggctaagggatcccgcgccatctggtatatgtggctgggcgctagattcctcgaatttgaggccctggggttccttaacgaagatcattggtttagccgggaaaattccctgagcggagttgaaggcgaggggctccacaaactgggctacatcctgcgcgaggtgtctaagaaagaaggaggcgccatgtacgcggacgataccgctgggtgggacacaagaattaccctcgaggatctgaagaacgaagagatggtcacgaatcatatggaaggagagcacaagaaacttgccgaggccatcttcaaactgacctatcagaacaaagtggttcgggtgcagcgccccacaccgagaggcaccgtcatggacattatcagccggcgcgaccaaagagggtccggacaggtgggcacatacgggctcaataccttcacgaacatggaagctcagctgattcggcaaatggagggcgaaggagtttttaagtctatccagcatcttacagccaccgaggagaatgctgtgcagaactggctggcccgcgtcggcagagaacggctcagcagaatggcgatctccggggatgactgcgtggtcaaacctctggatgaccgcttcgcctctgctctgacagccctcaacgatatgggaaaggtgcggaaagacattcagcaatgggagcccagcagaggctggaatgattggacccaggttcccttttgctcccaccacttccatgaactgatcatgaaggacgggcgcgtgcttgtcgtgccttgtcggaaccaggatgagctgattgggcgggctcgcatctctcagggcgccgggtggagcctccgggaaacggcgtgcctgggcaagtcctatgcccaaatgtggagccttatgtactttcacagacgcgacctgcggctcgctgccaatgctatttgttctgccgtgccgtcccattgggttcccaccagcagaacaacctggtctatccacgctaaaaacgagtggatgacaaccgaggatatgctgacagtgtggaatcgcgtctggatccaggaaaacccttggatggaggacaagacccccgtggaatcctgggaggaaattccttatctgggaaaacgggaggatcagtggtgcggcagcctcatcgggctgacgtccagagccacatgggcgaagaatattcagaccgccatcaaccaagttcggtctcttattggaaatgaggaatacaccgactatatgcccagcatgaaaagattccgccgggaggaagaggaagctggcgtgctgtggtga

SEQ ID NO: 19558 - RNA, 9876 nt, synthetic construct
  misc_feature 1..9876: note = derived and/or modified CDS sequence (opt5) from DENV-2__JX286516__SS-prME
  source 1..9876: mol_type = other RNA
acagccggcgtgatcgtgatgctgattcccacagctatggccttccacctcacgacccggaatggggaacctcatatgatcgttggacggcaggaaaagggcaagagcctgctttttaagacagaagacggggtgaatatgtgcaccctgatggcgattgatctcggagaactgtgtgaggacacaatcacctacaaatgcccgcttctgcgccaaaatgaacccgaggatattgactgttggtgcaattccacatctacctgggtgacgtatggcacctgtacaaccacaggggagcacagacgggaaaagcgcagcgtcgctctcgtgcctcatgttggaatgggcctggagaccagaacggaaacatggatgtcctctgagggcgcctggaaacacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaagaacaggacaaacgctttatctgcaagcattccatggtggatagaggctggggcaacgggtgtggactgttcggcaaaggcgggattgtcacatgcgccatgtttacgtgcaaaaagaatatggaagggaaaatcgttcagcctgagaacctcgaatacaccattgtgatcacaccccacagcggggaggagcatgcggtgggaaatgacaccggcaagcacggcaaagaaatcaagattacacctcagtcttccaccacggaggccgaactgaccgggtatggaatcgtcacaatggagtgtagcccccggaccggccttgatttcaacgaaatggtgctgctccaaatggaggacaaggcttggctggttcaccgccagtggtttcttgatctgccgctcccttggctgcccggggccgacacacagggatctaattggattcagaaggagaccctggtgacgttcaagaaccctcatgctaaaaagcaagacgtcgtggttctcggctcccaggaaggggccatgcacacagccctgaccggcgctacagagatccagatgagctccggaaatcttctgtttaccggccatctcaaatgcagactgcggatggataaacttcaactgaaagggatgtcttacagcatgtgtaccggaaagttcaagattgtgaaagaaatcgcggagacacagcacggcacgatcgtcattagagtgcagtatgagggggacggatccccctgcaagatccccttcgaaattaccgatctcgagaaacgccatgtcctgggccggctgatcacagtgaaccctattgttaccgaaaaggacagcccggtgaacatcgaggccgaacccccttttggggattcttacattatcgtcggcgtggagcccggacagctcaaactgaattggttcaagaagggctccagcatcgggcaaatgtttgagacaaccatgagaggagctaaacgcatggccattcttggcgacacggcctgggatttcgggtctctgggaggcgtttttacaagcatcgggaaggctctccaccaggtgttcggcgccatttacggagcggctttttccggcgtctcttggaccatgaaaatcctgattggggtgatcatcacctggattggaatgaacagccggtccacaagcctgtctgtgtcccttgttctcgtcggcgtggtgaccctgtatctgggggccatggtccaggccgacagcggatgtatcgtgtcttggaagaataaagaactcaagtgcggctccgggattttcatcacagataacgttcacacgtggaccgagcagtacaagtttcaacctgaaagcccctccaaactggcttctgccattcagaaggctcatgaggaaggcatctgtggaatcagaagcgtgacacgccttgagaatctgatgtggaaacagattaccccggagctcaaccacatcctgtccgaaaatgaggtcaagctgacaattatgaccggcgacatcaaagggattatgcaggccggaaagcggtctcttagacctcaacccacggaactcaaatatagctggaagacctggggcaaggcgaaaatgctgtccacagagagccataaccagaccttcctgatcgatgggcctgaaacagccgagtgccccaataccaaccgcgcttggaactctctcgaggtggaagactacggatttggcgttttcacaaccaacatctggctgaaacttcgggagaaacaggacgtgttttgtgattccaagctgatgagcgccgctattaaagacaatagagccgtccacgcggatatgggctattggatcgaatctgccctcaacgacacgtggaagatggagaaggcttccttcattgaggtgaaaagctgccactggcctaagtctcatacactgtggagcaatggggttctggaatccgagatgatcattcccaaaaacttcgccggaccggtgagccagcacaactaccgccctggctatcatacccaaaccgctgggccctggcaccttggaaagctcgaaatggattttgacttctgtgagggcacaaccgtcgtggtgacggaagattgcgggaatcggggaccctctctgagaacaaccacagcctccggcaaactgatcaccgagtggtgctgtcggagctgcacactccctccgctgcgctacagaggcgaggacgggtgttggtacggaatggaaattcggccccttaaggagaaggaagagaacctggtcaattccctcgttaccgccggccatgggcagatcgataacttttctctgggagtgctgggcatggctcttttcctcgaagagatgctgagaacgcgcgtggggaccaaacacgcgatcctgctcgtcgccctgagctttgtgacacttattaccggaaatatgtccttccgggacctgggcagagttatggtgatggtcggcgctacaatgaccgatgacatcgggatgggagtgacgtatctcgccctgctggccgcttttaaggttcgccctacattcgccgcgggccttctgctcagaaaactgacctctaaggagctcatgatggctacaattgggatcgccctgcttagccagtccaccctgcccgaaaccattctcgagctgacagatgccctggctcttggaatgatggccctgaaaatcgtgcggaacatggaaaagtaccaactcgcggtcacgatcatggctatttcttgcgtgcctaatgccgttatcctgcagaacgcctggaaggtgagctgtaccattctcgctgccgtctccgtgagccccctgcttctgacatcttcccagcagaaagctgactggatccctctcgccctgaccattaagggcctgaatcccacagcgatctttcttaccacgctgagccgcacatctaaaaagagatcctggccgctcaacgaggccatcatggctgtggggatggtcagcattctggcctcttccctcctgaaaaatgacatccctatgaccggaccccttgttgctggcggcctgctgaccgtgtgctatgtgctcacagggcggagcgccgatctggaacttgagcgcgccgctgacgtcaagtgggaggatcaagcggaaatttccggaagctctcctatcctgagcattaccatctccgaggacggctctatgagcattaaaaacgaagaggaggaacagacactcacgatcctgatcagaaccgggctcctggtgatttccggagttttccccgtgtctatcccgattacagccgctgcctggtacctttgggaggtcaagaagcagcgggccggcgtgctgtgggatgttccttctccccctcccgtggggaaagctgaactggaggacggagcctatcgcatcaagcagagaggcattctcggctactcccaaatcggggcgggagtctataaagaaggcacctttcacacaatgtggcatgtgaccagaggggctgtcctgatgcaccgcggaaagagaatcgagccctcctgggccgatgtgaaaaaggaccttattagctacggcgggggatggaagctggagggcgaatggaaagagggcgaagaggttcaggtgctcgccctggaacctgggaagaatccgcgggctgtccagacgaaacccggaatcttcaagaccaacacaggcaccattggggccgtgtccctcgattttagccctggaacatctggctcccccatcgttgacagaaaagggaaggtggtcggactgtacggcaatggcgtggtgacccgcagcggggcgtatgtttctgctattgcccagacagagaagtccatcgaggataaccctgaaatcgaggacgatattttccggaaaaagagacttacgatcatggacctgcatcccggagccggcaaaaccaagcgctacctgcctgctattgtccgggaagccatcaaaagagggctccgcacactgattcttgctccgacccgggtggtggccgcggagatggaagaggccctgagaggactccccatccgctatcaaacccctgctattcgggccgagcacacaggcagagaaatcgtcgacctgatgtgtcatgctacgttcaccatgcggctcctgagccccgtgcgcgttcctaactacaatcttatcattatggatgaggcccactttacagaccccgcctccatcgctgcgagagggtatatttctacccgggtggaaatgggcgaggccgctggaatcttcatgacagccaccccgcctggcagccgcgatccctttccccagtccaacgcccctattatggacgaggaaagagagatccccgaacggagctggaactctgggcacgagtgggtcacggatttcaagggaaagacagtgtggtttgttccttccatcaaagctggcaacgacattgccgcgtgcctgagaaagaatgggaaaaaggtgatccagctgagccgcaaaaccttcgattctgaatacgtcaagacccgggctaacgactgggattttgtggttacaaccgacattagcgagatgggagccaatttcaaggccgagagagtgatcgatccgcgccggtgtatgaaacccgtcattctcacagacggcgaagagagagtgatcctggctgggcctatgcccgtgacccattcctctgccgcgcaacgccggggcagaatcggacgcaaccctaagaatgaaaacgaccagtatatttacatgggcgagccccttgaaaatgatgaggactgcgcccactggaaagaggctaagatgctgctcgataacatcaatacgccggaagggattatccctagcatgtttgagcccgaaagagagaaagtcgacgccattgatggagaataccggctgcgcggcgaggctagaaagacattcgttgacctgatgcggcgcggggatctccctgtgtggcttgcctataaagtggctgccgagggaatcaactacgcggacagaaagtggtgttttgatggcattaagaataaccagatcctggaagagaacgtcgaagtggagatctggaccaaagagggggaacggaagaaactgaagcccagatggctcgacgcccgcatttattccgatcctctggctcttaaaggcttcaaggagttcgccgctggacggaagtctctgacactcaatctgatcaccgaaatgggcagactgcccacgtttatgacccagaaagcccgcaacgccctcgacaatcttgctgttctgcatacagcggaggtcgggggaaaggcctacacccacgctctgagcgaactcccggagacactggagacccttctgctcctgacactgctcgccgccgtcaccggcgggattttcctttttctgatgtccggaaaaggcatcggcaagatgacgctggggatgtgctgcattatcacagctagcatcctcctgtggtatgcccaaattcagcctcactggatcgcggcctctattatccttgagttctttctgattgtgctcctgatccccgagcccgaaaaacagcggacccctcaggataaccaactgacctacgttgtgatcgctattctcacagtcgtggccgctaccatggccaatgagatgggattccttgaaaagacaaagaaagacctgggctttgggtccatcacgacccaggagagcgagtccaacattctggacatcgatctcagaccggcgtctgcctggacactgtatgctgtcgccaccacattcgtgacccccatgcttcggcatagcattgaaaattcctctgttaacgtgagcctgacggctatcgccaatcaggctaccgtgctcatgggactgggcaaggggtggcctctgtccaaaatggacattggagtccccctccttgccatcggctgttacagccaggttaaccctatcacactgaccgcggccctgctcctgcttgtggctcactacgccattatcggccccgggctgcaagctaaggccacacgcgaggcccagaaaagagcggctgccggaattatgaagaatcctaccgtggatggcatcacggtcattgacctcgaaccgatcccctatgatcctaagtttgagaaacagctgggacaggtgatgctgctcatcctttgcgttacacaagtgctgatgatgcggaccacatgggctctgtgtgaagccctcaccctggccaccggacccatttctacactttgggagggcaaccctgggcgcttctggaatacgaccatcgctgtctccatggccaacatttttagaggaagctacctggcgggcgccggcctcctgttctctatcatgaagaatacaaccaacacacggcgcgggaccggaaatgtgggcgagacgctgggggaaaaatggaagtccagactcaacgctcttggaaaaagcgagtttcagatttataagaaatctggcatccaggaagtcgaccggacactggccaaggaggggatcaagcgcggagagaccgatcatcacgctgtgagcagaggctccgccaaactgcggtggttcgttgaaagaaacatggtgacccccgagggcaaggtcgtggacctcgggtgcggacgcggcgggtggtcttactattgtggaggcctgaaaaatgttcgggaagtgaaggggcttacaaaaggaggcccgggccatgaggaacctattcccatgagcacctacgggtggaacctggtcagactccaatccggagtggatgtgttctttacaccccctgagaagtgcgacacgctgctgtgtgatatcggcgagagctcccccaatcctaccattgaagcggggcgcacactccgggttcttaacctggtcgagaattggctgaacaataacacccagttctgcatcaaggtgctcaatccgtatatgccctctgtgattgagaagatggagacactgcagagaaagtacggaggcgcccttgtccgcaaccctctgagccggaatagcacccacgaaatgtactgggtttctaacgctacggggaatatcgtgagctccgtgaacatgatctctagaatgctcattaatcgctttaccatgaaacacaagaaagccacatatgagcccgacgtcgatctgggaagcggcacccggaacatcggcattgagtccgaaatccctaacctggacattatcgggaagagaattgagaagatcaaacaggaacatgagacaagctggcactacgaccaagatcatccctataagacctgggcttaccacggatcttatgaaacaaaacagaccggctccgccagctctatggtgaatggggttgtgcgcctccttacgaagccgtgggacgtcgtgcctatggttacacagatggctatgaccgataccacacccttcggacagcaacgggtgtttaaagagaaggtcgacacgagaacccaggagcctaaggaaggcaccaagaagctgatgaaaatcaccgccgagtggctgtggaaggaactcgggaaagagaagacaccccgcatgtgtaccagagaggagttcacacggaaagtgcgctccaacgcggccctgggagctgtgtttaccgatgagaataagtggaaaagcgccagagaagctgtcgaggacggccggttctgggaacttgttgatagagagcggaacctgcacctcgagggcaaatgcgaaacgtgtgtgtacaatatgatggggaagcgcgagaaaaagctgggagaatttggcaaagccaaggggtctagagccatttggtatatgtggctgggagcgcggttcctcgagtttgaagctctgggcttccttaacgaggaccattggttttcccgcgggaatagcctgtccggcgtggagggagaaggcctccacagactggggtacatccttcgggaggtcggaaagaaagaaggcggggccatgtacgccgatgacaccgctggatgggatacacgcattaccctggaggacctcaagaacgaagagatggtgacaaatcatatgaaaggcgagcacaagaaactggccgaagctatcttcaagctgacctatcagaacaaggttgtgagagtccagcggcctacgccccgcgggacagtgatggacattatcagcagaaaagatcaacggggctctggacaggttggcacctacgggctcaatacattcaccaacatggaggcccagctgatccgccaaatggaaggagagggcatttttaagagcatccagcatcttacggcgaccgaggaaattgccgtgcagaattggctggctagagtcgggcgggagcgcctctccagaatggccatctctggagacgattgcgtggttaaaccgattgacgatcggttcgctagcgccctgacagcgcttaacgacatgggcaaggtgagaaaagatatccagcaatgggaaccttcccgcgggtggaatgactggacccaggtccccttttgctctcaccacttccatgagctggtgatgaaggatggccgggtcctcgtggttccctgtagaaaccaggacgaactgatcggacgcgcccggattagccagggcgctgggtggtccctgaaggagacagcctgcctcggaaaatcttatgctcaaatgtggaccctgatgtactttcacagacgcgatcttcggctggccgctaacgccatctgtagcgcggtgccttcccattgggtcccgacaagcagaaccacgtggtctattcacgccaagcacgagtggatgacaaccgaagacatgctcgctgtgtggaatcgcgtgtggatccaggagaacccctggatggaagataaaacccctgttgagtcctgggaagaggtgccctatctgggcaagcgggaggaccagtggtgcgggagccttattggactgacatctagagccacctgggccaaaaatatccagacagctattaaccaagtccgctccctcatcggcaatgaagggtacacggactatatgcctagcatgaagcggttcagacgggaggaagaggaagccggcgtgctgtggtga

SEQ ID NO: 19559 - RNA, 9876 nt, synthetic construct
  misc_feature 1..9876: note = derived and/or modified CDS sequence (opt5) from DENV-2__JX286518__SS-prME
  source 1..9876: mol_type = other RNA
acagccggagtgatcgtcatgctgattcccacagctatggccttccacctcacgacccggaatggggagcctcatatgatcgttggacggcaggaaaagggcaagagcctgctttttaagacagaggacggggtgaatatgtgcaccctgatggcgattgatctcggagaactgtgtgaggacacaatcacctacaagtgcccgcttctgagacaaaatgaacccgaggatattgactgttggtgcaattccacatctacctgggtgacgtatggcacctgtacaaccacaggggagcacagacgggaaaagcgcagcgtcgctctcgtgcctcatgttggaatgggcctggagaccagaacggaaacatggatgtcctctgagggcgcctggaagcacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaagaacaggacaaacgctttatctgcaagcattccatggtggatagaggctggggcaacgggtgtggactgttcggcaaaggcgggattgtcacatgcgccatgtttacgtgcaaaaagaatatggaagggaaaatcgttcagcctgagaacctcgaatacaccattgtgatcacaccccacagcggggaggagcatgcggtgggaaatgacaccggcaagcacggcaaagaaatcaagattacacctcagtcttccaccacggaggccgaactgaccgggtatggaacagtcaccatggagtgtagcccccggacaggccttgatttcaacgaaatggtgctgctccaaatggaggacaaggcttggctggttcaccgccagtggtttcttgatctgccgctcccttggctgcccggggccgacacccagggatctaattggatccagaaggagacgctggtgacattcaagaaccctcatgctaaaaagcaagacgtcgtggttctcggctcccaggaaggggccatgcacaccgccctgacaggcgctaccgagattcagatgagctccggaaatcttctgtttaccggccatctcaaatgcagactgcggatggataaacttcaactgaaagggatgtcttacagcatgtgtacaggaaagttcaagatcgtgaaagaaattgcggagacgcagcacggcaccatcgtcatcagagtgcagtatgagggggacggatccccctgcaagattcccttcgaaatcacagatctcgagaaacgccatgtcctgggccggctgattaccgtgaaccctatcgttacagaaaaggacagcccggtgaacattgaggccgaacccccttttggggattcttacatcattgtcggcgtggagcccggacagctcaaactgaattggttcaagaagggctccagcatcgggcaaatgtttgagaccacgatgagaggagctaaacgcatggccatccttggcgacacagcctgggatttcgggtctctgggaggcgtttttaccagcattgggaaggctctccaccaggtgttcggcgccatctacggagcggctttttccggcgtctcttggaccatgaaaattctgatcggggtgattatcacatggatcggaatgaacagccggtccaccagcctgtctgtgtcccttgttctcgtcggcgtggtgacactgtatctgggggccatggtccaggccgacagcggatgtattgtgtcttggaagaataaagaactcaagtgcggctccgggatcttcattacggataacgttcacacctggacagagcagtacaagtttcaacctgaaagcccctccaaactggcttctgccatccagaaggctcatgaggaaggcatttgtggaatcagaagcgtgacccgccttgagaatctgatgtggaaacagatcacaccggagctcaaccacattctgtccgaaaatgaggtcaagctgaccatcatgacgggcgacattaaagggatcatgcaggccggaaagcggtctcttagacctcaacccaccgaactcaaatatagctggaagacatggggcaaggcgaaaatgctgtccaccgagagccataaccagacattcctgattgatgggcctgaaaccgccgagtgccccaatacaaaccgcgcttggaactctctcgaggtggaagactacggatttggcgttttcaccacgaacatctggctgaaacttcgggagaaacaggacgtgttttgtgattccaagctgatgagcgccgctatcaaagacaatagagccgtccacgcggatatgggctattggattgaatctgccctcaacgacacatggaagatggagaaggcttccttcatcgaggtgaaaagctgccactggcctaagtctcataccctgtggagcaatggggttctggaatccgagatgattatccccaaaaacttcgccggaccggtgagccagcacaactaccgccctggctatcatacccaaacagctgggccctggcaccttggaaagctcgaaatggattttgacttctgtgagggcaccacggtcgtggtgacagaagattgcgggaatcggggaccctctctgagaaccacaaccgcctccggcaaactgattacagagtggtgctgtcggagctgcaccctccctccgctgcgctacagaggcgaggacgggtgttggtacggaatggaaatccggccccttaaggagaaggaagagaacctggtcaattccctcgttacggccggccatgggcagattgataacttttctctgggagtgctgggcatggctcttttcctcgaagagatgctgagaacccgcgtggggacaaaacacgcgatcctgctcgtcgccctgagctttgtgacccttatcacaggaaatatgtccttccgggacctgggcagagttatggtgatggtcggcgctaccatgacggatgacattgggatgggagtgacatatctcgccctgctggccgcttttaaggttcgccctaccttcgccgcgggccttctgctcagaaaactgacatctaaggagctcatgatggctaccatcgggattgccctgcttagccagtccaccctgcccgaaacaatcctcgagctgacggatgccctggctcttggaatgatggccctgaaaattgtgcggaacatggaaaagtaccaactcgcggtcaccatcatggctatctcttgcgtgcctaatgccgttattctgcagaacgcctggaaggtgagctgtacaatcctcgctgccgtctccgtgagccccctgcttctgacctcttcccagcagaaagctgactggattcctctcgccctgacaatcaagggcctgaatcccaccgcgatttttcttacgacactgagccgcacctctaaaaagagatcctggccgctcaacgaggccatcatggctgtggggatggtcagcatcctggcctcttccctcctgaaaaatgacattcctatgaccggaccccttgttgctggcggcctgctgacagtgtgctatgtgctcaccgggcggagcgccgatctggaacttgagcgcgccgctgacgtcaagtgggaggatcaagcggaaatctccggaagctctcctattctgagcatcacaatttccgaggacggctctatgagcatcaaaaacgaagaggaggaacagacgctcaccattctgatcagaacagggctcctggtgatctccggagttttccccgtgtctattccgatcaccgccgctgcctggtacctttgggaggtcaagaagcagcgggccggcgtgctgtgggatgttccttctccccctcccgtggggaaagctgaactggaggacggagcctatcgcattaagcagagaggcatcctcggctactcccaaattggggcgggagtctataaagaaggcacatttcacaccatgtggcatgtgacgagaggggctgtcctgatgcaccgcggaaagagaatcgagccctcctgggccgatgtgaaaaaggaccttatcagctacggcgggggatggaagctggagggcgaatggaaagagggcgaagaggttcaggtgctcgccctggaacctgggaagaatccgcgggctgtccagaccaaacccggaattttcaagacaaacaccggcacaatcggggccgtgtccctcgattttagccctggaacctctggctcccccattgttgacagaaaagggaaggtggtcggactgtacggcaatggcgtggtgacacgcagcggggcgtatgtttctgctatcgcccagacggagaagtccattgaggataaccctgaaatcgaggacgatatcttccggaaaaagagacttaccattatggacctgcatcccggagccggcaaaacaaagcgctacctgcctgctatcgtccgggaagccattaaaagagggctccgcaccctgatccttgctccgacccgggtggtggccgcggagatggaagaggccctgagaggactccccattcgctatcaaacccctgctatccgggccgagcacacgggcagagaaattgtcgacctgatgtgtcatgctaccttcacaatgcggctcctgagccccgtgcgcgttcctaactacaatcttatcatcatggatgaggcccactttaccgaccccgcctccattgctgcgagagggtatatctctacacgggtggaaatgggcgaggccgctggaattttcatgaccgccacgccgcctggcagccgcgatccctttccccagtccaacgcccctatcatggacgaggaaagagagattcccgaacggagctggaactctgggcacgagtgggtcacagatttcaagggaaagaccgtgtggtttgttccttccatcaaagctggcaacgacatcgccgcgtgcctgagaaagaatgggaaaaaggtgattcagctgagccgcaaaaccttcgattctgaatacgtcaagacacgggctaacgactgggattttgtggttaccacagacatcagcgagatgggagccaatttcaaggccgagagagtgattgatccgcgccggtgtatgaaacccgtcatcctcaccgacggcgaagagagagtgattctggctgggcctatgcccgtgacgcattcctctgccgcgcaacgccggggcagaatcggacgcaaccctaagaatgaaaacgaccagtatatctacatgggcgagccccttgaaaatgatgaggactgcgcccactggaaagaggctaagatgctgctcgataacattaatacaccggaagggatcattcctagcatgtttgagcccgaaagagagaaagtcgacgccatcgatggagaataccggctgcgcggcgaggctagaaagaccttcgttgacctgatgcggcgcggggatctccctgtgtggcttgcctatagagtggctgccgagggaattaactacgcggaccggaaatggtgttttgatggcatcaagaataaccagattctggaagagaacgtcgaagtggagatctggacaaaggagggggaacgcaagaagctgaaaccccgctggctcgacgcccggatctattccgatcctctggctcttaaggagttcaaagagttcgccgctggcagaaagtctctgaccctcaatctgattacggagatgggacgcctgcccacctttatgacacagaaggcccggaacgccctcgacaatcttgctgttctgcataccgcggaagtgggcgggaaagcctacacacacgctctgagcgagctcccggagaccctggaaacacttctgctcctgaccctgctcgccgccgtcacgggaggcatcttcctttttctgatgtccgggaagggaattggcaaaatgacactgggcatgtgctgcatcattaccgctagcatcctcctgtggtatgcccaaatccagcctcactggattgcggcctctatcattcttgagttctttctgatcgtgctcctgattcccgaacccgagaagcagagaacccctcaggataaccaactgacatacgttgtgatcgctatcctcaccgtcgtggccgctacaatggccaatgaaatggggttccttgagaaaacgaagaaggacctgggatttggctccattaccacacaggagagcgaatccaacatcctggacattgatctccggccggcgtctgcctggaccctgtatgctgtcgccacaaccttcgtgacgcccatgcttcgccatagcatcgaaaatagctctgttaacgtgagcctgaccgctattgccaatcaggctacagtgctcatggggctgggaaaaggctggcctctgtccaagatggacatcggggtccccctccttgccattggatgttacagccaggttaaccctatcaccctgacagcggccctgctcctgcttgtggctcactacgccatcattggccccggcctgcaagctaaagccaccagagaagcccagaagcgggcggctgccgggatcatgaaaaatcctacggtggatggaattacagtcatcgacctcgagccgattccctatgatcctaagtttgaaaagcagctgggccaggtgatgctgctcatcctttgcgttacccaagtgctgatgatgcgcacaacctgggctctgtgtgaggccctcaccctggccacagggcccatctctacgctttgggagggaaaccctggcagattctggaataccacaattgctgtctccatggccaacatctttcgggggagctacctggcgggagccggcctcctgttctctattatgaaaaataccacaaacacccgcagaggcacggggaatgtgggagaaacactgggcgagaagtggaaatcccggctcaacgctcttggaaagagcgaatttcagatctataaaaagtctggcattcaggaggtcgaccgcaccctggccaaagagggcatcaagagaggggaaaccgatcatcacgctgtgagccggggatccgccaagctgagatggttcgttgagcgcaacatggtgacacccgaaggcaaagtcgtggacctcggctgcgggcggggaggctggtcttactattgtgggggactgaagaatgttagagaggtgaaaggccttaccaaagggggaccgggccatgaggagcctatccccatgagcacatacggctggaacctggtccgcctccaatccggggtggatgtgttctttacgccccctgagaaatgcgacaccctgctgtgtgatattggagaaagctcccccaatcctacaatcgaggcgggccggaccctcagagttcttaacctggtcgaaaattggctgaacaataacacacagttctgcattaaggtgctcaatccgtatatgccctctgtgatcgagaagatggaaaccctgcagcgcaaatacgggggagcccttgtccggaaccctctgagcagaaattccacgcacgagatgtactgggtttctaacgctaccggcaatattgtgagctccgtgaacatgatctctcgcatgctcatcaatcggtttacaatgaagcacaaaaaggccacctatgagcccgacgtcgatctggggagcggaacaagaaacattggcatcgaatccgagattcctaacctggacatcattggcaaacgcatcgaaaagattaagcaggagcatgaaaccagctggcactacgaccaagatcatccctataaaacatgggcttaccacgggtcttatgagaccaagcagacgggatccgccagctctatggtgaatggcgttgtgcggctccttacaaaaccgtgggacgtcgtgcctatggttacccagatggctatgaccgatacaacgcccttcgggcagcaaagagtgtttaaggagaaagtcgacacccgcacacaggaacctaaggagggaaccaagaaactgatgaagatcacagccgaatggctgtggaaagagctcggcaaggagaaaacccccagaatgtgtacacgggaagagttcacccgcaaggtgagatccaacgcggccctgggggctgtgtttacggatgaaaataaatggaaaagcgcccgggaggctgtcgaagacggaagattctgggagcttgttgatcgggagcgcaacctgcacctcgaaggcaagtgcgagacctgtgtgtacaatatgatgggcaaaagagaaaagaaactgggggagtttggaaaggccaaaggctctcgggccatctggtatatgtggctgggggcgcgcttcctcgaatttgaggctctgggattccttaacgaggaccattggttttccagaggcaatagcctgtccggggtggaaggcgagggactccaccggctgggctacattcttcgcgaagtcgggaagaaggagggaggcgccatgtacgccgatgacacagctgggtgggataccagaatcacactggaagacctcaaaaacgaggagatggtgaccaatcatatgaagggagaacacaaaaagctggccgaggctattttcaaactgacgtatcagaacaaggttgtgcgggtccagcgccctacacccagaggcaccgtgatggacatcattagccggaaggatcaacgcgggtctggccaggttggaacatacggcctcaataccttcacgaacatggaagcccagctgatcagacaaatggagggggagggaatctttaaaagcattcagcatcttaccgcgacagaagagatcgccgtgcagaattggctggctcgggtcggccgcgaaagactctcccggatggccatttctggggacgattgcgtggttaagccgatcgacgatagattcgctagcgccctgaccgcgcttaacgacatgggaaaagtgcgcaaggatattcagcaatgggagccttcccggggctggaatgactggacacaggtccccttttgctctcaccacttccatgaactggtgatgaaagatgggagagtcctcgtggttccctgtcgcaaccaggacgagctgatcggccgggccagaatcagccagggagctggctggtccctgaaggagaccgcctgcctcgggaagtcttatgctcaaatgtggacactgatgtactttcaccgccgggatcttagactggccgctaacgccatttgtagcgcggtgccttcccattgggtcccgaccagccgcacgacatggtctatccacgccaaacacgaatggatgaccaccgaggacatgctcgctgtgtggaatcgggtgtggattcaggaaaacccctggatggaggataagacacctgttgaatcctgggaggaggtgccctatctgggaaaaagagaagaccagtggtgcggcagccttatcgggctgacctctcgcgccacatgggccaagaatattcagacggctatcaaccaagtccggtccctcattggaaatgagggctacaccgactatatgcctagcatgaaaagattccggagagaagaggaagaggccggggtgctgtggtga

SEQ ID NO: 19560 - RNA, 9876 nt, synthetic construct
  misc_feature 1..9876: note = derived and/or modified CDS sequence (opt5) from DENV-2__JX286519__SS-prME
  source 1..9876: mol_type = other RNA
accgccggagtgatcgttatgctgattcccacagctatggccttccacctcacgacccggaatggggagcctcatatgatcgttggacggcaggaaaagggcaagagcctgctttttaagacagaggacgggattaatatgtgcaccctgatggcgatcgatctcggagaactgtgtgaggacacaattacctacaagtgcccgcttctgcgccaaaatgaacccgaggatatcgactgttggtgcaattccacatctacctgggtgacgtatggcacctgtacaaccacaggggagcacagacgggaaaagcgcagcgtggctctcgtccctcatgtgggaatgggcctggagaccagaacggaaacatggatgtcctctgagggcgcctggaaacacgttcagcggatcgagacctggattctgcgccatcccgggttcacaatcatggccgctattctcgcctacaccatcggaaccacacactttcagagagctctgattttcatccttctgacggccgtggcgcctagcatgaccatgcggtgcattggcatctccaaccgcgattttgtcgaaggggtgtctggaggcagctgggttgacatcgtgctcgagcacgggtcctgtgtcacaaccatggccaagaataagcccacactggatttcgaacttattaaaaccgaggctaagcagcctgccacgctgagaaaatattgcatcgaagctaagctcacaaacaccaccacagagagccggtgtccgacccaaggagagccctctctgaatgaagaacaggacaaacgctttatttgcaagcattccatggtggatagaggctggggcaacgggtgtggactgttcggcaaagggggaatcgtgacatgcgccatgtttacgtgcaaaaagaatatggaaggcaaaattgtccagcctgagaacctcgaatacaccatcgttatcacaccccacagcggggaggagcatgcggtgggaaatgacaccggcaagcacggcaaagaaattaagatcacacctcagtcttccaccacggaggccgaactgaccgggtatggaacagtgaccatggagtgtagcccccggacaggccttgatttcaacgaaatggtcctgctccaaatggaggacaaggcttggctggtgcaccgccagtggtttcttgatctgccgctcccttggctgcccggggccgacacccagggatctaattggattcagaaggagacgctggttacattcaagaaccctcatgctaaaaagcaagacgtggtcgtgctcggctcccaggaaggggccatgcacaccgccctgacaggcgctaccgagatccagatgagctccggaaatcttctgtttaccggccatctcaaatgcagactgcggatggataaacttcaactgaaagggatgtcttacagcatgtgtacaggaaagttcaagattgttaaagaaatcgcggagacgcagcacggcaccatcgtgattagagtccagtatgagggggacggatccccctgcaagatccccttcgaaattacagatctcgagaaacgccatgtgctgggccggctgatcaccgtcaaccctattgtgacagaaaaggacagcccggttaacatcgaggccgaacccccttttggggattcttacattatcgtgggcgtcgagcccggacagctcaaactgaattggttcaagaagggctccagcatcgggcaaatgtttgagaccacgatgagaggagctaaacgcatggccattcttggcgacacagcctgggatttcgggtctctgggaggcgtgtttaccagcatcgggaaggctctccaccaggttttcggcgccatttacggagcggctttttccggcgtgtcttggaccatgaaaatcctgattggggtcatcatcacatggattggaatgaacagccggtccaccagcctgtctgtgtcccttgtgctcgttggcgtcgtgacactgtatctgggggccatggtgcaggccgacagcggatgtatcgtctcttggaagaataaagaactcaagtgcggctccgggattttcatcacggataacgtgcacacctggacagagcagtacaagtttcaacctgaaagcccctccaaactggcttctgccattcagaaggctcatgaggaaggcatctgtggaatcagaagcgttacccgccttgagaatctgatgtggaaacagattacaccggagctcaaccacatcctgtccgaaaatgaggtgaagctgaccattatgacgggcgacatcaaagggattatgcaggccggaaagcggtctcttagacctcaacccaccgaactcaaatatagctggaagacatggggcaaggcgaaaatgctgtccaccgagagccataaccagacattcctgatcgatgggcctgaaaccgccgagtgccccaatacaaaccgcgcttggaactctctcgaggtcgaagactacggatttggcgtgttcaccacgaacatctggctgaaacttcgggagaaacaggacgtcttttgtgattccaagctgatgagcgccgctattaaagacaatagagccgtgcacgcggatatgggctattggatcgaatctgccctcaacgacacatggaagatggagaaggcttccttcattgaggtcaaaagctgccactggcctaagtctcataccctgtggagcaatggggtgctggaatccgagatgatcattcccaaaaacttcgccggaccggttagccagcacaactaccgccctggctatcatacccaaacagctgggccctggcaccttggaaagctcgaaatggattttgacttctgtgagggcaccacggtggtcgtgacagaagattgcgggaatcggggaccctctctgagaaccacaaccgcctccggcaaactgatcacagagtggtgctgtcggagctgcaccctccctccgctgcgctacagaggcgaggacgggtgttggtacggaatggaaattcggccccttaaggagaaggaagagaacctggtgaatagcctcgtcacggccggccatgggcagatcgataacttttctctgggagttctgggcatggctcttttcctcgaagagatgctgagaacccgcgtggggacaaaacacgcgatcctgctcgtggccctgagctttgtcacccttattacaggaaatatgtccttccgggacctgggcagagtgatggttatggtgggcgctaccatgacggatgacatcgggatgggagtcacatatctcgccctgctggccgcttttaaggtgcgccctaccttcgccgcgggccttctgctcagaaaactgacatctaaggagctcatgatggctaccattgggatcgccctgcttagccagtccaccctgcccgaaacaattctcgagctgacggatgccctggctcttggaatgatggccctgaaaatcgttcggaacatggaaaagtaccaactcgcggtgaccatcatggctatttcttgcgtccctaatgccgtgatcctgcagaacgcctggaaggttagctgtacaattctcgctgccgtgtccgtcagccccctgcttctgacctcttcccagcagaaagctgactggatccctctcgccctgacaattaagggcctgaatcccaccgcgatctttcttacgacactgagccgcacctctaaaaagagatcctggccgctcaacgaggccatcatggctgtggggatggtgagcattctggcctcttccctcctgaaaaatgacatccctatgaccggaccccttgtcgctggcggcctgctgacagtttgctatgtgctcaccgggcggagcgccgatctggaacttgagcgcgccgctgacgtgaagtgggaggatcaagcggaaatttccggaagctctcctatcctgagcattacaatctccgaggacggctctatgagcattaaaaacgaagaggaggaacagacgctcaccatcctgatcagaacagggctcctggtcatttccggagtgttccccgtttctatcccgattaccgccgctgcctggtacctttgggaggtgaagaagcagcgggccggcgtcctgtgggatgtgccttctccccctcccgttgggaaagctgaactggaggacggagcctatcgcatcaagcagagaggcattctcggctactcccaaatcggggcgggagtgtataaagaaggcacatttcacaccatgtggcatgtcacgagaggggctgtgctgatgcaccgcggaaagagaatcgagccctcctgggccgatgtcaaaaaggaccttattagctacggcgggggatggaagctggagggcgaatggaaagagggcgaagaggtgcaggttctcgccctggaacctgggaagaatccgcgggctgtgcagaccaaacccggaatcttcaagacaaacaccggcacaattggggccgtctccctcgattttagccctggaacctctggctcccccatcgtggacagaaaagggaaggttgtgggactgtacggcaatggcgtcgtgacacgcagcggggcgtatgtgtctgctattgcccagacggagaagtccatcgaggataaccctgaaatcgaggacgatattttccggaaaaagagacttaccatcatggacctgcatcccggagccggcaaaacaaagcgctacctgcctgctattgttcgggaagccatcaaaagagggctccgcaccctgattcttgctccgacccgggtcgtggccgcggagatggaagaggccctgagaggactccccatccgctatcaaacccctgctattcgggccgagcacacgggcagagaaatcgtggacctgatgtgtcatgctaccttcacaatgcggctcctgagccccgtccgcgtgcctaactacaatcttatcattatggatgaggcccactttaccgaccccgcctccatcgctgcgagagggtatatttctacacgggttgaaatgggcgaggccgctggaatcttcatgaccgccacgccgcctggcagccgcgatccctttccccagtccaacgcccctattatggacgaggaaagagagatccccgaacggagctggaactctgggcacgagtgggtgacagatttcaagggaaagaccgtctggtttgtgccttccatcaaagctggcaacgacattgccgcgtgcctgagaaagaatgggaaaaaggttatccagctgagccgcaaaaccttcgattctgaatacgtgaagacacgggctaacgactgggattttgtcgtgaccacagacattagcgagatgggagccaatttcaaggccgagagagttatcgatccgcgccggtgtatgaaacccgtgattctcaccgacggcgaagagagagtcatcctggctgggcctatgcccgtgacgcattcctctgccgcgcaacgccggggcagaatcggacgcaaccctaagaatgaaaacgaccagtatatttacatgggcgagccccttgaaaatgatgaggactgcgcccactggaaagaggctaagatgctgctcgataacatcaatacaccggaagggattgtgcctagcatgtttgagcccgaaagagagaaagtcgacgccatcgatggagaataccggctgcgcggcgaggctagaaagaccttcgttgacctgatgcggcgcggggatctccctgtgtggcttgcctataaagtggctgccgagggaattaactacgcggacagaaagtggtgttttgatggcatcaagaataaccagattctggaagagaacgtcgaagtggagatctggacaaaagagggggaacggaagaaactgaagcccagatggctcgacgcccgcatctattccgatcctctggctcttaaagagttcaaggagttcgccgctggccggaagtctctgaccctcaatctgattacggagatgggaagactgcccacctttatgacacagaaagcccgcagcgccctcgacaaccttgctgttctgcataccgcggaagtgggcgggaaggcctacacacacgctctgtccgagctcccggagaccctggaaacacttctgctcctgaccctgctcgccgccgtcacgggaggcatcttcctttttctgatgagcgggaaaggaattggcaagatgacactgggcatgtgctgcatcattaccgcttctatcctcctgtggtatgcccaaatccagcctcactggattgcggcctccatcattcttgagttctttctgatcgtgctcctgattcccgaacccgagaaacagcggacccctcaggataatcaactgacatacgttgtgatcgctatcctcaccgtcgtggccgctacaatggccaacgaaatggggttccttgagaagacgaagaaagacctgggatttggcagcattaccacacaggagtccgaatctaatatcctggacattgatctcagaccggcgagcgcctggaccctgtatgctgtcgccacaaccttcgtgacgcccatgcttcggcattccatcgagaactctagcgttaatgtgtccctgaccgctattgccaaccaggctacagtgctcatggggctgggaaagggctggcctctgagcaaaatggacatcggggtccccctccttgccattggatgttactctcaggttaatcctatcaccctgacagcggccctgctcctgcttgtggctcactacgccatcattggccccggcctgcaagctaaggccacccgcgaagcccagaaaagagcggctgccgggatcatgaagaaccctacggtggatggaattacagtcatcgacctcgagccgattccctatgatcctaagtttgaaaaacagctgggccaggtgatgctgctcatcctttgcgttacccaagtgctgatgatgcggacaacctgggctctgtgtgaggccctcaccctggccacagggcccatctccacgctttgggagggaaatcctggccgcttctggaacaccacaattgctgtcagcatggccaatatctttagagggtcttacctggcgggagccggcctcctgttctccattatgaagaacaccacaaatacccggcgcggcacggggaacgtgggagaaacactgggcgagaaatggaaaagcagactcaatgctcttgggaaatctgaatttcagatctataagaaaagcggcattcaggaggtcgaccggaccctggccaaggagggcatcaagcgcggggaaaccgatcatcacgctgtgtccagaggatctgccaaactgcggtggttcgttgagagaaacatggtgacacccgaaggcaaggtcgtggacctcggctgcgggcgcggaggctggagctactattgtgggggactgaaaaacgttcgggaggtgaagggccttaccaaagggggaccgggccatgaagaacctatccccatgtccacatacggctggaatctggtcagactccaaagcggggtggatgtgttctttacgccccctgagaagtgcgacaccctgctgtgtgatattggagaatcctctcccaaccctacaatcgaggcgggccgcaccctccgggttcttaatctggtcgaaaactggctgaataacaatacacagttctgcattaaggtgctcaacccgtatatgcccagcgtgatcgagaaaatggaaaccctgcagagaaagtacgggggagcccttgtccgcaatcctctgtcccggaactctacgcacgagatgtactgggttagcaatgctaccggcaacattgtgtcctctgtgaatatgatcagcagaatgctcatcaaccgctttacaatgaaacacaagaaagccacctatgagcccgacgtcgatctggggtccggaacacggaatattggcatcgaaagcgagattcctaacctggacatcattggcaagagaatcgaaaagattaaacaggagcatgaaacctcttggcactacgaccaagatcatccctataagacatgggcttaccacgggtcctatgagaccaaacagacgggaagcgcctcttccatggtgaacggcgttgtgcgcctccttacaaagccgtgggacgtcgtgcctatggttacccagatggctatgaccgatacaacgcccttcgggcagcaacgggtgtttaaagagaaggtcgacaccagaacacaggaacctaaggagggaaccaaaaagctgatgaaaatcacagccgaatggctgtggaaggagctcggcaaagagaagacaccccgcatgtgtacaagagaagagttcacccggaaagtgcgcagcaatgcggccctgggggctgtgtttacggatgaaaacaagtggaagtctgccagagaggctgtcgaagacggacggttctgggagcttgttgatagagagcggaatctgcacctcgaaggcaaatgcgagacctgtgtgtacaacatgatgggcaagcgcgagaagaagctgggggagtttggaaaagccaagggctccagagccatctggtatatgtggctgggggcgcggttcctcgaatttgaggctctgggattccttaatgaggaccattggtttagccgcggcaactccctgagcggggtggaaggcgagggactccacagactgggctacattcttcgggaagtcgggaagaaagagggaggcgccatgtacgccgatgacacagctgggtgggatacccgcatcacactggaagacctcaagaatgaggagatggtgaccaaccatatgaaaggagaacacaagaaactggccgaggctattttcaagctgacgtatcagaataaggttgtgagagtccagcggcctacaccccgcggcaccgtgatggacatcatttctagaaaagatcaacgggggagcggccaggttggaacatacggcctcaacaccttcacgaatatggaagcccagctgatccgccaaatggagggggagggaatctttaagtccattcagcatcttaccgcgacagaagagatcgccgtgcagaactggctggctagagtcggccgggaacgcctctctagaatggccattagcggggacgattgcgtggttaaaccgatcgacgatcggttcgcttccgccctgaccgcgcttaatgacatgggaaaggtgagaaaagatattcagcaatgggagccttctcgcggctggaacgactggacacaggtccccttttgcagccaccacttccatgaactggtgatgaaggatgggcgggtcctcgtggttccctgtagaaatcaggacgagctgatcggccgcgcccggatctcccagggagctggctggtctctgaaggagaccgcctgcctcgggaaaagctatgctcaaatgtggacactgatgtactttcacagacgcgatcttcggctggccgctaacgccatttgttccgcggtgcctagccattgggtcccgacctctagaacgacatggtccatccacgccaagcacgaatggatgaccaccgaggacatgctcgctgtgtggaaccgcgtgtggattcaggaaaatccctggatggaggataaaacacctgttgaaagctgggaggaggtgccctatctgggaaagcgggaagaccagtggtgcggctctcttatcgggctgacctccagagccacatgggccaaaaacattcagacggctatcaatcaagtccgcagcctcattggaaacgagggctacaccgactatatgccttccatgaagcggttcagacgggaagaggaagaggccggggtgctgtggtga

SEQ ID NO: 19561 - RNA, 9876 nt, synthetic construct
  misc_feature 1..9876: note = derived and/or modified CDS sequence (opt5) from DENV-2__KP188549__SS-prME
  source 1..9876: mol_type = other RNA
accgccggcgtgatcgtcatgctgattcccacagctatggccttccacctcacgaccagaaacggggaacctcatatgatcgttggacggcaggaaaagggcaaaagcctgctttttaagacagaagacggggtgaatatgtgcaccctgatggcgattgatctcggagaactgtgtgaggacacaatcacctacaaatgcccgcttctgcgccaaaacgaacccgaggatattgactgttggtgcaatagcacatctacctgggtgacgtatggcacctgtacaaccacaggggagcacagacgggaaaagcgcagcgtcgctctcgtgcctcatgttggaatgggcctggagaccagaacggaaacatggatgtcctctgagggcgcctggaaacacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaagaacaggacaaacgctttatctgcaagcattccatggtggatagaggctggggcaacgggtgtggactgttcggcaaaggagggattgtcacatgcgccatgtttacgtgcaaaaagaatatggaaggcaaaatcgttcagcctgagaacctcgaatacaccattgtgatcacaccccacagcggggaggagcatgcggtgggaaatgacaccggcaagcacggcaaagaaatcaagattacacctcagtcttccaccacggaggccgaactgaccgggtatggaacagtcaccatggagtgtagcccccggacaggccttgatttcaacgaaatggtgctgctccaaatggaggacaaggcttggctggttcaccgccagtggtttcttgatctgccgctcccttggctgcccggggccgacacccagggatctaattggatccagaaggagacgctggtgacattcaagaaccctcatgctaaaaagcaagacgtcgtggttctcggctcccaggaaggggccatgcacaccgccctgacaggcgctaccgagattcagatgagctccggaaatcttctgtttaccggccatctcaaatgcagactgcggatggataaacttcaactgaaagggatgtcttacagcatgtgtacaggaaagttcaagatcgtgaaagaaattgcggagacgcagcacggcaccatcgtcatcagagtgcagtatgagggggacggatccccctgcaagattcccttcgaaatcacagatctcgagaaacgccatgtcctgggccggctgattaccgtgaaccctatcgttacagaaaaggacagcccggtgaacattgaggccgaacccccttttggggattcttacatcattgtcggcgtggagcccggacagctcaaactgaattggttcaagaagggctccagcatcgggcaaatgtttgagaccacgatgagaggagctaaacgcatggccatccttggcgacacagcctgggatttcgggtctctgggaggcgtttttaccagcattgggaaggctctccaccaggtgttcggcgccatctacggagcggctttttccggcgtctcttggaccatgaaaattctgatcggggtgattatcacatggatcggaatgaacagccggtccaccagcctgtctgtgtcccttgttctcgtcggcgtggtgacactgtatctgggggccatggtccaggccgacagcggatgtattgtgtcttggaagaataaagaactcaagtgcggctccgggatcttcattacggataacgttcacacctggacagagcagtacaagtttcaacctgaaagcccctccaaactggcttctgccatccagaaggctcatgaggaaggcatttgtggaatcagaagcgtgacccgccttgagaatctgatgtggaaacagatcacaccggagctcaaccacattctgtccgaaaatgaggtcaagctgaccatcatgacgggcgacattaaagggatcatgcaggccggaaagcggtctcttagacctcaacccaccgaactcaaatatagctggaagacatggggcaaggcgaaaatgctgtccaccgagagccataaccagacattcctgattgatgggcctgaaaccgccgagtgccccaatacaaaccgcgcttggaactctctcgaggtggaagactacggatttggcgttttcaccacgaacatctggctgaaacttcgggagaaacaggacgtgttttgtgattccaagctgatgagcgccgctatcaaagacaatagagccgtccacgcggatatgggctattggattgaatctgccctcaacgacacatggaagatggagaaggcttccttcatcgaggtgaaaagctgccactggcctaagtctcataccctgtggagcaatggggttctggaatccgagatggtgattcccaaaaacttcgccggaccggtcagccagcacaactaccgccctggctatcatacccaaacagctgggccctggcaccttggaaagctcgaaatggattttgacttctgtgagggcaccacggtggtggtcacagaagattgcgagaaacgggggccctctctgagaaccacaaccgcctccggaaagctgatcacagagtggtgctgtcggagctgcaccctccctccgctgcgctacagaggcgaagacggctgttggtacgggatggagattcggccccttaaggaaaaagaggaaaatctggttaactccctcgtgacggccggacatggccagatcgataatttttctctgggggtgctgggaatggctcttttcctcgaggagatgctgagaacccgcgtcggcacaaagcacgcgattctgctcgtggccctgagctttgttacccttatcacagggaacatgtccttccgggacctgggaagagtgatggtcatggtgggcgctaccatgacggatgacatcggcatgggggttacatatctcgccctgctggccgcttttaaagtgcgccctaccttcgccgcgggacttctgctcagaaagctgacatctaaagaactcatgatggctaccattggcatcgccctgcttagccagtccaccctgcccgagacaattctcgaactgacggatgccctggctcttgggatgatggccctgaagatcgtccggaatatggagaagtaccaactcgcggtgaccattatggctatctcttgcgttcctaacgccgtgatcctgcagaatgcctggaaagtcagctgtacaattctcgctgccgtgtccgtgagccccctgcttctgacctcttcccagcagaaggctgactggatccctctcgccctgacaattaaaggactgaaccccaccgcgatctttcttacgacactgagccgcacctctaagaaaagatcctggccgctcaatgaagccattatggctgtcggcatggttagcatcctggcctcttccctcctgaagaacgacatccctatgaccgggccccttgtggctggaggcctgctgacagtgtgctatgtcctcaccggccggagcgccgatctggagcttgagcgcgccgctgacgtgaaatgggaagatcaagcggagatttccgggagctctcctatcctgagcattacaatctccgaagacggatctatgagcattaagaatgaggaggaagaacagacgctcaccatcctgattagaacaggcctcctggttatctccggggtgttccccgtctctatcccgattaccgccgctgcctggtacctttgggaagtgaagaaacagcgggccggagttctgtgggatgtgccttctccccctcccgtcggcaaggctgagctggaagacggggcctatcgcatcaaacagagagggattctcggctactcccaaatcggcgcgggggtgtataaggagggaacatttcacaccatgtggcatgtcacgcggggcgctgtgctgatgcaccgcgggaaaagaattgagccctcctgggccgatgttaagaaggaccttatcagctacggaggcgggtggaaactggaaggagagtggaaggaaggcgaggaagtgcaggtcctcgccctggagcctggcaaaaacccgcgggctgtgcagaccaagcccgggatcttcaaaacaaataccggaacaattggcgccgtttccctcgattttagccctgggacctctggatcccccatcgtggacagaaagggcaaggtcgtggggctgtacggaaacggcgtggttacacgcagcggcgcgtatgtctctgctattgcccagacggagaaatccatcgaagataatcctgagattgaagacgatatcttccggaagaaaagacttaccatcatggacctgcatcccggggccggaaagacaaaacgctacctgcctgctattgtgcgggaggccatcaagagaggcctccgcaccctgattcttgctccgacccgggtggtcgccgcggaaatggaggaggccctgagagggctccccatccgctatcaaacgcctgctattcgggccgaacacacgggaagagagatcgtggacctgatgtgtcatgctaccttcacaatgcggctcctgagccccgttcgcgtgcctaactacaaccttattatcatggatgaagcccactttaccgaccccgcctccatcgctgcgagaggctatatttctacacgggtcgagatgggggaggccgctggcatcttcatgaccgccacgccgcctggaagccgcgatccctttccccagtccaatgcccctattatggacgaagagagagaaatccccgagcggagctggaactctggccacgaatgggtgacagatttcaaggggaaaaccgtttggtttgtgccttccattaaggctggaaatgacatcgccgcgtgcctgcgcaagaatggcaagaaagtcatccagctgagccgcaagaccttcgattctgagtacgtgaagacacgggctaatgactgggattttgttgtgaccacagacattagcgagatgggggccaacttcaaagccgaaagagtcatcgatccgcgccggtgtatgaagcccgtgattctcaccgacggagaggaaagagtgatcctggctggccctatgcccgtcacgcattcctctgccgcgcaacgccgggggagaattggccgcaatcctaaaaacgagaatgaccagtatatctacatgggagaaccccttgagaacgatgaggactgcgcccactggaaggaagctaaaatgctgctcgataatatcaacacaccggagggcattatccctagcatgtttgaacccgagagagaaaaggttgacgccattgatggggagtaccggctgcgcggagaggctagaaaaaccttcgtggacctgatgcggcgcggcgatctccctgtgtggcttgcctataaggtcgctgccgaagggatcaattacgcggacagaaagtggtgttttgatggaattaaaaacaatcagatcctggaggaaaacgtggaggttgagatttggacaaaggaaggcgagcggaaaaagctgaaacccagatggctcgacgcccgcatctattccgatcctctggctcttaaggagttcaaggagttcgccgctgggcggaaatctctgaccctcaacctgatcacggaaatgggcagactgcccacctttatgacacagaaggcccgcaatgccctcgacaaccttgctgtgctgcataccgcggaggtcggaggcaaagcctacacacacgctctgagcgagctcccggaaaccctggagacacttctgctcctgaccctgctcgccgccgtgacagggggaattttcctttttctgatgtccggcaaggggatcggaaaaatgacactgggcatgtgctgcattatcaccgctagcattctcctgtggtatgcccaaatccagcctcactggatcgcggcctctattatccttgagttctttctgattgttctcctgatccccgagcccgaaaagcagcggacccctcaggataatcaactgacatacgtggtcattgctatcctcaccgtggtcgccgctacaatggccaacgagatgggcttccttgagaagacgaaaaaggacctggggtttggatccatcaccacacaggaaagcgagtccaatattctggacatcgatctcagaccggcgtctgcctggaccctgtatgctgtggccacaaccttcgttacgcccatgcttcggcatagcattgaaaactcctctgtgaatgtgagcctgaccgctatcgccaaccaggctacagtcctcatgggcctggggaaaggatggcctctgtccaagatggacattggcgttcccctccttgccatcgggtgttacagccaggtgaatcctattaccctgacagcggccctgctcctgcttgtggctcactacgccatcatcggacccggcctgcaagctaaagccacccgcgaggcccagaagagagcggctgccggcattatgaagaaccctacggtcgatgggatcacagtgattgacctcgaaccgatcccctatgatcctaaatttgagaagcagctgggacaggttatgctgctcattctttgcgtgacccaagtcctgatgatgcggacaacctgggctctgtgtgaggccctcaccctggccacaggccccatctctacgctttgggaagggaatcctggacgcttctggaacaccacaatcgctgtgtccatggccaatatttttagaggcagctacctggcgggggccggactcctgttctctatcatgaaaaacaccacaaatacccggcgcggcacgggcaacgtcggggagacactgggagaaaagtggaaatccagactcaatgctcttggcaagagcgagtttcagatttataaaaagtctgggatccaggaggtggaccggaccctggccaaggaaggaattaaacgcggcgagaccgatcatcacgctgttagcagagggtccgccaagctgcggtggttcgtggaaagaaacatggtcacacccgagggaaaagtggttgacctcggctgcggccgcgggggatggtcttactattgtggcgggctgaagaacgtgcgggaagtcaaaggacttaccaagggcgggccgggacatgaggagcctatccccatgagcacatacggctggaatctggtgagactccaatccggcgtggatgttttctttacgccccctgaaaagtgcgacaccctgctgtgtgatatcggggagagctcccccaaccctacaattgaagcgggacgcaccctccgggtccttaatctggtggagaactggctgaataacaatacacagttctgcatcaaagtgctcaacccgtatatgccctctgtcattgaaaagatggagaccctgcagagaaaatacggcggggcccttgttcgcaatcctctgagccggaactccacgcacgagatgtactgggtgtctaatgctaccggaaacatcgtgagctccgtcaatatgatttctagaatgctcatcaaccgctttacaatgaagcacaaaaaggccacctatgaacccgacgtggatctgggcagcgggacacggaatatcggaattgagtccgaaacccctaacctggacatcattggcaagagaatcgagaaaattaagcaggaacatgagacaagctggcactacgaccaagatcatccctataaaacctgggcttaccacggctcttatgagacgaagcagacagggtccgccagctctatggttaacggagtggtccgcctccttaccaaaccgtgggacgtggttcctatggtgacccagatggctatgacagatacgacccccttcggccagcaacgggtctttaaggaaaaggtggacacaagaacccaggagcctaaagaagggacaaagaaactgatgaagatcaccgccgagtggctgtggaaagagctcggaaaggagaagacaccccgcatgtgtaccagagaggagttcacgcggaaggtgcgctccaatgcggccctgggcgctgtctttaccgatgagaacaagtggaaaagcgccagagaagctgttgaggacgggcggttctgggagcttgtggatagagaacggaatctgcacctcgagggaaagtgcgaaacatgtgtgtacaacatgatgggcaaacgcgagaagaaactgggcgaatttgggaaggccaagggatctagagccatttggtatatgtggctgggcgcgcggttcctcgagtttgaggctctggggttccttaatgaagaccattggttttcccgcggaaacagcctgtccggcgtcgagggggaaggcctccacagactgggatacatccttcgggaggtgggcaaaaaggaagggggagccatgtacgccgatgacaccgctggctgggatacacgcatcaccctggaggacctcaaaaatgaggaaatggttacgaaccatatgaagggggagcacaaaaagctggccgaagctattttcaagctgacatatcagaataaagtggtcagagtgcagcggcctacccccagaggaacagttatggacatcattagcagaaaggatcaacggggctctggacaggtgggcacctacggactcaacacgttcaccaatatggaggcccagctgatccgccaaatggagggcgaagggatttttaaaagcatccagcatcttacagcgaccgaggaaacagccgtccagaactggctggctagagtgggacgggagcgcctctccagaatggccatctctggcgacgattgcgttgtgaagccgattgacgatcggttcgctagcgccctgaccgcgcttaatgacatggggaaagtcagaaaggatatccagcaatgggaaccttcccgcggatggaacgactggacacaggtgcccttttgctctcaccacttccatgagctggtcatgaaggatggccgggtgctcgttgtgccctgtagaaatcaggacgagctgattgggcgcgcccggatcagccagggcgctggatggtccctgaaagaaaccgcctgcctcggcaagtcttatgctcaaatgtggacgctgatgtactttcacagacgcgatcttcggctggccgctaacgccatttgtagcgcggtcccttcccattgggtgccgacaagcagaaccacctggtctatccacgccaaacacgagtggatgacaaccgaagacatgctcgctgtgtggaaccgcgtttggatccaggagaatccctggatggaagataagacacctgtggagtcctgggaggaagtcccctatctggggaaacgggaggaccagtggtgcggaagccttattggcctgacgtctagagccacctgggccaagaacatccagacagctattaatcaagtgcgctccctcatcgggaacgaaggatacaccgactatatgcctagcatgaagcggttcagacgggaggaagaggaggccggcgttctgtggtga

SEQ ID NO: 19562 - RNA, 9876 nt, synthetic construct
  misc_feature 1..9876: note = derived and/or modified CDS sequence (opt5) from DENV-2__KP188550__SS-prME
  source 1..9876: mol_type = other RNA
acagccggagtgatcgtcatgctgattcccacagttatggctttccacctcacgacccggaatggggagcctcatatgatcgtgggacggcaggaaaagggcaagagcctgctttttaagacagaggacggggtgaatatgtgcaccctgatggccattgatctcggagaactgtgtgaggacacaatcacctacaagtgcccgcttctgcgccaaaatgaacccgaggatattgactgttggtgcaatagcacatctacctgggtcacgtatggcacctgtacaaccacaggggagcacagacgggaaaagcgcagcgtggcgctcgttcctcatgtgggaatgggcctggagaccagaacggaaacatggatgtcctctgagggcgcttggaagcacgtccagcggatcgagacctggatcctgcgccatcccgggttcacaattatggccgccatcctcgcttacaccattggaaccacacactttcagagagccctgatcttcattcttctgacggctgtggcccctagcatgaccatgcggtgcatcggcatttccaaccgcgattttgttgaaggggtgtctggaggcagctgggtcgacatcgtgctcgagcacgggtcctgtgtgacaaccatggcgaagaataagcccacactggatttcgaacttatcaagaccgaggccaagcagcctgctacgctgagaaaatattgcattgaagccaagctcacaaacaccaccacagagagccggtgtccgacccaaggagagccctctctgaatgaagaacaggacaaacgctttatctgcaagcattccatggtcgatagaggctggggcaacgggtgtggactgttcggcaaagggggaattgttacatgcgctatgtttacgtgcaaaaagaatatggaaggcaaaatcgtgcagcctgagaacctcgaatacaccattgtgatcacaccccacagcggggaggagcatgccgtcggaaatgacaccggcaagcacggcaaagaaatcaagattacacctcagtcttccaccacggaggcggaactgaccgggtatggaacagtgaccatggagtgtagcccccggacaggccttgatttcaacgaaatggttctgctccaaatggaggacaaagcctggctggtgcaccgccagtggtttcttgatctgccgctcccttggctgcccggggctgacacccagggatctaattggatccagaaggagacgctggtcacattcaagaaccctcatgccaaaaagcaagacgtggttgtgctcggctcccaggaaggggctatgcacaccgccctgacaggcgccaccgagattcagatgagctccggaaatcttctgtttaccggccatctcaaatgcagactgcggatggataaacttcaactgaaagggatgtcttacagcatgtgtacaggaaagttcaagatcgtcaaagaaattgctgagacgcagcacggcaccatcgtgatcagagtccagtatgagggggacggatccccctgcaagattcccttcgaaatcacagatctcgagaaacgccatgtgctgggccggctgattaccgttaaccctatcgtgacagaaaaggacagcccggtcaacattgaggcggaacccccttttggggattcttacatcattgtgggcgttgagcccggacagctcaaactgaattggttcaagaagggctccagcatcgggcaaatgtttgagaccacgatgagaggagccaaacgcatggctatccttggcgacacagcctgggatttcgggtctctgggaggcgtgtttaccagcattgggaaggccctccaccaggtcttcggcgctatctacggagccgcgttttccggcgtgtcttggaccatgaaaattctgatcggggtgattatcacatggatcggaatgaacagccggtccaccagcctgtctgtttcccttgtcctcgtgggcgtggtcacactgtatctgggggctatggtgcaggccgacagcggatgtattgtttcttggaagaataaagaactcaagtgcggctccgggatcttcattacggataacgtgcacacctggacagagcagtacaagtttcaacctgaaagcccctccaaactggcctctgctatccagaaggcccatgaggaaggcatttgtggaatcagaagcgtcacccgccttgagaatctgatgtggaaacagatcacaccggagctcaaccacattctgtccgaaaatgaggtgaagctgaccatcatgacgggcgacattaaagggatcatgcaggctggaaagcggtctcttagacctcaacccaccgaactcaaatatagctggaagacatggggcaaggccaaaatgctgtccaccgagagccataaccagacattcctgattgatgggcctgaaaccgcggagtgccccaatacaaaccgcgcctggaactctctcgaggttgaagactacggatttggcgtgttcaccacgaacatctggctgaaacttcgggagaaacaggacgtcttttgtgattccaagctgatgagcgctgccatcaaagacaatagagctgtgcacgccgatatgggctattggattgaatctgcgctcaacgacacatggaagatggagaaggcctccttcatcgaggttaaaagctgccactggcctaagtctcataccctgtggagcaatggggtgctggaatccgagatgattatccccaaaaacttcgctggaccggtcagccagcacaactaccgccctggctatcatacccaaacagccgggccctggcaccttggaaagctcgaaatggattttgacttctgtgagggcaccacggtggtggtcacagaagattgcgggaatcggggaccctctctgagaaccacaaccgcttccggcaaactgattacagagtggtgctgtcggagctgcaccctccctccgctgcgctacagaggcgaggacgggtgttggtacggaatggaaatccggccccttaaggagaaggaagagaacctggttaattccctcgtgacggccggccatgggcagattgataacttttctctgggagtgctgggcatggcccttttcctcgaagagatgctgagaacccgcgtcgggacaaaacacgctatcctgctcgtggcgctgagctttgttacccttatcacaggaaatatgtccttccgggacctgggcagagtgatggtcatggtgggcgccaccatgacggatgacattgggatgggagttacatatctcgctctgctggccgcctttaaggtgcgccctaccttcgctgccggccttctgctcagaaaactgacatctaaggagctcatgatggcgaccatcgggattgctctgcttagccagtccaccctgcccgaaacaatcctcgagctgacggatgccctggcccttggaatgatggctctgaaaattgtccggaacatggaaaagtaccaactcgccgtgaccatcatggcgatctcttgcgttcctaatgctgtgattctgcagaacgcctggaaggtcagctgtacaatcctcgccgctgtgtccgtgagccccctgcttctgacctcttcccagcagaaagccgactggattcctctcgctctgacaatcaagggcctgaatcccaccgccatttttcttacgacactgagccgcacctctaaaaagagatcctggccgctcaacgaggcgatcatggccgtcgggatggttagcatcctggcttcttccctcctgaaaaatgacattcctatgaccggaccccttgtggccggcggcctgctgacagtgtgctatgtcctcaccgggcggagcgctgatctggaacttgagcgcgccgccgacgtgaagtgggaggatcaagctgaaatctccggaagctctcctattctgagcatcacaatttccgaggacggctctatgagcatcaaaaacgaagaggaggaacagacgctcaccattctgatcagaacagggctcctggttatctccggagtgttccccgtctctattccgatcaccgcggccgcttggtacctttgggaggtgaagaagcagcgggccggcgttctgtgggatgtgccttctccccctcccgtcgggaaagccgaactggaggacggagcttatcgcattaagcagagaggcatcctcggctactcccaaattggggccggagtgtataaagaaggcacatttcacaccatgtggcatgtcacgagaggggcggtgctgatgcaccgcggaaagagaatcgagccctcctgggctgatgttaaaaaggaccttatcagctacggcgggggatggaagctggagggcgaatggaaagagggcgaagaggtgcaggtcctcgccctggaacctgggaagaatccgcgggccgtgcagaccaaacccggaattttcaagacaaacaccggcacaatcggggctgtttccctcgattttagccctggaacctctggctcccccattgtggacagaaaagggaaggtcgtgggactgtacggcaatggcgtggttacacgcagcggggcctatgtctctgcgatcgctcagacggagaagtccattgaggataaccctgaaatcgaggacgatatcttccggaaaaagagacttaccattatggacctgcatcccggagccggcaaaacaaagcgctacctgcctgccatcgtgcgggaagctattaaaagagggctccgcaccctgatccttgccccgacccgggtggtcgctgccgagatggaagaggcgctgagaggactccccattcgctatcaaacccctgccatccgggctgagcacacgggcagagaaattgtggacctgatgtgtcatgccaccttcacaatgcggctcctgagccccgttcgcgtgcctaactacaatcttatcatcatggatgaggctcactttaccgaccccgcctccattgccgctagagggtatatctctacacgggtcgaaatgggcgaggcggccggaattttcatgaccgctacgccgcctggcagccgcgatccctttccccagtccaacgcccctatcatggacgaggaaagagagattcccgaacggagctggaactctgggcacgagtgggtgacagatttcaagggaaagaccgtttggtttgtgccttccatcaaagccggcaacgacatcgctgcctgcctgagaaagaatgggaaaaaggtcattcagctgagccgcaaaaccttcgattctgaatacgtgaagacacgggcgaacgactgggattttgttgtgaccacagacatcagcgagatgggagctaatttcaaggccgagagagtcattgatccgcgccggtgtatgaaacccgtgatcctcaccgacggcgaagagagagtgattctggccgggcctatgcccgtcacgcattcctctgctgcccaacgccggggcagaatcggacgcaaccctaagaatgaaaacgaccagtatatctacatgggcgagccccttgaaaatgatgaggactgcgcgcactggaaagaggccaagatgctgctcgataacattaatacaccggaagggatcattcctagcatgtttgagcccgaaagagagaaagttgacgctatcgatggagaataccggctgcgcggcgaggccagaaagaccttcgtggacctgatgcggcgcggggatctccctgtgtggcttgcttataaagtcgccgctgagggaattaactacgccgacagaaagtggtgttttgatggcatcaagaataaccagattctggaagagaacgtggaagttgagatctggacaaaagagggggaacggaagaaactgaagcccagatggctcgacgcgcgcatctattccgatcctctggcccttaaagagttcaaggagttcgctgccggccggaagtctctgaccctcaatctgattacggagatgggaagactgcccacctttatgacacagaaagctcgcaacgccctcgacaatcttgccgtgctgcataccgctgaagtcggcgggcgggcgcacacacacgccctgagcgagctcccggagaccctggaaacacttctgctcctgaccctgctcgctacggtgacaggaggcatcttcctttttctgatgtccgggaagggaattggcaaaatgaccctgggcatgtgctgcatcattaccgccagcatcctcctgtggtacgcccaaatccagcctcattggattgctgcctctatcattcttgagttctttctgatcgttctcctgattcccgaacccgagaagcagagaacacctcaggataaccaactgacctatgtggtcatcgcgatcctcacagtggtcgccgctacgatggccaatgaaatggggttccttgagaaaaccaagaaggacctgggatttggcacaattaccacacaggagtccgaaagcaacatcctggacattgatctccggccggcttccgcctggaccctgtacgcggtggccacgaccttcgttacacccatgcttcgccactctatcgagaatagctccgtgaacgtgtctctgaccgctattgccaatcaggctacagtcctcatggggctgggaaaaggctggcctctgagcaagatggacatcggggttcccctccttgccattggatgttattcccaggtgaaccctatcaccctgacggctgccctgctcctgcttgtggcgcattacgccatcattggccccggcctgcaagctaaagccacaagagaagctcagaagcgggccgccgcggggatcatgaaaaatcctaccgtcgatggaattacagtgatcgacctcgagccgattccctacgatcctaagtttgaaaagcagctgggccaggttatgctgctcatcctttgcgtgacccaagtcctgatgatgcgcaccacatgggctctgtgtgaggccctcacgctggctaccgggcccatcagcacactttgggagggaaaccctggcagattctggaataccacaattgccgtgtctatggccaacatctttcgggggtcctatctggctggagccggcctcctgttcagcattatgaaaaataccacgaacacacgcagaggcaccgggaatgtcggagaaaccctgggcgagaagtggaaatctcggctcaacgcgcttgggaagtccgaatttcagatctacaaaaagagcggcattcaggaggtggaccgcacactggccaaagagggcatcaagagaggggaaaccgatcaccatgctgtttctcggggaagcgccaagctgagatggttcgtggagcgcaacatggtcacacccgaaggcaaagtggttgacctcggctgcgggcggggaggctggtcctattactgtgggggactgaagaatgtgagagaggtcaaaggccttacgaaagggggaccgggccacgaagaacctatccccatgtctacctatggctggaacctggtgcgcctccaaagcggggtggatgttttctttacaccccctgagaaatgcgacaccctgctgtgtgatattggagaatccagccccaatcctacaatcgaggctggccggaccctcagagtccttaacctggtggaaaattggctgaacaataacacgcagttctgcattaaggtgctcaatccgtacatgccctccgtcatcgagaagatggaaaccctgcagcgcaaatatgggggagcccttgttcggaaccctctgtctagaaatagcacacacgagatgtactgggtgtccaacgcgaccggcaatattgtgtctagcgtcaacatgatctcccgcatgctcatcaatcggtttacaatgaagcataaaaaggccacctacgagcccgacgtggatctggggtctggaacaagaaacattggcatcgaaagcgagattcctaacctggacatcattggcaaacgcatcgaaaagattaagcaggagcacgaaacctcctggcattatgaccaagatcacccctacaaaacgtgggcttatcacgggagctacgagacaaagcagaccggatctgcctccagcatggttaatggcgtggtccggctccttaccaaaccgtgggacgtggttcctatggtgacacagatggctatgacggataccacacccttcgggcagcaaagagtctttaaggagaaagtggacacccgcacacaggaacctaaggagggaaccaagaaactgatgaagatcacagccaaatggctgtggaaggaactcggcaaagagaagacccccagaatgtgtacgcgggaggagttcacccgcaaagtgagatctaacgctgccctgggggcgatctttacagatgagaataagtggaagtccgcccgggaagctgtcgaggacggaagattctgggaacttgttgatcgggagcgcaacctgcatctcgagggcaaatgcgaaacctgtgtgtataatatgatgggcaagagagagaaaaagctgggggaatttggaaaagccaagggcagccgggctatttggtacatgtggctgggggcccgcttcctcgagtttgaagccctgggattccttaacgaggaccactggttttctagaggcaattccctgagcggggtggagggcgaaggactccatcggctgggctatatccttcgcgaggtcgggaagaaagaaggaggcgcgatgtacgctgatgacacagccgggtgggataccagaattacgctggaggacctcaagaacgaagagatggtgacaaatcacatgaaaggagagcataagaaactggccgaagctatcttcaagctgacctaccagaacaaggttgtgcgggtccagcgccctacacccagaggcaccgtgatggacattatctcccggaaagatcaacgcgggagcggccaggttggaacgtatggcctcaataccttcacaaacatggaggcccagctgatcagacaaatggaaggggagggaatttttaagaatatccagcaccttaccgctacagaggaaattgccgtgcagaactggctggcgcgggtcggccgcgagagactctctcggatggccatcagcggggacgattgcgtggttaaaccgattgacgatagattcgcttccgccctgaccgctcttaatgacatgggaaaggtgcgcaaagatatccagcaatgggaaccttctcggggctggaacgactggacacaggtccccttttgcagccaccatttccacgagctggtgatgaaggatgggagagtcctcgtggttccctgtcgcaaccaggacgaactgatcggccgggccagaatttcccagggagcgggctggtctctgaaggagaccgcctgcctcgggaaaagctacgctcaaatgtggacgctgatgtattttcatcgccgggatcttagactggccgctaatgccatctgttccgctgtgccttctcactgggtcccgacaagccgcaccacctggtccattcacgccaagcatgagtggatgacaaccgaagacatgctcgcggtgtggaaccgggtgtggatccaggagaatccctggatggaagataaaacacctgttgagagctgggaagaggtgccctacctgggaaagagagaggaccagtggtgcggctctcttattgggctgacgtcccgcgccacctgggctaaaaacatccagacagccattaatcaagtccggagcctcatcggaaacgaaggctataccgactacatgccttctatgaagagattccggagagaggaagaggaagccggggtgctgtggtga

SEQ ID NO: 19563 - RNA, 9876 nt, synthetic construct
  misc_feature 1..9876: note = derived and/or modified CDS sequence (opt5) from DENV-2__KP188553__SS-prME
  source 1..9876: mol_type = other RNA
accgccggcgtgatcgtcatgctgattcccacagctatggccttccacctcacgaccagaaacggggaacctcatatgatcgttggacggcaggaaaagggcaaaagcctgctttttaagacagaagacggggtgaatatgtgcaccctgatggcgattgatctcggagaactgtgtgaggacacaatcacctacaaatgcccgcttctgagacaaaacgaacccgaggatattgactgttggtgcaatagcacatctacctgggtgacgtatggcacctgtacaaccacaggggagcacagacgggaaaagcgcagcgtcgctctcgtgcctcatgttggaatgggcctggagaccagaacggaaacatggatgtcctctgagggcgcctggaaacacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaagaacaggacaaacgctttatctgcaagcattccatggtggatagaggctggggcaacgggtgtggactgttcggcaaagggggaattgtcacatgcgccatgtttacgtgcaaaaagaatatggaaggcaaaatcgttcagcctgagaacctcgaatacaccattgtgatcacaccccacagcggggaggagcatgcggtgggaaatgacaccggcaagcacggcaaagaaatcaagattacacctcagtcttccaccacggaggccgaactgaccgggtatggaacagtcaccatggagtgtagcccccggacaggccttgatttcaacgaaatggtgctgctccaaatggaggacaaggcttggctggttcaccgccagtggtttcttgatctgccgctcccttggctgcccggggccgacacccagggatctaattggatccagaaggagacgctggtgacattcaagaaccctcatgctaaaaagcaagacgtcgtggttctcggctcccaggaaggggccatgcacaccgccctgacaggcgctaccgagattcagatgagctccggaaatcttctgtttaccggccatctcaaatgcagactgcggatggataaacttcaactgaaagggatgtcttacagcatgtgtacaggaaagttcaagatcgtgaaagaaattgcggagacgcagcacggcaccatcgtcatcagagtgcagtatgagggggacggatccccctgcaagattcccttcgaaatcacagatctcgagaaacgccatgtcctgggccggctgattaccgtgaaccctatcgttacagaaaaggacagcccggtgaacattgaggccgaacccccttttggggattcttacatcattgtcggcgtggagcccggacagctcaaactgaattggttcaagaagggctccagcatcgggcaaatgtttgagaccacgatgagaggagctaaacgcatggccatccttggcgacacagcctgggatttcgggtctctgggaggcgtttttaccagcattgggaaggctctccaccaggtgttcggcgccatctacggagcggctttttccggcgtctcttggaccatgaaaattctgatcggggtgattatcacatggatcggaatgaacagccggtccaccagcctgtctgtgtcccttgttctcgtcggcgtggtgacactgtatctgggggccatggtccaggccgacagcggatgtattgtgtcttggaagaataaagaactcaagtgcggctccgggatcttcattacggataacgttcacacctggacagagcagtacaagtttcaacctgaaagcccctccaaactggcttctgccatccagaaggctcatgaggaaggcatttgtggaatcagaagcgtgacccgccttgagaatctgatgtggaaacagatcacaccggagctcaaccacattctgtccgaaaatgaggtcaagctgaccatcatgacgggcgacattaaagggatcatgcaggccggaaagcggtctcttagacctcaacccaccgaactcaaatatagctggaagacatggggcaaggcgaaaatgctgtccaccgagagccataaccagacattcctgattgatgggcctgaaaccgccgagtgccccaatacaaaccgcgcttggaactctctcgaggtggaagactacggatttggcgttttcaccacgaacatctggctgaaacttcgggagaaacaggacgtgttttgtgattccaagctgatgagcgccgctatcaaagacaatagagccgtccacgcggatatgggctattggattgaatctgccctcaacgacacatggaagatggagaaggcttccttcatcgaggtgaaaagctgccactggcctaagtctcataccctgtggagcaatggggttctggaatccgagatggtgattcccaaaaacttcgccggaccggtcagccagcacaactaccgccctggctatcatacccaaacagctgggccctggcaccttggaaagctcgaaatggattttgacttctgtgagggcaccacggtggtggtcacagaagattgcgagaaacgggggccctctctgagaaccacaaccgcctccggaaagctgatcacagagtggtgctgtcggagctgcaccctccctccgctgcgctacagaggcgaagacggctgttggtacgggatggagattcggccccttaaggaaaaagaggaaaatctggttaactccctcgtgacggccggacatggccagatcgataatttttctctgggggtgctgggaatggctcttttcctcgaggagatgctgagaacccgcgtcggcacaaagcacgcgattctgctcgtggccctgagctttgttacccttatcacagggaacatgtccttccgggacctgggaagagtgatggtcatggtgggcgctaccatgacggatgacatcggcatgggggttacatatctcgccctgctggccgcttttaaagtgcgccctaccttcgccgcgggacttctgctcagaaagctgacatctaaagaactcatgatggctaccattggcatcgccctgcttagccagtccaccctgcccgagacaattctcgaactgacggatgccctggctcttgggatgatggccctgaagatcgtccggaatatggagaagtaccaactcgcggtgaccattatggctatctcttgcgttcctaacgccgtgatcctgcagaatgcctggaaagtcagctgtacaattctcgctgccgtgtccgtgagccccctgcttctgacctcttcccagcagaaggctgactggatccctctcgccctgacaattaaaggactgaaccccaccgcgatctttcttacgacactgagccgcacctctaagaaaagatcctggccgctcaatgaagccattatggctgtcggcatggttagcatcctggcctcttccctcctgaagaacgacatccctatgaccgggccccttgtggctggaggcctgctgacagtgtgctatgtcctcaccggccggagcgccgatctggagcttgagcgcgccgctgacgtgaaatgggaagatcaagcggagatttccgggagctctcctatcctgagcattacaatctccgaagacggatctatgagcattaagaatgaggaggaagaacagacgctcaccatcctgattagaacaggcctcctggttatctccggggtgttccccgtctctatcccgattaccgccgctgcctggtacctttgggaagtgaagaaacagcgggccggagttctgtgggatgtgccttctccccctcccgtcggcaaggctgagctggaagacggggcctatcgcatcaaacagagaggcattctcggatactcccaaatcggcgcgggggtgtataaggagggaacatttcacaccatgtggcatgtcacgcggggcgctgtgctgatgcaccgcgggaaaagaattgagccctcctgggccgatgttaagaaggaccttatcagctacggaggcgggtggaaactggaaggagagtggaaggaaggcgaggaagtgcaggtcctcgccctggagcctggcaaaaacccgcgggctgtgcagaccaagcccgggatcttcaaaacaaataccggaacaattggcgccgtttccctcgattttagccctgggacctctggatcccccatcgtggacagaaagggcaaggtcgtggggctgtacggaaacggcgtggttacacgcagcggcgcgtatgtctctgctattgcccagacggagaaatccatcgaagataatcctgagattgaagacgatatcttccggaagaaaagacttaccatcatggacctgcatcccggggccggaaagacaaaacgctacctgcctgctattgtgcgggaggccatcaagagaggcctccgcaccctgattcttgctccgacccgggtggtcgccgcggaaatggaggaggccctgagagggctccccatccgctatcaaacgcctgctattcgggccgaacacacgggaagagagatcgtggacctgatgtgtcatgctaccttcacaatgcggctcctgagccccgttcgcgtgcctaactacaaccttattatcatggatgaagcccactttaccgaccccgcctccatcgctgcgagaggctatatttctacacgggtcgagatgggggaggccgctggcatcttcatgaccgccacgccgcctggaagccgcgatccctttccccagtccaatgcccctattatggacgaagagagagaaatccccgagcggagctggaactctggccacgaatgggtgacagatttcaaggggaaaaccgtttggtttgtgccttccattaaggctggaaatgacatcgccgcgtgcctgcgcaagaatggcaagaaagtcatcccgtacagccgcaagaccttcgattctgagtatgtgaagacacgggctaatgactgggattttgttgtgaccacagacattagcgagatgggggccaacttcaaagccgaaagagtcatcgatccccgccggtgtatgaagcctgtgattctgaccgacggagaggaaagagtgatcctcgctggccccatgcctgtcacgcattcctctgccgcgcagcgccgggggagaattggccgcaatcccaaaaacgagaatgaccaatacatctacatgggagaaccgctggagaacgatgaggactgcgcccactggaaggaagctaaaatgcttctggataatatcaacacacctgagggcattatccccagcatgtttgaacctgagagagaaaaggttgacgccattgatggggagtatcggctccgcggagaggctagaaaaaccttcgtggacctgatgcggcgcggcgatctgcccgtgtggctcgcctacaaggtcgctgccgaagggatcaattatgcggacagaaagtggtgttttgatggaattaaaaacaatcagatccttgaggaaaacgtggaggttgagatttggacaaaggaaggcgagcggaaaaagctgaaacctagatggctggacgcccgcatctactccgatcccctcgctctgaaggagttcaaggagttcgccgctgggcggaaatctcttaccctgaacctcatcacggaaatgggcagactgccgacctttatgacacagaaggcccgcaatgccctggacaacctcgctgtgcttcataccgcggaggtcggaggcaaagcctatacacacgctctgagcgagctgcctgaaaccctcgagacactgcttctgctcaccctgctggccgccgtgacagggggaattttcctctttcttatgtccggcaaggggatcggaaaaatgacactgggcatgtgctgcattatcaccgctagcattctgctctggtacgcccagatccaaccccactggatcgcggcctctattatcctggagttctttcttattgttctgctcatccccgagcctgaaaagcagcggaccccgcaggataatcagctgacatatgtggtcattgctatcctgaccgtggtcgccgctacaatggccaacgagatgggcttcctcgagaagacgaaaaaggaccttgggtttggatccatcaccacacaagaaagcgagtccaatattctggacatcgatctgagacccgcgtctgcctggaccctctacgctgtggccacaaccttcgttacgcctatgctgcggcatagcattgaaaactcctctgtgaatgtgagccttaccgctatcgccaaccaggctacagtcctgatgggcctcgggaaaggatggcccctgtccaagatggacattggcgttcctctgctcgccatcgggtgttacagccaggtgaatcccattacccttacagcggccctgctgctcctggtggctcactatgccatcatcggacctggccttcaggctaaagccacccgcgaggcccaaaagagagcggctgccggcattatgaagaacccgacggtcgatgggatcacagtgattgacctggaacccatcccttacgatcccaaatttgagaagcagctcggacaggttatgctgctgattctctgcgtgacccaggtccttatgatgcggacaacctgggctctgtgtgaggccctgaccctcgccacaggccctatctctacgctgtgggaagggaatcccggacgcttctggaacaccacaatcgctgtgtccatggccaatatttttagaggcagctatcttgcgggggccggactcctgttctctatcatgaaaaacaccacaaatacccggcgcggcacgggcaacgtcggggagacactgggagaaaagtggaaatccagactgaatgctctcggcaagagcgagtttcaaatttacaaaaagtctgggatccaggaggtggaccggacccttgccaaggaaggaattaaacgcggcgagaccgatcatcacgctgttagcagagggtccgccaagctgcggtggttcgtggaaagaaacatggtcacaccggagggaaaagtggttgacctgggctgcggccgcgggggatggtcttattactgtggcgggctcaagaacgtgcgggaagtcaaaggactgaccaagggcgggcctggacatgaggagcccatccccatgagcacatatggctggaatcttgtgagactgcagtccggcgtggatgttttctttacgcctcccgaaaagtgcgacaccctcctgtgtgatatcggggagagctcccctaacccgacaattgaagcgggacgcaccctgcgggtcctcaatcttgtggagaactggctgaataacaatacacaattctgcatcaaagtgctgaacccctacatgccttctgtcattgaaaagatggagaccctccagagaaaatacggcggggccctggttcgcaatccccttagccggaactccacgcacgagatgtattgggtgtctaatgctaccggaaacatcgtgagctccgtcaatatgatttctagaatgctgatcaaccgctttacaatgaagcacaaaaaggccacctacgaacctgacgtggatctcggcagcgggacacggaatatcggaattgagtccgaaacccccaacctggacatcattggcaagagaatcgagaaaattaagcaggaacatgagacaagctggcactatgaccaggatcatccgtacaaaacctgggcttatcacggctcttacgagacgaagcaaacagggtccgccagctctatggttaacggagtggtccgcctgctcaccaaaccttgggacgtggttcccatggtgacccagatggctatgacagatacgacccctttcggccagcagcgggtctttaaggaaaaggtggacacaagaacccaagagcccaaagaagggacaaagaaacttatgaagatcaccgccgagtggctgtggaaagagctgggaaaggagaagacacctcgcatgtgtaccagagaggagttcacgcggaaggtgcgctccaatgcggccctcggcgctgtctttaccgatgagaacaagtggaaaagcgccagagaagctgttgaggacgggcggttctgggagctggtggatagagaacggaatcttcacctggagggaaagtgcgaaacatgtgtgtataacatgatgggcaaacgcgagaagaaactcggcgaatttgggaaggccaagggatctagagccatttggtacatgtggctgggcgcgcggttcctggagtttgaggctctcgggttcctgaatgaagaccattggttttcccgcggaaacagcctttccggcgtcgagggggaaggcctgcacagactcggatacatcctgcgggaggtgggcaaaaaggaagggggagccatgtatgccgatgacaccgctggctgggatacacgcatcacccttgaggacctgaaaaatgaggaaatggttacgaaccatatgaagggggagcacaaaaagctcgccgaagctattttcaagctgacataccagaataaagtggtcagagtgcagcggcccaccccgcgcggaacagttatggacatcattagcagaaaggatcagcggggctctgggcaagtgggcacctatggactgaacacgttcaccaatatggaggcccagctcatccgccagatggagggcgaagggatttttaaaagcatccaacatctgacagcgaccgaggaaacagccgtccagaactggcttgctagagtgggacgggagcgcctgtccagaatggccatctctggcgacgattgcgttgtgaagcctattgacgatcggttcgctagcgccctcaccgcgctgaatgacatggggaaagtcagaaaggatatccagcagtgggaaccctcccgcggatggaacgactggacacaagtgcccttttgctctcaccacttccatgagcttgtcatgaaggatggccgggtgctggttgtgccttgtagaaatcaggacgagctcattgggcgcgcccggatcagccagggcgctggatggtccctgaaagaaaccgcctgcctgggcaagtcttacgctcagatgtggacgctcatgtattttcacagacgcgatctgcggcttgccgctaacgccatttgtagcgcggtcccgtcccattgggtgcccacaagcagaaccacctggtctatccacgccaaacacgagtggatgacaaccgaagacatgctggctgtgtggaaccgcgtttggatccaagagaatccttggatggaagataagacacccgtggagtcctgggaggaagtcccttacctcgggaaacgggaggaccagtggtgcggaagcctgattggccttacgtctagagccacctgggccaagaacatccagacagctattaatcaggtgcgctccctgatcgggaacgaaggatataccgactacatgcccagcatgaagcggttcagacgggaggaagaggaggccggcgttctctggtga

SEQ ID NO: 19564 - RNA, 9876 nt, synthetic construct
  misc_feature 1..9876: note = derived and/or modified CDS sequence (opt5) from DENV-2__KP188556__SS-prME
  source 1..9876: mol_type = other RNA
accgccggcgtgatcgtcatgctgattcccacagctatggccttccacctcacgaccagaaacggggaacctcatatgatcgttggacggcaggaaaagggcaaaagcctgctttttaagacagaagacggggtgaatatgtgcaccctgatggcgattgatctcggagaactgtgtgaggacacaatcacctacaaatgcccgcttctgcgccaaaacgaacccgaggatattgactgttggtgcaatagcacatctacctgggtgacgtatggcacctgtacaaccacaggggagcacagacgggaaaagcgcagcgtcgctctcgtgcctcatgttggaatgggcctggagaccagaacggaaacatggatgtcctctgagggcgcctggaaacacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaagaacaggacaaacgctttatctgcaagcattccatggtggatagaggctggggcaacgggtgtggactgttcggcaaaggagggattgtcacatgcgccatgtttacgtgcaaaaagaatatggaaggcaaaatcgttcagcctgagaacctcgaatacaccattgtgatcacaccccacagcggggaggagcatgcggtgggaaatgacaccggcaagcacggcaaagaaatcaagattacacctcagtcttccaccacggaggccgaactgaccgggtatggaacagtcaccatggagtgtagcccccggacaggccttgatttcaacgaaatggtgctgctccaaatggaggacaaggcttggctggttcaccgccagtggtttcttgatctgccgctcccttggctgcccggggccgacacccagggatctaattggatccagaaggagacgctggtgacattcaagaaccctcatgctaaaaagcaagacgtcgtggttctcggctcccaggaaggggccatgcacaccgccctgacaggcgctaccgagattcagatgagctccggaaatcttctgtttaccggccatctcaaatgcagactgcggatggataaacttcaactgaaagggatgtcttacagcatgtgtacaggaaagttcaagatcgtgaaagaaattgcggagacgcagcacggcaccatcgtcatcagagtgcagtatgagggggacggatccccctgcaagattcccttcgaaatcacagatctcgagaaacgccatgtcctgggccggctgattaccgtgaaccctatcgttacagaaaaggacagcccggtgaacattgaggccgaacccccttttggggattcttacatcattgtcggcgtggagcccggacagctcaaactgaattggttcaagaagggctccagcatcgggcaaatgtttgagaccacgatgagaggagctaaacgcatggccatccttggcgacacagcctgggatttcgggtctctgggaggcgtttttaccagcattgggaaggctctccaccaggtgttcggcgccatctacggagcggctttttccggcgtctcttggaccatgaaaattctgatcggggtgattatcacatggatcggaatgaacagccggtccaccagcctgtctgtgtcccttgttctcgtcggcgtggtgacactgtatctgggggccatggtccaggccgacagcggatgtattgtgtcttggaagaataaagaactcaagtgcggctccgggatcttcattacggataacgttcacacctggacagagcagtacaagtttcaacctgaaagcccctccaaactggcttctgccatccagaaggctcatgaggaaggcatttgtggaatcagaagcgtgacccgccttgagaatctgatgtggaaacagatcacaccggagctcaaccacattctgtccgaaaatgaggtcaagctgaccatcatgacgggcgacattaaagggatcatgcaggccggaaagcggtctcttagacctcaacccaccgaactcaaatatagctggaagacatggggcaaggcgaaaatgctgtccaccgagagccataaccagacattcctgattgatgggcctgaaaccgccgagtgccccaatacaaaccgcgcttggaactctctcgaggtggaagactacggatttggcgttttcaccacgaacatctggctgaaacttcgggagaaacaggacgtgttttgtgattccaagctgatgagcgccgctatcaaagacaatagagccgtccacgcggatatgggctattggattgaatctgccctcaacgacacatggaagatggagaaggcttccttcatcgaggtgaaaagctgccactggcctaagtctcataccctgtggagcaatggggttctggaatccgagatggtgattcccaaaaacttcgccggaccggtcagccagcacaactaccgccctggctatcatacccaaacagctgggccctggcaccttggaaagctcgaaatggattttgacttctgtgagggcaccacggtggtggtcacagaagattgcgagaaacgggggccctctctgagaaccacaaccgcctccggaaagctgatcacagagtggtgctgtcggagctgcaccctccctccgctgcgctacagaggcgaagacggctgttggtacgggatggagattcggccccttaaggaaaaagaggaaaatctggttaactccctcgtgacggccggacatggccagatcgataatttttctctgggggtgctgggaatggctcttttcctcgaggagatgctgagaacccgcgtcggcacaaagcacgcgattctgctcgtggccctgagctttgttacccttatcacagggaacatgtccttccgggacctgggaagagtgatggtcatggtgggcgctaccatgacggatgacatcggcatgggggttacatatctcgccctgctggccgcttttaaagtgcgccctaccttcgccgcgggacttctgctcagaaagctgacatctaaagaactcatgatggctaccattggcatcgccctgcttagccagtccaccctgcccgagacaattctcgaactgacggatgccctggctcttgggatgatggccctgaagatcgtccggaatatggagaagtaccaactcgcggtgaccattatggctatctcttgcgttcctaacgccgtgatcctgcagaatgcctggaaagtcagctgtacaattctcgctgccgtgtccgtgagccccctgcttctgacctcttcccagcagaaggctgactggatccctctcgccctgacaattaaaggactgaaccccaccgcgatctttcttacgacactgagccgcacctctaagaaaagatcctggccgctcaatgaagccattatggctgtcggcatggttagcatcctggcctcttccctcctgaagaacgacatccctatgaccgggccccttgtggctggaggcctgctgacagtgtgctatgtcctcaccggccggagcgccgatctggagcttgagcgcgccgctgacgtgaaatgggaagatcaagcggagatttccgggagctctcctatcctgagcattacaatctccgaagacggatctatgagcattaagaatgaggaggaagaacagacgctcaccatcctgattagaacaggcctcctggttatctccggggtgttccccgtctctatcccgattaccgccgctgcctggtacctttgggaagtgaagaaacagcgggccggagttctgtgggatgtgccttctccccctcccgtcggcaaggctgagctggaagacggggcctatcgcatcaaacagagagggattctcggctactcccaaatcggcgcgggggtgtataaggagggaacatttcacaccatgtggcatgtcacgcggggcgctgtgctgatgcaccgcgggaaaagaattgagccctcctgggccgatgttaagaaggaccttatcagctacggaggcgggtggaaactggaaggagagtggaaggaaggcgaggaagtgcaggtcctcgccctggagcctggcaaaaacccgcgggctgtgcagaccaagcccgggatcttcaaaacaaataccggaacaattggcgccgtttccctcgattttagccctgggacctctggatcccccatcgtggacagaaagggcaaggtcgtggggctgtacggaaacggcgtggttacacgcagcggcgcgtatgtctctgctattgcccagacggagaaatccatcgaagataatcctgagattgaagacgatatcttccggaagaaaagacttaccatcatggacctgcatcccggggccggaaagacaaaacgctacctgcctgctattgtgcgggaggccatcaagagaggcctccgcaccctgattcttgctccgacccgggtggtcgccgcggaaatggaggaggccctgagagggctccccatccgctatcaaacgcctgctattcgggccgaacacacgggaagagagatcgtggacctgatgtgtcatgctaccttcacaatgcggctcctgagccccgttcgcgtgcctaactacaaccttattatcatggatgaagcccactttaccgaccccgcctccatcgctgcgagaggctatatttctacacgggtcgagatgggggaggccgctggcatcttcatgaccgccacgccgcctggaagccgcgatccctttccccagtccaatgcccctattatggacgaagagagagaaatccccgagcggagctggaactctggccacgaatgggtgacagatttcaaggggaaaaccgtttggtttgtgccttccattaaggctggaaatgacatcgccgcgtgcctgcgcaagaatggcaagaaagtcatccagctgagccgcaagaccttcgattctgagtacgtgaagacacgggctaatgactgggattttgttgtgaccacagacattagcgagatgggggccaacttcaaagccgaaagagtcatcgatccgcgccggtgtatgaagcccgtgattctcaccgacggagaggaaagagtgatcctggctggccctatgcccgtcacgcattcctctgccgcgcaacgccgggggagaattggccgcaatcctaaaaacgagaatgaccagtatatctacatgggagaaccccttgagaacgatgaggactgcgcccactggaaggaagctaaaatgctgctcgataatatcaacacaccggagggcattatccctagcatgtttgaacccgagagagaaaaggttgacgccattgatggggagtaccggctgcgcggagaggctagaaaaaccttcgtggacctgatgcggcgcggcgatctccctgtgtggcttgcctataaggtcgctgccgaagggatcaattacgcggacagaaagtggtgttttgatggaattaaaaacaatcagatcctggaggaaaacgtggaggttgagatttggacaaaggaaggcgagcggaaaaagctgaaacccagatggctcgacgcccgcatctattccgatcctctggctcttaaggagttcaaggagttcgccgctgggcggaaatctctgaccctcaacctgatcacggaaatgggcagactgcccacctttatgacacagaaggcccgcaatgccctcgacaaccttgctgtgctgcataccgcggaggtcggaggcaaagcctacacacacgctctgagcgagctcccggaaaccctggagacacttctgctcctgaccctgctcgccgccgtgacagggggaattttcctttttctgatgtccggcaaggggatcggaaaaatgacactgggcatgtgctgcattatcaccgctagcattctcctgtggtatgcccaaatccagcctcactggatcgcggcctctattatccttgagttctttctgattgttctcctgatccccgagcccgaaaagcagcggacccctcaggataatcaactgacatacgtggtcattgctatcctcaccgtggtcgccgctacaatggccaacgagatgggcttccttgagaagacgaaaaaggacctggggtttggatccatcaccacacaggaaagcgagtccaatattctggacatcgatctcagaccggcgtctgcctggaccctgtatgctgtggccacaaccttcgttacgcccatgcttcggcatagcattgaaaactcctctgtgaatgtgagcctgaccgctatcgccaaccaggctacagtcctcatgggcctggggaaaggatggcctctgtccaagatggacattggcgttcccctccttgccatcgggtgttacagccaggtgaatcctattaccctgacagcggccctgctcctgcttgtggctcactacgccatcatcggacccggcctgcaagctaaagccacccgcgaggcccagaagagagcggctgccggcattatgaagaaccctacggtcgatgggatcacagtgattgacctcgaaccgatcccccatgatcctaaatttgagaagcagctgggacaggttatgctgctcattctttgcgtgacccaagtcctgatgatgcggacaacctgggctctgtgtgaggccctcaccctggccacaggccccatctctacgctttgggaagggaatcctggacgcttctggaacaccacaatcgctgtgtccatggccaatatttttagaggcagctatctggcgggggccggactcctgttctctatcatgaaaaacaccacaaatacccggcgcggcacgggcaacgtcggggagacactgggagaaaagtggaaatccagactcaatgctcttggcaagagcgagtttcagatttacaaaaagtctgggatccaggaggtggaccggaccctggccaaggaaggaattaaacgcggcgagaccgatcaccatgctgttagcagagggtccgccaagctgcggtggttcgtggaaagaaacatggtcacacccgagggaaaagtggttgacctcggctgcggccgcgggggatggtcttattactgtggcgggctgaagaacgtgcgggaagtcaaaggacttaccaagggcgggccgggacacgaggagcctatccccatgagcacatatggctggaatctggtgagactccaatccggcgtggatgttttctttacgccccctgaaaagtgcgacaccctgctgtgtgatatcggggagagctcccccaaccctacaattgaagcgggacgcaccctccgggtccttaatctggtggagaactggctgaataacaatacacagttctgcatcaaagtgctcaacccgtacatgccctctgtcattgaaaagatggagaccctgcagagaaaatatggcggggcccttgttcgcaatcctctgagccggaactccacgcacgagatgtactgggtgtctaatgctaccggaaacatcgtgagctccgtcaatatgatttctagaatgctcatcaaccgctttacaatgaagcataaaaaggccacctacgaacccgacgtggatctgggcagcgggacacggaatatcggaattgagtccgaaacccctaacctggacatcattggcaagagaatcgagaaaattaagcaggaacacgagacaagctggcattatgaccaagatcacccctacaaaacctgggcttatcacggctcttacgagacgaagcagacagggtccgccagctctatggttaacggagtggtccgcctccttaccaaaccgtgggacgtggttcctatggtgacccagatggctatgacagatacgacccccttcggccagcaacgggtctttaaggaaaaggtggacacaagaacccaggagcctaaagaagggacaaagaaactgatgaagatcaccgccgagtggctgtggaaagagctcggaaaggagaagacaccccgcatgtgtaccagagaggagttcacgcggaaggtgcgctccaatgcggccctgggcgctgtctttaccgatgagaacaagtggaaaagcgccagagaagctgttgaggacgggcggttctgggagcttgtggatagagaacggaatctgcatctcgagggaaagtgcgaaacatgtgtgtataacatgatgggcaaacgcgagaagaaactgggcgaatttgggaaggccaagggatctagagccatttggtacatgtggctgggcgcgcggttcctcgagtttgaggctctggggttccttaatgaagaccactggttttcccgcggaaacagcctgtccggcgtcgagggggaaggcctccatagactgggatatatccttcgggaggtgggcaaaaaggaagggggagccatgtacgccgatgacaccgctggctgggatacacgcatcaccctggaggacctcaaaaatgaggaaatggttacgaaccacatgaagggggagcataaaaagctggccgaagctattttcaagctgacataccagaataaagtggtcagagtgcagcggcctacccccagaggaacagttatggacatcattagcagaaaggatcaacggggctctggacaggtgggcacctatggactcaacacgttcaccaatatggaggcccagctgatccgccaaatggagggcgaagggatttttaaaagcatccagcaccttacagcgaccgaggaaacagccgtccagaactggctggctagagtgggacgggagcgcctctccagaatggccatctctggcgacgattgcgttgtgaagccgattgacgatcggttcgctagcgccctgaccgcgcttaatgacatggggaaagtcagaaaggatatccagcaatgggaaccttcccgcggatggaacgactggacacaggtgcccttttgctctcaccatttccacgagctggtcatgaaggatggccgggtgctcgttgtgccctgtagaaatcaggacgagctgattgggcgcgcccggatcagccagggcgctggatggtccctgaaagaaaccgcctgcctcggcaagtcttacgctcaaatgtggacgctgatgtattttcatagacgcgatcttcggctggccgctaacgccatttgtagcgcggtcccttcccactgggtgccgacaagcagaaccacctggtctatccacgccaaacatgagtggatgacaaccgaagacatgctcgctgtgtggaaccgcgtttggatccaggagaatccctggatggaagataagacacctgtggagtcctgggaggaagtcccctacctggggaaacgggaggaccagtggtgcggaagccttattggcctgacgtctagagccacctgggccaagaacatccagacagctattaatcaagtgcgctccctcatcgggaacgaaggatataccgactacatgcctagcatgaagcggttcagacgggaggaagaggaggccggcgttctgtggtga

SEQ ID NO: 19565 - RNA, 9876 nt, synthetic construct
  misc_feature 1..9876: note = derived and/or modified CDS sequence (opt5) from DENV-2__GU369819__SS-prME
  source 1..9876: mol_type = other RNA
acagccggagtgatcgtcatgctgattcccacagctatggccttccacctcacgacccggaacggggagcctcatatgatcgttggacggcaggaaaagggcaagagcctgctttttaagacagaggacggggtgaatatgtgcaccctgatggcgattgatctcggagaactgtgtgaggacacaatcacctacaaatgcccgcttctgcgccaaaacgaacccgaggatattgactgttggtgcaattccacatctacctgggtgacgtatggcacctgtacaaccacaggggagcaccggcgggaaaagcgcagcgtcgctctcgtgcctcatgttggaatgggcctggagaccagaacggaaacatggatgtcctctgagggcgcctggaaacacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaagaacaggacaaacgctttatctgcaagcattccatggtggatagaggctggggcaacgggtgtggactgttcggcaaagggggaattgtcacatgcgccatgtttacgtgcaaaaagaatatggaaggcaaagttgtgcagcctgagaacctcgaatacaccatcgtgattacaccccacagcggggaggagcatgcggtcggaaatgacaccggcaagcacggcaaagaaatcaagatcacacctcagtcttccattaccgaggccgaactgacggggtatggaaccgtgacaatggagtgtagcccccggaccggccttgatttcaacgaaatggttctgctccaaatggagaataaggcttggctggtgcaccgccagtggtttcttgacctgccgctcccttggctgcccggggccgatacacagggatctaactggatccagaaggagaccctggtcacgttcaagaatcctcatgctaaaaagcaagacgtggttgtgctcggctcccaggaaggggccatgcacacagccctgaccggcgctacagagattcagatgagctccggaaaccttctgtttaccggccatctcaaatgcagactgcggatggacaaacttcaactgaaagggatgtcttacagcatgtgtaccggaaagttcaagatcgtcaaagaaattgcggagacacagcacggcacgatcgtgatcagagtccagtatgagggggatggatccccctgcaagattcccttcgaaatcaccgacctcgagaaacgccatgtgctgggccggctgattacagttaaccctatcgtgaccgaaaaggatagcccggtcaatattgaggccgaacccccttttggggactcttacatcattatcggcgtggagcccggacagctcaaactgaactggttcaagaagggctccagcatcgggcaaatgtttgagacaaccatgagaggagctaaacgcatggccattcttggcgatacggcctgggacttcgggtctctgggaggcgtttttacaagcatcgggaaggctctccaccaggtgttcggcgccatttacggagcggctttttccggcgtctcttggaccatgaaaatcctgattggggtgatcatcacctggattggaatgaatagccggtccacaagcctgtctgtgtcccttgttctcgtcggcgtggtgaccctgtatctgggggccatggtcagagccgatagcggatgtgtggtttcttggaagaacaaagaactcaagtgcggctccgggatcttcattacagacaatgtgcacacgtggaccgagcagtacaagtttcagcctgaaagcccctccaaactggcttctgccatccaaaaggctcatgaggaaggcatttgtggaatccgcagcgtcacacggcttgagaacctgatgtggaaacagatcaccccggagctcaatcacattctgtccgaaaacgaggtgaagctgacaatcatgaccggcgatattaaagggatcatgcaggccggaaagagatctcttcgccctcagcccacggaactcaaatatagctggaagacctggggcaaggcgaaaatgctgtccacagagagccataatcaaaccttcctgattgacgggcctgaaacagccgagtgccccaacaccaatcgggcttggaactctctcgaggttgaagattacggatttggcgtgttcacaaccaatatctggctgaaacttagagagaaacaggacgtcttttgtgactccaagctgatgagcgccgctatcaaagataaccgcgccgtgcacgcggacatgggctattggattgaatctgccctcaatgatacgtggaagatggagaaggcttccttcatcgaggttaaaagctgccactggcctaagtctcatacactgtggagcaacggggtgctggaatccgagatgattatccccaaaaacttcgccggaccggtcagccagcacaattaccggcctggctatcatacccagaccgctgggccctggcaccttggaaagctcgaaatggactttgatctgtgtgagggcacaaccgtggtggtcacggaagactgcgggaacagaggaccctctctgcggacaaccacagcctccggcaaactcattaccgagtggtgctgtcgcagctgcacactgcctccgcttagataccggggcgaggatgggtgttggtacggaatggaaatcagacccctgaaggagaaggaagagaatctcgttaactccctggtgaccgccggccatgggcaaattgacaatttctctctgggagtgcttggcatggctctctttctggaagagatgctgcgcacgcggatcgggaccaaacacgcgatcctcctggtcgccgtgagcttcgttacacttattaccggaaacatgtcctttagagatctgggccgcgtgatggtcatggtgggcgctacaatgaccgacgatatcgggatgggagttacgtatctcgccctgctggccgctttcaaggtgagacctacatttgccgcgggccttctgctccggaaactgacctctaaggagctcatgatggctacaattgggatcgccctgcttagccagtccaccattcccgaaaccatcctggagctcacagacgccctggctctgggaatgatggtccttaaaatcgtgcgcaatatggaaaagtaccagctggccgttacgattatggcgatctcttgcgtgcctaacgctgtcattctccaaaatgcctggaaggtgagctgtaccatcctggccgctgtgtccgtcagccccctcctgcttacatcttcccagcagaaagccgattggattcctctggctctcaccatcaagggcctgaaccccacagccatcttcctgaccacgcttagcagaacatctaaaaagcggtcctggccgctgaatgaggcgattatggccgttgggatggtgagcatcctcgcttcttccctgctcaaaaacgacattcctatgaccggacccctggtggccggcggccttctgaccgtctgctatgtgctgacagggcgcagcgctgacctcgaactggagagagccgccgatgttaagtgggaggaccaggctgaaatctccggaagctctcctattcttagcatcaccatttccgaggatggctctatgagcatcaaaaatgaagaggaggaacaaacactgacgatcctcattcggaccgggctgctcgtgatctccggagtctttcccgtgtctattccgatcacagcggccgcttggtacctgtgggaggttaagaagcagcgcgccggcgtgctttgggacgtcccttctccccctcccgtggggaaagccgaactggaggatggagcttatagaattaagcagaaaggcatcctgggctactcccagatcggggccggagtctataaggaaggcaccttccacacaatgtggcatgtgaccagaggggcggttctcatgcaccgcggaaaaagaattgagccctcctgggctgacgtgaagaaggatctgatcagctacggcgggggatggaaacttgagggcgaatggaaggagggcgaagaggtccaagtgctggccctcgaacctgggaaaaacccgcgggccgttcagacgaagcccggaatttttaaaaccaatacaggcaccatcggggctgtgtccctggacttcagccctggaacatctggctcccccattgtcgatagaaaggggaaggtggtgggactctacggcaacggcgttgtcacccgcagcggggcctatgtgtctgcgatcgctcagacagagaaatccatcgaggacaaccctgaaattgaggatgacatctttcggaagaaaagactgacgattatggatcttcatcccggagccggcaagaccaaacgctacctgcctgccatcgtgcgggaagctattaagagagggctgcgcacactcatcctggccccgacccgggtcgtggctgccgagatggaagaggcgcttagaggactgcccattcgctatcagacccctgccatcaagacagagcacacgggccgggaaatcgttgacctcatgtgtcatgctaccttcacaatgagactgctcagccccgtgcgggtccctaattacaacctgattatcatggacgaggcccacttcaccgatcccgcttccattgccgcccgcgggtatatctctacaagagtggaaatgggcgaggctgcgggaatttttatgaccgccacgccgcctggcagccgggaccccttcccccaatccaatgctcctatcatggatgaggaacgcgagatccccgaaagaagctggaactctgggcacgagtgggttacagactttaaaggaaagaccgtgtggttcgtcccttccattaaagccggcaatgatatcgccgcttgccttcggaagaacgggaaaaaggtgattcagctgagcagaaagacctttgactctgaatacgttaaaacacgcgccaatgattgggacttcgtggtcaccacagatatcagcgagatgggagcgaactttaaggctgagcgggtgattgacccgagacgctgtatgaaacccgtgatcctgaccgatggcgaagaacgggtcatcctcgccgggcctatgcccgttacgcattcctctgccgctcagagacgcggccggattggaagaaatcctaagaacgaaaatgaccaatatatctacatgggcgagcccctggaaaacgacgaggattgcgcccactggaaagaggcgaagatgcttctggacaatattaacacaccggaagggatcattcctagcatgttcgagcccgaacgcgagaaagtggatgccatcgacggagaatacagactccggggcgaggctcgcaagacctttgtggatctgatgagaagaggggacctgcctgtctggctcgcctataaggtggctgccgagggaattaattacgctgatcgcaaatggtgtttcgacggcatcaagaacaaccagatccttgaagagaatattgaagttgagatctggacaaaagagggggaaagaaagaaactgaagccccggtggctggatgccagaatttattccgaccctctcgcgctgaaggagtttaaagagttcgccgctggccgcaagtctcttaccctgaacctcatcacggagatgggacggctgcccaccttcatgacacagaaagccagaaatgctctggataacctcgccgtgcttcataccgccgaagctggcgggcgcgcgtacaatcacgccctgagcgagctgccggagacactcgaaaccctgcttctgctcacactgctggctaccgtcacgggaggcatttttctcttccttatgtccgggcggggaatcggcaagatgacactgggcatgtgctgcatcattaccgccagcatcctgctctggtatgcccagattcaacctcactggatcgctgcctctattatcctggagtttttccttatcgtgctgctcattcccgaacccgagaaacagagaacccctcaggacaaccagctgacatacgttgtgatcgcgattctgaccgtcgtggccgctacaatggccaatgaaatggggtttctcgagaagacgaagaaagatcttggactgggctccatcaccacacaagagagcgaatccaacattctggacatcgacctccggccggcttctgcctggaccctgtatgcggtcgccacaaccttcgtgacgcccatgcttcgccatagcattgaaaatagctctgttaacgtgagcctgaccgctatcgccaatcaggctacagtgctcatggggctgggaaagggctggcctctgtccaaaatggatatcggggtccccctccttgccattggatgttacagccaggttaaccctatcaccctgacagctgccctgctcctgcttgtggcgcactacgccattatcggccccggcctgcaggctaaggccaccagagaagctcaaaaacgggccgccgcggggattatgaagaatcctacggtggacggaatcacagtcatcgatctcgagccgattccctatgaccctaagtttgaaaaacagctgggccaggtgatgctgctcatcctttgcgttacccaggtgctgatgatgcgcacaacctgggctctgtgtgaggccctcaccctggctacagggcccatttctacgctttgggagggaaaccctggcagattctggaataccacaatcgccgtctccatggccaacatttttcgggggagctacctggctggagccggcctcctgttctctatcatgaagaataccacaaacacccgcagaggcacggggaacatcggagaaacactgggcgagaaatggaagtcccggctcaatgcgcttgggaaaagcgaatttcaagtgtataagaaatctggcattcaggaggtcgatcgcaccctggccaaggagggcatcaagagaggggaaaccgaccatcacgctgtgagccggggatccgccaaactgagatggttcgttgagcgcaacatggtgacacccgaaggcaaggtcgtggatctcggctgcgggcggggaggctggtcttactattgtgggggactgaaaaatgttagagaggtgaagggccttaccaaagggggaccgggccatgaggagcctattcccatgagcacatacggctggaacctggtccgcctccagtccggggtggacgtgtttttcacgccccctgagaagtgcgataccctgctgtgtgacatcggagaaagctcccccaatcctacaattgaggctggccggaccctcagagttcttaacctggtcgaaaattggctgaacaataacacacaattctgcatcaaggtgctcaatccgtatatgccctctgtgatcgagaaaatggaagccctgcagcgcaagtacgggggagcgcttgtccggaaccctctgagcagaaattccacccacgagatgtactgggtttctaacgccacgggcaatattgtgagctccgtgaacatgatctctcgcatgctcattaaccggtttaccatgaaacacaagaaagctacatatgagcccgatgtcgacctggggagcggaaccagaaatatcggcattgaatccgagatccctaacctggatattatcggcaagcgcatcgaaaagattaaacaggagcatgaaacaagctggcactacgaccaggaccatccctataagacctgggcctaccacgggtcttatgagacaaaacaaaccggatccgctagctctatggtgaatggcgttgtgcggctccttacgaagccgtgggatgtcctgcctatggtgacacagatggccatgaccgacaccacacccttcgggcagcagagagtttttaaagagaaggtggatacgcgcacccaagaacctaaggagggaaccaagaagctgatgaaaatcaccgctgaatggctctggaaggagctgggcaaaaagaaaacacccagaatgtgtacccgggaggagttcacacgcaaggtcagatccaacgccgcgcttggggccatttttaccgacgagaataagtggaaaagcgctcgggaagccgtggaggatggaagattctgggaactggtggaccgggagcgcaacctccacctggagggcaagtgcgaaacgtgtgtctacaatatgatgggcaaaagagagaagaaactgggggaatttggaaaggctaagggctctcgggccatctggtatatgtggctcggggcccgcttcctggagtttgaagcgcttggattcctgaacgaggatcattggttttccagaggcaatagcctctccggggttgagggcgaaggactgcaccggcttggctacattctgcgcgacgtggggaaaaaggagggaggcgctatgtacgccgatgacaccgccgggtgggatacaagaatcaccctcgaagacctgaaaaacgaggaaatggtgacaaatcatatgaagggagagcacaaaaagctggctgaggccatcttcaagctcacctatcagaacaaagtcgtgcgggttcagcgccctacgcccagaggcacagtgatggacattatcagccggcgcgatcagagagggtctggccaagtcggaacctacggcctgaatacatttaccaacatggaagctcagcttattcggcagatggagggggaaggaatcttcaagagcattcaacatctgacggccaccgaggagatcgcggtgcagaattggctcgcccgcgttggcagagaacggctgtccagaatggctatctctggggacgattgcgtggtcaaaccgattgacgatcgcttcgccagcgctcttacagccctgaacgacatgggaaaggtgcggaaagatatccagcagtgggagccttccagaggctggaacgactggacccaagttcccttttgctctcaccacttccatgaactcgtgatgaaggatgggcgcgtcctggtggtcccctgtcggaatcaggacgagctgattggcagagcgcgcatcagccagggagccggctggtccctcaaggaaacagcttgcctggggaaatcttatgcccagatgtggacccttatgtactttcaccggagagatctgcgcctcgctgccaacgctatttgtagcgccgtgcctccgcattgggttcccacatcccggaccacgtggagcatccacgcgaagcacgagtggatgacaaccgaggacatgctggccgtgtggaatagagtctggattcaagaaaacccttggatggaggataaaacccccgtggaatcttgggaggaagtgccttatcttggaaagcgcgaggaccagtggtgcggctccctgatcgggctcacaagccgggctacctgggccaaaaatatccagacagccattaaccaggttagatctctgatcggaaatgaggaatacacggactatatgccctccatgaagcggttcagacgcgaggaagaggaagctggcgtgctgtggtga

SEQ ID NO: 19566 - RNA, 9876 nt, synthetic construct
  misc_feature 1..9876: note = derived and/or modified CDS sequence (opt5) from DENV-2__JX649147__SS-prME
  source 1..9876: mol_type = other RNA
accgccggcgtgatcattatgctgatccccacagctatggccttccacctcacgaccagaaacggggagcctcatatgattgtcggacggcaggaaaagggcaaaagcctgctttttaagacagaggacggggttaatatgtgcaccctgatggcgatcgatctcggagaactgtgtgaggacacaattacctacaaatgcccgcttctgcgccaatccgaacccgaggatatcgactgttggtgcaactctacaagcacctgggtgacgtatggcacctgtacaaccacaggggagcacagacgggaaaagcgctccgtggctctcgtccctcatgtgggaatgggcctggagaccagaacggaaacatggatgtctagcgagggcgcctggaaacacgcccagcggatcgagacctggattctgcgccatcccgggttcacaatcatggctgccattctcgcttacaccatcggaaccacacactttcagaaggccctgattttcatccttctgacggcggttgccccttccatgaccatgagatgcattggcatctctaatcgggattttgtggaaggggtcagcggaggctcctgggtggacatcgttctcgagcacgggagctgtgtgacaaccatggctaagaacaaacccacactggatttcgaacttattaagaccgaggccaaagaacctgctacgctgcgcaagtattgcatcgaggccaaactcacaaataccaccacagagtctagatgtccgacccagggagaaccctccctgaacgaggaacaagacaagcggtttgtctgcaagcatagcatggtggatcgcggctggggcaatgggtgtggactgttcggcaaagggggaattgtgacatgcgcgatgtttacgtgcaagaaaaacatggagggcaagatcgtccagcctgaaaatctcgagtacaccattgttatcacaccccactctggggaggaacatgccgtgggaaacgacaccggcaaacacggcaaggagatcaaaattacacctcagtccagcatcaccgaagctgagctgacggggtatggaaccgtgacaatggaatgttctcccagaaccggccttgatttcaatgagatggtcctgctccagatggaggacaaggcctggctggtgcaccggcaatggtttcttgatctgccgctcccttggctgcccggggctgacacacagggatccaactggattcagaaggaaaccctggttacgttcaaaaatcctcatgccaagaaacaggacgtggtcgtgctcggcagccaagagggggccatgcacacagctctgaccggcgcgacagaaatccagatgtcctctggaaaccttctgtttaccggccatctcaagtgccgcctgagaatggataaacttcagctgaaggggatgagctactccatgtgtaccggaaagttcaaaattgttaaggagatcgccgagacacaacacggcacgatcgtgattcgggtccagtatgaaggggacggaagcccctgcaaaatccccttcgagattatggatctcgaaaagagacatgtgctgggccgcctgatcaccgtcaatcctattgtgacagagaaagactctccggttaacatcgaagctgagcccccttttggggattcctacattatcatcggcgtggagcccggacagctcaagctgaactggttcaagaaaggcagctctattgggcagatgtttgaaaccacaatgcggggagccaagagaatggccatccttggcgacaccgcttgggatttcgggagcctgggaggcgtctttacgtccattgggaaagccctccaccaagtgttcggcgcgatctacggagctgccttttctggcgttagctggacaatgaagattctgatcggggtgatcattacctggatcggaatgaattcccgcagcacctctctgtccgtcagccttgtgctcgtgggcgttattacactgtatctgggggccatggtccaggctgactctggatgtgtggtgtcctggaaaaacaaggagctcaagtgcggcagcgggatcttcattaccgataatgtccacacatggacggaacagtacaaatttcagcctgagtccccctctaagctggccagcgctatccaaaaagcccatgaagagggcatctgtggaattcggtccgtgaccagacttgagaacctgatgtggaagcagatcacaccggaactcaatcacattctgtctgagaacgaagttaaactgaccatcatgacaggcgacattaaggggatcatgcaggcgggaaaacgcagccttcggcctcagcccaccgagctcaagtattcctggaagacgtggggcaaagccaagatgctgagcaccgaatctcataatcaaacattcctgatcgatgggcctgagaccgctgagtgccccaacaaaaatagagcctggaactccctcgaagtggaggactacggatttggcgtcttcacaaccaatatttggctgaagcttcgcgaaaaacaggacgtgttttgtgatagcaagctgatgtctgctgccatcaaggacaaccgggcggttcacgccgatatgggctattggattgagtccgctctcaatgacacatggaaaatggagaaggccagcttcatcgaagtgaaatcttgccactggcctaagagccataccctgtggtccaacggggtcctggagagcgaaatgattatccccaaatctttcgctggaccggtgtcccagcacaattacagacctggctattacacgcagacagccgggccctggcatcttggaaagctcgagatggattttgacttctgtgaaggcaccaccgttgtggtcacagaggattgcgggaaccgcggacccagcctgcggaccacgacagcctccggcaagctgattaccgagtggtgctgtagatcttgcacactccctccgctgcggtaccgcggcgaagacgggtgttggtatggaatggagatcagaccccttaaagaaaaggaggaaaacctggtgaatagcctcgtgaccgctggccacgggcaaatcgataacttttccctgggagtcctgggcatggcgcttttcctcgaggagatgctgcggacaagagttgggaccaaacatgccattctgctcgtggctgtgtcttttgtcacgctgatcaccggaaatatgagcttccgcgaccttggccgggtgatggttatggtgggcgccacaatgaccgatgacattgggatgggagtcacatacctggccctcctggctgcctttaaggtgagacctaccttcgcggctggcctgcttctgaaaaagctcacgtccaaggaactgatgatggccacaatcgggattgccctcctgtctcagagcaccatccccgagacaatccttgaactgaccgatgctctcgccctgggaatgatggttctgaaaattgtgcgcaacatggagaagtatcagcttgcggtcaccatcatggctatttcctgcgtgcctaatgccgttatcctgcaaaacgcctggaaagtgagctgtacaattctcgctgccgtctctgtgtcccccctgctcctgacgagctctcagcagaaggctgactggatccctcttgccctgaccatcaaaggcctcaatcccacagcgatttttctgaccacactgtccagaaccagcaagaaacggtcttggccgcttaacgaagccatcatggctgtggggatggtctccattctggccagctccctcctgaagaatgacatccctatgacgggacccctcgttgctggcggcctgcttacagtgtgctacgtgctgaccgggcgcagcgccgatctggagctcgagagagccaccgacgtcaagtgggaagatcaggctgagatttctggaagctcccctatcctgtctattacaatcagcgaagacggctccatgtctatcaaaaacgaggaggaagagcaaacccttacaattctgatccggacggggctcctggtgattagcggactcttccccatgtccatcccgattaccgcggccgcttggtatctgtgggaagttaagaaacagcgcgccggcgtgctttgggatgtcccttctccccctcccgtggggaaggccgagctggaagacggagcttacagaatcaaacagaagggcatcctgggctatagccagattggggccggagtttacaaggagggcacatttcacaccatgtggcacgtgacacggggggcggtcctcatgcatcgcggaaaaagaatcgagccctcctgggctgatgtgaagaaagacctgattagctacggcgggggatggaagcttgaaggcgagtggaaagaaggcgaggaagtccaagtgctggccctcgagcctgggaagaatccgcgggccgttcagaccaagcccggactgttcaaaacgaacaccggcacaatcggggctgtgtctctcgatttttcccctggaaccagcggctctcccattgtcgaccgcaaggggaaagtggttggactgtatggcaatggcgtggtcacaagatccggggcctacgtgagcgcgatcgctcagaccgagaagtccatcgaagataaccctgagattgaagacgatatcttccggaaaaagagacttacaattatggacctgcaccccggagccggcaagacgaaacgctatctgcctgccatcgtgcgggaggctattaagagagggctccgcaccctgatccttgccccgacacgggttgtcgctgccgaaatggaggaggcgctgagaggactccccattcgctaccagacccctgccatccgggctgaacataccggcagagagatcgtggacctgatgtgtcacgccacattcacgatgcgcctcctgtctcccgtgcgggtccctaattataaccttattatcatggatgaagctcattttaccgaccccgccagcattgccgctagagggtacatctccacacgggtggagatgggcgaggcggccggaattttcatgaccgctacaccgcctggcagccgcgatccctttccccaatctaacgcccctatcatggacgaagagagagaaatccccgagcggtcctggaatagcgggcacgaatgggttaccgatttcaaaggaaagacggtgtggtttgtcccttctattaaagccggcaacgacatcgctgcctgcctgcgcaagaatgggaagaaagtgattcagctgagcagaaagacattcgattccgagtatgttaaaacccggaccaacgactgggattttgtggtcacaaccgacatctctgagatgggagcgaatttcaaggctgaaagagtgattgatccgcgccggtgtatgaaacccgttatcctcacagacggcgaggaaagagtgatcctggccgggcctatgcccgtcacccacagctccgccgctcagcgccggggcagaattggacgcaaccctaagaatgagaacgaccaatacatctacatgggcgaaccccttgagaatgatgaggactgcgcccattggaaagaagcgaagatgctgctcgataacattaatacgccggaggggatcattccttctatgtttgaacccgagcgggaaaaggtggacgccatcgatggagagtatagactgcgcggcgaggctagaaaaacattcgtggacctgatgcggcgcggggatctccctgtctggcttgcctacagagttgctgccgaaggaattaactatgctgaccggcgctggtgttttgatggcgtgaagaataaccagatcctggaggaaaatgtggaggtcgagatctggaccaaagaaggggagagaaagaaactgaagccccggtggctcgacgccagaatttacagcgatcctctggcgcttaaggaattcaaagagttcgccgctggccgcaagtccctgacactcaacctgatcaccgaaatgggacggctgcccacgtttatgacccagaaagccagagacgctctcgataaccttgccgtgctgcacacagccgaggctggcgggcgcgcgtataatcatgccctgagcgagctcccggaaaccctggagacacttctgctcctgaccctgctcgctacagttaccggaggcattttcctttttctgatgtctgggaagggagtgggcaaaatgacgctgggcatgtgctgcatcattacagcctccatcctcctgtggtacgcccagatccaacctcactggattgctgccagcatcattcttgaattctttctgatcgtcctcctgattcccgagcccgaaaagcagcggacccctcaggacaaccagctgacctatgtggttatcgcgatcctcacagtggtcgccgctaccatggccaatgagatggggttccttgagaagacaaaaaaggacctgggactgggctccattgctacgcaagaaccggagtctaacatcctcgatattgacctgagacccgccagcgcgtggaccctttacgccgtggctacaacctttgtcacacctatgctgcggcactccatcgaaaattctagcgtgaacgtttccctcaccgccattgctaatcaggccacggtgctgatggggctgggaaaaggctggcccctcagcaagatggatatcggggtgcctcttctggctattggatgttactctcaggtcaaccccatcaccctgacagccgcgctcctgcttctgatcgcccattatgctattatcggccctggcctccaggccaaagctacccgcgaggcccaaaagagagccgcggctgggattatgaagaatccgacagttgacggaatcaccgtgattgatctggaccccatcccttacgatcccaaattcgaaaagcagctgggccaggtgatgctccttatcctgtgcgtcacgcaggtgctgatgatgcggacaacctgggccctctgtgaggctctgacacttgccaccgggcctatttccaccctgtgggagggaaaccccggccgcttttggaatacaacgatcgccgttagcatggctaacattttcagagggtcttatctcgccggagcgggcctgctgttttccatcatgaaaaataccacaaacacccggcgcggcacagggaatattggagaaaccctcggcgagaagtggaaaagcagacttaacgccctggggaagtctgaattccaaatctacaaaaagagcggaatccaggaggtggaccggacgctggctaaggagggcattaaacgcggggaaacagatcaccatgccgtctccagaggatctgctaagctccggtggtttgtggagagaaatatggtcaccccggaaggcaaagtggttgacctgggctgcgggcgcggaggctggagctattactgtgggggacttaagaacgtgcgggaggtcaaaggcctgaccaaggggggacctggccacgaagagcccatccccatgtccacatatggctggaacctcgtgagactgcagagcggggttgatgtgttcttcacccctcccgagaagtgcgacacactgctctgtgatattggagaatcctctcctaatccgacgatcgaggccggccgcacccttcgggtcctgagcctggtggaaaactggctcaataacgacacacaattttgcattaaagtgctgaatccctacatgccttccgttatcgagaagatggaaacccttcagagaaaatacgggggagcgctggtccgcaaccccctctctcggaatagcacacatgagatgtattgggtgtccaacgccaccggcaatatcgtgtctagcgtcaacatgatttccagaatgctgatcaatcgcttcacgatgaagcacaaaaaggctacctacgagcctgacgttgatctggggagcggaacacggaacattggcatcgaatctgagattcccaatctcgacatcattggcaagagaatcgaaaaaatcaagcaggagcacgaaacctcctggcattatgatcaggaccacccgtacaaaacatgggcctatcatgggagctacgagaccaagcaaacaggatctgcttccagcatggtgaacggcgtggtccgccttctgaccaaaccttgggatgtggttcccatggtgacgcagatggccatgacagacaccaccccttttgggcagcagcgggtcttcaaggagaaggtggatacaagaacgcaagaacccaaagagggaaccaagaaactgatgaagattacagctgaatggctctggaaagagctgggcaagaaaaagacccctcgcatgtgtacaagagaggaatttacccggaaggttcgctctaatgccgcgcttggggccatcttcacagacgagaacaaatggaagtccgctagagaagccgtggaggatagccggttttgggaactggtcgacaaagagagaaacctccacctggagggaaagtgcgaaacctgtgtgtataatatgatgggcaaacgggagaagaagctgggcgaattcgggaaagctaagggatcccgcgccatttggtacatgtggctcggcgccagatttctggagttcgaagcgcttgggtttctgaacgaggatcactggttcagccgggagaattctctcagcggagtggaaggcgaggggctgcataaacttggctacatcctgcgcgacgtctccaagaaagaaggaggcgctatgtatgccgacgatacggccgggtgggacaccagaattacactcgaggatctgaagaacgaagagatggttaccaatcacatggagggagaacataagaaactggctgaggccatctttaagctcacataccagaacaaagtggtgcgggtccagcgccccaccccgagaggcacggtgatggacatcatttctcggcgcgatcagagagggagcggacaagttggcacatatgggctgaataccttcacaaacatggaagctcagcttatccggcagatggagggcgagggaattttcaagtccatccaacacctgaccgtgacggaagagattgccgtccaggactggctcgcgcgcgtgggcagagaacggctgtctcgcatggccatcagcggggatgactgcgttgtgaaacctcttgatgacagatttgcttccgccctgaccgctctcaatgatatgggaaaggtccggaaggacatccagcagtgggagccctctagaggctggaacgattggacacaagtgcccttctgcagccatcactttcacgaactgattatgaaagacgggcgcgttctggtggtcccttgtcggaatcaggacgagctcatcggaagagcccgcatttcccagggcgcggggtggagcctgaaggagaccgcctgccttggcaaatcttacgctcagatgtggtccctgatgtatttccatcggagagatctccgcctggccgctaacgccatctgtagcgctgtgccgtctcactgggtccccacatcccggaccacatggagcattcatgccaagcacgaatggatgaccacggaggacatgcttacagtgtggaatagagtttggatccaagaaaacccttggatggaggataaaacccccgtggaatcctgggaggaggtcccttacctgggaaagcgcgaagaccagtggtgcggctctctcattgggctgaccagccgggcgacatgggccaagaatatccagaccgctatcaaccaggtgagatccctgattggaaacgaggaatatacagattacatgcccagcatgaaacgctttcggagagaggaagaggaggccggcgtgctctggtga

SEQ ID NO: 19567 - RNA, 9876 nt, synthetic construct
  misc_feature 1..9876: note = derived and/or modified CDS sequence (opt5) from DENV-2__KF704356__SS-prME
  source 1..9876: mol_type = other RNA
accgccggcatgatcattatgctgatccccacagtgatggctttccacctcacgacccggaacggggaacctcatatgattgtcagccggcaggaaaagggaaagtccctgctttttaatacaggcgacggggttcacatgtgcaccctgatggccatgcatctcggagagctgtgtgaagatacaatcacctacaagtgcccgcttctgagacaaaacgagcccgaagacattgattgttggtgcaattctacaagcacctgggtgacgtatggcacctgtacaaccacaggggagcaccggcgggagaaacgctccgtggcgctcgtccctcatgtgggaatgggcctggaaaccagaacggagacatggatgtctagcgaaggcgcttggaagcacgcccagcggatcgagacctggatcctgcgccaccccgggttcacaattatggccgctatcctcgcctacaccattggaaccacacattttcagagagctctgatcttcattcttctgacggccgttgcgccttccatgaccatgcggtgcatcggcatttctaaccgcgactttgtggagggggtcagcggaggctcctgggtggatatcgttctcgaacacgggagctgtgtgacaaccatggccaaaaataagcccacactggaccttgagctgatcaagaccgaagctaaacagcctgccacgctcagaaagtattgcattgaggctaaactgacaaacaccaccacagaatctcggtgtccgacccaaggagagccctccctgaatgaggaacaggataagcgcttcgtctgcaaacatagcatggtggacagaggctggggcaacgggtgtggactctttggcaaggggtctatcgtgacatgcgccatgttcacgtgcaagaaaattatgaagggaaaagtcgttcagcctgagaatctggaatacaccatcgtgattacaccccactccggcgaggaacacgcggtggggaacgataccggaaagcatggcaaagagatcaagatcacacctcagagctctattaccgaggccgaacttacgggctatgggaccgtcacaatggagtgtagcccccggaccggactggactttaatgaaatggtgctcctgcaaatggaggataaggcttggcttgttcaccgccagtggttcctggacctcccgctgccttggctgcccggcgccgatacacaggggagcaactggatccagaaggaaaccctcgtgacgtttaagaatcctcatgctaaaaagcaagacgtcgtggttctgggatcccaggagggcgccatgcacacagcccttaccggggctacagagattcagatgtctagcggcaacgtgctgttcaccggacatctcaaatgcagactgcggatggacaaacttcaactgaaaggcatgtcctacagcatgtgtaccgggaagtttaaggtcgtgaaagaaatcgcggagacacagcacggaacgattgtcatcagagtgcagtatgaaggcgatgggtctccctgcaagatccccttcgagattatggacctcgagaaacgccacgttctgggacggctgatcaccgtgaatcctattgtcacaggcaaggattccccggtgaacatcgaagccgagccccctttcggggacagctacattatcattggcgttgaacccggacagctcaaactgaactggtttaagaagggctctagcatcgggcaaatgttcgctaccacaatgagaggagccaaacgcatggccatccttggcgataccgcttgggactttgggtccctgggaggcgtgttcacgtctattgggaaggccctccatcaggtctttggcgcgatctacggagctgccttcagcggcgtgtcctggacaatgaaaattctgatcggggtgattatcacctggatcggaatgaatagccggtctacctccctgagcgtttctcttgtcctcgtgggcgtggtcacactgtatctgggggtgatggttcaggccgattccggatgtgtggtcagctggaagaacaaagagctcaagtgcggctccgggatttttatcaccgacaatgtgcacacatggacggaacagtacaagttccaacctgagtctcccagcaaactggcttccgccattcagaaggctcatgaggaaggcatctgtggaattagatctgttacccgccttgagaacctgatgtggaaacagatcacaccggaactcaatcacatcctgagcgagaacgaagtgaagctgaccattatgacaggcgatatcaaagggattatgcaggccggaaagcggtcccttagacctcaacccaccgagctcaaatatagctggaagacgtggggcaaggcgaaaatgctgtctaccgagtcccacaatcagacatttctgatcgacgggcctgaaaccgccgagtgccccaacacaaatcgcgcttggaacagcctcgaagtcgaggattacggattcggcgtgtttaccacaaatatttggctgaaacttcgggaagaacaggacgttttctgtgactctaaactgatgtccgccgctatcaaggataacagagccgtgcatgcggacatgggctattggatcgagagcgccctcaatgatacctggaaaattgaaaaggcttcttttatcgaggtcaagagctgccactggcctaaatcccatacgctgtggagcaacggggtgctggaatctgagatgattatccccaagaatttcgccggaccggtgtcccagcacaactaccgccctggctatcatacacaaaccgctgggccctggcaccttggaaaactcgagatggacttcgatttttgtgaaggcaccacagtcgttgtgaccgaggactgcgggaaccggggacccagcctgagaacgacaaccgcctccggcaagctgattacagaatggtgctgtcggtcttgcaccctccctccgctgcgctacagaggcgaggatgggtgttggtacggaatggaaatccggccccttaaagagaaggaggaaaatctggtgaacagcctcgtcacagccggccacgggcagattgacaatttctccctgggagtgctgggcatggctctttttctcgaggaaatgctgagaacccgcgttgggacgaagcatgcgatcctgctcgtggccgtctctttcgtgaccctgatcacaggaaacatgagctttcgggatcttggcagagttatggtgatggtcggcgctaccatgacagacgatattgggatgggagtgacctatctggccctcctggccgctttcaaagttcgccctacgtttgccgcgggcctgcttctgagaaagctcacatccaaagagctgatgatgaccacaatcgggattgtgctcctgtctcagagcaccatccccgaaaccattcttgagctgacagacgctctcgccctgggaatgatggtcctgaagatggtgcggaaaatggagaagtaccaacttgccgtgacgatcatggctatcctgtgcgtccctaatgccgttattctccagaacacctggaaggtgtcctgtacaatcctggcggtggtcagcgtgtctcccctcttcctgacctccagccagcagaaagctgattggattcctcttgccctgacaatcaagggcctcaatcccaccgccatttttctgacgacactgtctcgcaccaacaaaaagagatcctggccgcttaatgaagctatcatggccgttgggatggtgagcatcctggcttcttccctcctgaaaaacgacattcctatgaccggacccctcgtcgccggcggcctgcttacagtgtgctatgttctgaccgggcggagcgcggacctggagctcgaacgcgccgctgatgtgaagtgggaggaccaagccgaaatctccggaagctctcctattctgagcatcacaatttccgaggatggctctatgagcatcaaaaatgaggaagaggaacagacgcttaccattctgatcagaacagggctcctggtcatctccggactcttccccgtgtctattccgatcaccgctgccgcctggtacctgtgggaggtcaagaagcagcgggctggcgtgctttgggacgttccttctccccctcccgtggggaaagcggagctggaagatggagcctatcgcattaagcagaaaggcatcctgggctactcccaaattggggctggagtctataaggagggcacatttcacaccatgtggcatgtgacgagaggggccgttctcatgcacaaaggaaagcggatcgaaccctcctgggccgacgtgaagaaagatctgatcagctacggcgggggatggaaacttgagggcgaatggaaagagggcgaggaagtccaggtgctggctctcgagcctgggaagaacccgcgcgccgtgcagaccaaacccggactgttcaagacaaatgcgggcaccattggggctgtttccctcgactttagccctggaacatctggctcccccatcattgatagaaaggggaaagtcgtgggactgtacggcaacggcgtggtcacccggagcggggcctatgtgtctgccatcgctcagacagaaaagtccattgaggacaatcctgaaatcgaggatgacatcttcagaaaacgcaaacttacgattatggatctgcatcccggagccggcaaaaccaagcggtacctgcctgcgatcgttagagaggctattaagcgcgggctccggacactgatccttgccccgaccagagtggtcgccgctgaaatggaggaagccctgcgcggactccccattcggtatcaaacccctgctatcagagccgagcacacaggccgcgaaattgtggacctgatgtgtcacgcgacgttcaccatgcggctcctgagccccgttagagtgcctaactacaaccttatcatcatggacgaggcccattttacagatcccgcttccattgccgctcgggggtatatctctacccgcgtcgagatgggcgaagccgccggaattttcatgacagctaccccgcctggcagcagagacccctttccccagtccaatgcgcctatcatggatgaggaacgggagattcccgagcgcagctggtcttccgggcacgaatgggtgacggacttcaaaggaaagacagtttggtttgtgcctagcatcagagccggcaacgatatcgctgcctgcctgcggaaaaatgggaagaaagtcattcagctgtctagaaagaccttcgacagcgagtacgtgaagacccgcacaaacgattgggactttgtggtcaccacagatatctccgaaatgggagccaatttcaaagctgagcgggttattgacccgagacgctgtatgaagcccgtgatcctcaccgatggcgaagaacgggtgattctggccgggcctatgcccgtcacgcattctagcgcggctcaaagacgcggccggatcggaagaaaccctaaaaatgagaacgaccagtatatctacatgggcgaaccccttgagaatgacgaagattgcgcccactggaaggaggccaaaatgctgctcgacaacattaatacaccggaagggatcattccttccatgtttgagcccgagcgcgaaaaggtggatgctatcgacggagagtacagactgcggggcgaagcccgcaaaaccttcgttgatctgatgagaagaggggacctccctgtgtggcttgcgtatcgcgtcgccgctgagggaattaactacgccgatagacggtggtgttttgacggcatcaagaataaccagattctggaagagaatgtggaggttgaaatctggacaaaggagggggaacgcaagaagctgaaaccccgctggctcgatgctcggatctattctgaccctctggcccttaaggagttcaaagagttcgctgccggcagaaagagcctgaccctcaacctgattacggaaatgggacgcctgcccacctttatgacacagaaggcgcgggatgccctcgacaaccttgctgtgctgcacaccgccgaggctggcgggagagcctacaatcatgccctgtccgaactcccggagacactggaaacccttctgctcctgacactgctcgctaccgtcacgggaggcatcttcctttttctgatgagcgggcggggaattggcaaaatgacactgggcatgtgctgcatcattaccgcgtctatcctcctgtggtatgcccaaatccagcctcactggattgctgcctccatcattcttgagttctttctgatcgtgctcctgattcccgagcccgaaaagcagcgcacccctcaggataaccaactgacatacgtcgtgatcgccatcctcaccgttgtggctgccacaatggcgaatgagatggggttccttgagaagacgaagaaagacctgggactgggcagcattaccacacagcagccggagtccaacatcctcgacattgatctgagacccgcctctgcttggaccctttatgccgtggctacaacctttgtcacgcctatgctgcggcatagcatcgaaaattcctctgttaacgtgagcctcaccgccattgcgaatcaggccacagtgctgatggggctgggaaagggctggcccctctccaagatggacatcggggtccctcttctggctattggatgttacagccaagtgaaccccatcaccctgacagccgctctcttcctgcttgttgcccactacgctatcattggccctggcctgcaggccaaagcgacccgcgaggcccagaagagagctgccgctgggatcatgaaaaatccgacggtggatggaattacagtcatcgacctcgatcccattccttatgaccccaagtttgagaaacagctgggccaagtgatgctgctcgtcctttgcgtgacccaggttctgatgatgcggacaacctgggccctgtgtgaagccctcaccctggcgacagggcctatctctacgctttgggagggaaaccccggccgcttctggaataccacaatcgctgtgtccatggccaacatttttagagggagctacctggctggagccggcctcctgttctctatcatgaagaataccacaaacacccggcgcggcacggggaatatgggagaaacactgggcgagaagtggaaatccagactcaacgcccttggaaagagcgaatttcagatttataaaaagtctggaatccaagaggtcgatcggaccctggctaaagagggcattaagagaggggaaaccgaccatcacgccgtgagccgcggatccgcgaaactgcggtggttcgttgagagaaatatggtgacaccggaaggcaaggtcgtggatctcggctgcgggcgcggaggctggtcttactattgtgggggactgaagaacgtgcgggaggttaaaggccttaccaaaggcgggcctgggcacgaggaacccatccccatgagcacatacggctggaacctggtcagactccagtccggggtggacgtgttctttacgcctcccgagaaatgcgataccctgctgtgtgacatcggagaaagctcccctaatccgacagtcgaggccggccgcaccctccgggttcttaacctggtggaaaattggctgaacaataacacacagttctgcattaaggtgctcaatccctatatgccttctgtcatcgagaaaatggaggctctgcagagaaagtacgggggagcccttgtgcgcaaccccctgagcagaaattccacccatgaaatgtactgggtttctaacgctagcggcaatattgtgtcctctgtcaacatgatcagcagaatgctcattaatcgctttacgatgcggcacaagaaagccaccttcgagcctgatgtggacctggggtccggaacaagaaacatcggcatcgaaagcgagattcccaatctggacatcattggcaagcgcatcgagaagattaagcaagagtatgagacctcttggcattacgatcaggaccacccgtataaaacatgggcgtaccacgggtcctatgaaaccaagcagacaggaagcgcctcttccatggttaacggcgtggtcagactccttaccaagccttgggatgtggtgcccatggtcacgcagatggctatgacagacaccaccccttttgggcaacagcgggttttcaaagagaaggtggatacacgcacgcaggaacccaaagagggaaccaagaaactgatgaagatcacagccgaatggctgtggaaggagctcggcaaaaagaaaacccctagaatgtgtacacgggaggaatttaccagaaaggtgcggagcaacgctgccctgggggctattttcacagacgagaataaatggaagtctgcccgcgaagcggtcgaggattccagattttgggagcttgtggacaaagaacggaacctgcatctcgagggaaagtgcgaaacctgtgtttacaatatgatgggcaagcgcgagaaaaagctgggcgagttcgggaaagccaagggaagcagagctatctggtatatgtggctgggcgcccggtttctcgagttcgaggctctggggtttcttaacgaagatcactggttctcccgcgagaatagcctgtctggagtggaaggcgaggggctccataaactgggctacatccttagagacgtcagcaagaaggaaggaggcgccatgtacgccgatgacacggcggggtgggacacccggattacactggaggatctcaaaaacgaggaaatggtgaccaatcacatggagggagaacataagaaactggctgaggccatcttcaagctgacatatcagaacaaagttgtgcgcgtccaaagacccaccccgcggggcacggtgatggacattatctcccgcagagatcagcgggggtctggacaggttggcacatacgggctcaatacctttacaaacatggaagcccaactgattcgccagatggagggcgagggagtgttcaagaatatccagcaccttaccgtcacggaagagatcgctgtgcagaactggctggccagagtcggccgggaaagactcagccgcatggctatttccggggacgattgcgtggttaagcctctggacgatcggtttgcctctgcgcttaccgccctgaatgacatgggaaaagtgagaaaggatatccaacagtgggagcccagccgcggctggaacgactggacacaggtccccttctgctcccaccattttcacgagctcattatgaaagatgggcgggtgctggtggttccttgtagaaatcaggacgaactgatcggacgcgctcggatttctcaaggcgccgggtggagcctcagagagaccgcttgcctgggcaagtcctatgcccagatgtggagccttatgtacttccatcgccgggatctgagactcgcggccaacgctatctgttctgccgtgccgtcccactgggtccccacaagccgcaccacatggtctatccacgctaaacatgaatggatgaccacggaggacatgctgacagtgtggaaccgggtttggattcaggaaaatccttggatggaggacaagacccccgtggagtcctgggaagagatcccttatcttggaaagagagaagatcagtggtgcggcagcctgattgggctcacctcccgggccacatgggctaaaaacatccaaaccgccattaatcaggtcagatctctgatcggaaacgaggaatacacagactatatgcccagcatgaagcgctttcggagagaggaggaagaggcgggcgtgctgtggtga

SEQ ID NO: 19568 - RNA, 9876 nt, synthetic construct
  misc_feature 1..9876: note = derived and/or modified CDS sequence (opt5) from DENV-2__KF704355__SS-prME
  source 1..9876: mol_type = other RNA
accgccggcatgatcattatgctgatccccacagtgatggctttccacctcacgacccggaacggggagcctcatatgattgttagccggcaggaaaagggaaaatccctgctttttaagacaggcgacggggttaatatgtgcaccctgatggccatggatctcggagagctgtgtgaagacacaatcacctacaaatgcccgttccttagacaaaacgagcccgaagatattgactgttggtgcaattctacaagcacctgggtgacgtatggcacctgtacaaccacaggggagcacagacgggagaagcgctccgtggcgctggtccctcatgtgggaatgggcctcgaaaccagaacggagacatggatgtctagcgaaggcgcttggaaacacgcccagcggatcgagacctggatcctgcgccatcccgggtttacaattatggccgctatcctggcctacaccattggaaccacacacttccagagagctctcatctttattctgcttacggccgttgcgccttccatgaccatgcggtgcatcggcatttctaaccgcgatttcgtggagggggtcagcggaggctcctgggtggacatcgttctggaacacgggagctgtgtgacaaccatggccaagaataagcccacactcgatctggagcttatcaaaaccgaagctaagcagcctgccacgctgagaaaatattgcattgaggctaagctcacaaacaccaccacagaatctcggtgtccgacccaaggagagccctccctgaatgaggaacaggacaaacgctttgtctgcaagcatagcatggtggatagaggctggggcaacgggtgtggactgttcggcaaggggtctatcgtgacatgcgccatgtttacgtgcaaaaagattatgaaaggaaaggtcgttcagcctgagaatctcgaatacaccatcgtgattacaccccactccggcgaggaacatgcggtggggaacgacaccggaaaatatggcaaggagatcaaaatcacacctcagagctctattaccgaggccgaactgacgggctacgggaccgtcacaatggagtgtagcccccggaccggacttgatttcaatgaaatggtgctgctccaaatggaggacaaggcttggctggttcaccgccagtggtttcttgatctgccgctcccttggctgcccggcgccgacacacaggggagcaactggatccagaaggaaaccctggtgacgttcaaaaatcctcacgctaagaaacaagacgtcgtggttctcggatcccaggagggcgccatgcatacagccctgaccggggctacagagattcagatgtctagcggcaacgtgctttttaccggacacctgaagtgcagactccggatggataaactgcaacttaagggcatgtcctatagcatgtgtaccgggaagttcaaagtcgtgaaggaaatcgcggagacacagcatggaacgattgtcatcagagtgcagtacgaaggcgacgggtctccctgcaaaatccccttcgagattatggatctggagaagcgccacgttctcggacggctgatcaccgtgaatcctattgtcacaggcaaagactccccggtgaacatcgaagccgagcccccttttggggatagctacattatcattggcgttgaacccggacagctgaagctcaactggttcaagaaaggctctagcatcgggcaaatgtttggaaccacaatgagaggcgctaagcgcatggccatcctgggggacaccgcctgggatttcggatcccttggcggggtgtttacgtctattggcaaagctctgcatcaggtcttcggagccatctatggcgcggcttttagcggggtgtcctggacaatgaagattctcaccggagtgatcattacctggatcggcatgaatagccggtctacatccctgagcgtttctctggtccttgtgggggtggtcaccctctacctgggagtgatggttcaggccgactccggctgtgtggtcagctggaaaaacaaggagctgaagtgcgggtccggcatcttcattacagataatgtgcacacgtggaccgaacagtataaatttcaacctgagtctcccagcaagctcgcctccgctatccagaaagcccacgaggaaggaatttgtggcatcagatctgttacacgcctggagaaccttatgtggaagcagattaccccggaactgaatcatatcctcagcgagaacgaagtgaaactgacaatcatgaccggggacattaagggaatcatgcaggctggcaaacggtccctgagacctcaacccacggagcttaagtacagctggaagacctgggggaaagccaagatgctctctacagagtcccacaatcagaccttcctgattgatggacctgaaacagcggagtgccccaacaccaatcgcgcctggaacagcctggaagtcgaggactatggctttggcgtgttcacaaccaatatctggctcaaactgcgggaaaagcaggacgtcttttgtgattctaaacttatgtccgctgccattaaggacaacagagctgtgcatgccgatatggggtactggatcgagagcgcgctgaatgacacgtggaagatcgagaaagcctctttcattgaagtcaagagctgccactggcctaaatcccacacactctggagcaacggagtgctggagtctgaaatgatcattcccaagaatttcgctggcccggtgtcccagcataactatcgccctgggtaccacacccaaaccgccggaccctggcatctgggcaaacttgagatggattttgacttctgtgaggggacaaccgtcgttgtgacggaagattgcggaaaccggggccccagcctcagaacaaccacagcttccggcaagctgatcaccgagtggtgctgtcggtcttgcacactgcctccgctccgctacagaggggaagacggatgttggtatggcatggagattcggcccctgaaggaaaaagaggagaatcttgtgaacagcctggtcaccgccgggcacggacagatcgataatttttccctcggcgtgctggggatggccctgttccttgaagagatgctcagaacgcgcgttggaaccaagcatgctattctgctggtggcggtctcttttgtgacactcatcaccggcaacatgagcttccgggacctgggcagagttatggtgatggtcggggccacaatgaccgatgacatcggaatgggcgtgacgtaccttgctctgctcgccgcctttaaagttcgccctacattcgctgccgggctgctgcttagaaagctgacctccaaagaactcatgatgacaaccattggaatcgtgctgctctctcagagcaccattcccgagacaatcctggaacttacggatgcgctggctctcggcatgatggtcctgaagatggtgcggaagatggagaaatatcaactggccgtgaccattatggccatcctttgcgtccctaatgctgttatcctgcagaacgcctggaaggtgtcctgtacaattctcgcggtggtcagcgtgtctcccctgtttctcacctccagccagcagaaagctgactggatccctctggcccttacaattaaggggctgaatcccaccgccatcttcctcacgacactgtctcgcaccaacaaaaagagatcctggccgctgaatgaggctattatggccgttggaatggtgagcatccttgcttcttccctgctcaaaaacgacatccctatgaccggccccctggtcgccggcgggctcctgacagtgtgctacgttcttaccggacggagcgcggatctggaactggagcgcgccgctgacgtgaagtgggaagatcaagccgagatttccggcagctctcctatcctcagcattacaatctccgaagacgggtctatgagcattaagaatgaggaggaggaacagacgctgaccatccttattagaacaggactgctcgtcatctccggcctgtttcccgtgtctatcccgattaccgctgccgcctggtatctctgggaagtcaaaaagcagcgggctggggtgctgtgggatgttccttctccccctcccgtgggaaaagcggagcttgaggacggcgcctaccgcatcaagcagaaaggcattctggggtattcccaaatcggagctggcgtctacaaggaagggacattccacaccatgtggcacgtgacgagaggagccgttctgatgcataagggcaaacggattgagccctcctgggccgatgtgaagaaagacctcatcagctacgggggaggctggaagctggaaggcgagtggaaagaaggggaggaggtccaggtgcttgctctggaacctggaaagaacccgcgcgccgtgcagaccaagcccggcctctttaaaacaaatgcggggaccatcggagctgtttccctggatttcagccctggcacatctgggtcccccattatcgacagaaagggaaaagtcgtgggcctctatggcaacggggtggtcacccggagcggagcctacgtgtctgccattgctcagacagagaagtccatcgaagataatcctgagattgaagacgatatcttcagaaaacgcaagctgacgatcatggaccttcaccccggcgccgggaagaccaaacggtatctgcctgcgattgttagagaggctatcaagcgcggactgcggacactcattctggccccgaccagagtggtcgccgctgagatggaagaggcccttcgcggcctgcccatccggtaccaaacccctgctattagagccgaacatacagggcgcgagatcgtggacctcatgtgtcacgcgacgtttaccatgcggctgctcagccccgttagagtgcctaactataacctgattatcatggatgaagcccatttcacagaccccgcttccatcgccgctcggggctacatttctacccgcgtcgagatgggagaggccgccggcatctttatgacagctaccccgcctgggagcagagatcccttcccccagtccaatgcgcctattatggacgaagaacgggaaatccccgagcgcagctggtcttccggacacgagtgggtgacggattttaaaggcaagacagtttggttcgtgcctagcattagagccgggaacgacatcgctgcctgccttcggaaaaatggaaagaaggtcatccagctgtctagaaaaacctttgatagcgaatatgtgaagacccgcacaaacgactgggatttcgtggtcaccacagacatttccgagatgggcgccaattttaaagctgaacgggttatcgatccgagacgctgtatgaagcccgtgattctgaccgacggggaggaacgggtgatcctcgccggccctatgcccgtcacgcactctagcgcggctcaaagacgcggacggattggcagaaaccctaaaaatgagaacgaccagtacatctacatgggggagcccctggaaaatgatgaggactgcgcccattggaaggaagccaaaatgcttctggataacatcaatacaccggagggaattatcccttccatgttcgaacccgagcgcgagaaggtggacgctattgatggcgaatatagactcagaggggaagcccgcaagacctttgttgacctgatgagacggggagatctgcctgtgtggctcgcgtaccgcgtcgccgctgaaggcatcaactatgccgacagacggtggtgtttcgatgggattaaaaataaccagatccttgaggaaaatgtggaggttgagatttggacaaaggaaggcgagcgcaagaagctgaaaccccgctggctggacgctcggatctactctgatcctctcgccctgaaggagttcaaggagtttgctgccggaagaaaaagccttaccctgaacctcatcacggagatgggccgcctgcccaccttcatgacacagaaggcgcgggacgccctggataacctcgctgtgcttcacaccgccgaagctgggggacgggcctataatcatgccctgtccgagctgccggaaacactcgagaccctgcttctgctcacactgctggctaccgtcacgggcgggatttttctcttccttatgagcggacggggcatcggcaaaatgacactggggatgtgctgcattatcaccgcgtctattctgctctggtacgcccaaatccagcctcactggatcgctgcctccattatcctggaatttttccttattgtgctgctcatccccgagcccgagaagcagcgcacccctcaggacaaccaactgacatatgtcgtgattgccatcctgaccgttgtggctgccacaatggcgaatgaaatgggatttctcgagaaaacgaagaaggaccttggcctggggagcatcaccacacagcagccggaatccaacattctggatatcgacctcagacccgcctctgcttggaccctgtacgccgtggctacaaccttcgtcacgcctatgcttcggcacagcattgaaaattcctctgttaacgtgagcctgaccgccatcgcgaatcaggccacagtgctcatgggactgggcaaagggtggcccctgtccaagatggatattggagtccctctccttgctatcggctgttacagccaagtgaaccccattaccctgacagccgctctgtttctcctggttgcccattatgctatcatcggccctgggcttcaggccaaagcgacccgcgaagcccagaagagagctgccgctggaattatgaaaaatccgacggtggacggcatcacagtcattgatctggaccccatcccttacgatcccaagttcgagaagcagctcgggcaagtgatgctgctggtcctctgcgtgacccaggttcttatgatgcggacaacctgggccctgtgtgaggccctgaccctcgcgacaggacctatttctacgctgtgggaaggcaaccccgggcgcttttggaataccacaatcgctgtgtccatggccaacatcttcagaggaagctatcttgctggcgccggcctgctcttttctattatgaaaaataccacaaacacccggcgcgggacgggaaatatcggcgagacactgggggaaaagtggaaatccagactgaacgccctcggaaagagcgagttccagatttacaaaaagtctggcatccaagaagtcgaccggacccttgctaaagaggggattaagagaggagagaccgatcaccatgccgtgagccgcggctccgcgaagctgcggtggttcgttgaaagaaatatggtgacaccggagggcaaagtcgtggacctggggtgcggacgcggcgggtggtcttattactgtggaggcctcaagaacgtgcgggaagttaaagggctgaccaagggaggccctggccacgaggagcccatccccatgagcacatatgggtggaaccttgtcagactgcagtccggagtggatgtgtttttcacgcctcccgaaaaatgcgacaccctcctgtgtgatatcggcgagagctcccctaatccgacagtcgaagccgggcgcaccctgcgggttctcaaccttgtggagaattggctgaacaataacacacagttttgcattaaggtgctgaatccctacatgccttctgtcatcgaaaagatggaggctctccagagaaaatacggaggcgccctggtgcgcaacccccttagcagaaattccacccatgagatgtattgggtttctaacgctagcgggaatattgtgtcctctgtcaacatgatcagcagaatgctgattaatcgcttcacgatgcggcacaagaaagccacctacgaacctgacgtggacctcggatccggcacaagaaacatcggcatcgagagcgaaattcccaatctggatatcattgggaagcgcatcgagaaaattaagcaagaatatgagacctcttggcactacgaccaggatcatccgtataagacatgggcgtaccacggatcctatgagaccaaacagacaggcagcgcctcttccatggttaacggggtggtcagactgctcaccaagccttgggacgtggtgcccatggtcacgcagatggctatgacagataccaccccttttggacaacagcgggttttcaaagaaaaggtggacacacgcacgcaggagcccaaagaaggcaccaagaaacttatgaaaatcacagccgagtggctgtggaaggaactggggaaaaagaaaacccctagaatgtgtacacgggaggagtttaccagaaaggtgcggagcaacgctgccctcggagctattttcacagatgaaaataaatggaagtctgcccgcgaggcggtcgaagactccagattttgggagctggtggataaggagcggaaccttcatctggaaggcaaatgcgagacctgtgtttacaatatgatgggcaagcgcgagaaaaagctcggggagttcggaaaagccaagggcagcagagctatctggtacatgtggctgggggcccggtttctggagttcgaggctctcggatttctgaacgaggaccactggttctcccgcgaaaatagcctttctggcgtggagggggaaggcctgcacaagctcggatatatcctgagagatgtcagcaaaaaggagggcggggccatgtacgccgacgacacggcgggatgggatacccggattacacttgaagacctgaaaaacgaggagatggtgaccaatcatatggaaggcgagcacaagaaactcgctgaagccatcttcaagctgacatatcagaacaaggttgtgcgcgtccaaagacccaccccgcgggggacggtgatggatattatctcccgcagagaccagcggggatctggccaggttgggacatacggcctgaatacctttacaaacatggaggcccaactcattcgccagatggaaggagagggcgtgttcaaaaatatccagcatctgaccgtcacggaggaaatcgctgtgcagaactggcttgccagagtcgggcgggagagactgagccgcatggctatttccggagatgactgcgtggttaagcctctcgatgaccggtttgcctctgcgctgaccgcccttaatgatatgggcaaagtgagaaaggacatccaacagtgggaacccagccgcgggtggaacgattggacacaggtccccttctgctcccaccattttcacgagctgattatgaaagacggacgggtgctcgtggttccttgtagaaatcaggatgagctgatcggccgcgctcggatttctcaaggggccggctggagcctgagagaaaccgcttgcctcggaaagtcctatgcccagatgtggagcctgatgtacttccaccgccgggaccttagactggcggccaacgctatctgttctgccgtgccgtcccattgggtccccacaagccgcaccacatggtctatccacgctaagcatgagtggatgaccacggaagacatgctcacagtgtggaaccgggtttggattcaggagaatccttggatggaagataaaacccccgtggagtcctgggaggaaatcccttatctgggcaagagagaggaccagtggtgcgggagccttattggactgacctcccgggccacatgggctaaaaacatccaaaccgccattaatcaggtcagatctctcatcggcaacgaagagtacacagattacatgcccagcatgaagcgctttcggagagaagaggaggaagcgggggtgctgtggtga

SEQ ID NO: 19569 - RNA, 9876 nt, synthetic construct
  misc_feature 1..9876: note = derived and/or modified CDS sequence (opt5) from DENV-2__KF704354__SS-prME
  source 1..9876: mol_type = other RNA
accgccggcatgatcattatgctgatccccacagtgatggctttccacctcacgaccagaaacggggagcctcatatgattgtgagccggcaggaaaagggaaagtccctgctttttaagacagaggacggcgttaatatgtgcaccctgatggccatggatctcggggaactgtgtgaggacacaatcacctacaagtgcccgttccttagacaaaacgaacccgaggatattgactgttggtgcaattctacaagcacctgggtgacgtatggaacctgtacaaccacaggcgagcacagacgggaaaagcgctccgtggcgctggtccctcatgtggggatgggactcgagaccagaacggaaacatggatgtctagcgagggcgcttggaagcacgcccagcggatcgagacctggatcctgcgccatcccggctttacaattatggccgctatcctggcctacaccattgggaccacacacttccagagagctctcatctttattctgcttacggccgttgcgccttccatgaccatgcggtgcatcggaatttctaaccgcgatttcgtggaaggcgtcagcgggggatcctgggtggacatcgttctggagcacggcagctgtgtgacaaccatggccaagaataagcccacactcgattttgaactgatcaaaaccgaggctaagcagcctgccacgcttagaaaatattgcattgaagctaagctgacaaacaccaccacagagtctcggtgtccgacccaaggggagccctccctcaatgaagaacaggacaaacgcttcgtctgcaagcatagcatggtggatagaggatggggcaacggctgtgggctgtttggaaagggcgggatcgtgacatgcgccatgttcacgtgcaaaaagattatgaaaggaaaggtcgttcagcctgaaaatctggagtacaccatcgtgattacaccccactctggcgaagaacatgcggtggggaacgacaccggaaaacacggcaaggagatcaaaatcacacctcagtccagcattaccgaagccgagctcacgggctatgggaccgtcacaatggaatgttctccccggaccggactggattttaatgagatggtgcttctgcaaatggaaaacaaggcttggctcgttcaccgccagtggttcctggaccttccgctgccttggctccccggcgccgatacacaggggtccaattggatccagaaggagaccctggtgacgtttaaaaaccctcatgctaagaaacaagacgtcgtggttctgggaagccaggagggcgccatgcacacagccctcaccggggctacagaaattcagatgtcctctggcaatgtgctgttcaccggacatcttaagtgcagactgcggatggacaaactccaactgaagggcatgagctactccatgtgtaccgggaagttcaaagtcgtgaaggagatcgcggaaacacagcacggaacgattgtcatcagagtgcagtatgagggcgatgggagcccctgcaaaatcccctttgagattatggaccttgaaaagcgccatgttctgggacggctcatcaccgtgaaccctattgtcacaggcaaagattctccggtgaacatcgaggccgaaccccctttcggggactcctacattatcattggcgttgagcccggacagctgaagctgaattggtttaagaaaggcagctctatcgggcaaatgttcgctaccacaatgagaggagccaagcgcatggccatcctcggcgataccgcttgggactttgggagcctgggaggcgtgttcacgtccattgggaaagcccttcaccaggtctttggcgcgatctacggagctgccttctctggcgtgagctggacaatgaagattctgatcggggtgattatcacctggatcggaatgaactcccggagcacctctctctccgttagcctggtcctggtgggcgtggtcacactttatctcggggtgatggttcaggccgattctggatgtgtggtctcctggaaaaataaggaactgaagtgcggcagcgggatttttatcaccgacaacgtgcacacatggacggagcagtacaaattccaacctgagtccccctctaagctggctagcgccattcagaaagctcatgaagagggcatctgtggaattagatccgttacccgcctcgaaaatctgatgtggaagcagatcacaccggagcttaaccacatcctgtctgaaaatgaggtgaaactcaccattatgacaggcgatatcaaggggattatgcaggccggaaaacggagcctgagacctcaacccaccgagctgaagtattcctggaagacgtggggcaaagcgaagatgcttagcaccgaatctcataaccagacatttctcatcgacgggcctgagaccgccgaatgccccaatacaaaccgcgcttggaactccctggaggtcgaagattacggattcggcgtgtttaccacaaacatttggctgaaactccgggaggagcaggacgttttctgtgacagcaagctgatgtctgccgctatcaaagataatagagccgtgcacgcggacatgggctattggatcgaatccgcccttaacgatacctggaagattgagaaggctagcttcatcgaagtcaaatcttgccactggcctaagagccatacgctgtggtccaatggggtgctcgagagcgagatgattatccccaaaaactttgccggaccggtgtctcagcacaactaccgccctggctatcatacacaaaccgctgggccctggcacctgggaaagctggaaatggacttcgatttttgtgagggcaccacagtcgttgtgaccgaagactgcgggaatcggggaccctcccttagaacgacaaccgccagcggcaaactcattacagagtggtgctgtcggtcctgcaccctgcctccgctgcgctacagaggcgaagatgggtgttggtacggaatggagatccggcccctcaaggagaaggaagagaacctggtcaattctcttgtcacagccggccatgggcagattgacaacttcagcctgggagtgctcggcatggctctgtttctggaagagatgcttagaacccgcgttgggacgaaacacgcgatcctcctggtggccgtctccttcgtgaccctgatcacaggaaatatgtcttttcgggatctcggcagagttatggtgatggtcggcgctaccatgacagacgatattgggatgggagtgacctatctggcccttctggccgctttcaaggttcgccctacgtttgccgcgggcctcctgctgagaaaacttacaagcaaggaactgatgatgaccacaatcgggattgtgctcctgtcccagtctaccatccccgagaccattctcgagctgacagacgctcttgccctgggaatgatggtcctcaaaatggtgcggaagatggaaaagtaccaactggccgtgacgatcatggctatcctgtgcgtccctaacgccgttattcttcagaatacctggaaagtgagctgtacaatcctggcggtggtctccgtgagccccctcttcctgacctcttcccagcagaaggctgattggattcctctcgccctgacaatcaaaggccttaaccccaccgccatttttctgacgacactcagccgcaccaataagaaaagatcttggccgctgaacgaggctatcatggccgttgggatggtgtccatcctggctagctctcttctgaagaatgacattcctatgaccggacccctcgtcgccggcggcctgctcacagtgtgctatgttctgaccgggcggtccgcggaccttgaactggagcgcgccgctgatgtgaaatgggaagaccaagccgagatcagcggatccagccctattctgtctatcacaattagcgaggatggctccatgtctatcaagaacgaagaggaggaacagacgctcaccattctgatcagaacagggcttctggtcatcagcggactcttccccgtgtccattccgatcaccgctgccgcctggtacctgtgggaggtcaagaaacagcgggctggcgtgctctgggacgttccttctccccctcccgtggggaaggcggaactggaggatggagcctatcgcattaaacagaagggcatccttggctacagccaaattggggctggagtctataaagaaggcacatttcacaccatgtggcatgtgacgagaggggccgttctgatgcacaagggaaagcggatcgagccctcctgggccgacgtgaaaaaggatctgatctcttacggcgggggatggcgcctcgaaggcgagtggaaagagggcgaagaggtccaggtgctggctcttgaacctgggaagaatccgagagccgtgcagaccaaacccggactgttcaagacaaacgcgggcaccattggggctgttagcctcgacttctcccctggaacaagcggctctcccatcattgataagaaagggaaggtcgtgggactgtacggcaatggcgtggtcacccggtccggggcctatgtgagcgccatcgctcagacagagaaatctattgaagacaaccctgagatcgaggatgacatctttagaaagcgcaaactcacgattatggatctgcatcccggagccggcaagaccaagcggtaccttcctgcgatcgttagagaagctattaaacgcgggctgcggacactgatcctcgccccgaccagagtggtcgccgctgagatggaagaggccctgcgcggacttcccattcggtatcaaacccctgctatcagagccgaacacacaggccgcgagattgtggacctgatgtgtcatgcgacgttcaccatgcggctcctgtcccccgttagagtgcctaactacaatctcatcatcatggacgaggcccactttacagatcccgctagcattgccgctcgggggtatatctccacccgcgtcgaaatgggcgaggccgccggaattttcatgacagctaccccgcctggctctagagacccctttccccagagcaacgcgcctatcatggatgaggaacgggagattcccgaacgctcctggagctctgggcacgagtgggtgacggacttcaagggaaaaacagtttggtttgtgccttccatcaaggccggcaatgatatcgctgcctgcctgcgcaagaatgggaagaaggtcattcagcttagccggaaaaccttcgactctgaatacgtgaagaccagaacaaatgattgggactttgtggtcaccacagatatcagcgagatgggagccaacttcaaagctgaacgcgttattgacccgcggagatgtatgaagcccgtgatcctgaccgatggcgaggagcgcgtgattctggccgggcctatgcccgtcacgcattcctctgcggctcaacggagaggccgcatcggacggaatcctaaaaacgaaaatgaccagtatatctacatgggcgagcccctcgaaaacgacgaggattgcgcccactggaaggaagccaaaatgctgcttgacaatattaacacaccggaggggatcattcctagcatgtttgagcccgaaagagagaaggtggatgctatcgacggagaataccgcctgagaggcgaggcccggaagaccttcgttgatctcatgcgcagaggggacctgcctgtgtggctggcgtatcgggtcgccgctgaaggaattaattacgccgatcgcagatggtgtttcgacggcatcaaaaacaatcagattctcgaggagaacgtggaagttgagatctggacaaaggaaggggagcggaagaaacttaaacccagatggctggatgctcgcatctattccgaccctctggccctcaaagagtttaaggagttcgctgccggccggaaatctctgacccttaacctgattacggagatgggaagactccccacctttatgacacagaaggcgcgcgatgccctggacaatctggctgtgctccataccgccgaagctggcgggcgggcctacaaccacgcccttagcgagctgccggaaacactggagaccctcctgcttctgacactcctggctaccgtcacgggaggcatcttcctgtttctcatgtccgggagaggaattggcaaaatgacacttggcatgtgctgcatcattaccgcgagcatcctgctgtggtatgcccaaatccagcctcactggattgctgcctctatcattctcgagttctttctgatcgtgcttctgattcccgaacccgagaagcagcggacccctcaggataatcaactcacatacgtcgtgatcgccatcctgaccgttgtggctgccacaatggcgaacgaaatggggttcctggagaaaacgaagaaggacctcggatggggctccattaccacacagcagccggaaagcaatatccttgacattgatctgcgccccgcctccgcttggaccctgtatgccgtggctacaacctttgtcacgcctatgctcagacattctatcgagaacagctccgttaatgtgtctctgaccgccattgcgaaccaggccacagtgcttatggggctgggaaaaggctggcccctcagcaagatggacatcggggtccctctgctggctattggatgttactcccaagtgaatcccatcaccctcacagccgctcttttcctgctggttgcccactacgctatcattggccctggcctccaggccaaagcgacccgggaggcccagaagcgcgctgccgctgggatcatgaaaaacccgacggtggatggaattacagtcatcgacctggatcccattccttatgaccccaagtttgaaaagcagcttggccaagtgatgctgctcgtcctgtgcgtgacccaggttctgatgatgagaacaacctgggccctctgtgaggcccttaccctggcgacagggcctatcagcacgctgtgggaaggaaatcccggccggttctggaacaccacaatcgctgtgtctatggccaatatttttcgcgggtcctacctcgctggagccggcctgcttttcagcatcatgaaaaacaccacaaataccagacggggcacggggaacatgggagagacactgggcgaaaagtggaaatctcgcctcaatgccctggggaagtccgagttccagatttataaaaagagcggaatccaagaggtcgatagaaccctggctaaagaaggcattaagagaggggaaaccgaccatcacgccgtgtctagaggaagcgcgaagctccgctggtttgttgaacggaacatggtgacaccggagggcaaagtcgtggatcttggctgcgggagaggaggctggtcctactattgtgggggactgaagaacgtgcgcgaggttaaaggcctgaccaaagggggacctggccatgaggagcccatccccatgtctacatacggctggaatctcgtccggctgcagagcggggtggacgtgttctttacgcctcccgaaaaatgcgatacccttctgtgtgacatcggagagtccagccctaacccgacagtcgaagccggcagaaccctccgcgttctgaatctggtggagaactggctcaataacaatacacagttctgcattaaggtgcttaacccctatatgccttccgtcatcgagaagatggaagctctgcagcggaaatacgggggagccctggtgagaaatcccctctctcgcaacagcacccacgagatgtactgggtttccaatgcttctggcaacattgtgagctccgtcaatatgatctctcggatgctgattaacagatttacgatgcgccacaagaaagccaccttcgaacctgatgtggaccttgggagcggaacacggaatatcggcatcgagtccgaaattcccaacctggacatcattggcaagagaatcgagaaaattaagcaagagtatgaaaccagctggcattacgatcaggaccacccgtataagacatgggcgtaccatgggtcttatgagaccaaacagacaggatccgccagctctatggttaacggcgtggtccgcctcctgaccaagccttgggatgtggtgcccatggtcacgcagatggctatgacagacaccaccccttttgggcaacagagagttttcaaagaaaaggtggatacacggacgcaggagcccaaagaaggaaccaagaagctgatgaaaatcacagccgagtggctctggaaggagcttggcaaaaagaaaacccctcgcatgtgtacaagagaagagtttacccggaaggtgagatccaatgctgccctgggggctattttcacagacgaaaacaaatggaaaagcgcccgggaggcggtcgaggattctcgcttttgggaactggtggacaaggagagaaatctccacctggaaggaaaatgcgagacctgtgtttacaacatgatgggcaagcgggagaagaaacttggcgagttcgggaaagccaagggatcccgcgctatctggtatatgtggctgggcgccagatttctcgagttcgaagctctggggttcctgaatgaggatcactggtttagccgggaaaactccctcagcggagtggagggcgaagggctgcataaacttggctacatcctgcgcgacgtctctaaaaaggagggaggcgccatgtacgccgatgacacggcggggtgggacaccagaattacactcgaggatctgaaaaatgaagagatggtgaccaaccacatggaaggagagcataagaaacttgctgaagccatcttcaagctgacatatcagaataaggttgtgcgggtccaacgccccaccccgagaggcacggtgatggacattatcagccggcgcgatcagagagggtccggacaggttggcacatacgggctcaacacctttacaaatatggaggcccaactgattcggcagatggagggcgaaggagtgttcaaaaacatccagcacctgaccgtcacggaggaaatcgctgtgcagaattggctcgcccgcgtcggcagagagcggctgtctagaatggctattagcggggacgattgcgtggttaagcctcttgacgatcgctttgcctccgcgctgaccgccctcaacgacatgggaaaagtgcggaaggatatccaacagtgggagccctctagaggctggaatgactggacacaggtccccttctgcagccatcactttcacgaactgattatgaaagatgggcgcgtgcttgtggttccttgtcggaaccaggacgagctgatcggacgggctcgcatttcccaaggcgccgggtggtctctccgggaaaccgcttgcctgggcaagagctatgcccagatgtggtccctgatgtacttccatagacgcgatctccggctggcggccaacgctatctgtagcgccgtgccgtctcactgggtccccacatccagaaccacatggagcatccatgctaagcacgagtggatgaccacggaagacatgcttacagtgtggaatcgcgtttggattcaggagaacccttggatggaggacaaaacccccgtggaatcttgggaggaaatcccttatctgggaaagcgggaggatcagtggtgcggctccctcattgggctgaccagcagagccacatgggctaaaaatatccaaaccgccattaaccaggtccggtcccttatcggaaatgaagagtacacagactatatgccctctatgaagagatttcgccgggaggaagaggaagcgggcgtgctgtggtga

SEQ ID NO: 19570 - RNA, 9876 nt, synthetic construct
  misc_feature 1..9876: note = derived and/or modified CDS sequence (opt5) from DENV-2__KF704357__SS-prME
  source 1..9876: mol_type = other RNA
accgccggcatgatcattatgctgatccccacagtgatggctttccacctcacgacccggaacggggagcctcatatgattgtcagccggcaggaaaagggaaaatccctgctttttaagacaggcgacggggttaatatgtgcaccctgatggccatggatctcggagagctgtgtgaagacacaatcacctacaaatgcccgcttctgcgccaaaacgagcccgaagatattgactgttggtgcaattctacaagcacctgggtgacgtatggcacctgtacaaccacaggggagcaccggcgggagaagcgctccgtggcgctcgtccctcatgtgggaatgggcctggaaaccagaacggagacatggatgtctagcgaaggcgcttggaaacacgcccagcggatcgagacctggatcctgcgccatcccgggttcacaattatggccgctatcctcgcctacaccattggaaccacacactttcagagagctctgatcttcattcttctgacggccgttgcgccttccatgaccatgcggtgcatcggcatttctaaccgcgattttgtggagggggtcagcggaggctcctgggtggacatcgttctcgaacacgggagctgtgtgacaaccatggccaagaataagcccacactggatcttgagctgatcaaaaccgaagctaagcagcctgccacgctcagaaaatattgcattgaggctaagctgacaaacaccaccacagaatctcggtgtccgacccaaggagagccctccctgaatgaggaacaggacaaacgcttcgtctgcaagcatagcatggtggatagaggctggggcaacgggtgtggactctttggcaaggggtctatcgtgacatgcgccatgttcacgtgcaaaaagattatgaaaggaaaggtcgttcagcctgagaatctggaatacaccatcgtgattacaccccactccggcgaggaacatgcggtggggaacgacaccggaaaacacggcaaggagatcaaaatcacacctcagagctctattaccgaggccgaacttacgggctatgggaccgtcacaatggagtgtagcccccggaccggactggattttaatgaaatggtgctcctgcaaatggaggacaaggcttggcttgttcaccgccagtggttcctggatctcccgctgccttggctgcccggcgccgacacacaggggagcaactggatccagaaggaaaccctcgtgacgtttaaaaatcctcatgctaagaaacaagacgtcgtggttctgggatcccaggagggcgccatgcacacagcccttaccggggctacagagattcagatgtctagcggcaacgtgctgttcaccggacatctcaagtgcagactgcggatggataaacttcaactgaagggcatgtcctacagcatgtgtaccgggaagtttaaagtcgtgaaggaaatcgcggagacacagcacggaacgattgtcatcagagtgcagtatgaaggcgacgggtctccctgcaaaatccccttcgagattatggatctcgagaagcgccatgttctgggacggctgatcaccgtgaatcctattgtcacaggcaaagactccccggtgaacatcgaagccgagccccctttcggggatagctacattatcattggcgttgaacccggacagctcaagctgaactggtttaagaaaggctctagcatcgggcaaatgttcgctaccacaatgagaggagccaagcgcatggccatccttggcgacaccgcttgggattttgggtccctgggaggcgtgttcacgtctattgggaaagccctccaccaggtctttggcgcgatctacggagctgccttcagcggcgtgtcctggacaatgaagattctgatcggggtgattatcacctggatcggaatgaatagccggtctacctccctgagcgtttctcttgtcctcgtgggcgtggtcacactgtatctgggggtgatggttcaggccgactccggatgtgtggtcagctggaaaaacaaggagctcaagtgcggctccgggatttttatcaccgataatgtgcacacatggacggaacagtacaaattccaacctgagtctcccagcaagctggcttccgccattcagaaagctcatgaggaaggcatctgtggaattagatctgttacccgccttgagaacctgatgtggaagcagatcacaccggaactcaatcacatcctgagcgagaacgaagtgaaactgaccattatgacaggcgacatcaaggggattatgcaggccggaaaacggtcccttagacctcaacccaccgagctcaagtatagctggaagacgtggggcaaagcgaagatgctgtctaccgagtcccataatcagacatttctgatcgatgggcctgaaaccgccgagtgccccaacacaaatcgcgcttggaacagcctcgaagtcgaggactacggattcggcgtgtttaccacaaatatttggctgaaacttcgggaagaacaggacgttttctgtgattctaagctgatgtccgccgctatcaaagacaacagagccgtgcacgcggatatgggctattggatcgagagcgccctcaatgacacctggaagattgaaaaggcttcttttatcgaggtcaaaagctgccactggcctaagtcccatacgctgtggagcaacggggtgctggaatctgagatgattatccccaaaaatttcgccggaccggtgtcccagcacaactaccgccctggctatcatacacaaaccgctgggccctggcaccttggaaagctcgagatggatttcgacttttgtgaaggcaccacagtcgttgtgaccgaggattgcgggaaccggggacccagcctgagaacgacaaccgcctccggcaaactgattacagaatggtgctgtcggtcttgcaccctccctccgctgcgctacagaggcgaggacgggtgttggtacggaatggaaatccggccccttaaggagaaggaggaaaatctggtgaacagcctcgtcacagccggccatgggcagattgataatttctccctgggagtgctgggcatggctctttttctcgaggaaatgctgagaacccgcgttgggacgaaacacgcgatcctgctcgtggccgtctctttcgtgaccctgatcacaggaaacatgagctttcgggaccttggcagagttatggtgatggtcggcgctaccatgacagatgacattgggatgggagtgacctatctggccctcctggccgctttcaaggttcgccctacgtttgccgcgggcctgcttctgagaaaactcacatccaaggagctgatgatgaccacaatcgggattgtgctcctgtctcagagcaccatccccgaaaccattcttgagctgacagatgctctcgccctgggaatgatggtcctgaaaatggtgcggaagatggagaagtaccaacttgccgtgacgatcatggctatcctgtgcgtccctaatgccgttattctccagaacacctggaaagtgtcctgtacaatcctggcggtggtcagcgtgtctcccctcttcctgacctccagccagcagaaggctgactggattcctcttgccctgacaatcaaaggcctcaatcccaccgccatttttctgacgacactgtctcgcaccaacaagaaaagatcctggccgcttaatgaagctatcatggccgttgggatggtgagcatcctggcttcttccctcctgaagaacgacattcctatgaccggacccctcgtcgccggcggcctgcttacagtgtgctatgttctgaccgggcggagcgcggatctggagctcgaacgcgccgctgacgtgaaatgggaggatcaagccgaaatctccggaagctctcctattctgagcatcacaatttccgaggacggctctatgagcatcaagaatgaggaagaggaacagacgcttaccattctgatcagaacagggctcctggtcatctccggactcttccccgtgtctattccgatcaccgctgccgcctggtacctgtgggaggtcaagaaacagcgggctggcgtgctttgggatgttccttctccccctcccgtggggaaggcggagctggaagacggagcctatcgcattaaacagaagggcatcctgggctactcccaaattggggctggagtctataaagagggcacatttcacaccatgtggcatgtgacgagaggggccgttctcatgcacaagggaaagcggatcgaaccctcctgggccgatgtgaaaaaggacctgatcagctacggcgggggatggaaacttgagggcgaatggaaggagggcgaggaagtccaggtgctggctctcgagcctgggaaaaacccgcgcgccgtgcagaccaagcccggactgttcaagacaaatgcgggcaccattggggctgtttccctcgattttagccctggaacatctggctcccccatcattgacagaaaagggaaggtcgtgggactgtacggcaacggcgtggtcacccggagcggggcctatgtgtctgccatcgctcagacagaaaaatccattgaggataatcctgaaatcgaggacgatatcttcagaaagcgcaaacttacgattatggacctgcatcccggagccggcaagaccaagcggtacctgcctgcgatcgttagagaggctattaaacgcgggctccggacactgatccttgccccgaccagagtggtcgccgctgaaatggaggaagccctgcgcggactccccattcggtatcaaacccctgctatcagagccgagcacacaggccgcgaaattgtggacctgatgtgtcatgcgacgttcaccatgcggctcctgagccccgttagagtgcctaactacaaccttatcatcatggatgaggcccactttacagaccccgcttccattgccgctcgggggtatatctctacccgcgtcgagatgggcgaagccgccggaattttcatgacagctaccccgcctggcagcagagatccctttccccagtccaatgcgcctatcatggacgaggaacgggagattcccgagcgcagctggtcttccgggcacgaatgggtgacggatttcaagggaaaaacagtttggtttgtgcctagcatcagagccggcaacgacatcgctgcctgcctgcggaagaatgggaaaaaggtcattcagctgtctagaaagaccttcgatagcgagtacgtgaaaacccgcacaaacgactgggattttgtggtcaccacagacatctccgaaatgggagccaatttcaaggctgagcgggttattgatccgagacgctgtatgaaacccgtgatcctcaccgacggcgaggaacgggtgattctggccgggcctatgcccgtcacgcattctagcgcggctcaaagacgcggccggatcggaagaaaccctaagaatgagaacgaccagtatatctacatgggcgaaccccttgagaatgatgaagactgcgcccactggaaagaggccaagatgctgctcgataacattaatacaccggaagggatcattccttccatgtttgagcccgagcgcgaaaaagtggacgctatcgatggagagtacagactgcggggcgaagcccgcaagaccttcgttgacctgatgagaagaggggatctccctgtgtggcttgcgtatcgcgtcgccgctgagggaattaactacgccgacagacggtggtgttttgatggcatcaagaataaccagattctggaagagaatgtggaggttgaaatctggacaaaagagggggaaagaaagaaactgaagccccgctggctcgacgctcggatctattctgatcctctggcccttaaagagttcaaggagttcgctgccggcagaaagagcctgaccctcaacctgattacggaaatgggacgcctgcccacctttatgacacagaaagcgcgggacgccctcgataaccttgctgtgctgcataccgccgaggctggcgggagagcctacaatcacgccctgtccgaactcccggagacactggaaacccttctgctcctgacactgctcgctaccgtcacgggaggcatcttcctttttctgatgagcgggcggggaattggcaagatgacactgggcatgtgctgcatcattaccgcgtctatcctcctgtggtatgcccaaatccagcctcactggattgctgcctccatcattcttgagttctttctgatcgtgctcctgattcccgagcccgaaaaacagcgcacccctcaggacaaccaactgacatacgtcgtgatcgccatcctcaccgttgtggctgccacaatggcgaatgagatggggttccttgaaaagacgaaaaaggacctgggactgggcagcattaccacacagcagccggagtccaacatcctcgatattgacctgagacccgcctctgcttggaccctttatgccgtggctacaacctttgtcacgcctatgctgcggcatagcatcgaaaattcctctgttaacgtgagcctcaccgccattgcgaatcaggccacagtgctgatggggctgggaaagggctggcccctctccaaaatggatatcggggtccctcttctggctattggatgttacagccaagtgaaccccatcaccctgacagccgctctcttcctgcttgttgcccactacgctatcattggccctggcctgcaggccaaggcgacccgcgaggcccagaaaagagctgccgctgggatcatgaagaatccgacggtggacggaattacagtcatcgatctcgaccccattccttatgatcccaaatttgagaagcagctgggccaagtgatgctgctcgtcctttgcgtgacccaggttctgatgatgcggacaacctgggccctgtgtgaagccctcaccctggcgacagggcctatctctacgctttgggagggaaaccccggccgcttctggaataccacaatcgctgtgtccatggccaacatttttagagggagctacctggctggagccggcctcctgttctctatcatgaagaataccacaaacacccggcgcggcacggggaatatgggagaaacactgggcgagaaatggaagtccagactcaacgcccttgggaaaagcgaatttcagatttataagaaatctggaatccaagaggtcgaccggaccctggctaaggagggcattaaaagaggggaaaccgatcatcacgccgtgagccgcggatccgcgaagctgcggtggttcgttgagagaaatatggtgacaccggaaggcaaggtcgtggacctcggctgcgggcgcggaggctggtcttactattgtgggggactgaaaaacgtgcgggaggttaagggccttaccaaagggggacctggccatgaggaacccatccccatgagcacatacggctggaacctggtcagactccagtccggggtggatgtgttctttacgcctcccgagaagtgcgacaccctgctgtgtgatatcggagaaagctcccctaatccgacagtcgaggccggccgcaccctccgggttcttaacctggtggaaaattggctgaacaataacacacagttctgcattaaagtgctcaatccctatatgccttctgtcatcgagaagatggaggctctgcagagaaagtacgggggagcccttgtgcgcaaccccctgagcagaaattccacccacgaaatgtactgggtttctaacgctagcggcaatattgtgtcctctgtcaacatgatcagcagaatgctcattaatcgctttacgatgcggcacaaaaaggccaccttcgagcctgacgtggacctggggtccggaacaagaaacatcggcatcgaaagcgagattcccaatctggatatcattggcaaacgcatcgaaaagattaaacaagagtatgagacctcttggcattacgaccaggatcacccgtataagacatgggcgtaccatgggtcctatgaaaccaagcagacaggaagcgcctcttccatggttaacggcgtggtcagactccttaccaaaccttgggacgtggtgcccatggtcacgcagatggctatgacagataccaccccttttgggcaacagcgggttttcaaggagaaagtggacacacgcacgcaggaacccaaggagggaaccaaaaagctgatgaagatcacagccgaatggctgtggaaagagctcggcaagaaaaagacccctagaatgtgtacacgggaggaatttaccagaaaagtgcggagcaacgctgccctgggggctattttcacagatgagaataagtggaaatctgcccgcgaagcggtcgaggactccagattttgggagcttgtggataaggaacggaacctgcacctcgagggaaagtgcgaaacctgtgtttacaatatgatgggcaaacgcgagaagaaactgggcgagttcgggaaggccaaaggaagcagagctatctggtatatgtggctgggcgcccggtttctcgagttcgaggctctggggtttcttaacgaagaccactggttctcccgcgagaatagcctgtctggagtggaaggcgaggggctccataagctgggctacatccttagagatgtcagcaagaaagaaggaggcgccatgtacgccgacgacacggcggggtgggatacccggattacactggaggacctcaagaacgaggaaatggtgaccaatcacatggagggagaacataaaaagctggctgaggccatcttcaaactgacatatcagaacaaggttgtgcgcgtccaaagacccaccccgcggggcacggtgatggatattatctcccgcagagaccagcgggggtctggacaggttggcacatacgggctcaatacctttacaaacatggaagcccaactgattcgccagatggagggcgagggagtgttcaagaatatccagcaccttaccgtcacggaagagatcgctgtgcagaactggctggccagagtcggccgggaaagactcagccgcatggctatttccggggatgactgcgtggttaaacctctggatgaccggtttgcctctgcgcttaccgccctgaatgatatgggaaaggtgagaaaagacatccaacagtgggagcccagccgcggctggaacgattggacacaggtccccttctgctcccatcactttcacgagctcattatgaaggacgggcgggtgctggtggttccttgtagaaatcaggatgaactgatcggacgcgctcggatttctcaaggcgccgggtggagcctcagagagaccgcttgcctgggcaaatcctatgcccagatgtggagccttatgtacttccatcgccgggacctgagactcgcggccaacgctatctgttctgccgtgccgtcccactgggtccccacaagccgcaccacatggtctatccatgctaagcacgaatggatgaccacggaggacatgctgacagtgtggaaccgggtttggattcaggaaaatccttggatggaggataagacccccgtggagtcctgggaagagatcccttatcttggaaaaagagaagaccagtggtgcggcagcctgattgggctcacctcccgggccacatgggctaagaacatccaaaccgccattaatcaggtcagatctctgatcggaaacgaggaatacacagattatatgcccagcatgaaacgctttcggagagaggaggaagaggcgggcgtgctgtggtga

SEQ ID NO: 19571 - RNA, 9876 nt, synthetic construct
  misc_feature 1..9876: note = derived and/or modified CDS sequence (opt5) from DENV-2__KF704358__SS-prME
  source 1..9876: mol_type = other RNA
acagccggaatgatcattatgctgatccccacagtgatggctttccacctcacgaccagaaacggggaacctcatatgattgtcagccggcaggaaaagggaaagtccctgctttttaatacaggcgacggggttcacatgtgcaccctgatggccatgcatctcggagagctgtgtgaagatacaatcacctacaagtgcccgcttctgagacaaaacgagcccgaagacattgattgttggtgcaattctacaagcacctgggtgacgtatggcacctgtacaaccacaggggagcacagacgggagaaacgctccgtggcgctcgtccctcatgtgggaatgggcctggaaaccagaacggagacatggatgtctagcgaaggcgcttggaagcacgcccagcggatcgagacctggatcctgcgccaccccgggttcacaattatggccgctatcctcgcctacaccattggaaccacacattttcagagagctctgatcttcattcttctgacggccgttgcgccttccatgaccatgcggtgcatcggcatttctaaccgcgactttgtggagggggtcagcggaggctcctgggtggatatcgttctcgaacacgggagctgtgtgacaaccatggccaaaaataagcccacactggaccttgagctgatcaagaccgaagctaaacagcctgccacgctcagaaagtattgcattgaggctaaactgacaaacaccaccacagaatctcggtgtccgacccaaggagagccctccctgaatgaggaacaggataagcgcttcgtctgcaaacatagcatggtggacagaggctggggcaacgggtgtggactctttggcaaggggtctatcgtgacatgcgccatgttcacgtgcaagaaaattatgaagggaaaagtcgttcagcctgagaatctggaatacaccatcgtgattacaccccactccggcgaggaacacgcggtggggaacgataccggaaagcatggcaaagagatcaagatcacacctcagagctctattaccgaggccgaacttacgggctatgggaccgtcacaatggagtgtagcccccggaccggactggactttaatgaaatggtgctcctgcaaatggaggataaggcttggcttgttcaccgccagtggttcctggacctcccgctgccttggctgcccggcgccgatacacaggggagcaactggatccagaaggaaaccctcgtgacgtttaagaatcctcatgctaaaaagcaagacgtcgtggttctgggatcccaggagggcgccatgcacacagcccttaccggggctacagagattcagatgtctagcggcaacgtgctgttcaccggacatctcaaatgcagactgcggatggacaaacttcaactgaaaggcatgtcctacagcatgtgtaccgggaagtttaaggtcgtgaaagaaatcgcggagacacagcacggaacgattgtcatcagagtgcagtatgaaggcgatgggtctccctgcaagatccccttcgagattatggacctcgagaaacgccacgttctgggacggctgatcaccgtgaatcctattgtcacaggcaaggattccccggtgaacatcgaagccgagccccctttcggggacagctacattatcattggcgttgaacccggacagctcaaactgaactggtttaagaagggctctagcatcgggcaaatgttcgctaccacaatgagaggagccaaacgcatggccatccttggcgataccgcttgggactttgggtccctgggaggcgtgttcacgtctattgggaaggccctccatcaggtctttggcgcgatctacggagctgccttcagcggcgtgtcctggacaatgaaaattctgaccggggtgatcattacctggatcggaatgaatagccggtctacatccctgagcgtttctcttgtcctcgtgggcgtggtcaccctgtatctgggggtgatggttcaggccgattccggatgtgtggtcagctggaagaacaaagagctcaagtgcggctccgggatctttattacagacaatgtgcacacgtggaccgaacagtacaagttccaacctgagtctcccagcaaactggcttccgccatccagaaggctcatgaggaaggcatttgtggaatcagatctgttacacgccttgagaacctgatgtggaaacagattaccccggaactcaatcacatcctgagcgagaacgaagtgaagctgacaatcatgaccggcgatattaaagggatcatgcaggccggaaagcggtcccttagacctcaacccacggagctcaaatatagctggaagacctggggcaaggcgaaaatgctgtctacagagtcccacaatcagacctttctgattgacgggcctgaaacagccgagtgccccaacaccaatcgcgcttggaacagcctcgaagtcgaggattacggattcggcgtgtttacaaccaatatctggctgaaacttcgggaaaaacaggacgttttctgtgactctaagctgatgtccgccgctattaaagataacagagccgtgcatgcggacatgggctattggatcgagagcgccctcaatgatacgtggaagatcgagaaggcttcttttattgaagtcaaaagctgccactggcctaagtcccatacactgtggagcaacggggtgctggagtctgaaatgatcattcccaaaaatttcgccggaccggtgtcccagcacaactaccgccctggctatcatacccaaaccgctgggccctggcaccttggaaagctcgagatggacttcgatttttgtgagggcacaaccgtcgttgtgacggaagactgcgggaaccggggacccagcctgagaacaaccacagcctccggcaaactgatcaccgagtggtgctgtcggtcttgcacactccctccgctgcgctacagaggcgaagatgggtgttggtacggaatggagattcggccccttaaggaaaaggaggagaatctggtgaacagcctcgtcaccgccggccacgggcagatcgacaatttctccctgggagtgctgggcatggctctttttctcgaagagatgctgagaacgcgcgttgggaccaaacatgcgattctgctcgtggccgtctctttcgtgacactgatcaccggaaacatgagctttcgggatcttggcagagttatggtgatggtcggcgctacaatgaccgacgatatcgggatgggagtgacgtatctggccctcctggccgctttcaaggttcgccctacatttgccgcgggcctgcttctgagaaaactcacctccaaggaactgatgatgacaaccattgggatcgtgctcctgtctcagagcaccattcccgagacaatccttgaactgacggacgctctcgccctgggaatgatggtcctgaaaatggtgcggaagatggagaagtaccaacttgccgtgaccattatggctatcctgtgcgtccctaatgccgttatcctccagaacacatggaaagtgtcctgtaccattctggcggtggtcagcgtgtctcccctcttcctgacatccagccagcagaaggctgattggatccctcttgccctgaccattaaaggcctcaatcccacggccatctttctgacaaccctgtctcgcaccaacaagaaaagatcctggccgcttaatgaggctattatggccgttgggatggtgagcatcctggcttcttccctcctgaagaacgacatccctatgacaggacccctcgtcgccggcggcctgcttaccgtgtgctatgttctgacagggcggagcgcggacctggaactcgagcgcgccgctgatgtgaaatgggaagaccaagccgagatttccggaagctctcctatcctgagcattacgatctccgaagatggctctatgagcattaagaatgaggaggaagaacagacccttacaatcctgattagaaccgggctcctggtcatctccggactcttccccgtgtctatcccgattacagctgccgcctggtacctgtgggaagtcaagaaacagcgggctggcgtgctttgggacgttccttctccccctcccgtggggaaggcggagctggaggatggagcctatcgcatcaaacagaagggcattctgggctactcccaaatcggggctggagtctataaagaaggcacctttcacacgatgtggcatgtgaccagaggggccgttctcatgcacaagggaaagcggattgagccctcctgggccgacgtgaaaaaggatctgatcagctacggcgggggatggaaacttgaaggcgagtggaaggaaggcgaggaggtccaggtgctggctctcgaacctgggaaaaacccgcgcgccgtgcagacaaagcccggactgttcaagaccaatgcgggcacaatcggggctgtttccctcgactttagccctggaacctctggctcccccattatcgataaaaaggggaaagtcgtgggactgtacggcaacggcgtggtcacaagaagcggggcctatgtgtctgccattgctcagacggagaagtccatcgaagacaatcctgagattgaagatgacatcttccggaaaagaaaacttaccatcatggatctgcatcccggagccggcaagacaaaacgctacctgcctgcgattgttcgggaggctatcaagagagggctccgcaccctgattcttgccccgacccgggtggtcgccgctgagatggaagaggccctgagaggactccccatccgctatcaaacccctgctattcgggccgaacacacgggcagagagatcgtggacctgatgtgtcacgcgaccttcacaatgcgcctcctgagccccgttcgggtgcctaactacaaccttattatcatggacgaagcccattttaccgatcccgcttccatcgccgctagagggtatatttctacacgggtcgagatgggcgaggccgccggaatcttcatgaccgctacgccgcctggcagccgcgacccctttccccagtccaatgcgcctattatggatgaagagagagaaatccccgagcggagctggtcttccgggcacgagtgggtgacagacttcaaaggaaagaccgtttggtttgtgcctagcattcgcgccggcaacgatatcgctgcctgcctgcgcaagaatgggaagaaggtcatccagctgtctcggaaaaccttcgacagcgaatacgtgaagacaagaaccaacgattgggactttgtggtcacaaccgatatttccgagatgggagccaatttcaaagctgaacgcgttatcgacccgcggagatgtatgaagcccgtgattctcacggatggcgaggaacgcgtgatcctggccgggcctatgcccgtcacacattctagcgcggctcaacggagaggccgcattggacggaaccctaaaaatgagaacgaccagtatatctacatgggcgagccccttgaaaatgacgaggattgcgcccactggaaggaagccaaaatgctgctcgacaacatcaataccccggaggggattatcccttccatgtttgaacccgagagagagaaggtggatgctattgacggagaataccgcctgagaggcgaggcccggaagacattcgttgatctgatgcgcagaggggacctccctgtgtggcttgcgtatcgggtcgccgctgaaggaatcaactacgccgatcgcagatggtgttttgacggcattaaaaataaccagatcctggaggaaaatgtggaggttgagatttggaccaaggaaggggagcggaaaaagctgaaacccagatggctcgatgctcgcatctattctgaccctctggcccttaaggagttcaaggagttcgctgccggccggaaaagcctgacgctcaacctgatcaccgagatgggaagactgcccacatttatgacccagaaggcgcgcgatgccctcgacaaccttgctgtgctgcacacagccgaagctggcgggcgggcctacaatcatgccctgtccgagctcccggaaaccctggagacacttctgctcctgaccctgctcgctacggtcacaggaggcattttcctttttctgatgagcgggagaggaatcggcaaaatgaccctgggcatgtgctgcattatcaccgcgtctattctcctgtggtatgcccaaatccagcctcactggatcgctgcctccattatccttgagttctttctgattgtgctcctgatccccgagcccgagaagcagcggacacctcaggataaccaactgacctacgtcgtgattgccatcctcacagttgtggctgccacgatggcgaatgaaatggggttccttgagaaaaccaagaaggacctgggactgggcagcatcacaacccagcagccggaatccaacattctcgacatcgatctgcgccccgcctctgcttggacactttatgccgtggctaccacgtttgtcacccctatgctgagacatagcattgaaaattcctctgttaacgtgagcctcacagccatcgcgaatcaggccaccgtgctgatggggctgggaaaaggctggcccctctccaagatggacattggggtccctcttctggctatcggatgttacagccaagtgaaccccattacactgaccgccgctctcttcctgcttgttgcccactacgctatcatcggccctggcctgcaggccaaagcgacgcgggaagcccagaagcgcgctgccgctgggattatgaaaaatccgacagtggatggaatcaccgtcattgacctcgatcccatcccttatgaccccaagtttgagaagcagctgggccaagtgatgctgctcgtcctttgcgtgacacaggttctgatgatgagaaccacctgggccctgtgtgaggccctcacactggcgacggggcctatttctaccctttgggaaggaaaccccggccggttctggaatacaaccatcgctgtgtccatggccaacatctttcgcgggagctacctggctggagccggcctcctgttctctattatgaaaaatacaaccaacacgagacggggcacagggaatatgggagagaccctgggcgaaaagtggaaatcccgcctcaacgcccttggaaagagcgagtttcagatctataaaaagtctggcattcaagaagtcgatagaaccctggctaaagagggcatcaagagaggggaaacagaccatcacgccgtgagcagaggatccgcgaagctgcgctggttcgttgaacggaatatggtgaccccggagggcaaagtcgtggatctcggctgcgggagaggaggctggtcttactattgtgggggactgaagaacgtgcgcgaagttaaaggccttacaaaaggcgggcctgggcacgaggagcccattcccatgagcacgtacggctggaacctggtccggctccagtccggggtggacgtgttctttacccctcccgaaaaatgcgatacactgctgtgtgacatcggagagagctcccctaatccgaccgtcgaagccggcagaacactccgcgttcttaacctggtggagaattggctgaacaataacacccagttctgcatcaaggtgctcaatccctatatgccttctgtcattgaaaagatggaggctctgcagcggaaatacgggggagcccttgtgagaaaccccctgagccgcaattccacgcatgagatgtactgggtttctaacgctagcggcaatatcgtgtcctctgtcaacatgattagccggatgctcatcaatagatttaccatgcgccacaagaaagccacattcgaacctgatgtggacctggggtccggaacccggaacattggcatcgagagcgaaatccccaatctggacattatcggcaagagaattgagaaaatcaagcaagaatatgagacatcttggcattacgatcaggaccacccgtataagacctgggcgtaccacgggtcctatgagacaaaacagaccggaagcgcctcttccatggttaacggcgtggtccgcctccttacgaagccttgggatgtggtgcccatggtcacacagatggctatgaccgacaccacaccttttgggcaacagagagttttcaaagaaaaggtggatacgcggacccaggagcccaaagaaggaacaaagaagctgatgaaaattaccgccgagtggctgtggaaggaactcggcaaaaagaaaacacctcgcatgtgtaccagagaggagtttacacggaaggtgagaagcaacgctgccctgggggctatcttcaccgacgaaaataaatggaagtctgcccgggaggcggtcgaagattcccgcttttgggagcttgtggacaaggagagaaacctgcatctcgaaggaaaatgcgagacgtgtgtttacaatatgatgggcaagcgggagaagaagctgggcgagttcgggaaagccaagggaagccgcgctatttggtatatgtggctgggcgccagatttctcgagttcgaggctctggggtttcttaacgaggatcactggttctcccgggaaaatagcctgtctggagtggagggcgaagggctccataagctgggctacatccttcgcgacgtcagcaaaaaggagggaggcgccatgtacgccgatgacaccgcggggtgggacacaagaatcaccctggaagatctcaaaaacgaggagatggtgacaaatcacatggaaggagagcataagaaactggctgaagccattttcaagctgacctatcagaacaaggttgtgcgggtccaacgccccacgccgagaggcacagtgatggacatcatttcccggcgcgatcagagagggtctggacaggttggcacctacgggctcaatacatttaccaacatggaggcccaactgatccggcagatggaaggcgagggagtgttcaaaaatattcagcaccttacggtcaccgaggaaatcgctgtgcagaactggctggcccgcgtcggcagagagcggctcagcagaatggctatctccggggacgattgcgtggttaagcctctggacgatcgctttgcctctgcgcttacagccctgaatgacatgggaaaagtgcggaaggatattcaacagtgggaacccagcagaggctggaacgactggacccaggtccccttctgctcccaccattttcacgagctcatcatgaaagatgggcgcgtgctggtggttccttgtcggaatcaggacgagctgattggacgggctcgcatctctcaaggcgccgggtggagcctccgggaaacagcttgcctgggcaagtcctatgcccagatgtggagccttatgtacttccatagacgcgatctgcggctcgcggccaacgctatttgttctgccgtgccgtcccactgggtccccaccagcagaacaacctggtctatccacgctaagcatgagtggatgacgacagaagacatgctgaccgtgtggaaccgcgtttggatccaggagaatccttggatggaagacaaaacccccgtggagtcctgggaggaaattccttatcttggaaagcgggaggatcagtggtgcggcagcctgatcgggctcacatccagagccacctgggctaaaaacattcaaacagccatcaatcaggtccggtctctgattggaaacgaagagtacacggactatatgcccagcatgaagagatttcgccgggaagaggaggaagcgggcgtgctgtggtga

SEQ ID NO: 19572 - RNA, 9876 nt, synthetic construct
  misc_feature 1..9876: note = derived and/or modified CDS sequence (opt5) from DENV-2__KF041232__SS-prME
  source 1..9876: mol_type = other RNA
accgccggagtgatcattatgctgatccccaccgctatggccttccacctcacgaccagaaatggggaacctcatatgattgtcagcaagcaggaaaaaggaaagtccctgctttttaaaacagaagacggcgttaatatgtgcaccctgatggcgatggatctcggggaactgtgtgaagacacaatcacctacaactgcccccttctgcggcaaaatgaacccgaagatattgactgttggtgcaacgctacatctacctgggtgacgtatggaacctgtacagccaccggcgagcaccgcagagaaaagcggagcgtggccctcgtccctcatgtggggatgggactggagacacgcaccgaaacgtggatgtcctctgagggcgcttggaaacacgcccagagaatcgagacatggatcctgcggcatcccggcttcaccattatggctgccatcctcgcgtacacaattgggaccacctattttcagcgcgttctgatcttcattcttctgacagccgtggctcctagcatgacgatgagatgcatcggaatttccaatcgggattttgtcgaaggcgtgtctgggggaagctgggttgacatcgtgctcgagcacggctcctgtgtcaccacaatggccaagaacaagcccaccctggatttcgaacttatcaaaacagaggctaagcagcctgccaccctgcgcaaatactgcattgaagcgaagctcacgaatacaaccaccgccagcagatgtccgacacaaggggagccctctctgaacgaggaacaggacaaacggtttgtgtgcaagcactccatggtggatcgcggatggggcaatggctgtgggctgttcggaaagggcgggatcgtgacctgcgctatgtttacatgcaaaaagaacatggagggaaaaattgttcagcctgaaaatctcgagtatacgatcgtggtgacaccccatagcggcgaagagaacgccgtcgggaatgacacaggaaagcacggcaaagagattaaggtgacccctcagtcttccatcacagaagctgagctgaccggctacgggacggttaccatggaatgtagccccagaacaggacttgatttcaacgagatggtgctgctccaaatggaaaataaagcctggctggtccatcggcagtggtttcttgacctgccgctcccttggctgcccggcgccgatatccaggggtctaactggattcagaaggagaccctggtgacattcaagaaccctcacgctaaaaagcaagacgttgtggtcctcggatcccaggagggcgcgatgcacaccgccctgacgggggctacagaaatccagatgagctccggcaatcttctgtttaccggacatctcaaatgccgcctgagaatggacaaacttcaactgaaaggcatgtcttatagcatgtgtacagggaagttcaaggtggtcaaagagattgccgaaacccagcacggaaccatcgtggttcgggtgcagtacgagggcgatgggtccccctgcaagattcccttcgagatcatggacctcgagaagcggcatgtcctgggacgcctgatcacagtgaaccctattgttacggagaaggatagcccggtgaatatcgaagccgagcccccttttggcgactcttacattatcattggggtcgaacccggccagctcaaactgtcctggttcaagaagggaagctctatcggccaaatgtttgagaccacaatgagaggggctaaaagaatggccattcttggagataccgcgtgggacttcggcagcctcgggggagtgtttacatccatcggcaaggctctccaccaggtgttcggggccatctatggcgccgctttttctggagttagctggaccatgaaaattctgatcggcgtcgtgattacgtggatcgggatgaactcccgcagcacatctctgtccgtgagccttgtcctcgtgggagttgtgaccctgtacctgggcgccatggtccaggctgattctgggtgtgtggtttcctggaagaataaagagctcaagtgcggaagcggcattttcatcaccgacaacgtgcatacatggaccgaacagtataagtttcaacctgagtccccctctaaactggccagcgcgatccagaaggcccacgaagaggggatttgtggcatccggtccgtcacaagacttgaaaatctgatgtggaaacagattacgccggagctcaaccacatcctgtctgagaatgaagtgaagctgagcattatgaccggagatatcaaaggcatcatgcaggctgggaagcgctcccttcggcctcaacccacagagctcaaatacagctggaagacctggggaaaggccaaaatgctgtctacagaacctcataaccagaccttcctgattgacggccccgagacggctgaatgccctaataccaacagagcctggaactccctcgaggttgaggattatgggtttggagtgttcacaaccaacatctggctgaaacttaaagaacgccaggacgtcttttgtgacagcaagctgatgtctgcggccattaaagataatcgggctgtgcacgccgacatgggctactggatcgagtccgctctcaacgatacatggaagattgaaaaggccagcttcatcgaggtgaaatcttgccattggcccaagagccacaccctgtggtccaacggcgtcctggagagcgaaatgatcattccgaaaaatttcgccgggcctgtttctcagcacaactatagacccggataccatacacaaaccgctggcccctggcaccttgggaagctcgagatggactttgatttctgtgaaggaacgacagtggtggtcaccgaggactgcggcaatcgcgggccttccctgcggaccacaaccgcgagcggaaaactgatcacggaatggtgctgtagatcctgcacactcccgcccctgcggtaccgcggcgaggatggctgttggtatgggatggagattagacctcttaaggaaaaggaggaaaacctggtcaattctctcgttaccgccggacatggccagatcgacaactttagcctgggggtgctgggaatggctcttttcctcgaggaaatgctgcggacaagagtcggcaccaaacacgccgtgctgctcgttgccgtgtcctttatgacactgattaccgggaatatgtctttccgcgatcttggacgggtcatggtgatggttggcgctgccatgacggacgatatcggcatgggggtgacctacctggcgctcctggctgcctttaaggtcagacccacattcgccgctggactgcttctgcgcaaactcaccagcaaggagctgatgatgacaaccattggcatcgtgctcctgtcccagtctacgacacctgagaccatccttgaactgacagacgccctcgcgctggggatgatgattctgaaaatcgtgagaaacatggagaagtatcaacttgctgtcaccattatggccatcctgtgcgttcccaatgccgtgattctccagaacgcttggaaggtgagctgtaccatcctggccgctgtctccgtgagccctctcctgcttacatcttcccagcagaaagccgattggatccccctggcgctcacgattaagggactgaatccgaccgccatctttctgacaacccttagccggacaaacaaaaagcgctcttggcctctgaatgaagctattatggccgttggcatggtgtccatcctcgctagctctctgctcaaaaacgacattcccatgaccgggcctctggtcgccggaggccttctgacggtgtgctacgttctgacaggcagatccgccgacctcgagctggaacgggctgcggatgtgcgctgggaggaccaagccgagatcagcgggtccagccccatcctttctattaccatcagcgaagatggatccatgtctattaagaatgaggaagaggagcagaccctgacaatcctcattagaaccggcctgctcgtcatcagcgggctgttcccggtgtccattcctatcacagctgccgcctggtatctttgggaagtcaaaaagcagcgggctggagtgctgtgggacgttccctctcctccgcccgtgggcaaggccgagctggaagatggggcgtaccgcatcaaacagaagggcattctcggatatagccaaatcggcgctggggtctacaaagagggaacgtttcataccatgtggcacgtgacaagaggcgccgttctgatgcacaaggggaaacggattgaaccttcctgggccgacgtgcgcaaggatcttatctcttacggaggcgggtggaagctggagggagagtggaaagaaggcgaggaagtccaggtgctcgctctggagccgggcaagaaccccagagccgtgcagaccaaacctgggctgttcaagacaaacaccggaacgattggcgcggttagcctggacttttcccccgggaccagcggatctcctatcgtcgataaaaagggcaaggtggtggggctttatggaaatggcgtcgtgacacggtccggcacctacgttagcgctatcgcccagacagaaaaatctattgaggacaaccccgagatcgaagatgacattttcagaaagaaacgcctgaccatcatggatctgcatcctggggccggaaagacaaaacggtatctcccggctattgtgagagaggccatcaagcgcggcctgcggacgcttatcctggctcccaccagagtcgtggccgcggaaatggaggaagccctccgcgggctgcctattcggtaccaaacacccgctatcagagccgagcacaccggacgcgagattgttgacctcatgtgtcatgctaccttcacaatgcggctgctttcccctgtgagagtccccaattataacctgatcattatggacgaagcccactttacggatccggccagcatcgctgcgcggggctacatttccacccgcgtggagatgggggaagccgctggcatcttcatgacagccacccctcccggatctagagacccctttcctcagagcaatgcccccatcatggatgaggagcgggaaattcctgagcgctcctggaacagcggccatgaatgggttacagacttcaaggggaaaaccgtgtggtttgtcccgtctatcaaggctggaaatgatattgccgcgtgcctgcgcaaaaacggcaagaaagtgatccagctctcccggaagacgttcgacagcgagtatattaagacaagaaccaatgattgggactttgtggtcaccacagatatctctgaaatgggggctaacttcaaagccgagcgcgttatcgacccccggagatgtatgaagcctgtgattctgaccgatggagaggaacgcgtgatccttgccggccccatgcctgtcacacacagctccgctgcccaacggagagggcgcattggccggaatcccaaaaacgagaatgaccagtacatctacatgggagaaccgctggagaacgacgaagattgcgcgcactggaaggaggccaaaatgctcctggacaatattaacacccctgagggcatcatcccctctatgtttgaacctgagagagaaaaggtggatgctattgacggggagtatcgcctgagaggagaagcccggaaaacgttcgttgatctcatgcgcagaggcgaccttcccgtgtggctggcttaccgggtcgccgctgaggggatcaactatgccgatcgcagatggtgttttgacggaattaagaataaccagatcctggaggaaaatgtggaggttgaaatttggacaaaggagggcgagcggaaaaagctcaaacctagatggctggatgcgcgcatctacagcgacccccttgccctgaaggagttcaaagagttcgctgccgggcggaagtccctcaccctgaacctgattacagaaatgggcagactcccgacctttatgacgcagaaggctcgcaatgcccttgataacctggccgtgctgcataccgctgaggcgggaggccgggcctataatcacgctctctctgaactgcctgagacacttgagaccctgctcctgctgacactccttgccaccgtcacagggggaatcttcctgtttctgatgagcggcaaagggatcggaaagatgaccctcggcatgtgctgcattatcacggcctccattctgctttggtacgctcaaatccagccccattggattgccgcgagcatcatcctggagttctttctcattgtgctgctgatccccgagcctgaaaaacagagaacaccgcaggacaaccaactcacctatgtcgtgattgccatccttaccgttgtggctgccacaatggctaatgagatgggcttcctggaaaagaccaaaaaggattttgggctgggatctattgccacacagcagcccgagtccaacatcctcgacatcgacctgcggcctgcgagcgcctggacgctttacgctgtggccaccacattcattacccccatgctgcgccactccatcgaaaattctagcgtcaacgtttccctcacagctattgccaatcaggctaccgtgctgatgggcctggggaagggatggcctctctctaaaatggatatcggcgtgccccttctggccattgggtgttacagccaagtcaaccctatcacgctgaccgcggccctcctgcttctggtggctcactatgccattatcggaccgggcctccaggctaaggccacaagagaagcccagaaacgggcggctgccggcatcatgaagaatcccaccgttgacgggattacagtgatcgatctggaccctattccctacgatcctaaatttgagaagcagctgggacaagtcatgctccttgtgctgtgcgtcacccaggtgctgatgatgcgcacgacatgggctctctgtgaagccctgacccttgccacaggccccatctccaccctgtgggaggggaacccgggaagattctggaataccacaattgctgttagcatggccaacatctttcggggctcttatctcgcgggggccggactgctgttctccatcatgaagaacacgaccaatacacgcagaggcaccggcaacacaggggaaaccctcggagagaaatggaagaatcggcttaacagcctgggcaaatctgagtttcagatttacaagcgctccgggatccaagaagtggacagaacgctggctaaagagggaattaagcggggcgaaacagatcatcacgccgtcagcagagggtctgctaaactccgctggttcgtggagcggaatctggttacccctgagggaaaggtggtcgaccttggctgcggcagagggggatggagctattactgtggcgggctgaagaacgtgcgcgaagtgaaaggactcaccaagggcgggcccggacatgaggaacccatccctatgtccacatatggctggaatctggttcggctgcagtctggcgtcgatgtgttctttacaccccctgagaaatgcgacaccctcctttgtgatattggggaaagctccccgaaccccacggtggaggccggaagaaccctgcgcgtcctgaatctcgttgagaactggctgaataacaatacacagttctgcatcaaggtgcttaacccttacatgcccagcgtgatcgagaagatggagaccctgcagcggaagtacggcggggcgctcgtcagaaatcctctgtcccgcaactctacacacgaaatgtattgggtgagcaacgcctccggaaatattgtttctagcgtgaacatgatctcccggatgctgattaatagatttaccatgcgccataagaaagctacgtacgagcccgacgtcgatctcggctctgggacccggaacatcggaattgaaagcgagacaccgaatcttgacatcatcggcaagagaattgagaaaatcaagcaagaacacgagacctcctggcactatgaccaggatcatccttacaaaacatgggcctatcacggcagctacgaaaccaagcagacagggtctgcttccagcatggtgaacggagttgtgcgcctgctgaccaagccctgggacgtcattcctatggtgacgcagatggccatgacagataccacccccttcggccaacagagagtgtttaaagagaaggtcgacacacggacgcaggaacctaaagaggggaccaagaaactcatgaagatcacagctgagtggctgtggaaggaacttggcaaaaagaaaacccccagaatgtgtacaagagaggagttcgcccggaaggttagatctaatgcggccctgggcgctatttttaccgatgagaacaaatggaagtccgcccgggaggctgtggaagacagccgcttctgggagctcgtggataaagaaagaaatctgcatctggaggggaagtgcgaaacatgtgtctataacatgatgggaaagcgggagaaaaagatcggcgagtttggcaaagccaaggggtctcgcgccatttggtacatgtggctcggagcgagattcctggaatttgaggctcttggcttcctgaatgaagaccactggttttcccgggagaacagcctctccggggtggaaggagagggcctgcacaaacttgggtacatcctgcgcgaggttagcaagaaggaaggcggagccatgtatgccgatgacaccgctggctgggatacgagaatcaccctcgaggacctgaaaaatgaagagatggtgacaaaccatatggaaggggagcacaagaaactggccgaggctattttcaagctcacctaccagaataaagtcgtgcgggttcaacgcccgacacctagaggaaccgtgatggacatcatttctcggcgcgatcagagaggcagcgggcaggtcggaacgtatggcctgaacacattcaccaacatgggggcccaacttatccggcagatggaaggcgagggagtgtttaagggcattcagcatctgacagcgaccgaagaggttgccgtgcaggactggctcgctcgcgtcgggagagagcggctgtccagaatggccatctctggagatgactgcgtggtcaagccccttgatgaccgcttcgctaatgccctgacggcgctcaacgatatgggcaaagtgcggaaggacatccaacagtgggaacccagcagagggtggaatgattggacccaggttcctttttgctcccaccatttccacgagctgattatgaaagacggacgcgtgctggtcgtgccgtgtcggaaccaggatgaactcatcggcagagcccgcatttctcaaggggctggctggagcctgcgggagacagcctgccttggaaagtcctacgctcagatgtggtctctgatgtattttcacagacgcgacctccggctggccgctaatgccatctgtagcgcggtgccctcccattgggttcctaccagcagaacaacctggtctattcacgcccgccatgaatggatgacaaccgaggatatgcttacggtgtggaaccgggtctggatccaggagaatccctggatggaagacaaaacacctgtggagtcctgggaagagatcccctacctgggcaagagagaagaccagtggtgcgggagcctcattggactgacctctcgggctacctgggccagaaacatccaaacagccattaatcaggttcgctccctgatcggcagcgaggagtataccgattacatgccttccatgaagcggttcagacgcgaagaggaagaggctggggtgctctggtga

SEQ ID NO: 19573 - RNA, 9876 nt, synthetic construct
  misc_feature 1..9876: note = derived and/or modified CDS sequence (opt5) from DENV-2__KF041233__SS-prME
  source 1..9876: mol_type = other RNA
accgccggcgtcatcattatgctgatccccaccgctatggccttccacctcacgaccagaaatggggaacctcatatgattgtcagcaagcaggaaaaaggaaagtccctgctttttaaaaccgaagacggcgttaatatgtgcaccctgatggcgatggatctcggggaactgtgtgaagacacaatcacctacaactgcccccttctgcggcaaaatgaacccgaagatattgactgttggtgcaactctacaagcacctgggtgacgtatggaacctgtacagctaccggcgagcaccgcagagaaaagcggtccgtggccctcgtccctcatgtggggatgggactggagacacgcaccgaaacgtggatgtctagcgagggcgcctggaaacacgctcagagaatcgagacatggatcctgcggcatcccggcttcaccattatggccgctatcctcgcctacacaattgggaccacctattttcagcgcgttctgatcttcattcttctgacagcggtggccccttccatgacgatgagatgcatcggaatttctaatcgggattttgtcgaaggcgtgagcgggggatcctgggttgacatcgtgctcgagcacggcagctgtgtcaccacaatggctaagaacaagcccaccctggatttcgaacttatcaaaacagaggccaagcagcctgctaccctgcgcaaatactgcattgaagccaagctcacgaatacaaccaccgcgtctagatgtccgacacaaggggagccctccctgaacgaggaacaggacaaacggtttgtgtgcaagcacagcatggtggatcgcggatggggcaatggctgtgggctgttcggaaagggcgggatcgtgacctgcgccatgtttacatgcaaaaagaacatggagggaaaaattgttcagcctgaaaatctcgagtatacgatcgtggtgacaccccattctggcgaagagaacgctgtcgggaatgacacaggaaagcacggcaaagagattaaggtgacccctcagtccagcatcacagaagccgagctgaccggctacgggacggttaccatggaatgttctcccagaacaggacttgatttcaacgagatggtgctgctccaaatggaaaataaggcttggctggtccatcggcagtggtttcttgacctgccgctcccttggctgcccggcgccgatatccaggggtccaactggattcagaaggagaccctggtgacattcaagaaccctcacgccaaaaagcaagacgttgtggtcctcggaagccaggagggcgctatgcacaccgcgctgacgggggccacagaaatccagatgtcctctggcaatcttctgtttaccggacatctcaaatgccgcctgagaatggacaaacttcaactgaaaggcatgagctattccatgtgtacagggaagttcaaggtggtcaaagagattgctgaaacccagcacggaaccatcgtggttcgggtgcagtacgagggcgatgggagcccctgcaagattcccttcgagatcatggacctcgagaagcggcatgtcctgggacgcctgatcacagtgaaccctattgttacggagaaggattctccggtgaatatcgaagccgagcccccttttggcgactcctacattatcattggggtcgaacccggccagctcaaactgagctggttcaagaagggatctagcatcggccaaatgtttgagaccacaatgagaggggccaaaagaatggctattcttggagataccgcctgggacttcggctccctcgggggagtgtttacatctatcggcaaggcgctccaccaggtgttcggggctatctatggcgccgcctttagcggagtttcctggaccatgaaaattctgatcggcgtcgtgattacgtggatcgggatgaacagccgctctacatccctgagcgtgtctcttgtcctcgtgggagttgtgaccctgtacctgggcgtcatggtgcaggctgattccgggtgtgttgtgagctggaagaataaagagctcaagtgcggatccggcattttcatcaccgacaacgtccatacatggaccgaacagtataagtttcaacctgagtctcccagcaaactggccgctgccatccagaaggcgcacgaagaggggatttgtggcatccggtccgtgacaagacttgaaaatctgatgtggaaacagattacgccggagctcaaccacatcctgtctgagaatgaagttaagctgagcattatgaccggagatatcaaaggcatcatgcaggccgggaagcgctcccttcggcctcaacccacagagctcaaatacagctggaagacctggggaaaggctaaaatgctgtctacagaacctcataaccagaccttcctgattgacggccccgagacggccgaatgccctaataccaacagagcttggaactccctcgaggtggaggattatgggtttggagtcttcacaaccaacatctggctgaaacttaaagaacgccaggacgtgttttgtgacagcaagctgatgtctgccgcgattaaagataatcgggccgtgcacgctgacatgggctactggatcgagtccgccctcaacgatacatggaagattgaaaaggctagcttcatcgaggtcaaatcttgccattggcccaagagccacaccctgtggtccaacggcgttctggagagcgaaatgatcattccgaaaaatttcgccgggcctgtgtctcagcacaactatagacccggataccatacacaaaccgccggcccctggcaccttgggaagctcgagatggactttgatttctgtgaaggaacgacagtggtcgtgaccgaggactgcggcaatcgcgggccttccctgcggaccacaaccgctagcggaaaactgatcacggaatggtgctgtagatcctgcacactcccgcccctgcggtaccgcggcgaggatggctgttggtatgggatggagattagacctcttaaggaaaaggaggaaaacctggttaattctctcgtgaccgcgggacatggccagatcgacaactttagcctgggggtcctgggaatggcccttttcctcgaggaaatgctgcggacaagagtgggcaccaaacacgctgttctgctcattgccgtgtcctttatgacactgatcaccgggaatatgtctttccgcgatcttggacgggtcatggtgatggttggcgccgctatgacggacgatattggcatgggggtgacctacctggccctcctggcggcttttaaggtcagacccacattcgccgccggactgcttctgcgcaaactcaccagcaaggagctgatgatgacaaccatcggcatcgtgctcctgtcccagtctacgacacctgagaccattcttgaactgacagacgctctcgccctggggatgatgatcctgaaaattgtgagaaacatggagaagtatcaacttgcggtcaccatcatggctattctgtgcgttcccaatgccgtgatcctccagaacgcctggaaggtgagctgtaccatcctggctgccgtctccgtgagccctctcctgcttacatcttcccagcagaaagctgattggattcccctggccctcacgatcaagggactgaatccgaccgcgatttttctgacaacccttagccggacaaacaaaaagcgctcttggcctctgaatgaagccatcatggctgttggcatggtgtccattctcgccagctctctgctcaaaaacgacatccccatgaccgggcctctggtcgctggaggccttctgacggtgtgctacgttctgacaggcagatccgccgacctcgagctggaacgggccgctgatgtgcgctgggaggaccaagcggagatcagcgggtccagccccattctttctatcaccattagcgaagatggatccatgtctatcaagaatgaggaagaggagcagaccctgacaattctcatcagaaccggcctgctcgtcattagcgggctgttcccggtgtccatccctatcacagccgctgcctggtatctttgggaagtcaaaaagcagcgggccggagtgctgtgggacgttccctctcctccgcccgtgggcaaggctgagctggaagatggggcctaccgcattaaacagaagggaatcctcggctatagccaaattggcgcgggggtctacaaagagggaacgtttcataccatgtggcacgtgacaagaggcgctgttctgatgcacaaggggaaacggatcgaaccttcctgggccgacgtgcgcaaggatcttatttcttacggaggcgggtggaagctggagggagagtggaaagaaggcgaggaagtccaggtgctcgccctggagccgggcaagaaccccagagctgtgcagaccaaacctgggctgttcaagacaaacaccggaacgatcggcgccgttagcctggacttttcccccgggaccagcggatctcctatcgtcgataaaaagggcaaggtggtggggctttatggaaatggcgtcgtgacacggtccggcacctacgttagcgcgattgctcagacagaaaaatctatcgaggacaaccccgagattgaagatgacatcttcagaaagaaaaagctgaccattatggatctgcatcctggggccggaaaaacaaagcgctatctcccggccatcgtgcgggaggctatcaagagaggcctgcgcacgcttattctggcccccacccgggtcgtggctgccgaaatggaggaagcgctcagagggctgcctatccgctaccaaacacccgccattcgggctgagcacaccggaagagagatcgttgacctcatgtgtcatgccaccttcacaatgcgcctgctttcccctgtgcgggtccccaattataacctgattatcatggacgaagctcactttacggatccggccagcattgccgctagaggctacatctccacccgggtggagatgggggaagcggccggcatcttcatgacagctacccctcccggatctcgcgacccctttcctcagagcaatgcccccattatggatgaggagagagaaatccctgagcggtcctggaacagcggccatgaatgggttacagacttcaaagggaagaccgtgtggtttgtcccgtctattaaagccggaaatgatatcgctgcctgcctgcgcaagaacggcaaaaaggtgattcagctctccagaaagacgttcgacagcgagtatatcaaaacacggaccaatgattgggactttgtggtcaccacagatatctctgaaatgggggcgaacttcaaggctgagagagttattgacccccgccggtgtatgaaacctgtgatcctgaccgatggagaggaaagagtgattcttgccggccccatgcctgtcacacacagctccgccgctcaacgccgggggagaatcggccgcaatcccaagaacgagaatgaccagtacatttacatgggagaaccgctggagaacgacgaagattgcgcccactggaaagaggcgaagatgctcctggacaatatcaacacccctgagggcatcattccctctatgtttgaacctgagcgggaaaaagtggatgccatcgacggggagtatagactgcgcggagaagctagaaagacgttcgttgatctcatgcggcgcggcgaccttcccgtgtggctggcctacagagtcgctgccgaggggattaactatgctgatcggcgctggtgttttgacggaatcaagaataaccagattctggaggaaaatgtggaggttgaaatctggacaaaagagggcgagagaaagaaactcaagcctcggtggctggatgccagaatttacagcgacccccttgcgctgaaagagttcaaggagttcgccgctgggcgcaagtccctcaccctgaacctgatcacagaaatgggccggctcccgacctttatgacgcagaaagccagaaatgctcttgataacctggccgtgctgcataccgccgaggctggaggccgcgcgtataatcacgccctctctgaactgcctgagacacttgagaccctgctcctgctgacactccttgctaccgtcacagggggaatcttcctgtttctgatgagcggcaaggggattggaaaaatgaccctcggcatgtgctgcatcattacggcctccatcctgctttggtacgcccaaattcagccccattggatcgctgccagcatcattctggagttctttctcatcgtgctgctgattcccgagcctgaaaagcagcggacaccgcaggacaaccaactcacctatgtcgtgatcgcgattcttaccgttgtggccgctacaatggccaatgagatgggcttcctggagaagaccaagaaggattttgggctgggatctatcgctacacagcagcccgagtccaacatcctcgacattgacctgagacctgccagcgcgtggacgctttacgccgtggctaccacattcatcacccccatgctgcggcactccattgaaaattctagcgtcaacgtttccctcacagccatcgctaatcaggccaccgtgctgatgggcctggggaaaggatggcctctctctaagatggatattggcgtgccccttctggctatcgggtgttacagccaagtcaaccctattacgctgaccgccgcgctcctgcttctggtggcccactatgctatcatcggaccgggcctccaggccaaagctacacgcgaagcccagaagagagccgcggctggcattatgaaaaatcccaccgttgacgggatcacagtgattgatctggaccctatcccctacgatcctaagtttgagaagcagctgggacaagtcatgctccttgtgctgtgcgtcacccaggtgctgatgatgcggacgacatgggccctctgtgaagctctgacccttgccacaggccccatttccaccctgtgggaggggaacccgggacgcttctggaataccacaatcgccgttagcatggctaacatctttagaggctcttatctcgccggggcgggactgctgttctccattatgaaaaacacgaccaatacacggcgcggcaccggcaacacaggggaaaccctcggagagaagtggaaaaatagacttaacagcctgggcaagtctgagtttcagatctacaaacggtccgggattcaagaagtggaccgcacgctggccaaggagggaatcaaaagaggcgaaacagatcatcacgctgtcagccgggggtctgccaagctcagatggttcgtggagcgcaatctggttacccctgagggaaaggtggtcgaccttggctgcggcagagggggatggagctattactgtggcgggctgaaaaacgtgcgggaagtgaagggactcaccaaaggcgggcccggacatgaggaacccattcctatgtccacatatggctggaatctggttcgcctgcagtctggcgtcgatgtgttctttacaccccctgagaagtgcgacaccctcctttgtgatatcggggaaagctccccgaaccccacggtggaggctggacggaccctgagagtcctgaatctcgttgagaactggctgaataacaatacacagttctgcatcaaagtgcttaacccttacatgcccagcgtgattgaaaagatggagaccctgcagcgcaagtacggcggggccctcgtccggaatcctctgtccagaaactctacacacgaaatgtattgggtgagcaacgcgtccggaaatatcgtttctagcgtgaacatgatttcccgcatgctgatcaatcggtttaccatgagacataaaaaggccacgtacgagcccgacgtcgatctcggctctgggacccgcaacattggaatcgaaagcgagacaccgaatcttgacatcattggcaaacggatcgagaagattaaacaagaacacgagacctcctggcactatgaccaggatcatccttacaagacatgggcttatcacggcagctacgaaaccaagcagacagggtctgcctccagcatggtgaacggagttgtgagactgctgaccaaaccctgggacgtcatccctatggtgacgcagatggctatgacagataccacccccttcggccaacagcgcgtgtttaaggagaaagtcgacacaagaacgcaggaacctaaggaggggaccaaaaagctcatgaagattacagccgagtggctgtggaaagaacttggaaagaaaaagacaccccggatgtgtacacgcgaggagttcgctagaaaagttcggtctaatgccgcgctgggcgccatctttaccgatgagaacaagtggaaatccgctagagaggccgtggaagacagccggttctgggagctcgtggataaggaacgcaatctgcatctggaggggaagtgcgaaacatgtgtctataacatgatgggaaaaagagagaagaaaattggcgagtttggcaaggctaaagggtctcgggccatctggtacatgtggctcggagcccgcttcctggaatttgaggcgcttggcttcctgaatgaagaccactggttttccagagagaacagcctctccggggtggaaggagagggcctgcacaaacttgggtacatcctgcgggaggttagcaagaaagaaggcggagctatgtatgccgatgacaccgccggctgggatacgcgcattaccctcgaggacctgaagaatgaagagatggtgacaaaccatatggaaggggagcacaaaaagctggctgaggccatcttcaaactcacctaccagaataaggtcgtgagagttcaacggccgacacctcgcggaaccgtgatggacattatctctagacgggatcagcgcggcagcgggcaggtcggaacgtatggcctgaacacattcaccaacatgggggctcaacttattagacagatggaaggcgagggagtgtttaagggcatccagcatctgacagccaccgaagaggttgcggtgcaggactggctcgcccgggtcgggcgcgagagactgtcccggatggctatctctggagatgactgcgtggtcaaaccccttgatgacagattcgccagcgctctgacggccctcaatgatatgggcaaggtgcgcaaagacattcaacagtgggaaccctcccgggggtggaacgattggacccaggttcctttttgctctcaccatttccacgagctgatcatgaaggacggaagagtgctggtcgtgccgtgtcgcaatcaggatgaactcattggccgggcgagaatcagccaaggggccggctggtccctgcgcgagacagcttgccttggaaaatcttacgcccagatgtggagcctgatgtattttcaccggagagacctccgcctggctgccaacgctatttgttccgccgtgcccagccattgggttcctacctctcggacaacctggtccatccacgcgagacatgaatggatgacaaccgaggatatgcttacggtgtggaatcgcgtctggatccaggagaacccctggatggaagacaagacactggtggagagctgggaagagattccttacctcggcaagcgggaagaccagtggtgcgggtctctgatcggactgacctccagagccacctgggctcggaatattcaaacagccatcaaccaggttagaagcctcattggctccgaggagtataccgattacatgccctctatgaaacgcttccggagagaagaggaagaggccggggtgctgtggtga

SEQ ID NO: 19574 - RNA, 9876 nt, synthetic construct
  misc_feature 1..9876: note = derived and/or modified CDS sequence (opt5) from DENV-2__KF041234__SS-prME
  source 1..9876: mol_type = other RNA
accgccggagtgatcattatgctgatccccaccgctatggccttccacctcacgaccagaaatggggaacctcatatgattgtcagcaagcaggaaaaaggaaagtccctgctttttaaaacagaagacggcgttaatatgtgcaccctgatggcgatggatctcggggaactgtgtgaagacacaatcacctacaactgcccccttctgcggcaaaatgaacccgaagatattgactgttggtgcaacgctacatctacctgggtgacgtatggaacctgtacagccaccggcgagcaccgcagagaaaagcggagcgtggccctcgtccctcatgtggggatgggactggagacacgcaccgaaacgtggatgtcctctgagggcgcttggaaacacgcccagagaatcgagacatggatcctgcggcatcccggcttcaccattatggctgccatcctcgcgtacacaattgggaccacctattttcagcgcgttctgatcttcattcttctgacagccgtggctcctagcatgacgatgagatgcatcggaatttccaatcgggattttgtcgaaggcgtgtctgggggaagctgggttgacatcgtgctcgagcacggctcctgtgtcaccacaatggccaagaacaagcccaccctggatttcgaacttatcaaaacagaggctaagcagcctgccaccctgcgcaaatactgcattgaagcgaagctcacgaatacaaccaccgccagcagatgtccgacacaaggggagccctctctgaacgaggaacaggacaaacggtttgtgtgcaagcactccatggtggatcgcggatggggcaatggctgtgggctgttcggaaagggcgggatcgtgacctgcgctatgtttacatgcaaaaagaacatggagggaaaaattgttcagcctgaaaatctcgagtatacgatcgtggtgacaccccatagcggcgaagagaacgccgtcgggaatgacacaggaaagcacggcaaagagattaaggtgacccctcagtcttccatcacagaagctgagctgaccggctacgggacggttaccatggaatgtagccccagaacaggacttgatttcaacgagatggtgctgctccaaatggaaaataaagcctggctggtccatcggcagtggtttcttgacctgccgctcccttggctgcccggcgccgatatccaggggtctaactggattcagaaggagaccctggtgacattcaagaaccctcacgctaaaaagcaagacgttgtggtcctcggatcccaggagggcgcgatgcacaccgccctgacgggggctacagaaatccagatgagctccggcaatcttctgtttaccggacatctcaaatgccgcctgagaatggacaaacttcaactgaaaggcatgtcttatagcatgtgtacagggaagttcaaggtgattaaagagatcgccgaaacccagcacggaaccattgtcgtgcgggttcagtacgagggcgatgggtccccctgcaagatccccttcgagatcatggacctcgagaagcggcatgtgctgggacgcctgattacagtcaaccctatcgtgacggagaaggatagcccggttaatattgaagccgagcccccttttggcgactcttacatcattatcggggtggaacccggccagctcaaactgtcctggttcaagaagggaagctctattggccaaatgtttgagaccacaatgagaggggctaaaagaatggccatccttggagataccgcgtgggacttcggcagcctcgggggagtctttacatccatcggcaaggctctccaccaggtgttcggggccatttatggcgccgctttttctggagtgagctggaccatgaaaatcctgattggcgttgtcatcacgtggattgggatgaactcccgcagcacatctctgtccgtgagccttgtgctcgtcggagtggttaccctgtacctgggcgtgatggtccaggccgattctgggtgtgtggtttcctggaagaataaagagctcaagtgcggaagcggcatcttcatcaccgacaacgtgcatacatggaccgaacagtataagtttcaacctgagtccccctctaaactggctagcgccattcagaaggcgcacgaagaggggatctgtggcattcggtccgtcacaagacttgaaaatctgatgtggaaacagatcacgccggagctcaaccacattctgtctgagaatgaagtgaagctgagcatcatgaccggagatatcaaaggcattatgcaggccgggaagcgctcccttcggcctcaacccacagagctcaaatacagctggaagacctggggaaaggctaaaatgctgtctacagaacctcataaccagaccttcctgatcgacggccccgagacggccgaatgccctaataccaacagagcttggaactccctcgaggttgaggattatgggtttggagtgttcacaaccaacatttggctgaaacttaaagaacgccaggacgtcttttgtgacagcaagctgatgtctgccgcgatcaaagataatcgggccgtgcacgctgacatgggctactggattgagtccgccctcaacgatacatggaagatcgaaaaggctagcttcatcgaggtgaaatcttgccattggcccaagagccacaccctgtggtccaacggcgtcctggagagcgaaatgattatcccgaaaaatttcgccgggcctgtttctcagcacaactatagacccggataccatacacaaaccgccggcccctggcaccttgggaagctcgagatggactttgatttctgtgaaggaacgacagtggtggtcaccgaggactgcggcaatcgcgggccttccctgcggaccacaaccgctagcggaaaactgattacggaatggtgctgtagatcctgcacactcccgcccctgcggtaccgcggcgaggatggctgttggtatgggatggagatcagacctcttaaggaaaaggaggaaaacctggtcaattctctcgttaccgcgggacatggccagattgacaactttagcctgggggtgctgggaatggcccttttcctcgaggaaatgctgcggacaagagtcggcaccaaacacgctgtgctgctcgttgccgtgtcctttatgacactgatcaccgggaatatgtctttccgcgatcttggacgggtcatggtgatggttggcgccgctatgacggacgatattggcatgggggtgacctacctggccctcctggcggcttttaaggtcagacccacattcgccgccggactgcttctgcgcaaactcaccagcaaggagctgatgatgacaaccatcggcatcgtgctcctgtcccagtctacgacacctgagaccattcttgaactgacagacgctctcgccctggggatgatgatcctgaaaattgtgagaaacatggagaagtatcaacttgcggtcaccatcatggctattctgtgcgttcccaatgccgtgatcctccagaacgcctggaaggtgagctgtaccatcctggctgccgtctccgtgagccctctcctgcttacatcttcccagcagaaagctgattggattcccctggccctcacgatcaagggactgaatccgaccgcgatttttctgacaacccttagccggacaaacaaaaagcgctcttggcctctgaatgaagccatcatggctgttggcatggtgtccattctcgccagctctctgctcaaaaacgacatccccatgaccgggcctctggtcgctggaggccttctgacggtgtgctacgttctgacaggcagatccgccgacctcgagctggaacgggccgctgatgtgcgctgggaggaccaagcggagatcagcgggtccagccccattctttctatcaccattagcgaagatggatccatgtctatcaagaatgaggaagaggagcagaccctgacaattctcatcagaaccggcctgctcgtcattagcgggctgttcccggtgtccatccctatcacagccgctgcctggtatctttgggaagtcaaaaagcagcgggccggagtgctgtgggacgttccctctcctccgcccgtgggcaaggctgagctggaagatggggcctaccgcattaaacagaagggaatcctcggctatagccaaattggcgcgggggtctacaaagagggaacgtttcataccatgtggcacgtgacaagaggcgctgttctgatgcacaaggggaaacggatcgaaccttcctgggccgacgtgcgcaaggatcttatttcttacggaggcgggtggaagctggagggagagtggaaagaaggcgaggaagtccaggtgctcgccctggagccgggcaagaaccccagagctgtgcagaccaaacctgggctgttcaagacaaacaccggaacgatcggcgccgttagcctggacttttcccccgggaccagcggatctcctatcgtcgataaaaagggcaaggtggtggggctttatggaaatggcgtcgtgacacggtccggcacctacgttagcgcgattgctcagacagaaaaatctatcgaggacaaccccgagattgaagatgacatcttcagaaagaaacgcctgaccattatggatctgcatcctggggccggaaagacaaaacggtatctcccggccatcgtgagagaggctatcaagcgcggcctgcggacgcttattctggcccccaccagagtcgtggctgccgaaatggaggaagcgctccgcgggctgcctatccggtaccaaacacccgccattagagctgagcacaccggacgcgagatcgttgacctcatgtgtcatgccaccttcacaatgcggctgctttcccctgtgagagtccccaattataacctgattatcatggacgaagctcactttacggatccggccagcattgccgctcggggctacatctccacccgcgtggagatgggggaagcggccggcatcttcatgacagctacccctcccggatctagagacccctttcctcagagcaatgcccccattatggatgaggagcgggaaatccctgagcgctcctggaacagcggccatgaatgggttacagacttcaaggggaaaaccgtgtggtttgtcccgtctattaaggccggaaatgatatcgctgcctgcctgcgcaaaaacggcaagaaagtgattcagctctcccggaagacgttcgacagcgagtatatcaagacaagaaccaatgattgggactttgtggtcaccacagatatctctgaaatgggggcgaacttcaaagctgagcgcgttattgacccccggagatgtatgaagcctgtgatcctgaccgatggagaggaacgcgtgattcttgccggccccatgcctgtcacacacagctccgccgctcaacggagagggcgcatcggccggaatcccaaaaacgagaatgaccagtacatttacatgggagaaccgctggagaacgacgaagattgcgcccactggaaggaggcgaaaatgctcctggacaatatcaacacccctgagggcatcattccctctatgtttgaacctgagagagaaaaggtggatgccatcgacggggagtatcgcctgagaggagaagctcggaaaacgttcgttgatctcatgcgcagaggcgaccttcccgtgtggctggcctaccgggtcgctgccgaggggattaactatgctgatcgcagatggtgttttgacggaatcaagaataaccagattctggaggaaaatgtggaggttgaaatctggacaaaggagggcgagcggaaaaagctcaaacctagatggctggatgcccgcatttacagcgacccccttgcgctgaaggagttcaaagagttcgccgctgggcggaagtccctcaccctgaacctgatcacagaaatgggcagactcccgacctttatgacgcagaaggcccgcaatgctcttgataacctggccgtgctgcataccgccgaggctggaggccgggcgtataatcacgccctctctgaactgcctgagacacttgagaccctgctcctgctgacactccttgctaccgtcacagggggaatcttcctgtttctgatgagcggcaaagggattggaaagatgaccctcggcatgtgctgcatcattacggcctccatcctgctttggtacgcccaaattcagccccattggatcgctgccagcatcattctggagttctttctcatcgtgctgctgattcccgagcctgaaaaacagagaacaccgcaggacaaccaactcacctatgtcgtgatcgcgattcttaccgttgtggccgctacaatggccaatgagatgggcttcctggaaaagaccaaaaaggattttgggctgggatctatcgctacacagcagcccgagtccaacatcctcgacattgacctgcggcctgccagcgcgtggacgctttacgccgtggctaccacattcatcacccccatgctgcgccactccattgaaaattctagcgtcaacgtttccctcacagccatcgctaatcaggccaccgtgctgatgggcctggggaagggatggcctctctctaaaatggatattggcgtgccccttctggctatcgggtgttacagccaagtcaaccctattacgctgaccgccgcgctcctgcttctggtggcccactatgctatcatcggaccgggcctccaggccaaggctacaagagaagcccagaaacgggccgcggctggcattatgaagaatcccaccgttgacgggatcacagtgattgatctggaccctatcccctacgatcctaaatttgagaagcagctgggacaagtcatgctccttgtgctgtgcgtcacccaggtgctgatgatgcgcacgacatgggccctctgtgaagctctgacccttgccacaggccccatttccaccctgtgggaggggaacccgggaagattctggaataccacaatcgccgttagcatggctaacatctttcggggctcttatctcgccggggcgggactgctgttctccattatgaagaacacgaccaatacacgcagaggcaccggcaacacaggggaaaccctcggagagaaatggaagaatcggcttaacagcctgggcaaatctgagtttcagatctacaagcgctccgggattcaagaagtggacagaacgctggccaaagagggaatcaagcggggcgaaacagatcatcacgctgtcagcagagggtctgccaaactccgctggttcgtggagcggaatctggttacccctgagggaaaggtggtcgaccttggctgcggcagagggggatggagctattactgtggcgggctgaagaacgtgcgcgaagtgaaaggactcaccaagggcgggcccggacatgaggaacccattcctatgtccacatatggctggaatctggttcggctgcagtctggcgtcgatgtgttctttacaccccctgagaaatgcgacaccctcctttgtgatatcggggaaagctccccgaaccccacggtggaggctggaagaaccctgcgcgtcctgaatctcgttgagaactggctgaataacaatacacagttctgcatcaaggtgcttaacccttacatgcccagcgtgattgagaagatggagaccctgcagcggaagtacggcggggccctcgtcagaaatcctctgtcccgcaactctacacacgaaatgtattgggtgagcaacgcgtccggaaatatcgtttctagcgtgaacatgatttcccggatgctgatcaatagatttaccatgcgccataagaaagccacgtacgagcccgacgtcgatctcggctctgggacccggaacattggaatcgaaagcgagacaccgaatcttgacatcattggcaagagaatcgagaaaattaagcaagaacacgagacctcctggcactatgaccaggatcatccttacaaaacatgggcttatcacggcagctacgaaaccaagcagacagggtctgcctccagcatggtgaacggagttgtgcgcctgctgaccaagccctgggacgtcatccctatggtgacgcagatggctatgacagataccacccccttcggccaacagagagtgtttaaagagaaggtcgacacacggacgcaggaacctaaagaggggaccaagaaactcatgaagattacagccgagtggctgtggaaggaacttggcaaaaagaaaacccccagaatgtgtacaagagaggagttcgctcggaaggttagatctaatgccgcgctgggcgccatctttaccgatgagaacaaatggaagtccgctcgggaggccgtggaagacagccgcttctgggagctcgtggataaagaaagagacctgcatctggaggggaagtgcgaaacatgtgtctataatatgatgggaaagcgggagaaaaagattggcgagtttggcaaagctaaggggtctcgcgccatctggtacatgtggctcggagccagattcctggaatttgaggcgcttggcttcctgaacgaagatcactggttttcccgggagaatagcctctccggggtggaaggagagggcctgcacaaacttgggtacatcctgcgcgaggttagcaagaaggaaggcggagctatgtatgccgacgataccgccggctgggacacgagaattaccctcgaggacctgaaaaacgaagagatggtgacaaatcatatggaaggggagcacaagaaactggctgaggccatcttcaagctcacctaccagaacaaagtcgtgcgggttcaacgcccgacacctagaggaaccgtgatggatattatctctcggcgcgaccagagaggcagcgggcaggtcggaacgtatggcctgaatacattcaccaacatgggggctcaacttattcggcagatggaaggcgagggagtgtttaagggcatccagcatctgacagccaccgaagaggttgcggtgcaggattggctcgcccgcgtcgggagagagcggctgtccagaatggctatctctggagacgattgcgtggtcaagccccttgacgatcgcttcgccaacgctctgacggccctcaatgacatgggcaaagtgcggaaggatattcaacagtgggaacccagcagagggtggtccgactggacccaggttcctttttgctctcaccatttccacgagctgatcatgaaagatggacgcgtgctggtcgtgccgtgtcggaaccaggacgaactcattggcagagcgcgcatcagccaaggggccggctggtccctgcgggagacagcttgccttggaaagtcttacgcccagatgtggagcctgatgtattttcacagacgcgatctccggctggctgccaatgctatttgttccgccgtgcccagccattgggttcctacctctagaacaacctggtccatccacgcgcgccatgaatggatgacaaccgaggacatgcttacggtgtggaaccgggtctggatccaggagaatccctggatggaagacaaaacacctgtggagagctgggaagagattccctacctgggcaagagagaagatcagtggtgcgggtctctcatcggactgacctcccgggccacctgggctagaaacattcaaacagccatcaatcaggttcgcagcctgattggctccgaggagtataccgactacatgccttctatgaagcggttcagacgcgaagaggaagaggccggggtgctctggtga

SEQ ID NO: 19575 - RNA, 9876 nt, synthetic construct
  misc_feature 1..9876: note = derived and/or modified CDS sequence (opt5) from DENV-2__KF041235__SS-prME
  source 1..9876: mol_type = other RNA
accgccggagtgatcattatgctgatccccaccgctatggccttccacctcacgaccagaaacggggaacctcatatgattgtcagcaagcaggaaaaaggaaagtccctgctttttaaaacagaagacggcgttaatatgtgcaccctgatggcgatggatctcggggaactgtgtgaagacacaatcacctacaactgcccccttctgcggcaaaatgaacccgaagatattgactgttggtgcaactctacaagcacctgggtgacgtatggaacctgtacagctaccggcgaacaccgcagagaaaagcggtccgtggccctcgtccctcatgtggggatgggactggagacacgcaccgaaacgtggatgtctagcgagggcgcctggaaacacgctcagagaatcgagacatggatcctgcggcatcccggcttcaccattatggccgctatcctcgcctacacaattgggaccacctattttcagcgcgttctgatcttcattcttctgacagcggtggccccttccatgacgatgagatgcatcggaatttctaatcgggattttgtcgaaggcgtgagcgggggatcctgggttgacatcgtgctcgagcacggcagctgtgtcaccacaatggctaagaacaagcccaccctggatttcgaacttatcaaaacagaggccaagcagcctgctaccctgcgcaaatactgcattgaagccaagctcacgaatacaaccaccgcgtctagatgtccgacacaaggggagccctccctgaacgaggaacaggacaaacggtttgtgtgcaagcacagcatggtggatcgcggatggggcaatggctgtgggctgttcggaaagggcgggatcgtgacctgcgccatgtttacatgcaaaaagaacatggagggaaaaattgttcagcctgaaaatctcgagtatacgatcgtggtgacaccccattctggcgaagagaacgctgtcgggaatgacacaggaaagcacggcaaagagattaaggtgacccctcagtccagcatcacagaagccgagctgaccggctacgggacggttaccatggaatgttctcccagaacaggacttgatttcaacgagatggtgctgctccaaatggaaaataaggcttggctggtccatcggcagtggtttcttgacctgccgctcccttggctgcccggcgccgatatccaggggtccaactggattcagaaggagaccctggtgacattcaagaaccctcacgccaaaaagcaagacgttgtggtcctcggaagccaggagggcgctatgcacaccgcgctgacgggggccacagaaatccagatgtcctctggcaatcttctgtttaccggacatctcaaatgccgcctgagaatggacaaacttcaactgaaaggcatgagctattccatgtgtacagggaagttcaaggtggtcaaagagattgctgaaacccagcacggaaccatcgtggttcgggtgcagtacgagggcgatgggagcccctgcaagattcccttcgagatcatggacctcgagaagcggcatgtcctgggacgcctgatcacagtgaaccctattgttacggagaaggattctccggtgaatatcgaagccgagcccccttttggcgactcctacattatcattggggtcgaacccggccagctcaaactgagctggttcaagaagggatctagcatcggccaaatgtttgagaccacaatgagaggggccaaaagaatggctattcttggagataccgcctgggacttcggctccctcggaggggtgtttacatctatcggcaaggcgctccaccaggtgttcggggctatctatggcgccgcctttagcggagtttcctggaccatgaaaattctgatcggcgtcgtgattacgtggatcgggatgaacagccgctctacatccctgagcgtgtctcttgtcctcgtgggagttgtgaccctgtacctgggcgtcatggtgcaggctgattccgggtgtgttgtgagctggaagaataaagagctcaagtgcggatccggcattttcatcaccgacaacgtccatacatggaccgaacagtataagtttcaacctgagtctcccagcaaactggcctccgctatccagaaggcccacgaagaggggatttgtggcatccggtctgtgacaagacttgaaaatctgatgtggaaacagattacgccggagctcaaccacatcctgagcgagaatgaagttaagctgtccattatgaccggagatatcaaaggcatcatgcaggcggggaagcgcagccttcggcctcaacccacagagctcaaatactcttggaagacctggggaaaggccaaaatgctgtccacagaacctcataaccagaccttcctgattgacggccccgagacggctgaatgccctaataccaacagagcctggaatagcctcgaggtggaggattatgggtttggagtcttcacaaccaacatctggctgaaacttaaagaacgccaggacgtgttttgtgactctaagctgatgtccgctgccattaaagataatcgggcggtgcacgccgacatgggctactggatcgagagcgctctcaacgatacatggaagattgaaaaggcctctttcatcgaggtcaaaagctgccattggcccaagtcccacaccctgtggagcaacggcgttctggagtctgaaatgatcattccgaaaaatttcgctgggcctgtgtcccagcacaactatagacccggataccatacacaaaccgccggcccctggcaccttgggaagctcgagatggactttgatttctgtgaaggaacgacagtggtcgtgaccgaggactgcggcaatcgcgggcctagcctgcggaccacaaccgcctccggaaaactgatcacggaatggtgctgtagatcttgcacactcccgcccctgcggtaccgcggcgaggatggctgttggtatgggatggagattagacctcttaaggaaaaggaggaaaacctggttaatagcctcgtgaccgctggacatggccagatcgacaacttttccctgggggtcctgggaatggcgcttttcctcgaggaaatgctgcggacaagagtgggcaccaaacacgccgttctgctcgtggctgtctcttttatgacactgattaccgggaatatgagcttccgcgatcttggacgggtgatggttatggtgggcgccgccatgacggacgatatcggcatgggggtcacctacctggctctcctggccgcgtttaaggtgagacccacattcgctgccggactgcttctgcgcaaactcacctccaaggagctgatgatgacaaccattggcatcgtgctcctgtctcagagcacgacacctgagaccatccttgaactgacagacgccctcgctctggggatgatgattctgaaaatcgtcagaaacatggagaagtatcaacttgccgttaccattatggcgatcctgtgcgtgcccaatgctgtgattctccagaacgcctggaaggtctcctgtaccatcctggccgctgtgagcgtttctcctctcctgcttacatccagccagcagaaagccgattggatccccctggctctcacgattaagggactgaatccgaccgccatctttctgacaaccctttctcggacaaacaaaaagcgctcctggcctctgaatgaagcgattatggccgtgggcatggtcagcatcctcgcttcttccctgctcaaaaacgacattcccatgaccgggcctctggtggccggaggccttctgacggtttgctacgtgctgacaggcagaagcgctgacctcgagctggaacgggccgccgatgtccgctgggaggaccaagctgagatctccgggagctctcccatccttagcattaccatctccgaagatggatctatgagcattaagaatgaggaagaggagcagaccctgacaatcctcattagaaccggcctgctcgtgatctccgggctgttcccggtctctattcctatcacagcggccgcttggtatctttgggaagtgaaaaagcagcgggccggagttctgtgggacgtgcccagccctccgcccgtcggcaaggccgagctggaagatggggcttaccgcatcaaacagaaggggattctcggctattcccaaatcggcgccggggtgtacaaagagggaacgtttcataccatgtggcacgttacaagaggcgcggtgctgatgcacaaggggaaacggattgaaccttcttgggctgacgtccgcaaggatcttatcagctacggaggcgggtggaagctggagggagagtggaaagaaggcgaggaagtccaggtgctcgccctggagccgggcaagaaccccagagccgttcagaccaaacctgggctgttcaagacaaacaccggaacgattggcgctgtctccctggactttagccccgggacctctggatcccctatcgtggataaaaagggcaaggtggtcgggctttatggaaatggcgtggttacacggagcggcacctacgtgtctgccatcgcgcagacagaaaaatccattgaggacaaccccgagatcgaagatgacattttcagaaagaaacgcctgaccatcatggatctgcatcctggggctggaaagacaaaacggtatctcccggccattgtcagagaggccatcaagcgcggcctgcggacgcttatcctggctcccaccagagtggttgccgctgaaatggaggaagccctccgcgggctgcctattcggtaccaaacacccgcgatcagagccgagcacaccggacgcgagattgtggacctcatgtgtcatgctaccttcacaatgcggctgcttagccctgtcagagtgcccaattataacctgatcattatggacgaagcccactttacggatccggcttccatcgccgcccggggctacatttctacccgcgttgagatgggggaagctgcgggcatcttcatgacagccacccctcccggaagcagagacccctttcctcagtccaatgctcccatcatggatgaggagcgggaaattcctgagcgcagctggaactctggccatgaatgggtgacagacttcaaggggaaaaccgtctggtttgtgccgtccatcaaggccggaaatgatattgccgcttgcctgcgcaaaaacggcaagaaagtgatccagctcagccggaagacgttcgactctgagtatattaagacaagaaccaatgattgggactttgtcgttaccacagatatcagcgaaatgggggccaacttcaaagcggagcgcgtgatcgacccccggagatgtatgaagcctgtgattctgaccgatggagaggaacgcgtcatccttgctggccccatgcctgtgacacactcctctgccgcccaacggagagggcgcattggccggaatcccaaaaacgagaatgaccagtacatctacatgggagaaccgctggagaacgacgaagattgcgctcactggaaggaggccaaaatgctcctggacaatattaacacccctgagggcatcatccccagcatgtttgaacctgagagagaaaaggttgatgcgattgacggggagtatcgcctgagaggagaagcccggaaaacgttcgtggatctcatgcgcagaggcgaccttcccgtctggctggcttaccgggtggccgctgaggggatcaactatgccgatcgcagatggtgttttgacggaattaagaataaccagatcctggaggaaaatgttgaggtggaaatttggacaaaggagggcgagcggaaaaagctcaaacctagatggctggatgctcgcatctactccgacccccttgccctgaaggagttcaaagagttcgcggccgggcggaagtctctcaccctgaacctgattacagaaatgggcagactcccgacctttatgacgcagaaggctcgcaatgcccttgataacctggctgtcctgcataccgccgaggccggaggccgggcttataatcacgcgctcagcgaactgcctgagacacttgagaccctgctcctgctgacactccttgccaccgtgacagggggaatcttcctgtttctgatgtccggcaaagggatcggaaagatgaccctcggcatgtgctgcattatcacggctagcattctgctttggtacgcccaaatccagccccattggattgccgcttctatcatcctggagttctttctcattgtcctgctgatccccgagcctgaaaaacagagaacaccgcaggacaaccaactcacctatgtggttattgccatccttaccgtggtggcggccacaatggctaatgagatgggcttcctggaaaagaccaaaaaggattttgggctgggatccattgccacacagcagcccgagagcaacatcctcgacatcgacctgcggcctgcttccgcctggacgctttacgcggtcgccaccacattcattacccccatgctgcgccactctatcgagaatagctccgttaacgtgtctctcacagctattgccaatcaggctaccgtgctgatgggcctggggaagggatggcctctcagcaaaatggatatcggcgtcccccttctggccattgggtgttactcccaagtgaaccctatcacgctgaccgctgccctcctgcttctggttgcgcactatgccattatcggaccgggcctccaggctaaggccacaagagaagctcagaaacgggccgccgcgggcatcatgaagaatcccaccgtggacgggattacagtcatcgatctggaccctattccctacgatcctaaatttgagaagcagctgggacaagtgatgctccttgtcctgtgcgtgacccaggttctgatgatgcgcacgacatgggctctctgtgaagccctgacccttgctacaggccccatcagcaccctgtgggaggggaacccgggaagattctggaataccacaattgccgtgtctatggccaacatctttcggggctcctatctcgctggggccggactgctgttcagcatcatgaagaacacgaccaatacacgcagaggcaccggcaacacaggggaaaccctcggagagaaatggaagaatcggcttaactctctgggcaaatccgagtttcagatttacaagcgcagcgggatccaagaagtcgacagaacgctggcgaaagagggaattaagcggggcgaaacagatcatcacgccgtgtctagagggagcgctaaactccgctggttcgttgagcggaatctggtgacccctgagggaaaggtcgtggaccttggctgcggcagagggggatggtcctattactgtggcgggctgaagaacgtgcgcgaagttaaaggactcaccaagggcgggcccggacatgaggaacccatccctatgtctacatatggctggaatctggtccggctgcagagcggcgtggatgtgttctttacaccccctgagaaatgcgacaccctcctttgtgatattggggaatccagcccgaaccccacggtcgaggccggaagaaccctgcgcgttctgaatctcgtggagaactggctgaataacaatacacagttctgcatcaaggtgcttaacccttacatgccctccgtcatcgagaagatggagaccctgcagcggaagtacggcggggctctcgtgagaaatcctctgtctcgcaacagcacacacgaaatgtattgggtttccaacgcctctggaaatattgtgagctccgtcaacatgatctctcggatgctgattaatagatttaccatgcgccataagaaagcgacgtacgagcccgacgtggatctcggcagcgggacccggaacatcggaattgaatccgagacaccgaatcttgacatcatcggcaagagaattgagaaaatcaagcaagaacacgagaccagctggcactatgaccaggatcatccttacaaaacatgggcctatcacggctcttacgaaaccaagcagacagggtccgctagctctatggttaacggagtggtccgcctgctgaccaagccctgggacgtgattcctatggtgacgcagatggccatgacagataccacccccttcggccaacagagagtctttaaagagaaggttgacacacggacgcaggaacctaaagaggggaccaagaaactcatgaagatcacagctgagtggctgtggaaggaacttggcaaaaagaaaacccccagaatgtgtacaagagaggagttcgcccggaaggtgagatccaatgctgccctgggcgcgatttttaccgatgagaacaaatggaaaagcgcccgggaggctgtggaagactctcgcttctgggagctcgtcgataaagaaagaaatctgcatctggaggggaagtgcgaaacatgtgtgtataacatgatgggaaagcgggagaaaaagatcggcgagtttggcaaagccaaggggtcccgcgctatttggtacatgtggctcggagccagattcctggaatttgaggcccttggcttcctgaatgaagaccactggtttagccgggagaactccctcagcggggttgaaggagagggcctgcacaaacttgggtacatcctgcgcgaggtgtctaagaaggaaggcggagcgatgtatgctgatgacaccgccggctgggatacgagaatcaccctcgaggacctgaaaaatgaagagatggtcacaaaccatatggaaggggagcacaagaaactggccgaggctattttcaagctcacctaccagaataaagtggttcgggtgcaacgcccgacacctagaggaaccgtcatggacatcattagccggcgcgatcagagaggctccggacaggtgggaacgtatggcctgaacacattcaccaacatgggggcccaacttatccggcagatggaaggcgagggagtttttaagggcattcagcatctgacagctaccgaagaggtggccgtccaggactggctcgcgcgcgtggggagagagcggctgtctagaatggccatcagcggagatgactgcgtcgtgaagccccttgatgaccgcttcgcttccgccctgacggctctcaatgatatgggcaaagttcggaaggacatccaacagtgggaaccctctagagggtggaacgattggacccaggtgcctttttgcagccaccatttccacgagctgattatgaaagacggacgcgtcctggtggtgccgtgtcggaatcaggatgaactcatcggcagagcccgcatttcccaaggggcgggctggtctctgcgggagacagcctgccttggaaagagctacgctcagatgtggtccctgatgtattttcacagacgcgacctccggctggccgctaacgccatctgtagcgctgttccctctcattgggtgcctacctccagaacaacctggagcattcacgcccgccatgaatggatgacaaccgaggatatgcttacggtctggaatcgggtgtggatccaggagaacccctggatggaagacaaaacacctgttgagtcttgggaagagatcccctacctgggcaagagagaagaccagtggtgcgggtccctcattggactgaccagccgggcgacctgggccagaaatatccaaacagctattaaccaggtgcgctccctgatcggctctgaggagtataccgattacatgcctagcatgaagcggttcagacgcgaagaggaagaggccggggtcctctggtga

SEQ ID NO: 19576 - RNA, 9876 nt, synthetic construct
  misc_feature 1..9876: note = derived and/or modified CDS sequence (opt5) from DENV-2__KF041237__SS-prME
  source 1..9876: mol_type = other RNA
accgccggagtgatcattatgctgatccccaccgctatggccttccacctcacgaccagaaacggggaacctcatatgattgtcagcaagcaggaaaaaggaaagtccctgctttttaaaacagaagacggcgttaatatgtgcaccctgatggcgatggatctcggggaactgtgtgaagacacaatcacctacaactgcccccttctgcggcaaaatgaacccgaagatattgactgttggtgcaactctacaagcacctgggtgacgtatggaacctgtacagctaccggcgaacaccgcagagaaaagcggtccgtggccctcgtccctcatgtggggatgggactggagacacgcaccgaaacgtggatgtctagcgagggcgcctggaaacacgctcagagaatcgagacatggatcctgcggcatcccggcttcaccattatggccgctatcctcgcctacacaattgggaccacctattttcagcgcgttctgatcttcattcttctgacagcggtggccccttccatgacgatgagatgcatcggaatttctaatcgggattttgtcgaaggcgtgagcgggggatcctgggttgacatcgtgctcgagcacggcagctgtgtcaccacaatggctaagaacaagcccaccctggatttcgaacttatcaaaacagaggccaagcagcctgctaccctgcgcaaatactgcattgaagccaagctcacgaatacaaccaccgcgtctagatgtccgacacaaggggagccctccctgaacgaggaacaggacaaacggtttgtgtgcaagcacagcatggtggatcgcggatggggcaatggctgtgggctgttcggaaagggcgggatcgtgacctgcgccatgtttacatgcaaaaagaacatggagggaaaaattgttcagcctgaaaatctcgagtatacgatcgtggtgacaccccattctggcgaagagaacgctgtcgggaatgacacaggaaagcacggcaaagagattaaggtgacccctcagtccagcatcacagaagccgagctgaccggctacgggacggttaccatggaatgttctcccagaacaggacttgatttcaacgagatggtgctgctccaaatggaaaataaggcttggctggtccatcggcagtggtttcttgacctgccgctcccttggctgcccggcgccgatatccaggggtccaactggattcagaaggagaccctggtgacattcaagaaccctcacgccaaaaagcaagacgttgtggtcctcggaagccaggagggcgctatgcacaccgcgctgacgggggccacagaaatccagatgtcctctggcaatcttctgtttaccggacatctcaaatgccgcctgagaatggacaaacttcaactgaaaggcatgagctattccatgtgtacagggaagttcaaggtggtcaaagagattgctgaaacccagcacggaaccatcgtggttcgggtgcagtacgagggcgatgggagcccctgcaagattcccttcgagatcatggacctcgagaagcggcatgtcctgggacgcctgatcacagtgaaccctattgttacggagaaggattctccggtgaatatcgaagccgagcccccttttggcgactcctacattatcattggggtcgaacccggccagctcaaactgagctggttcaagaagggatctagcatcggccaaatgtttgagaccacaatgagaggggccaaaagaatggctattcttggagataccgcctgggacttcggctccctcggaggggtgtttacatctatcggcaaggcgctccaccaggtgttcggggctatctatggcgccgcctttagcggagtttcctggaccatgaaaattctgatcggcgtcgtgattacgtggatcgggatgaacagccgctctacatccctgagcgtgtctcttgtcctcgtgggagttgtgaccctgtacctgggcgtcatggtgcaggctgattccgggtgtgttgtgagctggaagaataaagagctcaagtgcggatccggcattttcatcaccgacaacgtccatacatggaccgaacagtataagtttcaacctgagtctcccagcaaactggcctccgctatccagaaggcccacgaagaggggatttgtggcatccggtctgtgacaagacttgaaaatctgatgtggaaacagattacgccggagctcaaccacatcctgagcgagaatgaagttaagctgtccattatgaccggagatatcaaaggcatcatgcaggcggggaagcgcagccttcggcctcaacccacagagctcaaatactcttggaagacctggggaaaggccaaaatgctgtccacagaacctcataaccagaccttcctgattgacggccccgagacggctgaatgccctaataccaacagagcctggaatagcctcgaggtggaggattatgggtttggagtcttcacaaccaacatctggctgaaacttaaagaacgccaggacgtgttttgtgactctaagctgatgtccgctgccattaaagataatcgggcggtgcacgccgacatgggctactggatcgagagcgctctcaacgatacatggaagattgaaaaggcctctttcatcgaggtcaaaagctgccattggcccaagtcccacaccctgtggagcaacggcgttctggagtctgaaatgatcattccgaaaaatttcgctgggcctgtgtcccagcacaactatagacccggataccatacacaaaccgccggcccctggcaccttgggaagctcgagatggactttgatttctgtgaaggaacgacagtggtcgtgaccgaggactgcggcaatcgcgggcctagcctgcggaccacaaccgcctccggaaaactgatcacggaatggtgctgtagatcttgcacactcccgcccctgcggtaccgcggcgaggatggctgttggtatgggatggagattagacctcttaaggaaaaggaggaaaacctggttaatagcctcgtgaccgctggacatggccagatcgacaacttttccctgggggtcctgggaatggcgcttttcctcgaggaaatgctgcggacaagagtgggcaccaaacacgccgttctgctcgtggctgtctcttttatgacactgattaccgggaatatgagcttccgcgatcttggacgggtgatggttatggtgggcgccgccatgacggacgatatcggcatgggggtcacctacctggctctcctggccgcgtttaaggtgagacccacattcgctgccggactgcttctgcgcaaactcacctccaaggagctgatgatgacaaccattggcatcgtgctcctgtctcagagcacgacacctgagaccatccttgaactgacagacgccctcgctctggggatgatgattctgaaaatcgtcagaaacatggagaagtatcaacttgccgttaccattatggcgatcctgtgcgtgcccaatgctgtgattctccagaacgcctggaaggtctcctgtaccatcctggccgctgtgagcgtttctcctctcctgcttacatccagccagcagaaagccgattggatccccctggctctcacgattaagggactgaatccgaccgccatctttctgacaaccctttctcggacaaacaaaaagcgctcctggcctctgaatgaagcgattatggccgtgggcatggtcagcatcctcgcttcttccctgctcaaaaacgacattcccatgaccgggcctctggtggccggaggccttctgacggtttgctacgtgctgacaggcagaagcgctgacctcgagctggaacgggccgccgatgtccgctgggaggaccaagctgagatctccgggagctctcccatccttagcattaccatctccgaagatggatctatgagcattaagaatgaggaagaggagcagaccctgacaatcctcattagaaccggcctgctcgtgatctccgggctgttcccggtctctattcctatcacagcggccgcttggtatctttgggaagtgaaaaagcagcgggccggagttctgtgggacgtgcccagccctccgcccgtcggcaaggccgagctggaagatggggcttaccgcatcaaacagaaggggattctcggctattcccaaatcggcgccggggtgtacaaagagggaacgtttcataccatgtggcacgttacaagaggcgcggtgctgatgcacaaggggaaacggattgaaccttcttgggctgacgtccgcaaggatcttatcagctacggaggcgggtggaagctggagggagagtggaaagaaggcgaggaagtccaggtgctcgccctggagccgggcaagaaccccagagccgttcagaccaaacctgggctgttcaagacaaacaccggaacgattggcgctgtctccctggactttagccccgggacctctggatcccctatcgtggataaaaagggcaaggtggtcgggctttatggaaatggcgtggttacacggagcggcacctacgtgtctgccatcgcgcagacagaaaaatccattgaggacaaccccgagatcgaagatgacattttcagaaagaaacgcctgaccatcatggatctgcatcctggggctggaaagacaaaacggtatctcccggccattgtcagagaggccatcaagcgcggcctgcggacgcttatcctggctcccaccagagtggttgccgctgaaatggaggaagccctccgcgggctgcctattcggtaccaaacacccgcgatcagagccgagcacaccggacgcgagattgtggacctcatgtgtcatgctaccttcacaatgcggctgcttagccctgtcagagtgcccaattataacctgatcattatggacgaagcccactttacggatccggcttccatcgccgcccggggctacatttctacccgcgttgagatgggggaagctgcgggcatcttcatgacagccacccctcccggaagcagagacccctttcctcagtccaatgctcccatcatggatgaggagcgggaaattcctgagcgcagctggaactctggccatgaatgggtgacagacttcaaggggaaaaccgtctggtttgtgccgtccatcaaggccggaaatgatattgccgcttgcctgcgcaaaaacggcaagaaagtgatccagctcagccggaagacgttcgactctgagtatattaagacaagaaccaatgattgggactttgtcgttaccacagatatcagcgaaatgggggccaacttcaaagcggagcgcgtgatcgacccccggagatgtatgaagcctgtgattctgaccgatggagaggaacgcgtcatccttgctggccccatgcctgtgacacactcctctgccgcccaacggagagggcgcattggccggaatcccaaaaacgagaatgaccagtacatctacatgggagaaccgctggagaacgacgaagattgcgctcactggaaggaggccaaaatgctcctggacaatattaacacccctgagggcatcatccccagcatgtttgaacctgagagagaaaaggttgatgcgattgacggggagtatcgcctgagaggagaagcccggaaaacgttcgtggatctcatgcgcagaggcgaccttcccgtctggctggcttaccgggtggccgctgaggggatcaactatgccgatcgcagatggtgttttgacggaattaagaataaccagatcctggaggaaaatgttgaggtggaaatttggacaaaggagggcgagcggaaaaagctcaaacctagatggctggatgctcgcatctactccgacccccttgccctgaaggagttcaaagagttcgcggccgggcggaagtctctcaccctgaacctgattacagaaatgggcagactcccgacctttatgacgcagaaggctcgcaatgcccttgataacctggctgtcctgcataccgccgaggccggaggccgggcttataatcacgcgctcagcgaactgcctgagacacttgagaccctgctcctgctgacactccttgccaccgtgacagggggaatcttcctgtttctgatgtccggcaaagggatcggaaagatgaccctcggcatgtgctgcattatcacggctagcattctgctttggtacgcccaaatccagccccattggattgccgcttctatcatcctggagttctttctcattgtcctgctgatccccgagcctgaaaaacagagaacaccgcaggacaaccaactcacctatgtggttattgccatccttaccgtggtggcggccacaatggctaatgagatgggcttcctggaaaagaccaaaaaggattttgggctgggatccattgccacacagcagcccgagagcaacatcctcgacatcgacctgcggcctgcttccgcctggacgctttacgcggtcgccaccacattcattacccccatgctgcgccactctatcgagaatagctccgttaacgtgtctctcacagctattgccaatcaggctaccgtgctgatgggcctggggaagggatggcctctcagcaaaatggatatcggcgtcccccttctggccattgggtgttactcccaagtgaaccctatcacgctgaccgctgccctcctgcttctggttgcgcactatgccattatcggaccgggcctccaggctaaggccacaagagaagctcagaaacgggccgccgcgggcatcatgaagaatcccaccgtggacgggattacagtcatcgatctggaccctattccctacgatcctaaatttgagaagcagctgggacaagtgatgctccttgtcctgtgcgtgacccaggttctgatgatgcgcacgacatgggctctctgtgaagccctgacccttgctacaggccccatcagcaccctgtgggaggggaacccgggaagattctggaataccacaattgccgtgtctatggccaacatctttcggggctcctatctcgctggggccggactgctgttcagcatcatgaagaacacgaccaatacacgcagaggcaccggcaacacaggggaaaccctcggagagaaatggaagaatcggcttaactctctgggcaaatccgagtttcagatttacaagcgcagcgggatccaagaagtcgacagaacgctggcgaaagagggaattaagcggggcgaaacagatcatcacgccgtgtctagagggagcgctaaactccgctggttcgttgagcggaatctggtgacccctgagggaaaggtcgtggaccttggctgcggcagagggggatggtcctattactgtggcgggctgaagaacgtgcgcgaagttaaaggactcaccaagggcgggcccggacatgaggaacccatccctatgtctacatatggctggaatctggtccggctgcagagcggcgtggatgtgttctttacaccccctgagaaatgcgacaccctcctttgtgatattggggaatccagcccgaaccccacggtcgaggccggaagaaccctgcgcgttctgaatctcgtggagaactggctgaataacaatacacagttctgcatcaaggtgcttaacccttacatgccctccgtcatcgagaagatggagaccctgcagcggaagtacggcggggctctcgtgagaaatcctctgtctcgcaacagcacacacgaaatgtattgggtttccaacgcctctggaaatattgtgagctccgtcaacatgatctctcggatgctgattaatagatttaccatgcgccataagaaagcgacgtacgagcccgacgtggatctcggcagcgggacccggaacatcggaattgaatccgagacaccgaatcttgacatcatcggcaagagaattgagaaaatcaagcaagaacacgagaccagctggcactatgaccaggatcatccttacaaaacatgggcctatcacggctcttacgaaaccaagcagacagggtccgctagctctatggttaacggagtggtccgcctgctgaccaagccctgggacgtgattcctatggtgacgcagatggccatgacagataccacccccttcggccaacagagagtctttaaagagaaggttgacacacggacgcaggaacctaaagaggggaccaagaaactcatgaagatcacagctgagtggctgtggaaggaacttggcaaaaagaaaacccccagaatgtgtacaagagaggagttcgcccggaaggtgagatccaatgctgccctgggcgcgatttttaccgatgagaacaaatggaaaagcgcccgggaggctgtggaagactctcgcttctgggagctcgtcgataaagaaagaaatctgcatctggaggggaagtgcgaaacatgtgtgtataacatgatgggaaagcgggagaaaaagatcggcgagtttggcaaagccaaggggtcccgcgctatttggtacatgtggctcggagccagattcctggaatttgaggcccttggcttcctgaatgaagaccactggtttagccgggagaactccctcagcggggttgaaggagagggcctgcacaaacttgggtacatcctgcgcgaggtgtctaagaaggaaggcggagcgatgtatgctgatgacaccgccggctgggatacgagaatcaccctcgaggacctgaaaaatgaagagatggtcacaaaccatatggaaggggagcacaagaaactggccgaggctattttcaagctcacctaccagaataaagtggttcgggtgcaacgcccgacacctagaggaaccgtcatggacatcattagccggcgcgatcagagaggctccggacaggtgggaacgtatggcctgaacacattcaccaacatgggggcccaacttatccggcagatggaaggcgagggagtttttaagggcattcagcatctgacagctaccgaagaggtggccgtccaggactggctcgcgcgcgtggggagagagcggctgtctagaatggccatcagcggagatgactgcgtcgtgaagccccttgatgaccgcttcgcttccgccctgacggctctcaatgatatgggcaaagttcggaaggacatccaacagtgggaaccctctagagggtggaacgattggacccaggtgcctttttgcagccaccatttccacgagctgattatgaaagacggacgcgtcctggtggtgccgtgtcggaatcaggatgaactcatcggcagagcccgcatttcccaaggggcgggctggtctctgcgggagacagcctgccttggaaagagctacgctcagatgtggtccctgatgtattttcacagacgcgacctccggctggccgctaacgccatctgtagcgctgttccctctcattgggtgcctacctccagaacaacctggagcattcacgccggccatgaatggatgacaaccgaggatatgcttacggtctggaatcgcgtgtggatccaggagaacccctggatggaagacaaaacacctgttgagtcttgggaagagatcccctacctggggaagcgggaagaccagtggtgcggatccctcattggcctgaccagcagagcgacctgggcccggaatatccaaacagctattaaccaggtgagatccctgatcgggtctgaggagtataccgattacatgcctagcatgaagcgcttccggagagaagaggaagaggccggagtcctctggtga

SEQ ID NO: 19577 - RNA, 9876 nt, synthetic construct
  misc_feature 1..9876: note = derived and/or modified CDS sequence (opt5) from DENV-2__KM217156__SS-prME
  source 1..9876: mol_type = other RNA
accgccggcgtgatcattatgctgatccccaccgctatggccttccacctcacgaccagaaatggggaacctcatatgattgttagcaagcaggaaaaggggaagtccctgctttttaaaaccgaagacggcgttaatatgtgcaccctgatggcgatggatctcggggaactgtgtgaagacacaatcacctacaactgcccccttctgcggcaaaatgaacccgaggatattgactgttggtgcaacgctacatctacctgggtgacgtatggaacctgtacagccaccggcgagcaccgcagagaaaagcggagcgtggccctcgtccctcatgtggggatgggactggagacacgcaccgaaacgtggatgtcctctgagggcgcttggaaacacgcccagagaatcgagacatggatcctgcggcatcccggcttcaccattatggctgccatcctcgcgtacacaattgggaccacctattttcagcgcgttctgatcttcattcttctgacagccgtggctcctagcatgacgatgagatgcatcggaatttccaatcgggattttgtcgaaggcgtgtctgggggaagctgggttgacatcgtgctcgagcacggctcctgtgtcaccacaatggccaagaacaagcccaccctggatttcgaacttatcaaaacagaggctaagcagcctgccaccctgcgcaaatactgcattgaagcgaagctcacgaatacaaccaccgccagcagatgtccgacacaaggggagccctctctgaacgaggaacaggacaaacggtttgtgtgcaagcactccatggtggatcgcggatggggcaatggctgtgggctgttcggaaagggcgggatcgttacctgcgctatgtttacatgcaaaaagaacatggagggaaaaattgtccagcctgaaaatctcgagtatacgatcgtggtgacaccccatagcggcgaagagaacgccgtcgggaatgacacaggaaagcacggcaaagagattaaggtgacccctcagtcttccatcacagaagctgagctgaccggctacgggacggttaccatggaatgtagccccagaacaggacttgatttcaacgagatggtgctgctccaaatggaaaataaagcctggctggtccatcggcagtggtttcttgacctgccgctcccttggctgcccggcgccgatatccaggggtctaactggattcagaaggagaccctggtgacattcaagaaccctcacgctaaaaagcaagacgttgtggtcctcggatcccaggagggcgcgatgcacaccgccctgacgggggctacagaaatccagatgagctccggcaatcccctttttaccggacatctgaaatgccgcctcagaatggacaagctgcaacttaaaggcatgtcttatagcatgtgtacagggaagttcaaggtggtcaaagagattgccgaaacccagcacggaaccatcgtggttcggattcagtacgagggcgatgggtccccctgcaagatccctttcgagatcatggacctggagaagcggcatgtgctcggacgcctgattacagtcaacccgatcgtgacggagaaggatagccccgttaatattgaagccgagcctccctttggcgactcttacatcattatcggggtggaacctggccagctgaaactctcctggttcaagaagggaagctctattggccaaatgtttgagaccacaatgagaggggctaaaagaatggccatcctgggagataccgcgtgggacttcggcagccttgggggagtctttacatccatcggcaaggctctgcaccaggtgttcggggccatttatggcgccgctttttctggagtgagctggaccatgaaaatcctcattggcgttgtcatcacgtggattgggatgaactcccgcagcacatctctgtccgtgagcctggtgcttgtcggagtggttaccctctacctgggcgtgatggtccaggccgattctgggtgtgtggtttcctggaagaataaagagctgaagtgcggaagcggcatcttctttaccgacaacgtgcatacatggaccgaacagtataagttccaacccgagtccccgtctaaactcgctagcgccatccagaaggcgcacgaagaggggatttgtggcatccggtccattacaagactggataatcttatgtggaaacagatcacgcctgaactgaaccacattctctctgagaatgaggtcaagctgagcatcatgaccggagacatcaaaggcattatgcaggccgggaagcgctccctgcggccccaacctacagaacttaaatacagctggaagacctggggaaaggctaaaatgctctctacagagccccataaccagacctttctgatcgatggccctgaaacggcccagtgccccaataccaacagagcttggaactccctggaggtggaagactatgggttcggagtttttacaaccaacatttggctcaagctgaaagagcgccaggacgtgttctgtgatagcaaacttatgtctgccgcgatcaaagacaatcgggccgtccacgctgatatgggctactggattgagtccgccctgaacgacacatggaagatcgaaaaggctagcttcatcgaggtgaaatcttgccattggcccaagagccacaccctctggtccaacggcgtgctggaaagcgagatgattatccctaaaaattttgccgggcccgtctctcaacacaactatagacccggataccatacacagaccgccggcccttggcacctggggaaacttgagatggatttcgacttttgtgaaggaacgacagttgtggtgaccgaggattgcggcaatcgcgggccgtccctccggaccacaaccgctagcggaaaactgattacggaatggtgctgtagatcctgcacactgccccctctccggtaccgcggcgaggacggctgttggtatgggatggaaatcagacccctgaaggagaaggaggaaaaccttgtcaattctctggtgaccgcgggacatggccagattgataacttcagcctcggggttctgggaatggccctgtttcttgaggaaatgctccggacaagagtgggcaccaaacacgctgtcctgctggtggccgtttccttcatgacactcatcaccgggaatatgtcttttcgcgacctgggacgggtgatggtcatggtgggcgccgctatgacggatgacattggcatgggggttacctaccttgccctgctcgcggctttcaaggtgagacctacatttgccgccggactgctgcttcgcaaactgaccagcaaggagctcatgatgacaaccatcggcatcgtcctgctctcccaatctacgacacccgaaaccattctggagcttacagatgctctggccctcgggatgatgatcctgaaaattgtgagaaacatggagaagtatcagctggcggtgaccatcatggctattctttgcgtccctaatgccgttatcctgcagaacgcctggaaggtgagctgtaccatcctcgctgccgtgtccgtcagccccctgctcctgacatcttcccagcaaaaagctgactggattccgcttgccctgacgatcaagggactcaatcctaccgcgattttcctgacaaccctgagccggacaaacaaaaagcgctcttggccccttaatgaagccatcatggctgtgggcatggtttccattctggccagctctctcctgaaaaacgacatccctatgaccgggcccctcgtggctggaggcctgcttacggtctgctacgtgctgacaggcagatccgccgatctggagctcgaacgggccgctgacgttcgctgggaggatcaggcggaaatcagcgggtccagcccgattctgtctatcaccattagcgaggacggatccatgtctatcaagaatgaggaagaggaacagacccttacaattctgatcagaaccggcctcctggtgattagcgggctctttcctgtctccatccccatcacagccgctgcctggtatctgtgggaggtgaaaaagcagcgggccggagtcctttgggatgtgccttctccgccccctgttggcaaggctgagctggaagacggggcctaccgcattaaacaaaagggaatcctgggctatagccagattggcgcgggggtgtacaaagagggaacgttccataccatgtggcacgtcacaagaggcgctgtgctcatgcacaaggggaaacggatcgaaccgtcctgggccgatgttcgcaaggacctgatttcttacggaggcgggtggaaacttgagggagaatggaaagagggcgaggaagtgcaggtcctggccctcgagcccggcaagaaccctagagctgtgcagaccaaacccgggctgtttaagacaaacaccggaacgatcggcgccgtgagcctcgatttctcccctgggaccagcggatctcccatcgttgacaaaaagggcaaggtcgtggggctgtatggaaatggcgtggtcacacggtccggcacctacgtgagcgcgattgctcaaacagaaaaatctatcgaggataaccctgaaattgaggacgatatcttcagaaagaaacgccttaccattatggacctgcatccgggggccggaaagacaaaacggtatctgcccgccatcgttagagaggctatcaagcgcggcctccggacgctgattcttgcccctaccagagtggtcgctgccgaaatggaggaagcgctgcgcgggctccccatccggtaccagacccctgccattagagctgagcacaccggacgcgaaatcgtggacctgatgtgtcatgccacctttacaatgcggctcctgtcccccgttagagtgccgaattataaccttattatcatggatgaggctcacttcacggaccctgccagcattgccgctcggggctacatctccacccgcgtcgagatgggggaagcggccggcatctttatgacagctacaccgcccggatctagagatcctttcccccagagcaatgcccctattatggacgaggaacgggagatcccggagcgctcctggaacagcggccatgaatgggtgacagattttaaggggaaaaccgtttggttcgtgccctctattaaggccggaaatgacatcgctgcctgcctgcgcaaaaacggcaagaaagtcattcaactgtcccggaagacgtttgatagcgagtatatcaagacaagaaccaatgactgggatttcgtggtgaccacagacatctctgaaatgggggcgaactttaaagctgagcgcgtcattgatcctcggagatgtatgaagcccgttatcctcaccgacggagaagaaagagtgattctggccggccctatgcccgtgacacacagctccgccgctcagcggagagggcgcatcggccggaatccgaaaaacgagaatgaccagtacatttacatgggagaacctcttgagaacgatgaagactgcgcccactggaaggaggcgaaaatgctgctcgataatatcaacacccccgaaggcatcattccttctatgttcgagcccgagagagaaaaggtcgacgccatcgatggggagtatcgcctgagaggagaagctcggaaaacgtttgtggacctgatgcgcagaggcgatctccctgtttggcttgcctaccgggtggctgccgaggggattaactatgctgaccgcagatggtgtttcgatggaatcaagaataaccagattctggaagagaatgtcgaggtggaaatctggacaaaggagggcgaacggaaaaagctgaaacccagatggctcgacgcccgcatttacagcgatccgctggcgcttaaggagttcaaagagtttgccgctgcccggaagtccctgaccctcaacctgatcacagaaatggggagactgcctaccttcatgacgcaaaaggctcgcaatgccctcgacaaccttgccgttctgcataccgctgaggcgggcggacgggcctataatcacgctctgtctgaactccccgagacactggaaacccttctgctcctgacactgctcgccaccgtgacaggcgggatctttcttttcctgatgagcggaaaaggcattgggaagatgaccctgggaatgtgctgcatcattacggcctccatcctcctgtggtacgctcagattcagccccattggatcgccgcgagcatcattcttgagtttttcctgatcgtcctcctgattcctgagccggaaaaacagagaacaccccaagataaccagctgacctatgtggtcatcgccattctcaccgtggttgctgccacaatggctaatgagatgggctttcttgaaaagaccaaaaaggacttcggcctggggtctatcgccacacagcagcctgagtccaacatcctggacattgatctccggcccgcgagcgcctggacgctgtacgctgtggccaccacatttatcacccctatgcttcgccactccattgaaaattctagcgtgaacgtctccctgacagctatcgccaatcaagctaccgttctcatgggactgggcaaggggtggcccctgtctaaaatggacattggagtgcctctccttgccatcggctgttacagccaggtgaacccgattacgctgaccgcggccctgctcctgcttgtcgctcactatgccatcatcgggcccggactgcaggctaaggcctccagagaggcccagaaacgggcggctgccggcattatgaagaatcctacagtggatggcatcaccgttattgacctcgatcccatcccttacgaccccaaattcgagaagcaactgggacaggtgatgctgctcattctttgcgtcacacaggtgctgatgatgcgcaccacgtgggctctgtgtgaagccctcacactggccaccggaccgatcagcacactttgggagggcaaccctgggagattttggaataccaccatcgctgtctctatggccaacattttccggggatcctatctggcgggcgccgggctcctgtttagcatcatgaagaacacaacgaatacccgcagaggaacaggcaacaccggcgaaacactgggggagaaatggaagaatcgggtgtctctccttggaaaatccgagttccaaatttacaagcgcagcggcatccaggaggttgatagaaccctggctaaagaggggattaagcggggagaaacggaccatcacgccgtgtctagaggcagcgctaaactgcgctggttcgtcgagcggaacctcgtgacacccgaagggaaggttgtggatctgggatgcggcagaggcgggtggtcctattactgtggaggccttaagaatgtccgcgaggtgaaagggctgaccaagggaggccccgggcatgaggaacctatccccatgtctacctatggatggaacctcgtgcggctgctgacaggcgccgacgtctttttcacccctccggagaaatgcgatacactcctttgtgacatcggcgaaagctcccccaatcctacggtcgaggcggggagaaccctgcgcgtgctgaacctcgtggaaaattggctgaacaataacacacagttttgcattaaggtccttaatccctacatgcctagcgttatcgagaaaatggagaccctgcagcggaagtacggaggcgccctcgtgagaaaccccctgtcccgcaattctacacacgaaatgtattgggtgagcaacgcttccgggaacattgtctctagcgtgaatatgatctcccggatgctgattaacagattcaccatgcgccataagaaagccacgtacgatccggacgttgacctcggatctggcacccggaatatcgggatcgagagcgaaacacctaaccttgatattatcggaaagagaattgagaaaatcaagcaagaacacgagacctcccgccactatgaccaggatcatccctacaaaacatgggcttatcacggcagctacgagaccaagcagacaggctctgcctccagcaccgtgaatggggtcgtgagactgctgacgaagccttgggacgttattcccatggtgacacagatggctatgaccgataccacaccttttggacaacagcgggtcttcaaagaaaaggtggacacgcgcacccaggagcccaaagaaggcacaaagaaactcatgaagatcaccgccgagtggctgtggaaggaacttgggaaaaagaaaacaccgagaatgtgtacccgggaggagtttgcgagaaaggtgcggtctaacgccgctctgggagccattttcacagatgaaaataaatggaagtccgctcgcgaggccgtcgaagacagcagattttgggagctcgttgataaagagcggaacctgcatctggaaggcaagtgcgagacctgtgtgtataatatgatggggaagcgcgagaagaagatcggagagttcggcaaagccaagggctctagagcgatctggtacatgtggctcggggctcggtttctggagttcgaggcccttggatttctgaacgaggaccactggttctcccgcgaaaatagcctctccggcgtggagggggaaggactgcacaaacttggctacattctgagagaggtcagcaagaaggaagggggcgccatgtatgctgatgacacggccggatgggacacccggatcacactcgaggatctgaaaaacgaggaaatggtgaccaatcatatggagggcgaacacaagaaactggctgaggccattttcaagctcacataccagaacaaagttgtgcgcgtccaaagacctacaccccgggggacggtgatggacatcatttctcgcagagatcagcggggaagcgttcaggtgggcacatatgggctgggaacctttacaaatatgggcgcgcaacttatccgccagatggaaggggagggcgtcttcaagggaatccagcatctgaccgccacggaggaagtggctgttcaggactggctcgccagagtgggccgggagagactgtcccgcatggctatttctggggatgactgcgtcgtgaagccccttgatgaccggtttgccagcgcgctgaccgccctcaacgatatgggaaaagtcagaaaggacatccaacagtgggaaccttcccgcggctggaacgattggacacaggtgccgttctgctctcaccattttcacgagctgattatgaaagacgggcgggttctggtggtcgcttgtagaaatcaggatgagctcatcggacgcgcccggattagccaaggcgctgggtggtccctgagagaaaccgcctgccttggcaagtcttacgctcagatgtggagcctgatgtatttccaccgccgggacctcagactggccgcgaacgccatctgttccgctgtgcccagccattgggtgcctacatctcgcaccacatggtccatccacgccggacatgagtggatgaccacggaagacatgcttacagtttggaatcgggtgtggattcaggagaacccctggatggaagataaaacccctgtcgagagctgggaggaaatcccctacctgggcaagagagaggaccagtggtgcgggtctctcattggactgacctcccgggccacatgggctagaaatatccaaaccgccattaaccaggtgcgcagcctgatcggctccgaagagtatacagattacatgccttctatgaagcggtttgggagagaagaggaggaagcgggagttctctggtga

SEQ ID NO: 19578 - RNA, 9876 nt, synthetic construct
  misc_feature 1..9876: note = derived and/or modified CDS sequence (opt5) from DENV-2__KX380809__SS-prME
  source 1..9876: mol_type = other RNA
accgccggaatcattatcatgatgattcccaccgtgatggctttccacctgacgaccagaaacggggaacctcatatgatcgtgagccggcaggaaaaggggaaaagcctcctgtttaagacagagaatggagttaacatgtgcacccttatggccatggacctgggggaactctgtgaggatacaattacctacaattgcccgctgcttcgccaaaacgaacccgaggacatcgattgttggtgcaattctacaagcacctgggtgacgtatggaacctgtacagcgaccggcgagcacagacgggaaaaacgctccgtggctctggtccctcatgtggggatgggactcgagacaagaaccgaaacgtggatgtctagcgagggcgcctggaagcacgcccagcggatcgagacatgggttctgcgccatcccggcttcaccgtgatggctgccattctggcttacacaatcgggaccacctattttcagagagtcctcattttcatcctgcttacagccgtggcgccttccatgacgatgcggtgcattggaatctctaaccgcgactttgttgaaggcgtgagcgggggatcctgggtcgatattgtgctggagcacggcagctgtgtgaccacaatggccaaaaataagcccaccctcgacttcgaactgatcaagacagaggctaaacaccctgccacccttagaaagtactgcatcgaagctaaactgacgaacacaaccaccgcctctcggtgtccgacacagggggagccctccctcaatgaggaacaagataagcgctttgtctgcaaacatagcatggttgacagaggatggggcaacggctgtgggctgttcggaaagggcgggattgtgacctgcgcgatgtttacatgcaagaaaaatatggagggaaagatcgtgcagcctgaaaacctggagtatacgattgtcatcacaccccactctggcgaagagaatgccgtggggaacgatacaggaaaacatggcaaggagattaaagttacccctcagtccagcatcacagaagctgagctcaccggctacgggacggccaccatggaatgttctccccggacaggactggacttcaatgagatggtgcttctgcagatggaaaacaaggcttggctcgtccaccgccaatggtttctggatcttccgctgccttggctccccggcgccgacacccaggggtccaactggatccagaaagagacactggtgaccttcaagaatcctcacgccaagaaacaggatgttgtggtcctgggaagccaagagggcgctatgcatacggcgctcacaggggccaccgaaattcagatgtcctctggcaacctgctttttacaggacacctgaagtgcagactccggatggacaaactgcagcttaagggcatgagctattccatgtgtaccgggaaattcaaggtggtcaaggagatcgctgaaacccaacatggaacaattgtgatcagagttcagtacgagggcgacgggagcccctgcaaaattcccttcgagatcatggatctggaaaagcgccacgtgctcggacggctgatcacggtcaatcctattgtgaccgagaaagactctccggttaacatcgaagccgagcccccttttggcgattcctacattatcattggggtggaacccggccagctgaagctcagctggttcaaaaagggatctagcatcggccagatgtttgagacaaccatgagaggggccaagcgcatggctattctgggagacacagcctgggatttcggctcccttgggggagtctttacctctatcggcaaagcgctgcatcaagtgttcggggctatctatggcgccgcctttagcggagtgtcctggacgatgaagattctcatcggcgttgtcattacatggatcgggatgaatagccggtctacctccctgagcgtgtctctggtgcttgtcggaattgtgaccctctacctgggcgttatggtgcaggctgactccgggtgtgtcgtgagctggaaaaacaaggagctgaaatgcggatccggcatcttcatcacagataatgttcacacctggacagaacagtataagtttcagcctgagtctcccagcaagctcgcctccgctattcaaaaagcccacgaagaggggatctgtggcattagatctgtgacgcgcctggaaaaccttatgtggaagcagatcaccccggagctgaatcatattctcagcgagaacgaagtcaaactgacaatcatgaccggagacatcaagggcattatgcaggcggggaaacggtccctgagacctcagcccacagagcttaagtacagctggaaagcctggggaaaggctaagatgctctctaccgaactgcacaatcatacgttcctgatcgatggccctgagaccgccgaatgccccaacacaaatcgcgcttggaactccctcgaggtggaggactatgggtttggagttttcaccacaaatatttggctgaaacttaaggaacggcaagatgtgttttgtgacagcaaactgatgtctgccgcgatcaaggacaacagagccgtccacgctgatatgggctactggattgagtccgccctcaacgacacctggaaaatcgaaaaggctagcttcatcgaggtgaagtcttgccactggcctaaaagccatacactgtggtccaatggcgtgctggagagcgaaatgattatccccaagaacttcgccgggccggtctctcagcacaattatcgccctggataccatacccagacggccggcccctggcaccttgggcggctcgagatggattttgacttctgtgaaggaacaaccgttgtggtgaccgaggattgcggcaacagagggccctccctgcggacaaccacggctagcggaaaactgattacagaatggtgctgtcgctcctgcaccctccctccgctgagataccggggcgaggacggctgttggtatgggatggagatcagaccccttaaggaaaaagaggaaaatctggtcaactctctcgtgacagcgggacatggccagattgataattttagcctgggggttctgggaatggcccttttcctcgaggaaatgctgcgcacccgggtgggcacaaagcacgctatcctgctcgtcgccgtgtcctttgttaccctgattacggggaacatgtctttcagagaccttggacgcgtgatggtcatggtgggcgccaccatgacagatgacatcggcatgggggttacctacctggctctcctggccgcgtttaaggtgagacctacattcgctgccggactgcttctgcggaaactcaccagcaaggagctgatgatgacgacaatcggcattgtcctcctgtcccaatctaccatccccgagacaattcttgaactgaccgatgccctcgctctggggatgatggtgctgaaaatcgtgcgcaatatggagaagtatcagcttgccgtcaccattatggcgatcctgtgcgttcctaacgctgtgatcctccagaatgcctggaaagtgagctgtacaattctggccgtcgtgtccgttagccccctcctgcttacgtcttcccaacagaaggctgactggatccctctggccctcaccattaagggactgaaccccacagctatctttctgaccacacttagcagaacctctaaaaagcggtcctggccgctgaatgaagccattatggcggtgggcatggtcagcatcctcgcctcttccctgctcaaaaacgatatccctatgacggggcccctggtggctggaggccttctgacagtttgctacgtgctgaccggccgcagcgccgacctcgagctggaaagagctgccgacgtccggtgggaggagcaggccgaaatttccgggagctctcctatccttagcattaccatctccgaggatggatctatgagcattaagaatgaagaggaggaacagacactgaccatcctcattcgcacaggcctgctcgtgatctccgggctgttccccgtctctatcccgattacggctgcggcctggtatctttgggaggtgaaaaagcaaagagctggagttctgtgggacgtgccttctccccctcccgtcggcaaagccgaactggaggatggggcctaccggatcaagcagaagggcattctcggctattcccagatcggcgctggggtgtacaaagaaggaacctttcacacaatgtggcatgttacccgcggcgccgtgctgatgcacaaggggaaaagaattgagccctcctgggcggacgtcaagaaagatcttatcagctacggaggcgggtggaagctggagggagaatggaaggagggcgaagaggtccaggtgctcgctctggaacctggcaaaaacccgcgggccgttcaaacaaagcccggactcttcaaaaccaacacgggaaccatcggcgccgtctccctggactttagccctgggacatctggatcccccattgtggataagaaaggcaaggtggtcgggctttatggaaatggcgtggttaccagaagcggcacatacgtgtctgctatcgcccagaccgagaagtccattgaggacaaccctgaaatcgaggatgacattttccgcaaaaagcggctgacaatcatggatctgcatcccggggcgggaaaaacgaagagatatctccctgctatcgtccgcgaagccattaaacggggcctgagaacccttatcctggccccgacacgcgtggttgctgccgagatggaagaggctctccgggggctgcccattagataccagacccctgccatccgcgcggagcacaccggacgggaaattgtggacctcatgtgtcatgccacattcacgatgagactgcttagccccatccgggtccctaattataacctgattatcatggatgaggctcactttaccgaccccgcctccatcgctgcccgcggctacatttctacaagagtggaaatgggggaggccgctggcatcttcatgaccgcgacaccgcctggaagccgggacccctttccccagtccaatgcccctattatggatgaggaacgcgagatccccgaaagaagctggaactctggccacgagtgggttaccgacttcaaggggaagacggtgtggtttgtcccttccattaaagctggaaatgatatcgccgcctgcctgcggaagaacggcaaaaaggtgatccaactcagcagaaaaacattcgactctgaatatattaagacccgcaccaatgattgggactttgtggtcacaaccgatatcagcgagatgggggctaacttcaaggccgagcgggttattgacccgagacgctgtatgaaacccgtgatcctgacagatggagaagaacgggtgattcttgcgggccctatgcccgtcacccattcctctgctgcccagagacgcgggcgggtgggcagaaatcctaagaacgaaaatgaccagtacatctacatgggagagcccctggaaaacgatgaggactgcgcccactggaaagaggctaagatgctcctggacaatatcaacacgccggaaggcattatccctagcatgtttgagcccgaacgcgagaaagttgatgccattgacggggaatatagactgcggggagaggcgcgcaagacattcgtggatctcatgagacggggcgaccttcctgtctggctggcctaccgcgtggctgccgaggggatcaactatgctgatagacggtggtgttttgacggagttaaaaataaccaaattctggaagagaatgtggaagtcgagatctggaccaaggagggcgaaagaaagaaactcaagccccgctggctggatgcccggatttactccgaccctcttgctctgaaagagttcaaggagttcgccgcggggagaaaatctctcacactgaacctgatcaccgagatgggccgcctccccacgtttatgacccagaaggcccggaatgctcttgataacctggccgtgctgcatacagctgaagccggaggcagagcctataatcacgctctcagcgagctgccggagacccttgaaacactgctcctgctgaccctccttgcgacagtcaccgggggaatcttcctgtttctgatgtccggcaaggggattggaaaaatgacgctcggcatgtgctgcatcattacagccagcatcctgctttggtacgctcagattcagcctcactggatcgccgcctctatcattctggagttctttctcatcgtgctgctgattcccgaacccgagaagcaacggacccctcaggacaaccagctcacctatgttgtgatcgctattcttacagtggtcgccgcgaccatggccaatgaaatgggcttcctggagaaaacaaagaaagattttgggctgggatccatcacgacccagcaaccggacagcaacatcctcgatattgacctgcgccccgcttccgcctggacactttacgctgttgccaccacattcatcacccctatgctgagacattctattgagaatagctccgtgaacgtgtctctcacggcgatcgccaatcaggctaccgtcctgatgggcctggggaagggatggcccctcagcaagatggacattggcgtgcctcttctggccatcgggtgttactcccaggttaaccccattacactgaccgctgccctcctgcttctggtggctcactatgccatcatcggacctggcctccaggcgaaagccacacgggaagctcaaaagcgcgccgctgccggcattatgaaaatcccgaccgtcgatgggattacggtgatcgacctggatcccattccttacgaccccaagtttgagaaacagctgggacaggtcatgctccttgtgctgtgcgttacacaggtgctgatgatgagaaccacatgggccctctgtgaagcgctgacccttgctaccggccctatcagcacactgtgggaggggaatcccggacggttctggaacacgaccatcgccgtctctatggctaatatttttcgcggctcctatctcgccggggccggactgctgttcagcatcatgaagaacacagctaacaccagacggggcacaggcaataccggggaaacgctcggagagaagtggaaaaaccgccttaatgccctgggcaagtctgagtttcaaatttacaaaaagtccgggatccaggaagtggatagaacactggcgaaagagggaattaagcggggcgaaaccgaccatcacgccgttagcagagggtctgctaaactccgctggttcgtggagcggaacctggtcaccccggagggaaaggtggtggatcttggctgcggcagagggggatggagctattactgtggcgggctgaagaatgttaaagaagtcaagggactcacaaaaggcgggcctggacatgaggaacccatccccatgtccacctatggctggaacctggtgcgcctgcagtctggcgtggacgtcttctttacacctcccgagaagtgcgatacgctcctttgtgacatcggggaaagctcccctaatccgaccgttgaggccggacggacactgagagtgctgaacctcgtggagaattggctgaacaataacacccaattctgcattaaagtccttaatccctacatgcctagcgtgatcgaaaagatggaggctctgcagcgcaagtacggcggggccctcgttcggaaccccctgtccagaaattctacacacgaaatgtattgggtgagcaacgcgtccggaaacattgtctctagcgtgaatatgatctcccgcatgctgattaaccggtttaccatgaaacacaagaaagccacgtacgagcctgatgttgacctcggctctgggaccagaaatatcggaatcgaaagcgagacacccaaccttgatattatcggcaagcgcattgagaaaatcaagcaggaacatgagacctcctggcactatgaccaggaccatccgtacaagacatgggcttatcacggcagctacgaaaccaaacaaacagggtctgcctccagcatggtgaatggagtcgtgcggctgctgaccaagccttgggatgtgattcccatggtcacgcagatggctatgacagacaccacccctttcggccagcagagagtttttaaagagaaggtggatacacgcacgcaagaacccaaagaggggaccaagaagctcatgaaaatcacagccgagtggctgtggaaggaacttggcaaaaagaaaacccctagaatgtgtacacgggaggagttcacccgcaaggtgagatctaacgctgccctgggcgcgatttttacagacgagaataaatggaagtccgcccgggaggctgtcgaagatagcgggttctgggagctcgtggacaaggaaagaaacctgcacctggagggaaaatgcgaaacctgtgtttataatatgatgggcaagcgggagaaaaagctcggcgagtttgggaaagccaagggatctcgcgctatctggtacatgtggctgggcgccagattccttgaatttgaggccctggggttcctcaacgaagatcattggttttcccgggagaatagcctgtccggagtggaaggcgaggggcttcacaagctgggctacatcctccgcgacgtcagcaaaaaggagggaggcgcgatgtatgctgatgacacggccgggtgggataccagaattacactggaagacctgaaaaacgaggaaatggtgaccaatcatatggagggagaacaccggaagctcgccgaggctatcttccgcctgacataccagaacaaagttgtgagagtccagcggcccaccccgcgcggcacggtgatggacattatctctagacgggatcagcgcgggagcggacaagttgtgacatatggccttaataccttcacaaacatggaggcccagctgattagacagatggaaggggagggcgtctttaagtccatccaacatctcaccgtgacggaagagatcgctgtcaagaactggctggagcgggtgggacgcgaaagactttctcggatggccattagcggcgacgattgcgttgtgaaacctctggacgatagattcgcgtccgccctcaccgctctgaatgacatggggaaggtccgcaaagatatccagcagtgggagccctctcggggatggaacgactggacacaggtgcccttttgcagccaccacttccatgaactgattatgaaggatggcagagtgctcgttgtgccttgtcgcaatcaagacgagctgatcgggcgggccagaatttcccagggagctggctggtctcttcgcgaaaccgcctgcctggggaaaagctacgcgcagatgtggtccctcatgtattttcaccggagagatctgcgccttgccgctaacgccatctgtagcgctgtcccgtctcattgggtgcccacatcccggaccacatggagcatccacgccacccacgagtggatgacgacagaggacatgctgaccgtttggaatagagtgtggattcaggaaaacccttggatggaggataagacccccgtcgaatcttgggaggaaatcccttacctcggcaagcgcgaggaccaatggtgcggatccctgattggcctgacaagccgggctacctgggccaaaaatatccagacagcgattaaccaggtgagatccctcatcgggaatgaggaatatacggactacatgccctctatgaagcggttcagacgcgaggaagaggaagccggagtcctgtggtga

SEQ ID NO: 19579 - RNA, 9876 nt, synthetic construct
  misc_feature 1..9876: note = derived and/or modified CDS sequence (opt5) from DENV-2__KX380810__SS-prME
  source 1..9876: mol_type = other RNA
accgccggcatcattatcatgatgattcccacggtgatggctttccacctgacgacccggaacggggaacctcatatgatcgtgagccggcaggaaaagggaaaaagcctcctgtttaagacagagaatggcgttaacatgtgcacccttatggccatggacctgggggaactctgtgaggatacaattacctacaattgcccgctgcttcgccaaaacgaacccgaggacatcgattgttggtgcaattctacaagcacctgggtgacgtatggaacctgtacagcgaccggcgagcacagacgggaaaaacgctccgtggctctggtccctcatgtggggatgggactcgagacaagaaccgaaacgtggatgtctagcgagggcgcctggaagcacgcccagcggatcgagacatgggttctgcgccatcccggcttcaccgtgatggctgccattctggcttacacaatcgggaccacctattttcagagagtcctcattttcatcctgcttacagccgtggcgccttccatgacgatgcggtgcattggaatctctaaccgcgactttgttgaaggcgtgagcgggggatcctgggtcgatattgtgctggagcacggcagctgtgtgaccacaatggccaaaaataagcccaccctcgacttcgaactgatcaagacagaggctaaacaccctgccacccttagaaagtactgcatcgaagctaaactgacgaacacaaccaccgcctctcggtgtccgacacagggggagccctccctcaatgaggaacaagataagcgctttgtctgcaaacatagcatggttgacagaggatggggcaacggctgtgggctgttcggaaagggcgggattgtgacctgcgcgatgtttacatgcaagaaaaatatggagggaaagatcgtgcagcctgaaaacctggagtatacgattgtcatcacaccccactctggcgaagagaatgccgtggggaacgatacaggaaaacatggcaaggagattaaagttacccctcagtccagcatcacagaagctgagctcaccggctacgggacggccaccatggaatgttctccccggacaggactggacttcaatgagatggtgcttctgcagatggaaaacaaggcttggctcgtccaccgccaatggtttctggatcttccgctgccttggctccccggcgccgacacccaggggtccaactggatccagaaagagacactggtgaccttcaagaatcctcacgccaagaaacaggatgttgtggtcctgggaagccaagagggcgctatgcatacggcgctcacaggggccaccgaaattcagatgtcctctggcaacctgctttttacaggacacctgaagtgcagactccggatggacaaactgcagcttaagggcatgagctattccatgtgtaccgggaaattcaaggtggtcaaggagatcgctgaaacccaacatggaacaattgtgatcagagttcagtacgagggcgacgggagcccctgcaaaattcccttcgagatcatggatctggaaaagcgccacgtgctcggacggctgatcacggtcaatcctattgtgaccggcaaagactctccggttaacatcgaggccgaacccccttttggggattcctacattatcattggcgtggagcccggacagctgaagctcagctggttcaaaaagggctctagcatcgggcagatgtttgaaacaaccatgagaggagccaagcgcatggctattctgggcgacacagcctgggatttcgggtcccttggaggcgtctttacctctatcgggaaagcgctgcatcaagtgttcggcgctatctatggagccgcctttagcggcgtgtcctggacgatgaagattctcatcggggttgtcattacatggatcggaatgaatagccggtctacctccctgagcgtgtctctggtgcttgtcggcattgtgaccctctacctgggggttatggtgcaggctgactccggatgtgtcgtgagctggaaaaacaaggagctgaaatgcggctccgggatcttcatcacagataatgttcacacctggacagagcagtataagtttcagcctgaatctcccagcaagctcgcctccgctattcaaaaagcccacgaggaaggcatctgtggaattagatctgtgacgcgcctggagaaccttatgtggaagcagatcaccccggaactgaatcatattctcagcgagaacgaggtcaaactgacaatcatgaccggcgacatcaaggggattatgcaggcgggaaaacggtccctgagacctcagcccacagaacttaagtacagctggaaagcctggggcaaggctaagatgctctctaccgagctgcacaatcatacgttcctgatcgatgggcctgaaaccgccgagtgccccaacacaaatcgcgcttggaactccctcgaagtggaggactatggatttggcgttttcaccacaaatatttggctgaaacttaaggagcggcaagatgtgttttgtgacagcaaactgatgtctgccgcgatcaaggacaacagagccgtccacgctgatatgggctactggattgaatccgccctcaacgacacctggaaaatcgagaaggctagcttcatcgaagtgaagtcttgccactggcctaaaagccatacactgtggtccaatggggtgctggagagcgagatgattatccccaagaacttcgccggaccggtctctcagcacaattatcgccctggctaccatacccagacggccgggccctggcaccttggacggctcgaaatggattttgacttctgtgagggcacaaccgttgtggtgaccgaagattgcgggaacagaggaccctccctgcggacaaccacggctagcggcaaactgattacagagtggtgctgtcgctcctgcaccctccctccgctgagataccggggcgaagacgggtgttggtatggaatggagatcagaccccttaaggagaaagaagagaatctggtcaactctctcgtgacagcgggccatgggcagattgataattttagcctgggagttctgggcatggcccttttcctcgaagagatgctgcgcacccgggtggggacaaagcacgctatcctgctcgtcgccgtgtcctttgttaccctgattacgggaaacatgtctttcagagaccttggccgcgtgatggtcatggtgggcgccaccatgacagatgacatcgggatgggagttacctacctggctctcctggccgcgtttaaggtgagacctacattcgctgccggcctgcttctgcggaaactcaccagcaaggaactgatgatgacgacaatcgggattgtcctcctgtcccaatctaccatccccgagacaattcttgagctgaccgatgccctcgctctgggaatgatggtgctgaaaatcgtgcgcaatatggaaaagtatcagcttgccgtcaccattatggcgatcctgtgcgttcctaacgctgtgatcctccagaatgcctggaaagtgagctgtacaattctggccgtcgtgtccgttagccccctcctgcttacgtcttcccaacagaaggctgactggatccctctggccctcaccattaagggcctgaaccccacagctatctttctgaccacacttagcagaacctctaaaaagcggtcctggccgctgaatgaggccattatggcggtggggatggtcagcatcctcgcctcttccctgctcaaaaacgatatccctatgacgggacccctggtggctggcggccttctgacagtttgctacgtgctgaccgggcgcagcgccgacctcgaactggagagagctgccgacgtccggtgggaagaacaggccgagatttccggaagctctcctatccttagcattaccatctccgaagatggctctatgagcattaagaatgaggaagaggagcagacactgaccatcctcattcgcacagggctgctcgtgatctccggactgttccccgtctctatcccgattacggctgcggcctggtatctttgggaagtgaaaaagcaaagagctggcgttctgtgggacgtgccttctccccctcccgtcgggaaagccgagctggaagatggagcctaccggatcaagcagaagggcattctcggctattcccagatcggggctggagtgtacaaagagggcacctttcacacaatgtggcatgttacccgcggggccgtgctgatgcacaagggaaaaagaattgaaccctcctgggcggacgtcaagaaagatcttatcagctacggcgggggatggaagctggagggcgagtggaaggaaggcgaggaagtccaggtgctcgctctggagcctgggaaaaacccgcgggccgttcaaacaaagcccggactcttcaaaaccaacacgggcaccatcggggccgtctccctggactttagccctggaacatctggctcccccattgtggataagaaagggaaggtggtcggactttatggcaatggcgtggttaccagaagcgggacatacgtgtctgctatcgcccagaccgaaaagtccattgaggacaaccctgagatcgaagatgacattttccgcaaaaagcggctgacaatcatggatctgcatcccggagcgggcaaaacgaagagatatctccctgctatcgtccgcgaggccattaaacgggggctgagaacccttatcctggccccgacacgcgtggttgctgccgaaatggaggaagctctccggggactgcccattagataccagacccctgccatccgcgcggagcacaccggccgggagattgtggacctcatgtgtcatgccacattcacgatgagactgcttagccccatccgggtccctaattataacctgattatcatggatgaagctcactttaccgaccccgcctccatcgctgcccgcgggtacatttctacaagagtggagatgggcgaagccgctggaatcttcatgaccgcgacaccgcctggcagccgggacccctttccccagtccaatgcccctattatggatgaggagcgcgaaatccccgagagaagctggaactctgggcacgaatgggttaccgacttcaagggaaagacggtgtggtttgtcccttccattaaagctggcaatgatatcgccgcctgcctgcggaagaacgggaaaaaggtgatccaactcagcagaaaaacattcgactctgagtatattaagacccgcaccaatgattgggactttgtggtcacaaccgatatcagcgaaatgggagctaacttcaaggccgagcgggttattgacccgagacgctgtatgaaacccgtgatcctgacagatggcgaggaacgggtgattcttgcggggcctatgcccgtcacccattcctctgctgcccagagacgcggccgggtgggaagaaatcctaagaacgagaatgaccagtacatctacatgggcgaacccctggagaacgatgaagactgcgcccactggaaagaggctaagatgctcctggacaatatcaacacgccggaggggattatccctagcatgtttgaacccgagcgcgaaaaagttgatgccattgacggagagtatagactgcggggcgaagcgcgcaagacattcgtggatctcatgagaagaggggaccttcctgtctggctggcctaccgcgtggctgccgagggaatcaactatgctgatagacggtggtgttttgacggcgttaaaaataaccaaattctggaggaaaatgtggaggtcgaaatctggaccaaggagggggagagaaagaaactcaagccccgctggctggatgcccggatttactccgaccctcttgctctgaaagagttcaaggagttcgccgcgggcagaaaatctctcacactgaacctgatcaccgaaatgggacgcctccccacgtttatgacccagaaggcccggaatgctcttgataacctggccgtgctgcatacagctgaggccggcgggagagcctataatcacgctctcagcgaactgccggagacccttgagacactgctcctgctgaccctccttgcgacagtcaccggaggcatcttcctgtttctgatgtccgggaagggaattggcaaaatgacgctcggcatgtgctgcatcattacagccagcatcctgctttggtacgctcagattcagcctcactggatcgccgcctctatcattctggagttctttctcatcgtgctgctgattcccgagcccgaaaagcaacggacccctcaggacaaccagctcacctatgttgtgatcgctattcttacagtggtcgccgcgaccatggccaatgagatggggttcctggagaagaccaagaaagattttggactgggctccatcacgacccagcaaccggacagcaacatcctcgatattgacctgcgccccgcttccgcctggacactttacgctgttgccaccacattcatcacccctatgctgagacattctattgagaatagctccgtgaacgtgtctctcacggcgatcgccaatcaggctaccgtcctgatggggctgggaaagggctggcccctcagcaagatggacattggggtgcctcttctggccatcggatgttactcccaggttaaccccattacactgaccgctgccctcctgcttctggtggctcactatgccatcatcggccctggcctccaggcgaaagccacacgggaggctcaaaagcgcgccgctgccgggattatgaaaatcccggccgcggatattggaaccgtcatcgacctggatcccattccttacgaccccaagtttgaaaaacagctgggccaggtgatgctccttgtcctgtgcagcacacaggtgctgatgatgagaacaacctgggctctctgtgaggccctgacacttgctaccgggcctatctctaccctgtgggaaggaaatcccggccggttctggaacacaacgatcgccgtttccatggccaatatttttcgcgggagctatctcgctggagccggcctgctgttctctatcatgaagaacaccgcgaacacaagacggggcaccgggaatacaggagagaccctcggcgaaaagtggaaaaaccgccttaatgccctggggaagtccgagtttcaaatttacaaaaagagcggaatccaggaggtggatagaacgctggctaaagaaggcattaagagaggggaaacagaccatcacgccgtctctcggggaagcgctaaactccgctggttcgtggaacggaacctggttaccccggagggcaaggtggtcgatcttggctgcgggagaggaggctggtcctattactgtgggggactgaagaatgtgaaagaggtgaagggcctcaccaaagggggacctggccatgaagaacccatccccatgtctacatatggctggaacctggttcgcctgcagagcggggtcgacgtgttctttacccctcccgaaaagtgcgatacactcctttgtgacatcggagagtccagccctaatccgacggtggaagccggccggaccctgagagtcctgaacctcgttgagaattggctgaacaataacacacaattctgcattaaagtgcttaatccctacatgccttccgtgatcgagaagatggaagcgctgcagcgcaagtacgggggagccctcgtccggaaccccctgtctagaaatagcacccacgagatgtattgggtgtccaacgcttctggcaacattgttagctccgtgaatatgatctctcgcatgctgattaaccggtttacaatgaaacacaagaaagccacctacgaacctgatgtcgacctcgggagcggaacgagaaatatcggcatcgagtccgaaacccccaaccttgatattatcggcaagcgcattgagaaaatcaagcaggagcatgaaacaagctggcactatgaccaggaccatccgtacaagacctgggcttatcacgggtcttacgagacaaaacaaaccggatccgccagctctatggtgaatggcgttgtgcggctgctgacaaagccttgggatgtcattcccatggtgacccagatggctatgacggacacaacccctttcgggcagcagagagtgtttaaagaaaaggtcgatacccgcacacaagagcccaaagaaggaacgaagaagctcatgaaaatcaccgccgagtggctgtggaaggagcttggcaaaaagaaaacacctagaatgtgtacccgggaagagttcacacgcaaggttagatccaacgcggccctgggggctatttttaccgacgaaaataaatggaaaagcgcccgggaggctgtggaggattctggattctgggaactcgtggacaaggagagaaacctgcacctggaaggcaaatgcgagacatgtgtctataatatgatgggcaagcgggagaaaaagctcggggagtttggaaaagccaagggctcccgcgccatctggtacatgtggctgggggcgagattccttgagtttgaagctctgggattcctcaacgaggatcattggtttagccgggaaaattccctgagcggcgtggagggggaaggccttcacaagctgggatacatcctccgcgacgtttctaaaaaggagggcggggccatgtatgccgatgacaccgctggatgggatacgagaattaccctggaggacctgaaaaacgaagagatggtgacaaatcatatggaaggcgagcaccggaagctcgccgaagctatcttccgcctgacctaccagaacaaagtcgtgagagttcagcggcccacaccgcgcgggaccgtgatggacattatcagcagacgggatcagcgcggatccggccaagtcgtgacgtatgggcttaatacattcaccaacatggaggcccagctgattagacagatggagggcgaaggagtttttaagtctatccaacatctcacagtgaccgaggaaatcgcggtcaagaactggctggagcgggtgggccgcgagagacttagccggatggccatttccggggacgattgcgtcgtgaaacctctggacgatagattcgcttctgccctcacggctctgaatgacatgggaaaggttcgcaaagatatccagcagtgggaacccagccggggctggaacgactggacccaggtgcccttttgctcccaccacttccatgagctgattatgaaggatgggagagtcctcgtggtgccttgtcgcaatcaagacgaactgatcggacgggccagaatttctcagggcgcggggtggagccttcgcgagacagcctgcctgggcaaatcctacgctcagatgtggagcctcatgtattttcaccggagagatctgcgccttgccgctaacgccatctgttctgctgttccgtcccattgggtgcccatcagccggaccacatggtctattcacgccacccacgaatggatgacaaccgaggacatgctgacggtctggaatagagtgtggatccaggagaacccttggatggaagataagacacccgttgagtcctgggaagagattccttacctcggaaagcgcgaagaccaatggtgcggcagcctgatcgggctgacctcccgggcgacctgggccaaaaatattcagacagctatcaaccaggtgagatctctcattggaaatgaggagtataccgactacatgcccagcatgaagcggttcagacgcgaagaggaagaggccggcgtcctgtggtga

SEQ ID NO: 19580 - RNA, 9876 nt, synthetic construct
  misc_feature 1..9876: note = derived and/or modified CDS sequence (opt5) from DENV-2__KX380811__SS-prME
  source 1..9876: mol_type = other RNA
accgccggaatcattatcatgatgattcccaccgtgatggctttccacctgacgaccagaaatggggagcctcatatgatcgtcagccggcaggaaaagggaaaatccctcctgtttaagaccgagaatggcgttaacatgtgcacccttatggccatggacctgggggaactctgtgaggatacgattacctacaattgcccgctgcttcgccaaaacgaacccgaggacatcgattgttggtgcaattctacaagcacctgggtgacgtatggaacctgtacagcgaccggcgagcaccggcgggaaaaacgctccgtggctctggtccctcatgtggggatgggactcgagacaagaaccgaaacgtggatgtctagcgagggcgcctggaagcacgcccagcggatcgagacatggattctgcgccatcccggcttcaccatcatggctgccattctggcttacacaatcgggaccacctattttcagagagttctcattttcatcctgcttacagccgtgacgccttccatggcgatgcggtgcattggaatctctaaccgcgactttgtcgaaggcgtgagcgggggatcctgggttgatatcgtgctggagcacggcagctgtgtcaccacaatggccaaaaataagcccaccctcgacttcgaactgattaagacagaggctaaacaccttgccaccctgagaaagtactgcgtggaagctaaactcacgaacacaaccaccgcctctcggtgtcctacacagggggagccgtccctgaatgaggaacaagataagcgctttgtgtgcaaacatagcatggtcgacagaggatggggcaacggctgtgggctgttcggaaagggcgggatcgttacctgcgcgatgtttacatgcaagaaaaatatggagggaaaggtggtgcagcccgaaaacctcgagtatacgattgtcatcacccctcactctggcgaagagaatgccgtggggaacgatacaggaaaacatggcaaggagattaaagttacaccccagtccagcatcacagaagctgagctgaccggctacgggacggtgaccatggaatgttctcctcggacaggacttgacttcaatgagatggtcctgctccagatggaaaacaaggcctggctggtgcaccgccaatggtttcttgatctgcccctcccgtggctgcctggcgctgacacccaggggtccaactggatccagaaagagacactggttaccttcaagaatccccacgccaagaaacaggatgtggtcgtgctcggaagccaagagggcgccatgcatacggctctgacaggggcgaccgaaattcagatgtcctctggcaaccttctgtttacaggacacctcaagtgcagactgcggatggacaaacttcagctgaagggcatgagctattccatgtgtaccgggaaattcaaggtcgtgaaggagatcgccgaaacccaacatggaacaattgttatcagagtgcagtacgagggcgacgggagcccttgcaaaattcccttcgagatcatggatctcgaaaagcgccacgtcctgggacggctgatcacggtgaatcccattgttaccgagaaagactctcctgtgaacatcgaagctgagccgccctttggcgattcctacattatcattggggtcgaacctggccagctcaagctgagctggttcaaaaagggatctagcatcggccagatgtttgagacaaccatgagaggggccaagcgcatggccattcttggagacacagcttgggatttcggctccctcggcggggtgtttacctctatcgggaaagccctccatcaagtgttcggggcgatctatggcgctgcctttagcggagtttcctggacgatgaagattctgatcggcgtcgtgattacatggatcgggatgaatagccggtctacctccctgagcgtgtctcttgtcctcgtgggagttgtgaccctgtacctgggcgtcatggtgcaggccgactccgggtgtgttgtgagctggaaaaacaaggagctcaaatgcggatccggcattttcatcacagataatgtccacacctggacagaacagtataagtttcagcccgagtctcctagcaagctggcttccgccatccaaaaagctcacgaagaggggatttgtggcatcagatctgtgacgcgccttgaaaacctgatgtggaagcagattacccccgagctcaatcatatcctgacagagaacgaagttaaactgaccattatgacaggagacatcaagggcatcatgcaggccgggaaacggagccttagaccgcagcctaccgagctcaagtactcctggaaagcgtggggaaaggccaagatgctgagcacggaactgcacaatcataccttcctcattgatggccccgagacagctgaatgccctaacaccaatcgcgcctggaactctctggaggtggaggactatgggtttggagtcttcacaaccaatatctggcttaaactgaaggaacggcaagatgtgttttgtgactccaacctcatgagcgctgccattaaagacaacagagcggtgcacgccgatatgggctactggatcgagtctgctctgaatgacacatggaagattgaaaaagcctccttcatcgaggtcaagagctgccactggcccaagtctcataccctgtggagcaacggcgttcttgagtccgaaatgatcattcctaaaaatttcgctgggcccgtgagccagcacaactatcgcccgggataccatacgcagacagccggcccttggcacctcgggcggctggagatggattttgacttctgtgaaggaaccaccgtggtcgtgacagaggattgcggcaatagagggccctctctgcggaccacgacagcctccggaaagctcatcaccgaatggtgctgtcgcagctgcacactgccccctcttagataccggggcgaggacggctgttggtatgggatggagattagaccgctgaaagaaaaggaggaaaacctcgttaattccctggtgaccgctggacatggccagatcgataacttttctctgggggtccttggaatggcgctgttcctggaggaaatgctgcgcacacgggtgggcaccaaacacgccattctcctggttgctgtgagctttgtcacgcttatcaccgggaatatgtccttcagagacctgggacgcgtgatggttatggtgggcgccacaatgaccgatgacattggcatgggggtcacatacctcgccctgctggctgcctttaaggtgagacccaccttcgcggctggacttctgctccggaagctgacgtctaaagagctcatgatgacaaccatcggcatcgtgctgcttagccaatccacaattcctgagtctatcctggaactcaccgatgccctggccctggggatgatggtccttaagattgttcgcaacatggagaaatatcagctggctgtgaccatcatggccattctctgcgtgcccaatgcggtcatcctgcagaacgcttggaaggtgagctgtacaacgctcgccgttgtgtccgtcagccctctgcttctgacctcttcccaacagaaagccgactggatccccctcgctctgacaattaagggactgaatcctaccgccatctttcttacaaccctgagcagaacgtctaagaaacggtcctggcccctcaacgaagctattatggccgtgggcatggttagcatcctggcgtcttccctcctgaagaatgatattccgatgacagggcctcttgtggccggaggcctgctgaccgtctgctacgtgctcaccggccgcagcgctgacctggagcttgaaagagccgctgacgtccggtgggaggagcaggccgaaatctccgggagctctcccatcctgagcattacaatctccgaggatggatctatgagcattaaaaacgaagaggaggaacagaccctcacaatcctgattcgcacgggcctcctggtgatctccgggcttttccctgtttctattcccatcaccgccgctgcgtggtatctgtgggaggtgaagaaacaaagagccggagtcctgtgggacgtgccgagccctccccctgttggcaaggctgaactcgaggatggggcctaccggatcaaacagaagggcattctgggctattcccagatcggcgccggggtgtacaaggaaggaacatttcacaccatgtggcatgtcacacgcggcgctgtgcttatgcacaaagggaagagaattgagccctcttgggccgacgtgaaaaaggatctgatcagctacggaggcgggtggaaactcgagggagaatggaaggagggcgaagaggttcaggtcctggcgctcgaacccggcaagaaccctcgggctgtgcaaaccaaaccggggctgttcaagacgaataccggaacaattggcgccgtgtcccttgactttagccccgggacctctggatcccctatcgtcgataaaaagggcaaagtggttgggctgtatggaaacggcgtggtcacaagaagcggcacctacgtgtctgccatcgctcagacagagaagtccattgaggacaatcccgaaatcgaggatgacattttccgcaagaaacggctgacgatcatggatctccatcctggggccggaaagaccaaaagatatctgcccgcgattgttcgcgaagctatcaagcggggccttagaacactgatcctcgcccctacccgcgtggtcgccgctgagatggaagaggccctgcgggggctcccgattagataccagacccccgctatccgcgccgagcacacaggacgggaaattgtggacctgatgtgtcatgcgacgttcaccatgagacttctgagccctatccgggttcccaactataatctgattatcatggatgaggcccactttacagaccctgcttccattgccgctcgcggctacatctctaccagagtggaaatgggggaggccgccggcatcttcatgacagctacacccccgggaagccgggacccttttccccagtccaacgcgcccattatggatgaggaacgcgagatccctgaaagaagctggaactctggccacgagtgggtcacggacttcaaagggaagacagtgtggtttgtgccctccattaaggccggaaacgatatcgctgcctgcctccggaaaaatggcaagaaagtcattcaactgagcagaaagaccttcgactctgaatatatcaaaacccgcacaaacgattgggactttgttgtgaccacagatatcagcgagatgggggccaatttcaaggctgagcgggtgattgaccctagacgctgtatgaagccggtcatccttaccgatggagaggaacgggtgattctggccggccccatgcctgttacgcattcctctgcggctcagagacgcgggcgggtgggcagaaaccccaaaaatgaaaacgaccagtacatctacatgggagagcctctcgaaaatgatgaggactgcgcccactggaaggaggccaaaatgctgctggacaacattaacacacccgaaggcatcatcccgagcatgtttgagcctgaacgcgagaaggtcgatgctattgacggggaatatagactccggggagaggcccgcaaaaccttcgtggatcttatgagacggggcgacctgcccgtttggctggcgtaccgcgtggccgctgaggggatcaattatgccgatagacggtggtgttttgacggagtcaagaacaatcaaattctcgaagagaacgtggaagtcgagatctggacaaaagagggcgaaagaaagaagctgaaacctcgctggcttgatgctcggatttactccgaccccctggccctcaaggagttcaaagagttcgctgccgggagaaagtctctgaccctgaatctcatcacggagatgggccgccttcctacctttatgacacagaaagcgaagaacgccctggataatctggctgtgctccataccgccgaagctggaggccgggcctataaccacgccctgagcgagcttcccgagacactggaaaccctcctgctgctcacacttctggctaccgttacagggggaattttcctgtttctcatgtccggcaaggggatcggaaaaatgacactgggcatgtgctgcatcattaccgcgagcatccttctgtggtacgcccagattcagccgcactggatcgctgcctctattatcctcgagttctttctgatcgtgctgctcattcctgaacccgagaagcaaagaacaccccaggacaatcagcttacatatgtggtcatcgccattctgaccgttgtggctgccacaatggcgaacgaaatgggcttcctggagaaaacgaagaaagattttgggctcggatccatcaccacacagcaacctgagagcaatattctggacatcgatcttcggccggcctccgcttggaccctgtacgccgtggctacaaccttcatcacgcccatgctccgccattctattgaaaacagctccgtcaatgtgtctctgaccgccatcgcgaaccaggccacagttctgatgggcctcgggaagggatggcctcttagcaagatggacattggcgtgcccctgctggctatcgggtgttactcccaggtcaatcctattaccctcacagccgctctgcttctgctcgtggcccactatgctatcattggacccggcctgcaggccaaagcgaccagagaggcccaaaagcgggctgccgctggcatcatgaaaatccctacggtcgacgggatgacagtgattgatctggacccgatcccctacgatcctaagtttgaaaaacagctcggacaggttatgcttctggtgctgtgcgtcacccaggtgctcatgatgcgcacaacctgggccctgtgtgaggcccttaccctggcgacaggccccattagcacgctctgggaagggaaccctggaagattctggaataccacaatcgctgtttctatggccaacatttttcggggctcctatctggctggggccggactcctgttcagcatcatgaagaacaccgccaatacacgcagaggcaccggcaacacgggggagacacttggagagaagtggaaaaatcggctgaacgctctgggcaagtctgaatttcaaatctacaaaaagtccgggattcaggaggtggaccgcaccctcgccaaagaaggaatcaagagaggcgagaccgatcatcacgcggtcagccgggggtctgccaaactgagatggttcgtggagcgcaatcttgtgacacccgaaggaaaggttgtcgacctgggctgcggcagagggggatggagctattactgtggcgggctcaagaacgtgaaagaggtgaagggactgaccaaaggcgggccgggacatgaagaacctattcccatgtccacatatggctggaatctggtcagactccagtctggcgttgatgtgttctttacgccccctgaaaagtgcgacacccttctgtgtgatatcggggagagctcccccaaccctacagtggaggctggacgcaccctgcgggtcctcaatctggtggaaaactggcttaataacaatacacaattctgcattaaagttctgaacccgtacatgcccagcgtgatcgagaagatggaagccctccagagaaagtacggcggggctctggtccgcaatcctctgtcccggaactctacccacgagatgtattgggtgagcaacgcctccggaaatatcgtttctagcgtgaacatgatttccagaatgctcatcaatcgctttacgatgcggcacaaaaaggcgacctacgaacccgacgtcgatcttggctctgggacaagaaacattggaatcgagagcgagacccctaatctggacattatcggcaaacgcatcgaaaagattaaacaggagcatgaaacatcctggcactatgatcaggaccatccctacaagacctgggcctatcacggcagctacgagacaaagcaaaccgggtctgcttccagcatggtgaacggagtggtccggctgctcacgaaaccgtgggacgttatccctatggtgacacagatggccatgaccgataccacacccttcggccagcagagagtgtttaaggaaaaagtcgacacgcgcacccaagagcctaaggaggggaccaaaaagctgatgaagattaccgctgaatggctttggaaagagctgggaaagaaaaagacacccagaatgtgtacccgggaagagttcacacgcaaagtgagatctaatgccgctctcggcgccatctttaccgatgagaacaagtggaaatccgcgcgggaagccgttgaggacagcgggttctgggaactggtggataaggagagaaatctgcacctcgaaggaaagtgcgagacgtgtgtctataacatgatgggcaaacgggagaagaaactgggcgaatttgggaaggctaaaggatctcgcgccatttggtacatgtggcttggcgctagattcctggagtttgaagccctcgggttcctgaatgaggaccattggttttcccgggaaaacagcctttccggagtggagggcgaggggctgcacaagctcggctacatcctgcgcgatgttagcaagaaagaaggaggcgccatgtatgcggacgataccgctgggtgggacacaagaattaccctggaggatctcaagaatgaagagatggtgacaaaccatatggaaggagagcacaaaaagctggccgaggccatcttcaaacttacctaccagaataaggtcgtgcgggttcagcgccctacgcccagaggcacagtgatggacatcatttctcggcgcgaccagagagggagcggacaagtcgtgacctatggcctgaacacattcaccaacatggaagctcagctcatccggcagatggagggggaaggcgtctttaagtccattcaacagctgacggtgaaagaggagatcgccgttaagaattggcttattcgcgtgggaagagaacggctgtctcgcatggctatcagcggcgatgactgcgtcgtgaaaccgctcgatgacagattcgcctccgcgctgaccgccctgaacgatatggggaaggtgcggaaagacatccagcagtgggagccttctagaggatggaatgattggacacaagttcccttttgcagccatcacttccacgaactcattatgaaggacggccgcgtgctggtcgtgccctgtcggaaccaggatgagcttatcgggagagctcgcatttcccagggagccggctggtctctgcgggaaaccgcttgcctcggaaagagctacgcccagatgtggtccctgatgtattttcatagacgcgaccttcggctggcggccaatgctatctgtagcgccgttccttctcactggattccgacatccagaaccacatggagcatccatgctacccacgagtggatgacgacagaggatatgctcaccgtgtggaaccgcgtctggatccaagaaaatccctggatggaggacaaaacccctgtggaatcttgggaggaaattccctacctgggcaagcgggaggatcagtggtgcggatccctgatcggcctcacaagcagagccacctgggctaaaaacattcagacagccatcaatcaggtccgctccctgattgggaacgaggaatatacggactacatgccttctatgaagcggttcagacgggaggaagaggaagcgggagtgctttggtga

SEQ ID NO: 19581 - RNA, 9876 nt, synthetic construct
  misc_feature 1..9876: note = derived and/or modified CDS sequence (opt5) from DENV-2__KX380813__SS-prME
  source 1..9876: mol_type = other RNA
accgccggaatcattatcatgatgattcccaccgtgatggctttccacctgacgaccagaaacggggagcctcatatgatcgtcagccggcaggaaaagggaaagtccctcctgtttaagacagagaatggcgttaacatgtgcacccttatggccatggacctgggggaactctgtgaggatacaattacctacaattgcccgctgcttagacaaaacgaacccgaggacatcgattgttggtgcaattctacaagcacctgggtgacgtatggaacctgtacagcgaccggcgagcacagacgggaaaaacgctccgtggctctggtccctcatgtggggatgggactcgagacaagaaccgaaacgtggatgtctagcgagggcgcctggaagcacgcccagcggatcgagacatggattctgcgccatcccggcttcaccatcatggctgccattctggcttacacaatcgggaccacctattttcagagagttctcattttcatcctgcttacagccgtgacgccttccatggcgatgcggtgcattggaatctctaaccgcgactttgtcgaaggcgtgagcgggggatcctgggttgatatcgtgctggagcacggcagctgtgtcaccacaatggccaaaaataagcccaccctcgacttcgaactgattaagacagaggctaaacaccttgccaccctgagaaagtactgcgtggaagctaaactcacgaacacaaccaccgcctctcggtgtcctacacagggggagccgtccctgaatgaggaacaagataagcgctttgtgtgcaaacatagcatggtcgacagaggatggggcaacggctgtgggctgttcggaaagggcgggatcgttacctgcgcgatgtttacatgcaagaaaaatatggagggaaaggtggtgcagcccgaaaacctcgagtatacgattgtcatcacccctcactctggcgaagagaatgccgtggggaacgatacaggaaaacatggcaaggagattaaagttacaccccagtccagcatcacagaagctgagctgaccggctacgggacggtgaccatggaatgttctcctcggacaggacttgacttcaatgagatggtcctgctccagatggaaaacaaggcctggctggtgcaccgccaatggtttcttgatctgcccctcccgtggctgcctggcgctgacacccaggggtccaactggatccagaaagagacactggttaccttcaagaatccccacgccaagaaacaggatgtggtcgtgctcggaagccaagagggcgccatgcatacggctctgacaggggcgaccgaaattcagatgtcctctggcaaccttctgtttacaggacacctcaagtgcagactgcggatggacaaacttcagctgaagggcatgagctattccatgtgtaccgggaaattcaaggtcgtgaaggagagcgccgaaacccaacatggaacaatcgttattagagtgcagtacgagggcgacgggtctccttgcaaaatccccttcgagattatggatctcgaaaagcgccacgtcctgggacggctgatcacggtgaatcccatcgttaccgagaaagactcccctgtgaacattgaagctgagccgccctttggcgatagctacatcattatcggggtcgaacctggccagctcaagctgtcttggttcaaaaagggaagctccattggccagatgtttgagacaaccatgagaggggccaagcgcatggccatccttggagacacagcttgggatttcggctctctcgggggagtgtttaccagcattggcaaagccctccatcaagtgttcggggcgatctatggcgctgccttttccggagttagctggacgatgaagatcctgattggcgtcgtgatcacatggattgggatgaactctcggtccaccagcctgtctgtgtcccttgtcctcgtgggagttgtgaccctgtacctgggcgtcatggtgcaggccgacagcgggtgtgttgtgtcctggaaaaacaaggagctcaaatgcggatctggcatcttcattacagataatgtccacacctggacagaacagtataagtttcagcccgagagcccttccaagctggcttctgccatccaaaaagctcacgaagaggggatctgtggcattagaagcgtgacgcgccttgaaaacctgatgtggaagcagatcacccccgagctcaatcatattctgacagagaacgaagttaaactgaccatcatgacaggagacattaagggcatcatgcaggccgggaaacggacccttagaccgcagcctacggagctcaagtactcctggaaagcgtggggaaaggccaagatgctgagcaccgaactgcacaatcatacattcctcatcgatggccccgagaccgctgaatgccctaacacaaatcgcgcctggaactctctggaggtggaggactatgggtttggagtcttcaccacaaatatttggcttaaactgaaggaacggcaagatgtgttttgtgactccaaactcatgagcgctgccatcaaggacaacagagcggtgcacgccgatatgggctactggattgagtctgctctgaacgacacctggaaaatcgaaaaggcctccttcattgaggtcaagagctgccactggcccaaatctcatacgctgtggagcaatggcgttcttgagtccgaaatgatcatccctaagaacttcgctgggcccgtgagccagcacaattatcgcccgggataccatacacagaccgccggcccttggcacctcgggcggctggagatggattttgacttctgtgaaggaaccacagtggtcgtgaccgaggattgcggcaacagagggccctctctgcggacgacaaccgcctccggaaaactcattacagaatggtgctgtcgcagctgcaccctgccccctcttagataccggggcgaggacggctgttggtatgggatggagatcagaccgctgaaggaaaaagaggaaaatctcgttaactccctggtgacagctggacatggccagattgataatttttctctgggggtccttggaatggcgctgttcctggaggaaatgctgcgcacccgggtgggcacgaagcacgccatcctcctggttgctgtgagctttgtcacccttattacagggaacatgtccttcagagacctgggacgcgtgatggttatggtgggcgccaccatgacagatgacatcggcatgggggtcacctacctcgccctgctggctgcctttaagattagacccacgttcgcggctggacttctgctccggaaactgacatctaaggagctcatgatgaccacaatcggcatcgtgctgcttagccaatccaccattcctgagtctatcctggaactcaccgatgccctggccctggggatgatggtgcttaaaattgtccgcaatatggagaagtatcagctggctgttacaatcatggccattctctgcgtgcccaacgcggtgatcctgcagaatgcttggaaagtcagctgtacgaccctcgccgtggtttccgtgagccctctgcttctgacatcttcccaacagaaggccgactggatccccctcgctctgaccattaagggactgaaccctacagccatctttcttaccacgctgagcagaacatctaaaaagcggtcctggcccctcaatgaagctattatggccgtcggcatggtgagcatcctggcgtcttccctcctgaaaaacgatattccgatgaccgggcctcttgttgccggaggcctgctgaccgtgtgctacgtcctcacaggccgcagcgctgacctggagcttgaaagagccgctgacgtgcggtgggaggagcaggccgaaatctccgggagctctcccatcctgagcattaccatctccgaggatggatctatgagcattaagaatgaagaggaggaacagacactcacgatcctgattcgcaccggcctcctggtcatctccgggcttttccctgtgtctattcccatcacagccgctgcgtggtatctgtgggaggttaaaaagcaaagagccggagtgctgtgggacgtcccgagccctccccctgtgggcaaagctgaactcgaggatggggcctaccggatcaagcagaagggcattctgggctattcccagatcggcgccggggtttacaaagaaggaacctttcacacaatgtggcatgtgacccgcggcgctgtccttatgcacaaggggaaaagaattgagccctcttgggccgacgtgaagaaagatctgatcagctacggaggcgggtggaagctcgagggagaatggaaggagggcgaagaggtgcaggttctggcgctcgaacccggcaaaaaccctcgggctgtccaaacgaagccggggctgttcaaaaccaacacaggaaccattggcgccgtgtcccttgactttagccccgggacatctggatcccctatcgtggataagaaaggcaaggtcgtggggctgtatggaaatggcgttgtgaccagaagcggcacatacgtctctgccatcgctcagacggagaagtccattgaggacaaccccgaaatcgaggatgacattttccgcaaaaagcggctgaccatcatggatctccatcctggggccggaaaaacaaagagatatctgcccgcgattgtgcgcgaagctatcaaacggggccttagaaccctgatcctcgcccctacccgcgttgtggccgctgagatggaagaggccctgcgggggctcccgattagataccagacacccgctatccgcgccgagcacacgggacgggaaattgtcgacctgatgtgtcatgcgaccttcacaatgagacttctgagccctatccgggtgcccaattataacctgattatcatggatgaggcccactttaccgaccctgcttccattgccgctcgcggctacatctctacaagagttgaaatgggggaggccgccggcatcttcatgaccgctacgcccccgggaagccgggacccttttccccagtccaatgcgcccattatggatgaggaaaaggagatccctgaacgcagctggaactctggccacgagtgggtgacagacttcaaggggaaaaccgtctggtttgtgccctccattaaggccggaaatgatatcgctgcctgcctccgcaagaatggcaagaaagtgattcaactgagccggaagaccttcgactctgaatatatcaagacaagaaccaatgattgggactttgtcgttacaaccgatatcagcgagatgggggccaacttcaaagctgagcgcgtgattgaccctcggagatgtatgaagccggtgatccttacggatggagaggaacgcgtcattctggccggccccatgcctgtgacacattcctctgcggctcagcggagagggcgcgttggccggaatcccaaaaacgaaaatgaccagtacatctacatgggagagcctctcgaaaacgatgaggactgcgcccactggaaggaggccaaaatgctgctggacaatattaacacccccgaaggcatcatcccgagcatgtttgagcctgaaagagagaaggtggatgctattgacggggaatatcgcctcagaggagaggcccggaaaacattcgtcgatcttatgcgcagaggcgacctgcccgtgtggctggcgtaccgggttgccgctgaggggatcaactatgccgatcgcagatggtgttttgacggagtgaagaataaccaaattctcgaagagaatgtcgaagtggagatctggaccaaggagggcgaacggaaaaagctgaaacctagatggcttgatgctcgcatttactccgaccccctggccctcaaggagttcaaagagttcgctgccgggcggaagtctctgacgctgaacctcatcaccgagatgggcagacttcctacatttatgacccagaaggcgaaaaatgccctggataacctggctgtcctccatacagccgaagctggaggccgcgcctataatcacgccctgagcgagcttcccgagaccctggaaacactcctgctgctcacccttctggctacggtgacagggggaattttcctgtttctcatgtccggcaaggggatcggaaaaatgaccctgggcatgtgctgcatcattaccgcgagcatccttctgtggtacgcccagattcagccgcactggatcgctgcctctattatcctcgagttctttctgatcgttctgctcattcctgaacccgagaagcaacggacaccccaggacaaccagcttacctatgtggtgatcgccattctgacagtcgttgctgccacgatggcgaatgaaatgggcttcctggagaaaaccaagaaggattttgggctcggatccatcacaacccagcaacctgagagcaacattctggacatcgatcttagaccggcctccgcttggacactgtacgccgtggctaccacgttcatcacccccatgctccggcattctattgaaaatagctccgtgaacgtctctctgacagccatcgcgaatcaggccaccgtgctgatgggcctcgggaaaggatggcctcttagcaagatggacattggcgttcccctgctggctatcgggtgttactcccaggtgaaccctattacactcaccgccgctctgcttctgctcgtcgcccactatgctatcattggacccggcctgcaggccaaagcgacgcgcgaggcccaaaagagagctgccgctggcatcatgaaaaatcctacagtggacgggatgaccgtcatcgatctggacccgattccctacgatcctaagtttgaaaagcagctcggacaggtgatgcttctggttctgtgcgtgacacaggtcctcatgatgcggaccacctgggccctgtgtgaggcccttacactggcgacgggccccatcagcaccctctgggaagggaaccctggacgcttctggaatacaaccattgctgtgtctatggccaacatctttagaggctcctatctggctggggccggactcctgttcagcattatgaaaaacacagccaatacccggcgcggcacgggcaacacaggggagacccttggagagaagtggaaaaatagactgaacgctctgggcaagtctgaatttcaaatctacaaaaagtccgggatccaggaggttgaccggaccctcgccaaagaaggaattaagcgcggcgagacagatcatcacgcggtgagcagagggtctgccaagctgcggtggttcgtcgagagaaatcttgtgacccccgaaggaaaagtggttgacctgggctgcggccgcgggggatggagctattactgtggcgggctcaagaacgtcaaagaggtgaagggactgacaaaaggcgggccgggacatgaagaacctatccccatgtccacgtatggctggaatctggtgcggctccagtctggcgtcgatgttttctttaccagccccgaaaagtgcgacacacttctgtgtgatattggggagtccagccctaaccccaccgtggaggctggaagaacactgcgcgtgctcaatctggtcgaaaactggcttaataacaatacccaattctgcatcaaggtgctgaacccttacatgccgtccgttattgagaaaatggaagccctccagcggaagtacggcggggctctggtgagaaatcccctgtctcgcaacagcacgcacgagatgtattgggtctccaacgcctctggaaatatcgtgagctccgttaacatgatctctcggatgctcattaatagatttaccatgcgccacaaaaaggcgacatacgaacctgacgtggatcttggcagcgggacccggaacatcggaattgagtccgagacacccaatctggacatcattggcaaaagaatcgaaaagatcaagcaggagcatgaaaccagctggcactatgatcaggaccatccttacaaaacatgggcctatcacggctcttacgagaccaagcaaacggggtccgctagctctatggtcaacggagtggtgcgcctgctcacaaaaccctgggacgtcattccgatggttacccagatggccatgaccgatacaacgcctttcggccagcagcgggtgtttaaggaaaaagtggacaccagaacacaagagcccaaggaggggaccaagaaactgatgaagatcacagctgaatggctttggaaagagctgggaaagaaaaagacccctcgcatgtgtacaagagaagagttcacccggaaagtccgctccaatgccgctctcggcgccatttttacggatgagaacaagtggaaaagcgcgagagaagccgtggaggactctgggttctgggaactggttgataaagagcggaatctgcacctcgaaggaaagtgcgagacctgtgtgtataacatgatgggcaaaagagagaagaaactgggcgaatttgggaaggctaagggatcccgggccatctggtacatgtggcttggcgctcgcttcctggagtttgaagccctcgggttcctgaatgaggaccattggtttagcagagaaaactcccttagcggagtcgagggcgaggggctgcacaaactcggctacattctgcgggatgtgtctaagaaagaaggaggcgccatgtatgcggacgatacagctgggtgggacacccgcatcacactggaggatctcaagaatgaagagatggttaccaaccatatggaaggagagcacaaaaagctggccgaggccattttcaaacttacgtaccagaataaagtggtcagagtgcagcggcccacacctcgcggcaccgttatggacatcatcagcagacgggaccagcgcgggtccggacaagtggtcacatatggcctgaacaccttcacgaacatggaagctcagctcattagacagatggagggggaaggcgtgtttaagtctatccaacagctgaccgtcaaagaggagattgccgtgaagaattggcttatccgggttggacgcgaaagactgagccggatggctatttccggcgatgactgcgtggtcaaacccctcgatgaccgcttcgcctctgcgctgacagccctgaacgatatggggaaggtgagaaaggacatccagcagtgggagccgagccggggatggaatgattggacccaagtgcctttttgctcccatcacttccacgaactcatcatgaaagacggcagagttctggtggtcccctgtcgcaaccaggatgagcttattgggcgggctagaatctctcagggagccggctggagcctgcgcgaaacagcttgcctcgggaagtcctacgcccagatgtggagcctgatgtattttcatcggagagaccttcgcctggcggccaatgctatttgttctgccgtgccctcccactggatccctaccagccggacaacctggtctattcatgctacgcacgagtggatgacaaccgaggatatgctcaccgtttggaacagagtgtggatccaagaaaatccgtggatggaggacaaaacacccgtcgaatcctgggaggaaatcccttacctgggcaagcgcgaggatcagtggtgcggaagcctgattggcctcacctcccgggccacatgggctaaaaacatccagacggccattaatcaggtgagatctctgatcgggaacgaggaatataccgactacatgcccagcatgaagcgcttccggagagaggaagaggaagcgggagtcctttggtga

SEQ ID NO: 19582 - RNA, 9876 nt, synthetic construct
  misc_feature 1..9876: note = derived and/or modified CDS sequence (opt5) from DENV-2__KX380814__SS-prME
  source 1..9876: mol_type = other RNA
accgccggcatcattatcatgatgattcccaccgtgatggctttccacctgacgaccagaaacggggagcctcatatgatcgtcagccggcaggaaaagggaaaatccctcctgtttaagacagagaatggcgttaacatgtgcacccttatggccatggacctgggggaactctgtgaggatacaattacctacaattgcccgctgcttagacaaaacgaacccgaggacatcgattgttggtgcaattctacaagcacctgggtgacgtatggaacctgtacagcgaccggcgagcacagacgggaaaaacgctccgtggctctggtccctcatgtggggatgggactcgagacaagaaccgaaacgtggatgtctagcgagggcgcctggaagcacgcccagcggatcgagacatggattctgcgccatcccggcttcaccatcatggctgccattctggcttacacaatcgggaccacctattttcagagagttctcattttcatcctgcttacagccgtgacgccttccatggcgatgcggtgcattggaatctctaaccgcgactttgtcgaaggcgtgagcgggggatcctgggttgatatcgtgctggagcacggcagctgtgtcaccacaatggccaaaaataagcccaccctcgacttcgaactgattaagacagaggctaaacaccttgccaccctgagaaagtactgcgtggaagctaaactcacgaacacaaccaccgcctctcggtgtcctacacagggggagccgtccctgaatgaggaacaagataagcgctttgtgtgcaaacatagcatggtcgacagaggatggggcaacggctgtgggctgttcggaaagggcgggatcgttacctgcgcgatgtttacatgcaagaaaaatatggagggaaaggtggtgcagcccgaaaacctcgagtatacgattgtcatcacccctcactctggcgaagagaatgccgtggggaacgatacaggaaaacatggcaaggagattaaagttacaccccagtccagcatcacagaagctgagctgaccggctacgggacggtgaccatggaatgttctcctcggacaggacttgacttcaatgagatggtcctgctccagatggaaaacaaggcctggctggtgcaccgccaatggtttcttgatctgcccctcccgtggctgcctggcgctgacacccaggggtccaactggatccagaaagagacactggttaccttcaagaatccccacgccaagaaacaggatgtggtcgtgctcggaagccaagagggcgccatgcatacggctctgacaggggcgaccgaaattcagatgtcctctggcaaccttctgtttacaggacacctcaagtgcagactgcggatggacaaacttcagctgaagggcatgagctattccatgtgtaccgggaaattcaaggtcgtgaaggagatcgccgaaacccaacatggaacaattgttatcagagtgcagtacgagggcgacgggagcccttgcaaaattcccttcgagatcatggatctcgaaaagcgccacgtcctgggacggctgatcacggtgaatcccattgttaccgagaaagactctcctgtgaacatcgaagctgagccgccctttggcgattcctacattatcattggggtcgaacctggccagctcaagctgagctggttcaaaaagggatctagcatcggccagatgtttgagacaaccatgagaggggccaagcgcatggccattcttggagacacagcttgggatttcggctccctcggcggggtgtttacctctatcgggaaagccctccatcaagtgttcggggcgatctatggcgctgcctttagcggagtttcctggacgatgaagattctgatcggcgtcgtgattacatggatcgggatgaatagccggtctacctccctgagcgtgtctcttgtcctcgtgggagttgtgaccctgtacctgggcgtcatggtgcaggccgactccgggtgtgttgtgagctggaaaaacaaggagctcaaatgcggatccggcattttcatcacagataatgtccacacctggacagaacagtataagtttcagcccgagtctcctagcaagctggcttccgccatccaaaaagctcacgaagaggggatttgtggcatcagatctgtgacgcgccttgaaaacctgatgtggaagcagattacccccgagctcaatcatatcctgacagagaacgaagttaaactgaccattatgacaggagacatcaagggcatcatgcaggccgggaaacggacccttagaccgcagcctacggagctcaagtacagctggaaagcgtggggaaaggccaagatgctgtccaccgaactgcacaatcatacattcctcattgatggccccgagaccgctgaatgccctaacacaaatcgcgcctggaacagcctggaggtggaggactatgggtttggagtcttcaccacaaatatctggcttaaactgaaggaacggcaagatgtgttttgtgactctaaactcatgtccgctgccattaaggacaacagagcggtgcacgccgatatgggctactggatcgagagcgctctgaacgacacctggaaaattgaaaaggcctctttcatcgaggtcaagtcctgccactggcccaaaagccatacgctgtggtctaatggcgttcttgagagcgaaatgatcattcctaagaacttcgctgggcccgtgtcccagcacaattatcgcccgggataccatacacagaccgccggcccttggcacctcgggcggctggagatggattttgacttctgtgaaggaaccacagtggtcgtgaccgaggattgcggcaacagagggcccagcctgcggacgacaaccgcctctggaaaactcatcacagaatggtgctgtcgctcctgcaccctgccccctcttagataccggggcgaggacggctgttggtatgggatggagattagaccgctgaaggaaaaagaggaaaatctcgttaacagcctggtgacagctggacatggccagatcgataatttttccctgggggtccttggaatggcgctgttcctggaggaaatgctgcgcacccgggtgggcacgaagcacgccattctcctggttgctgtgtcttttgtcacccttatcacagggaacatgagcttcagagacctgggacgcgtgatggttatggtgggcgccaccatgacagatgacattggcatgggggtcacctacctcgccctgctggctgcctttaagatcagacccacgttcgcggctggacttctgctccggaaactgacatccaaggagctcatgatgaccacaatcggcattgtgctgctttctcaaagcaccatccctgagtccattctggaactcaccgatgccctggccctggggatgatggtgcttaaaatcgtccgcaatatggagaagtatcagctggctgttacaattatggccatcctctgcgtgcccaacgcggtgatcctgcagaatgcttggaaagtctcttgtacgaccctcgccgtggttagcgtgtcccctctgcttctgacaagctctcaacagaaggccgactggattcccctcgctctgaccatcaagggactgaaccctacagccatttttcttaccacgctgtccagaacaagcaaaaagcggtcttggcccctcaatgaagctatcatggccgtcggcatggtgtccattctggcgagctctctcctgaaaaacgatatcccgatgaccgggcctcttgttgccggaggcctgctgaccgtgtgctacgtcctcacaggccgctccgctgacctggagcttgaaagagccgctgacgtgcggtgggaggagcaggccgaaatcagcgggtccagccccattctgtctatcaccattagcgaggatggatccatgtctatcaagaatgaagaggaggaacagacactcacgattctgatccgcaccggcctcctggtcattagcgggcttttccctgtgtccatccccatcacagccgctgcgtggtatctgtgggaggttaaaaagcaaagagccggagtgctgtgggacgtcccgtctcctccccctgtgggcaaagctgaactcgaggatggggcctaccggattaagcagaagggaatcctgggctatagccagattggcgccggggtttacaaagaaggaacctttcacacaatgtggcatgtgacccgcggcgctgtccttatgcacaaggggaaaagaatcgagccctcctgggccgacgtgaagaaagatctgatttcttacggaggcgggtggaagctcgagggagaatggaaggagggcgaagaggtgcaggttctggcgctcgaacccggcaaaaaccctcgggctgtccaaacgaagccggggctgttcaaaaccaacacaggaaccatcggcgccgtgagccttgacttttcccccgggacaagcggatctcctatcgtggataagaaaggcaaggtcgtggggctgtatggaaatggcgttgtgaccagatccggcacatacgtcagcgccattgctcagacggagaagtctatcgaggacaaccccgaaattgaggatgacatcttccgcaaaaagcggctgaccattatggatctccatcctggggccggaaaaacaaagagatatctgcccgcgatcgtgcgcgaagctatcaaacggggccttagaaccctgattctcgcccctacccgcgttgtggccgctgagatggaagaggccctgcgggggctcccgatcagataccagacacccgctattcgcgccgagcacacgggacgggaaatcgtcgacctgatgtgtcatgcgaccttcacaatgagacttctgtcccctattcgggtgcccaattataacctgatcattatggatgaggcccactttaccgaccctgctagcatcgccgctcgcggctacatctccacaagagttgaaatgggggaggccgccggcattttcatgaccgctacgcccccgggatctcgggacccttttccccagagcaatgcgcccatcatggatgaggaaaaggagattcctgaacgctcctggaacagcggccacgagtgggtgacagacttcaaggggaaaaccgtctggtttgtgccctctatcaaggccggaaatgatattgctgcctgcctccgcaagaacggcaagaaagtgatccaactgtcccggaagaccttcgacagcgaatatatcaagacaagaaccaatgattgggactttgtcgttacaaccgatatttctgagatgggggccaacttcaaagctgagcgcgtgatcgaccctcggagatgtatgaagccggtgattcttacggatggagaggaacgcgtcatcctggccggccccatgcctgtgacacatagctccgcggctcagcggagagggcgcgttggccggaatcccaaaaacgaaaatgaccagtacatttacatgggagagcctctcgaaaacgatgaggactgcgcccactggaaggaggccaaaatgctgctggacaatatcaacacccccgaaggcatcattccgtctatgtttgagcctgaaagagagaaggtggatgctatcgacggggaatatcgcctcagaggagaggcccggaaaacattcgtcgatcttatgcgcagaggcgacctgcccgtgtggctggcgtaccgggttgccgctgaggggattaactatgccgatcgcagatggtgttttgacggagtgaagaataaccaaatcctcgaagagaatgtcgaagtggagatttggaccaaggagggcgaacggaaaaagctgaaacctagatggcttgatgctcgcatctacagcgaccccctggccctcaaggagttcaaagagttcgctgccgggcggaagtccctgacgctgaacctcattaccgagatgggcagacttcctacatttatgacccagaaggcgaaaaatgccctggataacctggctgtcctccatacagccgaagctggaggccgcgcctataatcacgccctgtctgagcttcccgagaccctggaaacactcctgctgctcacccttctggctacggtgacagggggaatcttcctgtttctcatgagcggcaaggggatcggaaaaatgaccctgggcatgtgctgcattatcaccgcgtccattcttctgtggtacgcccagatccagccgcactggattgctgccagcatcatcctcgagttctttctgattgttctgctcatccctgaacccgagaagcaacggacaccccaggacaaccagcttacctatgtggtgattgccatcctgacagtcgttgctgccacgatggcgaatgaaatgggcttcctggagaaaaccaagaaggattttgggctcggatctattacaacccagcaacctgagtccaacatcctggacatcgatcttagaccggccagcgcttggacactgtacgccgtggctaccacgttcattacccccatgctccggcattccatcgaaaattctagcgtgaacgtctccctgacagccattgcgaatcaggccaccgtgctgatgggcctcgggaaaggatggcctctttctaagatggacatcggcgttcccctgctggctattgggtgttacagccaggtgaaccctatcacactcaccgccgctctgcttctgctcgtcgcccactatgctattatcggacccggcctgcaggccaaagcgacgcgcgaggcccaaaagagagctgccgctggcatcatgaaaaatcctacagtggacgggatgaccgtcattgatctggacccgatcccctacgatcctaagtttgaaaagcagctcggacaggtgatgcttctggttctgtgcgtgacacaggtcctcatgatgcggaccacctgggccctgtgtgaggcccttacactggcgacgggccccatttccaccctctgggaagggaaccctggacgcttctggaatacaaccatcgctgtgagcatggccaacatttttagaggctcttatctggctggggccggactcctgttctccatcatgaaaaacacagccaatacccggcgcggcacgggcaacacaggggagacccttggagagaagtggaaaaatagactgaacgctctgggcaagagcgaatttcaaatctacaaaaagtctgggattcaggaggttgaccggaccctcgccaaagaaggaatcaagcgcggcgagacagatcatcacgcggtgtccagagggagcgccaagctgcggtggttcgtcgagagaaatcttgtgacccccgaaggaaaagtggttgacctgggctgcggccgcgggggatggtcttattactgtggcgggctcaagaacgtcaaagaggtgaagggactgacaaaaggcgggccgggacatgaagaacctattcccatgagcacgtatggctggaatctggtgcggctccagtccggcgtcgatgttttctttacctctcccgaaaagtgcgacacacttctgtgtgatatcggggagagctcccctaaccccaccgtggaggctggaagaacactgcgcgtgctcaatctggtcgaaaactggcttaataacaatacccaattctgcattaaggtgctgaacccttacatgccgagcgttatcgagaaaatggaagccctccagcggaagtacggcggggctctggtgagaaatcccctgtcccgcaactctacgcacgagatgtattgggtcagcaacgcctccggaaatatcgtgtctagcgttaacatgatttcccggatgctcatcaatagatttaccatgcgccacaaaaaggcgacatacgaacctgacgtggatcttggctctgggacccggaacattggaatcgagagcgagacacccaatctggacattatcggcaaaagaatcgaaaagattaagcaggagcatgaaacctcctggcactatgatcaggaccatccttacaaaacatgggcctatcacggcagctacgagaccaagcaaacggggtctgcttccagcatggtcaacggagtggtgcgcctgctcacaaaaccctgggacgtcatcccgatggttacccagatggccatgaccgatacaacgcctttcggccagcagcgggtgtttaaggaaaaagtggacaccagaacacaagagcccaaggaggggaccaagaaactgatgaagattacagctgaatggctttggaaagagctgggaaagaaaaagacccctcgcatgtgtacaagagaagagttcacccggaaagtccgctctaatgccgctctcggcgccatctttacggatgagaacaagtggaagtccgcgagagaagccgtggaggacagcgggttctgggaactggttgataaagagcggaatctgcacctcgaaggaaagtgcgagacctgtgtgtataacatgatgggcaaaagagagaagaaactgggcgaatttgggaaggctaagggatctcgggccatttggtacatgtggcttggcgctcgcttcctggagtttgaagccctcgggttcctgaatgaggaccattggttttccagagaaaacagcctttccggagtcgagggcgaggggctgcacaaactcggctacatcctgcgggatgtgagcaagaaagaaggaggcgccatgtatgcggacgatacagctgggtgggacacccgcattacactggaggatctcaagaatgaagagatggttaccaaccatatggaaggagagcacaaaaagctggccgaggccatcttcaaacttacgtaccagaataaagtggtcagagtgcagcggcccacacctcgcggcaccgttatggacatcatttctagacgggaccagcgcgggagcggacaagtggtcacatatggcctgaacaccttcacgaacatggaagctcagctcatcagacagatggagggggaaggcgtgtttaagtccattcaacagctgaccgtcaaagaggagatcgccgtgaagaattggcttattcgggttggacgcgaaagactgtctcggatggctatcagcggcgatgactgcgtggtcaaacccctcgatgaccgcttcgcctccgcgctgacagccctgaacgatatggggaaggtgagaaaggacatccagcagtgggagccgtctcggggatggaatgattggacccaagtgcctttttgcagccatcacttccacgaactcattatgaaagacggcagagttctggtggtcccctgtcgcaaccaggatgagcttatcgggcgggctagaatttcccagggagccggctggtctctgcgcgaaacagcttgcctcggaaagagctacgcccagatgtggtccctgatgtattttcatcggagagaccttcgcctggcggccaatgctatctgtagcgccgtgccctctcactggattcctacctcccggacaacctggagcatccatgctacgcacgagtggatgacaaccgaggatatgctcaccgtttggaacagagtgtggatccaagaaaatccgtggatggaggacaaaacacccgtcgaatcttgggaggaaattccttacctgggcaagcgcgaggatcagtggtgcggatccctgatcggcctcaccagccgggccacatgggctaaaaacattcagacggccatcaatcaggtgagatccctgattgggaacgaggaatataccgactacatgccctctatgaagcgcttccggagagaggaagaggaagcgggagtcctttggtga

SEQ ID NO: 19583 - RNA, 9876 nt, synthetic construct
  misc_feature 1..9876: note = derived and/or modified CDS sequence (opt5) from DENV-2__KX380807__SS-prME
  source 1..9876: mol_type = other RNA
acagccggcatcattatcatgatgattcccacggtgatggctttccacctgacgaccagaaatggggagcctcatatgatcgtgagccggcaggaaaagggcaagagcctcctgtttaagacagagaatggggttaacatgtgcacccttatggccatggacctgggggaactctgtgaggatacaattacctacaattgcccgctgcttcgccaaaacgaacccgaggacatcgattgttggtgcaattctacaagcacctgggtgacgtatgggacctgtacagcgaccggcgagcacagacgggaaaaacgctccgtggctctggcccctcatgtcgggatgggactcgagacaagaaccgaaacgtggatgtctagcgagggcgcctggaagcacgctcagcggatcgagatttgggtgctgcgccatcccggcttcacaatcatggccgctattctggcctacaccatcgggacaacctattttcagagagttctcattttcatcctgcttaccgcggtggccccttccatgacaatgcggtgcattggaatctctaaccgcgactttgtcgaaggcgtgagcgggggatcctgggttgatatcgtgctggagcacggcagctgtgtcacgaccatggctaaaaataagcccacactcgacttcgaactgattaagaccgaggccaaacaccctgctacacttagaaagtactgcatcgaagccaaactgaccaacacgacaaccgcgtctcggtgtccgacccagggggagccctccctcaatgaggaacaagataagcgctttgtgtgcaaacatagcatggtggacagaggatggggcaacggctgtgggctgttcggaaagggcgggattgtcacatgcgccatgtttacctgcaagaaaaatatggagggaaagatcgttcagcctgaaaacctggagtatacaattgtgatcacgccccactctggcgaagagaatgctgtggggaacgataccggaaaacatggcaaggagatcaaagtcacacctcagtccagcattaccgaagccgagctcacaggctacgggaccgtgacgatggaatgttctccccggaccggactggacttcaatgagatggttcttctgcagatggaaaacaaggcttggctcgtgcaccgccaatggtttctggatcttccgctgccttggctccccggcgccgacacacaggggtccaactggatccagaaagagaccctggtcacattcaagaatcctcacgccaagaaacaggatgtggttgtgctgggaagccaagagggcgctatgcataccgcgctcacgggggccacagaaattcagatgtcctctggcaacctgctttttaccggacacctgaagtgcagactccggatggacaaactgcagcttaagggcatgagctattccatgtgtacagggaaattcaaggtcgtgaaggagatcgctgaaacccaacatggaaccattgtcatcagagtgcagtacgagggcgacgggagcccctgcaaaatccccttcgagattatggatctggaaaagcgccacgttctcggacggctgatcacagtgaatcctattgtcacggagaaagactctccggtgaacatcgaagccgagcccccttttggcgattcctacattatcattggggttgaacccggccagctgaagctcagctggttcaaaaagggatctagcatcggccagatgtttgagaccacaatgagaggggccaagcgcatggctatcctgggagacaccgcctgggatttcggctcccttgggggagtgtttacatctattggcaaagcgctgcatcaagtcttcggggctatctatggcgccgcctttagcggagtgtcctggaccatgaagattctcatcggcgtggttattacgtggatcgggatgaatagccggtctacatccctgagcgtctctctggtgcttgtgggagtcgtgaccctctacctgggcgttatggtgcaggctgactccgggtgtgtcgtgagctggaaaaacaaggagctgaaatgcggatccggcatcttcattaccgataatgttcacacatggaccgaacagtataagtttcagcctgagtctcccagcaagctcgcctccgctatccaaaaagcccacgaagaggggatttgtggcatcagatctgtgacacgcctggaaaaccttatgtggaagcagattacgccggagctgaatcatatcctcagcgagaacgaagtcaaactgaccatcatgacaggagacattaagggcatcatgcaggcggggaaacggtccctgagacctcagcccaccgagcttaagtacagctggaaagcctggggaaaggctaagatgctctctacagaactgcacaatcataccttcctgattgatggccctgagacggccgaatgccccaacaccaatcgcgcttggaactccctcgaggtggaggactatgggtttggagttttcacaaccaatatctggctgaaacttaaggaacggcaagatgtgttttgtgacagcaaactgatgtctgccgcgattaaggacaacagagccgtccacgctgatatgggctactggatcgagtccgccctcaacgacacatggaaaatcgaaaaggctagcttcattgaggtgaagtcttgccactggcctaaaagccataccctgtggtccaatggcgtgctggagagcgaaatgatcattcccaagaacttcgccgggccggtctctcagcacaattatcgccctggataccatacacagaccgccggcccctggcaccttgggcggctcgagatggattttgacttctgtgaaggaacgacagttgtggtgaccgaggattgcggcaacagagggccctccctgcggaccacaaccgctagcggaaaactgatcacggaatggtgctgtcgctcctgcacactccctccgctgagataccggggcgaggacggctgttggtatgggatggagattagaccccttaaggaaaaagaggaaaatctggtcaactctctcgtgaccgcgggacatggccagatcgataattttagcctgggggttctgggaatggcccttttcctcgaggaaatgctgcgcacacgggtgggcaccaagcacgctattctgctcgtcgccgtgtcctttgttacactgatcaccgggaacatgtctttcagagaccttggacgcgtgatggtcatggtgggcgccacgatgaccgataatatcggcatgggggttacatacctggctctcctggccgcgtttaaggtgagacctaccttcgctgccggactgcttctgcggaaactcacaagcaaggagctgatgatgaccacgattggcatcgtcctcctgtcccaatctacaattcccgagaccatccttgaactgacagacgccctcgctctggggatgatggtgctgaaaattgtgcgcaacatggagaagtatcagcttgccgtcaccatcatggcgatcctgtgcgttcctaatgctgtgattctccagaacgcctggaaagtgagctgtaccatcctggccgtcgtgtccgttagccccctcctgcttacatcttcccaacagaaggctgattggattcctctggccctcacgatcaagggactgaatcccaccgctatttttctgacaacccttagcagaacatctaaaaagcggtcctggccgctgaacgaagccatcatggcggtgggcatggtcagcatcctcgcctcttccctgctcaaaaatgacattcctatgaccgggcccctggtggctggaggccttctgacggtttgctacgtgctgacaggccgcagcgccgatctcgagctggaaagagctgccgacgtccggtgggaggagcaggccgaaatctccgggagctctcctattcttagcatcaccatttccgaggacggatctatgagcatcaagaacgaagaggaggaacagaccctgacaattctcatccgcaccggcctgctcgtgatctccgggctgttccccgtctctattccgatcacagctgcggcctggtatctttgggaggtgaaaaagcaaagagctggagttctgtgggatgtgccttctccccctcccgtcggcaaagccgaactggaggacggggcctaccggattaagcagaagggaatcctcggctattcccagattggcgctggggtgtacaaagaaggaacgtttcacaccatgtggcatgttacacgcggcgccgtgctgatgcacaaggggaaaagaatcgagccctcctgggcggatgtcaagaaagaccttatcagctacggaggcgggtggaagctggagggagaatggaaggagggcgaagaggtccaggtgctcgctctggaacctggcaaaaacccgcgggccgttcaaaccaagcccggactgttcaaaacaaataccggaacgattggcgccgtctccctggattttagccctgggacctctggatcccccatcgtggacaagaaaggcaaggtggtcgggctttatggaaacggcgtggttacaagaagcggcacctacgtgtctgctattgcccagacagagaagtccatcgaggataatcctgaaattgaggacgatatcttccgcaaaaagcggctgaccatcatggacctgcatcccggggcgggaaaaacaaagagatatctccctgctattgtccgcgaagccatcaaacggggcctgagaacgcttattctggccccgacccgcgtggttgctgccgagatggaagaggctctccgggggctgcccatcagataccagacccctgccattcgcgcggagcacaccggacgggaaatcgtggatctcatgtgtcatgccaccttcacaatgagactgcttagccccattcgggtccctaactataatctgatcatcatggacgaggctcactttacggatcccgcctccattgctgcccgcggctacatctctaccagagtggaaatgggggaggccgctggcattttcatgacagcgaccccgcctggaagccgggacccctttccccagtccaacgcccctatcatggacgaggaacgcgagattcccgaaagaagctggaactctggccacgagtgggttacagatttcaaggggaagaccgtgtggtttgtcccttccatcaaagctggaaacgacatcgccgcctgcctgcggaagaatggcaaaaaggtgattcaactcagcagaaaaacgttcgattctgaatatatcaagacacgcaccaacgactgggattttgtggtcaccacagacattagcgagatgggggctaatttcaaggccgagcgggttatcgatccgagacgctgtatgaaacccgtgattctgaccgacggagaagaacgggtgatccttgcgggccctatgcccgtcacacattcctctgctgcccagagacgcgggcgggtgggcagaaaccctaagaatgaaaacgatcagtacatctacatgggagagcccctggaaaatgacgaggattgcgcccactggaaagaggctaagatgctcctggacaacattaacaccccggaaggcatcattcctagcatgtttgagcccgaacgcgagaaagttgacgccgtggatggggaatatagactgcggggagaggcgcgcaagacgttcgtcgacctcatgagacggggcgatcttcctgtgtggctggcctacaaagttgctgccgaggggatcaattatgctgaccgcagatggtgttttgatggagtgaagaacaatcaaattctggaagagaacgtcgaagtggagatctggacaaaggagggcgaacggaaaaagctcaaacccagatggctggacgcccgcatttactccgatcctcttgctctgaaggagttcaaagagttcgccgcggggcggaagtctctcaccctgaatctgatcacagagatgggcagactccccacctttatgacgcagaaggcccgcaacgctcttgacaatctggccgtcctgcataccgctgaagccggaggccgggcctataaccacgctctcagcgagctgccggagacacttgaaaccctgctcctgctgacactccttgcgaccgtgacagggggaatcttcctgtttctgatgtccggcaaagggattggaaagatgaccctcggcatgtgctgcatcattacggccagcatcctgctttggtacgctcagattcagcctcactggatcgccgcctctatcattctggagttctttctcatcgttctgctgattcccgaacccgagaaacaaagaacacctcaggataatcagctcacctatgtggtgatcgctattcttaccgtcgttgccgcgacaatggccaacgaaatgggcttcctggagaagaccaaaaaggactttgggctgggatccatcacaacgcagcaaccggagagcaatatcctcgatattgacctgcggcccgcttccgcctggaccctttacgctgtggccacaaccttcatcacacctatgctgcgccattctattgaaaacagctccgtgaatgtctctctcaccgcgatcgccaaccaggctacggtgctgatgggcctggggaagggatggcccctcagcaaaatggatattggcgttcctcttctggccatcgggtgttactcccaggtgaatcccattaccctgacagctgccctcctgcttctggtcgctcactatgccatcatcggacctggcctccaggcgaaggccaccagagaggctcaaaaacggacagccgctggcattatgaagatcccggccgccctgattgtgaccgtcatcgacctggaccccattccttacgatcccaaatttgaaaagcagctcggacaggtgatgcttctggttctgtgcagcacacaggtgctcatgatgcgcacaacctgggcgctgtgtgaggctcttacactggccaccggacctatctctaccctctgggaaggcaaccccgggagattctggaatacaacgatcgctgtctccatggccaacatttttcggggaagctatctggccggcgctgggctcctcttctctatcatgaagaacaccgccaatacacgcagaggaaccggcaacacaggcgagacccttggggagaaatggaagaatcggctgaacgcgctgggaaaatccgaatttcaaatttacaagaaaagcggcatccaggaggtggaccgcacgctcgccaaggaagggattaaaagaggagagacagatcatcacgctgtttctcggggcagcgccaagctgagatggttcgtggagcgcaatcttgtcaccccggaagggaaggtggtggacctgggatgcggccggggcgggtggtcctattactgtggaggcctcaaaaacgttaaggaggtcaaagggctgaccaagggaggccctgggcatgaagaacccatccccatgtctacatatggatggaatctggtgagactccagagcggcgtggatgtcttctttacccctcccgaaaaatgcgacacacttctgtgtgatatcggcgagtccagccctaacccgacggttgaggctgggcgcaccctgcgggtgctcacactggtggaaaattggcttaacaataacacccaattctgcattaaggtcctgaatccctacatgccttccgtgatcgagaagatggaagccctccagagaaaatacggaggcgcgctggttcgcaaccccctgtctcggaatagcacacacgagatgtattgggtgtccaacgcctctgggaacattgtcagctccgtgaatatgatctctagaatgctcattaaccgctttaccatgcggcacaagaaagctacgtacgaacctgacgttgatcttggaagcggcaccagaaatatcgggatcgagtccgagacacccaacctggacattatcggaaagcgcattgagaagatcaagcaggagcatgaaaccagctggcactatgatcaggaccatccgtacaagacatgggcctatcacggctcttacgagaccaaacaaacaggctccgctagctctatggtgaatggggtcgtgcggctgctcaccaagccttgggatgtgattcccatggtcacgcagatggccatgacagacaccacccctttcggacagcagagagtttttaaagaaaaggtggacacacgcacgcaagagcccaaagagggcaccaagaagctgatgaaaatcacagctgaatggctttggaaggagctggggaaaaagaaaacccctagaatgtgtacacgggaagagttcacccgcaaggtgagatccaacgccgcgctcggagccatttttacagatgagaataaatggaaaagcgctcgggaagccgtcgaggactctggcttctgggaactggtggataaggagagaaacctgcacctcgaagggaaatgcgagacctgtgtttataatatgatgggaaagcgggagaaaaagctgggcgaatttggcaaagctaaggggtcccgcgccatctggtacatgtggcttggagccagattcctggagtttgaagcgctcggcttcctgaacgaggaccattggtttagccgggaaaattcccttagcggggtggagggagagggcctgcacaagctcgggtacatcctgcgcgatgtctctaaaaaggaaggcggagctatgtatgccgacgatacggccggctgggacaccagaattacactggaggatctcaaaaacgaagagatggtgaccaatcatatggaaggggagcacaagaaactggctgaggccatcttcaaacttacataccagaacaaggttgtgcgggtccagcgccccaccccgagaggaacggtgatggacattatcagccggcgcgatcagagaggctccgggcaagttgtgacatatggactgaataccttcacaaacatggaagctcagctcattcggcagatggagggcgaaggggtctttaaatctatccaacagctgaccgccacggaggagatcgcggtgaagaactggcttgtccgcgtgggcagagaacggctgagccgcatggccatttccggagacgactgcgttgtgaaacctctcgatgacagattcgcttctgccctgaccgctctgaatgatatgggcaaggtccggaaagacatccagcagtgggagcccagcagagggtggaacgattggacacaagtgcccttttgctcccatcacttccacgaactcattatgaaggacggacgcgtgctggttgtgccttgtcggaatcaggatgagcttatcggcagagcccgcatttctcagggggcgggatggagcctgcgggaaaccgcctgcctcggcaagtcctacgctcagatgtggagcctgatgtattttcatagacgcgaccttcggctggccgctaacgccatctgttctgctgtcccgtcccactgggtgcccacaagcagaaccacatggtctatccatgccacccacgagtggatgacgacagaggatatgctcaccgtttggaatcgcgtgtggattcaagaaaacccttggatggaggacaaaacccccgtcgaatcctgggaggaaatcccttacctggggaagcgggaggatcagtggtgcggcagcctgattggactcacatccagagcgacctgggccaaaaatatccagacagctattaaccaggtgcgctctctgatcggcaatgaggaatatacggactacatgcccagcatgaagcggttcagacgggaggaagaggaagccggggtcctttggtga

SEQ ID NO: 19584 - RNA, 9876 nt, synthetic construct
  misc_feature 1..9876: note = derived and/or modified CDS sequence (opt5) from DENV-2__KX380815__SS-prME
  source 1..9876: mol_type = other RNA
accgccggaatcattatcatgatgattcccacagtgatggctttccacctgacgaccagaaacggggagcctcatatgatcgtgagccggcaggaaaaggggaaaagcctcctgtttaagacagagaatggcgttaacatgtgcacccttatggccatggacctgggggaactctgtgaggatacaattacctacaattgcccgctgcttcgccaaaacgaacccgaggacatcgattgttggtgcaattctacaagcacctgggtgacgtatgggacctgtacagcgaccggcgagcacagacgggaaaaacgctccgtggctctggtccctcatgtggggatggggctcgagacaagaaccgaaacgtggatgtctagcgagggcgcctggaagcacgcccagcggatcgagacatgggttctgcgccatcccggcttcaccattatggctgccatcctggcttacacaattgggaccacctattttcagagagtgctcatcttcattctgcttacagccgtcgcgccttccatgacgatgcggtgcatcggaatttctaaccgcgactttgtggaaggcgttagcgggggatcctgggtggatatcgtcctggagcacggcagctgtgtgaccacaatggccaaaaataagcccaccctcgacttcgaactgatcaagacagaggctaaacaccctgccacccttagaaagtactgcattgaagctaaactgacgaacacaaccaccgcctctcggtgtccgacacagggggagccctccctcaatgaggaacaagataagcgctttgtgtgcaaacatagcatggtcgacagaggatggggcaacggctgtgggctgttcggaaagggcgggatcgttacctgcgcgatgtttacatgcaagaaaaatatggagggaaagattgtgcagcctgaaaacctggagtatacgatcgtgattacaccccactctggcgaagagaatgccgtcgggaacgatacaggaaaacatggcaaggagatcaaagtgacccctcagtccagcatcacagaagctgagctcaccggctacgggacggttaccatggaatgttctccccggacaggactggacttcaatgagatggtgcttctgcagatggaaaacaaggcctggctcgtccaccgccaatggtttctggatcttccgctgccttggctccccggcgctgacacccaggggtccaactggattcagaaagagacactggtgaccttcaagaatcctcacgccaagaaacaggatgttgtggtcctgggaagccaagagggcgccatgcatacggctctcacaggggcgaccgaaatccagatgtcctctggcaacctgctttttacaggacacctgaagtgcagactccggatggacaaactgcagcttaagggcatgagctattccatgtgtaccgggaaattcaaggtggtcaaggagattgccgaaacccaacatggaacaatcgtgattagagttcagtacgagggcgacgggagcccctgcaaaatccccttcgagatcatggatctggaaaagcgccacgtgctcggacggctgattacggtcaatcctatcgtgaccgagaaagactctccggttaacattgaagctgagcccccttttggcgattcctacatcattatcggggtggaacccggccagctgaagctcagctggttcaaaaagggatctagcattggccagatgtttgagacaaccatgagaggggccaagcgcatggccatcctgggagacacagcttgggatttcggctcccttgggggagtctttacctctatcggcaaagccctgcatcaagtgttcggggcgatttatggcgctgcctttagcggagtgtcctggacgatgaagatcctcattggcgttgtcatcacatggattgggatgaatagccggtctacctccctgagcgtgtctctggtgcttgtcggagtggttaccctctacctgggcgtgatggtccaggccgactccgggtgtgtggttagctggaaaaacaaggagctgaaatgcggatccggcatcttcatcacagataatgtgcacacctggacagaacagtataagtttcagcctgagtctcccagcaagctcgcttccgccattcaaaaagctcacgaagaggggatctgtggcattagatctgtcacgcgcctggaaaaccttatgtggaagcagatcaccccggagctgaatcatattctcacagagaacgaagtgaaactgaccatcatgacaggagacatcaagggcattatgcaggccgggaaacggagcctgagacctcagcccaccgagcttaagtactcctggaaagcgtggggaaaggccaagatgctcagcacggaactgcacaatcataccttcctgatcgatggccctgagacagctgaatgccccaacaccaatcgcgcctggaactctctcgaggttgaggactatgggtttggagtgttcacaaccaatatttggctgaaacttaaggaacggcaagatgtctcctgtgacagcaaactgatgtctgctgccatcaaggacaacagagcggtgcacgccgatatgggctactggattgagtccgctctcaacgacacatggaaaatcgaaaaggccagctttatcgaggtgaagtcttgccactggcctaaaagccataccctgtggtccaatggcgtcctggagagcgaaatgattatccccaagaacttcgctgggccggtttctcagcacaattatcgccctggataccatacgcagacagccggcccctggcaccttgggcggctcgagatggatttcgacttttgtgaaggaaccaccgtggtggtcacagaggattgcggcaacagagggccctccctgcggaccacgacagccagcggaaaactgattaccgaatggtgctgtcgctcctgcacactccctccgctgagataccggggcgaggacggctgttggtatgggatggagatcagaccccttaaggaaaaagaggaaaatctggtgaactctctcgttaccgctggacatggccagattgataatttcagcctgggggtgctgggaatggcgctttttctcgaggaaatgctgcgcacacgggtcggcaccaagcacgccatcctgctcgtggctgtttccttcgtgacgctgattaccgggaacatgtcttttagagaccttggacgcgtcatggtgatggttggcgccacaatgaccgatgacatcggcatgggggtgacatacctggccctcctggctgccttcaaggtcagacctacctttgcggctggactgcttctgcggaaactcacgagcaaggagctgatgatgacaaccatcggcattgtgctcctgtcccaatctacaatccccgagaccattcttgaactgaccgatgccctcgccctggggatgatggtgctgaaaatcgtccgcaatatggagaagtatcagcttgctgttacaattatggccatcctgtgcgtgcctaacgcggtgatcctccagaatgcttggaaagtcagctgtacgaccctggccgtggtttccgtgagccccctcctgcttacatcttcccaacagaagaccgactggattcctctggccctcacaatcaagggactgaaccccaccgctattttcctgacgacacttagcagaacctctaaaaagcggtcctggccgctgaatgaagccatcatggctgtcggcatggtgagcattctcgcctcttcctttctgaaaaacgatatccctatgaccgggcccctcgttgcgggaggcctgcttacagtgtgctacgtcctgaccggccgcagcgccgacctggagctcgaaagagctgccgacatccggtgggaggagcaggctgaaatttccgggagctctcctatcctgagcattacaatctccgaggatggatctatgagcattaagaatgaagaggaggaacagacgcttaccatcctgattcgcacaggcctcctggtgatctccggactcttccccgtctctatcccgattaccgccgccgcttggtatctgtgggaggtgaaaaagcaaagagcgggagttctttgggacgtgccttctccccctcccgtcggcaaagccgaactggaggatggggcttaccggatcaagcagaagggcattctgggctattcccagatcggcgccggggtgtacaaagaaggaacatttcacaccatgtggcatgttacgcgcggcgccgtgctcatgcacaaggggaaaagaattgagccctcctgggctgacgtcaagaaagatctgatcagctacggaggcgggtggaaacttgagggagaatggaaggagggcgaagaggtccaggtgctggccctcgaacctggcaaaaacccgcgggcggttcaaaccaagcccgggctgttcaaaacaaacaccggaacaatcggcgctgtctccctcgactttagccctgggacctctggatcccccattgtggataagaaaggcaaggtggtcgggctgtatggaaatggcgtggttacaagaagcggcacgtacgtgtctgccatcgcccagaccgagaagaacattgaggacaatcctgaaatcgaggatgacattttccgcaaaaagcggcttacaatcatggatctgcatcccggggctggaaaaaccaagagatatctgcctgccatcgtccgcgaagcgattaaacggggcctcagaaccctgatccttgctccgacacgcgtggttgccgccgagatggaagaggctctgcgggggctccccattagataccagacgcctgccatccgcgctgagcacaccggacgggaaattgtggacctgatgtgtcatgccacattcaccatgagactcctgtcccccatccgggtccctaactataatcttattatcatggatgaggcgcactttacagaccccgccagcatcgctgcccgcggctacatttccaccagagtggaaatgggggaggctgccggcatcttcatgacggccacaccgcctggatctcgggacccctttccccagagcaacgctcctattatggatgaggaacgcgagatccccgaaagatcctggaatagcggccacgagtgggttaccgacttcaaggggaagaccgtgtggtttgtcccttctattaaagcgggaaacgatatcgccgcttgcctgcggaagaatggcaaaaaggtgatccaactgtccagaaaaacattcgacagcgaatatgtgaagacccgcacaaacgattgggactttgtcgttaccacggatatttctgagatgggggccaatttcaaggccgagcgggtgatcgacccgagacgctgtatgaaacccgtgattctcacagatggagaagaacgggtcatcctggctggccctatgcccgtgacccatagctccgccgcgcagagacgcgggcgggttggcagaaaccctaagaatgaaaacgaccagtacatttacatgggagagccccttgaaaatgatgaggactgcgctcactggaaagaggccaagatgctgctcgacaacatcaacacaccggaaggcatcattccttctatgtttgagcccgaacgcgagaaagtggatgccatcgacggggaatatagactgcggggagaggctcgcaagaccttcgtcgatctgatgagacggggcgacctccctgtgtggcttgcctaccgcgttgcggccgaggggattaattatgctgatagacggtggtgttttgacggagtgaaaaacaatcaaatcctggaagagaacgtcgaagtggagatttggacgaaggagggcgaaagaaagaaactgaagccccgctggctcgatgcccggatctacagcgaccctctggctcttaaagagttcaaggagttcgccgctgggagaaaatccctgaccctcaatctgattacagagatgggccgcctgcccacctttatgacacagaaggcccggaacgcgctcgataatcttgccgtcctgcataccgctgaagccggaggcagagcttataaccacgccctgtctgagctcccggagacactggaaacccttctgctcctgacgctgctcgccacagtgaccgggggaatcttcctttttctgatgagcggcaaggggatcggaaaaatgaccctgggcatgtgctgcattgttacagcttccatcctcctgtggtacgcgcagattcagcctcactggatcgccgctagcattatccttgagttctttctgatcgtgctcctgattcccgaacccgagaagcaacggacccctcaggacaatcagctgacatatgtggtcatcgccattctcacggttgtggccgctaccatggccaacgaaatgggcttccttgagaaaacaaagaaagattttgggctgggatctatcaccacacagcaaccggagtccaatattctggacatcgatctccgccccgcgagcgcctggaccctgtacgctgtggccacgaccttcatcacacctatgcttagacattccattgaaaactctagcgtcaatgtgtccctgaccgctatcgccaaccaggcgacagttctcatgggcctggggaagggatggcccctgtctaagatggacattggcgtgcctctccttgccatcgggtgttacagccaggtcaatcccattaccctgacggctgccctgctcctgcttgtggctcactatgccatcattggacctggcctgcaggctaaagccacacgggaggcgcaaaagcgcgccgctgccggcatcatgaaaatcccggctgccctcattatgaccgtcatcgacctggatcccattccttacgaccccaagtttgaaaaacagctgggacaggtgatgctccttgttctgtgctccacacaggtgctgatgatgagaaccacctgggccctctgtgaggcgctgacacttgctacgggacctatcagcaccctgtgggaaggcaaccccgggcggttctggaatacaaccattgccgtctctatggctaacatctttcgcggatcctatctcgccggcgccgggctgctgttcagcatcatgaagaacacagctaataccagacggggaacgggcaacacaggcgagaccctcggggagaagtggaaaaatcaacttaacgccctgggaaagtctgaatttcagatttacaaaaagtccggcatccaggaggtggatcgcaccctggcgaaagaagggattaagagaggagagacagaccatcacgccgttagccggggctctgctaaactcagatggttcgtggagcgcaatctggtcaccccggaagggaaggtggtggatcttggatgcggccggggcgggtggagctattactgtggaggcctgaagaacgttaaagaggtcaaggggctcacaaaaggaggccctgggcatgaggaacccatccccatgtccacgtatggatggaatctggtgagactgcaatctggcgtggacgtcttctttacccctcccgaaaagtgcgatacactcctttgtgacattggcgagagctcccctaacccgaccgttgaggccgggcgcacactgcgggtgctgaatctcgtggaaaactggctgaataacaatacccagttctgcatcaaagtccttaacccctacatgcctagcgtgatcgagaagatggaagctctgcagagaaagtacggaggcgccctcgttcgcaatcccctgtcccggaactctacgcacgagatgtattgggtgagcaacgcgtccgggaatattgtctctagcgtgaacatgatctccagaatgctgattaatcgctttaccatgcggcacaaaaaggccacatacgaacctgatgttgacctcggatctggcaccagaaacatcgggattgagagcgaggtgcccaatcttgatatcatcggaaaacgcattgaaaagatcaaacaggagcatgaaacatcctggcactatgaccaagatcatccgtacaagacctgggcttatcacggcagctacgagacaaagcagaccggctctgcctccagcatggtcaacggggtggtgcggctgctgacgaaaccttgggacgtcattcccatggttacacagatggctatgaccgacaccacacctttcggacagcaaagagtgtttaaggaaaaagtggatacgcgcacccaggagcccaaggagggcaccaagaagctcatgaagatcaccgccgaatggctgtggaaagagcttgggaagaaaaagacacctagaatgtgtacccgggaagagttcacacgcaaagtcagatctaatgctgccctgggagcgatttttaccgacgagaacaagtggaaatccgcccgggaagctgtggaggatagcggcttctgggaactcgttgacaaggagagaaatctgcacctggaagggaagtgcgagacgtgtgtgtataacatgatgggaaaacgggagaagaaactcggcgaatttggcaaggccaaagggtctcgcgctatctggtacatgtggctgggagccagattccttgagtttgaagccctgggcttcctcaatgaggatcattggttttcccgggaaaacagcctgtccggggtcgagggagagggccttcacaagctggggtacattctccgcgacgtgagcaagaaagaaggcggagcgatgtatgctgatgacaccgccggctgggatacaagaatcaccctggaggacctgaagaatgaagagatggttacaaaccatatggaaggggagcacaaaaagctcgccgaggctatcttccggctgacctaccagaataaagtggtccgcgtgcagagacccacgccgcggggaacagttatggatattatctctcgcagagaccaacggggcagcggacaggtggtcacctatggacttaacacattcaccaacatggaagcccagctgattcgccaaatggagggcgaaggggtgtttaagtccatccagcatctcacggctaccgaggagattgccgtcaagaattggctggtgagagttggccgggaacgcctttctagaatggcgatcagcggagacgattgcgtggtcaaacctctggacgatcggttcgccaacgctctcacagccctgaatgacatgggcaaggtgagaaaagatatccagcagtgggagccctcccgcgggtggaacgactggacccaagtgcccttttgctctcaccacttccatgaactgattatgaaggatggacgggttctcgtggtcccttgtagaaatcaggacgagctgatcggccgcgctcggattagccagggggccggatggtcccttagagaaacagcgtgcctgggcaaatcttacgcccagatgtggagcctcatgtattttcaccgccgggatctgagacttgctgccaacgctatctgttccgccgtgccgagccattgggttcccacctctcgcacaacctggtccattcacgctacgcacgagtggatgacaaccgaggacatgctgaccgtgtggaatcgggtctggatccaagaaaacccttggatggaggataagacacccgtggaaagctgggaggaaatcccttacctcgggaagagagaggaccagtggtgcggctctctgattggactgacctcccgcgccacatgggcgaaaaatatccagacggccattaaccaggtccggagcctcatcggcaatgaggaatataccgattacatgccctccatgaagagattccggagagaggaagaggaagctggggtgctgtggtga

SEQ ID NO: 19585 - RNA, 9876 nt, synthetic construct
  misc_feature 1..9876: note = derived and/or modified CDS sequence (opt5) from DENV-2__KX380816__SS-prME
  source 1..9876: mol_type = other RNA
accgccggcatcattatcatgatgattcccaccgtgatggctttccacctgacgaccagaaacggggagcctcatatgatcgtcagccggcaggaaaagggaaaatccctcctgtttaagacagagaatggcgttaacatgtgcacccttatggccatggacctgggggaactctgtgaggatacaattacctacaattgcccgctgcttagacaaaacgaacccgaggacatcgattgttggtgcaattctacaagcacctgggtgacgtatggaacctgtacagcgaccggcgagcacagacgggaaaaacgctccgtggctctggtccctcatgtggggatgggactcgagacaagaaccgaaacgtggatgtctagcgagggcgcctggaagcacgcccagcggatcgagacatggattctgcgccatcccggcttcaccatcatggctgccattctggcttacacaatcgggaccacctattttcagagagttctcattttcatcctgcttacagccgtgacgccttccatggcgatgcggtgcattggaatctctaaccgcgactttgtcgaaggcgtgagcgggggatcctgggttgatatcgtgctggagcacggcagctgtgtcaccacaatggccaaaaataagcccaccctcgacttcgaactgattaagacagaggctaaacaccttgccaccctgagaaagtactgcgtggaagctaaactcacgaacacaaccaccgcctctcggtgtcctacacagggggagccgtccctgaatgaggaacaagataagcgctttgtgtgcaaacatagcatggtcgacagaggatggggcaacggctgtgggctgttcggaaagggcgggatcgttacctgcgcgatgtttacatgcaagaaaaatatggagggaaaggtggtgcagcccgaaaacctcgagtatacgattgtcatcacccctcactctggcgaagagaatgccgtggggaacgatacaggaaaacatggcaaggagattaaagttacaccccagtccagcatcacagaagctgagctgaccggctacgggacggtgaccatggaatgttctcctcggacaggacttgacttcaatgagatggtcctgctccagatggaaaacaaggcctggctggtgcaccgccaatggtttcttgatctgcccctcccgtggctgcctggcgctgacacccaggggtccaactggatccagaaagagacactggttaccttcaagaatccccacgccaagaaacaggatgtggtcgtgctcggaagccaagagggcgccatgcatacggctctgacaggggcgaccgaaattcagatgtcctctggcaaccttctgtttacaggacacctcaagtgcagactgcggatggacaaacttcagctgaagggcatgagctattccatgtgtaccgggaaattcaaggtcgtgaaggagatcgccgaaacccaacatggaacaattgttatcagagtgcagtacgagggcgacgggagcccttgcaaaattcccttcgagatcatggatctcgaaaagcgccacgtcctgggacggctgatcacggtgaatcccattgttaccgagaaagactctcctgtgaacatcgaagctgagccgccctttggcgattcctacattatcattggggtcgaacctggccagctcaagctgagctggttcaaaaagggatctagcatcggccagatgtttgagacaaccatgagaggggccaagcgcatggccattcttggagacacagcttgggatttcggctccctcggcggggtgtttacctctatcgggaaagccctccatcaagtgttcggggcgatctatggcgctgcctttagcggagtttcctggacgatgaagattctgatcggcgtcgtgattacatggatcgggatgaatagccggtctacctccctgagcgtgtctcttgtcctcgtgggagttgtgaccctgtacctgggcgtcatggtgcaggccgactccgggtgtgttgtgagctggaaaaacaaggagctcaaatgcggatccggcattttcatcacagataatgtccacacctggacagaacagtataagtttcagcccgagtctcctagcaagctggcttccgccatccaaaaagctcacgaagaggggatttgtggcatcagatctgtgacgcgccttgaaaacctgatgtggaagcagattacccccgagctcaatcatatcctgacagagaacgaagttaaactgaccattatgacaggagacatcaagggcatcatgcaggccgggaaacggacccttagaccgcagcctacggagctcaagtacagctggaaagcgtggggaaaggccaagatgctgtccaccgaactgcacaatcatacattcctcattgatggccccgagaccgctgaatgccctaacacaaatcgcgcctggaacagcctggaggtggaggactatgggtttggagtcttcaccacaaatatctggcttaaactgaaggaacggcaagatgtgttttgtgactctaaactcatgtccgctgccattaaggacaacagagcggtgcacgccgatatgggctactggatcgagagcgctctgaacgacacctggaaaattgaaaaggcctctttcatcgaggtcaagtcctgccactggcccaaaagccatacgctgtggtctaatggcgttcttgagagcgaaatgatcattcctaagaacttcgctgggcccgtgtcccagcacaattatcgcccgggataccatacacagaccgccggcccttggcacctcgggcggctggagatggattttgacttctgtgaaggaaccacagtggtcgtgaccgaggattgcggcaacagagggcccagcctgcggacgacaaccgcctctggaaaactcatcacagaatggtgctgtcgctcctgcaccctgccccctcttagataccggggcgaggacggctgttggtatgggatggagattagaccgctgaaggaaaaagaggaaaatctcgttaacagcctggtgacagctggacatggccagatcgataatttttccctgggggtccttggaatggcgctgttcctggaggaaatgctgcgcacccgggtgggcacgaagcacgccattctcctggttgctgtgtcttttgtcacccttatcacagggaacatgagcttcagagacctgggacgcgtgatggttatggtgggcgccaccatgacagatgacattggcatgggggtcacctacctcgccctgctggctgcctttaagatcagacccacgttcgcggctggacttctgctccggaaactgacatccaaggagctcatgatgaccacaatcggcattgtgctgctttctcaaagcaccatccctgagtccattctggaactcaccgatgccctggccctggggatgatggtgcttaaaatcgtccgcaatatggagaagtatcagctggctgttacaattatggccatcctctgcgtgcccaacgcggtgatcctgcagaatgcttggaaagtctcttgtacgaccctcgccgtggttagcgtgtcccctctgcttctgacaagctctcaacagaaggccgactggattcccctcgctctgaccatcaagggactgaaccctacagccatttttcttaccacgctgtccagaacaagcaaaaagcggtcttggcccctcaatgaagctatcatggccgtcggcatggtgtccattctggcgagctctctcctgaaaaacgatatcccgatgaccgggcctcttgttgccggaggcctgctgaccgtgtgctacgtcctcacaggccgctccgctgacctggagcttgaaagagccgctgacgtgcggtgggaggagcaggccgaaatcagcgggtccagccccattctgtctatcaccattagcgaggatggatccatgtctatcaagaatgaagaggaggaacagacactcacgattctgatccgcaccggcctcctggtcattagcgggcttttccctgtgtccatccccatcacagccgctgcgtggtatctgtgggaggttaaaaagcaaagagccggagtgctgtgggacgtcccgtctcctccccctgtgggcaaagctgaactcgaggatggggcctaccggattaagcagaagggaatcctgggctatagccagattggcgccggggtttacaaagaaggaacctttcacacaatgtggcatgtgacccgcggcgctgtccttatgcacaaggggaaaagaatcgagccctcctgggccgacgtgaagaaagatctgatttcttacggaggcgggtggaagctcgagggagaatggaaggagggcgaagaggtgcaggttctggcgctcgaacccggcaaaaaccctcgggctgtccaaacgaagccggggctgttcaaaaccaacacaggaaccatcggcgccgtgagccttgacttttcccccgggacaagcggatctcctatcgtggataagaaaggcaaggtcgtggggctgtatggaaatggcgttgtgaccagatccggcacatacgtcagcgccattgctcagacggagaagtctatcgaggacaaccccgaaattgaggatgacatcttccgcaaaaagcggctgaccattatggatctccatcctggggccggaaaaacaaagagatatctgcccgcgatcgtgcgcgaagctatcaaacggggccttagaaccctgattctcgcccctacccgcgttgtggccgctgagatggaagaggccctgcgggggctcccgatcagataccagacacccgctattcgcgccgagcacacgggacgggaaatcgtcgacctgatgtgtcatgcgaccttcacaatgagacttctgtcccctattcgggtgcccaattataacctgatcattatggatgaggcccactttaccgaccctgctagcatcgccgctcgcggctacatctccacaagagttgaaatgggggaggccgccggcattttcatgaccgctacgcccccgggatctcgggacccttttccccagagcaatgcgcccatcatggatgaggaaaaggagattcctgaacgctcctggaacagcggccacgagtgggtgacagacttcaaggggaaaaccgtctggtttgtgccctctatcaaggccggaaatgatattgctgcctgcctccgcaagaacggcaagaaagtgatccaactgtcccggaagaccttcgacagcgaatatatcaagacaagaaccaatgattgggactttgtcgttacaaccgatatttctgagatgggggccaacttcaaagctgagcgcgtgatcgaccctcggagatgtatgaagccggtgattcttacggatggagaggaacgcgtcatcctggccggccccatgcctgtgacacatagctccgcggctcagcggagagggcgcgttggccggaatcccaaaaacgaaaatgaccagtacatttacatgggagagcctctcgaaaacgatgaggactgcgcccactggaaggaggccaaaatgctgctggacaatatcaacacccccgaaggcatcattccgtctatgtttgagcctgaaagagagaaggtggatgctatcgacggggaatatcgcctcagaggagaggcccggaaaacattcgtcgatcttatgcgcagaggcgacctgcccgtgtggctggcgtaccgggttgccgctgaggggattaactatgccgatcgcagatggtgttttgacggagtgaagaataaccaaatcctcgaagagaatgtcgaagtggagatttggaccaaggagggcgaacggaaaaagctgaaacctagatggcttgatgctcgcatctacagcgaccccctggccctcaaggagttcaaagagttcgctgccgggcggaagtccctgacgctgaacctcattaccgagatgggcagacttcctacatttatgacccagaaggcgaaaaatgccctggataacctggctgtcctccatacagccgaagctggaggccgcgcctataatcacgccctgtctgagcttcccgagaccctggaaacactcctgctgctcacccttctggctacggtgacagggggaatcttcctgtttctcatgagcggcaaggggatcggaaaaatgaccctgggcatgtgctgcattatcaccgcgtccattcttctgtggcacgcccagatccagccgcattggattgctgccagcatcatcctcgagttctttctgattgttctgctcatccctgaacccgagaagcaacggacaccccaggacaaccagcttacctacgtggtgattgccatcctgacagtcgttgctgccacgatggcgaatgaaatgggcttcctggagaaaaccaagaaggattttgggctcggatctattacaacccagcaacctgagtccaacatcctggacatcgatcttagaccggccagcgcttggacactgtatgccgtggctaccacgttcattacccccatgctccggcactccatcgaaaattctagcgtgaacgtctccctgacagccattgcgaatcaggccaccgtgctgatgggcctcgggaaaggatggcctctttctaagatggacatcggcgttcccctgctggctattgggtgttacagccaggtgaaccctatcacactcaccgccgctctgcttctgctcgtcgcccattacgctattatcggacccggcctgcaggccaaagcgacgcgcgaggcccaaaagagagctgccgctggcatcatgaaaaatcctacagtggacgggatgaccgtcattgatctggacccgatcccctatgatcctaagtttgaaaagcagctcggacaggtgatgcttctggttctgtgcgtgacacaggtcctcatgatgcggaccacctgggccctgtgtgaggcccttacactggcgacgggccccatttccaccctctgggaagggaaccctggacgcttctggaatacaaccatcgctgtgagcatggccaacatttttagaggctcttacctggctggggccggactcctgttctccatcatgaaaaacacagccaatacccggcgcggcacgggcaacacaggggagacccttggagagaagtggaaaaatagactgaacgctctgggcaagagcgaatttcaaatctataaaaagtctgggattcaggaggttgaccggaccctcgccaaagaaggaatcaagcgcggcgagacagatcaccatgcggtgtccagagggagcgccaagctgcggtggttcgtcgagagaaatcttgtgacccccgaaggaaaagtggttgacctgggctgcggccgcgggggatggtcttactattgtggcgggctcaagaacgtcaaagaggtgaagggactgacaaaaggcgggccgggacacgaagaacctattcccatgagcacgtacggctggaatctggtgcggctccagtccggcgtcgatgttttctttacctctcccgaaaagtgcgacacacttctgtgtgatatcggggagagctcccctaaccccaccgtggaggctggaagaacactgcgcgtgctcaatctggtcgaaaactggcttaataacaatacccaattctgcattaaggtgctgaacccttatatgccgagcgttatcgagaaaatggaagccctccagcggaagtacggcggggctctggtgagaaatcccctgtcccgcaactctacgcacgagatgtactgggtcagcaacgcctccggaaatatcgtgtctagcgttaacatgatttcccggatgctcatcaatagatttaccatgcgccataaaaaggcgacatatgaacctgacgtggatcttggctctgggacccggaacattggaatcgagagcgagacacccaatctggacattatcggcaaaagaatcgaaaagattaagcaggagcacgaaacctcctggcattacgatcaggaccacccttataaaacatgggcctaccacggcagctatgagaccaagcaaacggggtctgcttccagcatggtcaacggagtggtgcgcctgctcacaaaaccctgggacgtcatcccgatggttacccagatggccatgaccgatacaacgcctttcggccagcagcgggtgtttaaggaaaaagtggacaccagaacacaagagcccaaggaggggaccaagaaactgatgaagattacagctgaatggctttggaaagagctgggaaagaaaaagacccctcgcatgtgtacaagagaagagttcacccggaaagtccgctctaatgccgctctcggcgccatctttacggatgagaacaagtggaagtccgcgagagaagccgtggaggacagcgggttctgggaactggttgataaagagcggaatctgcatctcgaaggaaagtgcgagacctgtgtgtacaacatgatgggcaaaagagagaagaaactgggcgaatttgggaaggctaagggatctcgggccatttggtatatgtggcttggcgctcgcttcctggagtttgaagccctcgggttcctgaatgaggaccactggttttccagagaaaacagcctttccggagtcgagggcgaggggctgcataaactcggctacatcctgcgggatgtgagcaagaaagaaggaggcgccatgtacgcggacgatacagctgggtgggacacccgcattacactggaggatctcaagaatgaagagatggttaccaaccacatggaaggagagcataaaaagctggccgaggccatcttcaaacttacgtatcagaataaagtggtcagagtgcagcggcccacacctcgcggcaccgttatggacatcatttctagacgggaccagcgcgggagcggacaagtggtcacatacggcctgaacaccttcacgaacatggaagctcagctcatcagacagatggagggggaaggcgtgtttaagtccattcaacagctgaccgtcaaagaggagatcgccgtgaagaattggcttattcgggttggacgcgaaagactgtctcggatggctatcagcggcgatgactgcgtggtcaaacccctcgatgaccgcttcgcctccgcgctgacagccctgaacgatatggggaaggtgagaaaggacatccagcagtgggagccgtctcggggatggaatgattggacccaagtgcctttttgcagccaccacttccatgaactcattatgaaagacggcagagttctggtggtcccctgtcgcaaccaggatgagcttatcgggcgggctagaatttcccagggagccggctggtctctgcgcgaaacagcttgcctcggaaagagctatgcccagatgtggtccctgatgtactttcaccggagagaccttcgcctggcggccaatgctatctgtagcgccgtgccctctcattggattcctacctcccggacaacctggagcatccacgctacgcacgagtggatgacaaccgaggatatgctcaccgtttggaacagagtgtggatccaagaaaatccgtggatggaggacaaaacacccgtcgaatcttgggaggaaattccttatctgggcaagcgcgaggatcagtggtgcggatccctgatcggcctcaccagccgggccacatgggctaaaaacattcagacggccatcaatcaggtgagatccctgattgggaacgaggaatacaccgactatatgccctctatgaagcgcttccggagagaggaagaggaagcgggagtcctttggtga

SEQ ID NO: 19586 - RNA, 9876 nt, synthetic construct
  misc_feature 1..9876: note = derived and/or modified CDS sequence (opt5) from DENV-2__KX380817__SS-prME
  source 1..9876: mol_type = other RNA
accgccggaatcattatcatgatgattcccaccgtgatggctttccacctgacgaccagaaacggggagcctcatatgatcgtgagccggcaggaaaagggaaaatccctcctgtttaagaccgagaatggcgttaacatgtgcacccttatggccatggacctgggggaactctgtgaggataccattacctacaattgcccgctgcttcgccaaaacgaacccgaggacatcgattgttggtgcaattctacgagcacctgggtgacgtatggaacctgtacagcgaccggcgagcaccggcgggaaaaacgctccgtggctctggtccctcatgtggggatgggactcgagacaagaaccgaaacgtggatgtctagcgagggcgcctggaagcacgcccagcggatcgagacatggattctgcgccatcccggcttcaccatcatggctgccattctggcttacacaatcgggaccacctattttcagagagttctcattttcatcctgcttacagccgtgacgccttccatggcgatgcggtgcattggaatctctaaccgcgactttgtcgaaggcgtgagcgggggatcctgggttgatatcgtgctggagcacggcagctgtgtcaccacaatggccaaaaataagcccaccctcgacttcgaactgattaagacagaggctaaacaccttgccaccctgagaaagtactgcgtggaagctaaactcacgaacacaaccaccgcctctcggtgtcctacacagggggagccgtccctgaatgaggaacaagataagcgctttgtgtgcaaacatagcatggtcgacagaggatggggcaacggctgtgggctgttcggaaagggcgggatcgttacctgcgcgatgtttacatgcaagaaaaatatggagggaaaggtggtgcagcccgaaaacctcgagtatacgattgtcatcacccctcactctggcgaagagaatgccgtggggaacgatacaggaaaacatggcaaggagattaaaatcacaccccagtccagcatcacagaagctgagctgaccggctacgggacggttaccatggaatgttctcctcggacaggacttgacttcaatgagatggtgctgctccagatggaaaacaaggcctggctggtccaccgccaatggtttcttgatctgcccctcccgtggctgcctggcgctgacacccaggggtccaactggattcagaaagagacactggtgaccttcaagaatccccacgccaagaaacaggatgttgtggtcctcggaagccaagagggcgccatgcatacggctctgacaggggcgaccgaaatccagatgtcctctggcaaccttctgtttacaggacacctcaagtgcagactgcggatggacaaacttcagctgaagggcatgagctattccatgtgtaccgggaaattcaaggtggtcaaggagattgccgaaacccaacatggaacaatcgtgattagagttcagtacgagggcgacgggagcccttgcaaaatccccttcgagatcatggatctcgaaaagcgccacgtgctgggacggctgattacggtcaatcccatcgtgaccgagaaagactctcctgttaacattgaagctgagccgccctttggcgattcctacatcattatcggggtggaacctggccagctcaagctgagctggttcaaaaagggatctagcattggccagatgtttgagacaaccatgagaggggccaagcgcatggccatccttggagacacagcttgggatttcggctccctcggcggggtctttacctctatcgggaaagccctccatcaagtgttcggggcgatttatggcgctgcctttagcggagtgtcctggacgatgaagatcctgattggcgttgtcatcacatggattgggatgaatagccggtctacctccctgagcgtgtctcttgtgctcgtcggagtggttaccctgtacctgggcgtgatggtccaggccgactccgggtgtgtggttagctggaaaaacaaggagctcaaatgcggatccggcatcttcatcacagataatgtgcacacctggacagaacagtataagtttcagcccgagtctcctagcaagctggcttccgccattcaaaaagctcacgaagaggggatctgtggcattagatctgtcacgcgccttgaaaacctgatgtggaagcagatcacccccgagctcaatcatattctgacagagaacgaagtgaaactgaccatcatgacaggagacatcaagggcattatgcaggccgggaaacggagccttagaccgcagcctaccgagctcaagtactcctggaaagcgtggggaaaggccaagatgctgagcacggaactgcacaatcataccttcctcatcgatggccccgagacagctgaatgccctaacaccaatcgcgcctggaactctctggaggttgaggactatgggtttggagtgttcacaaccaatatttggcttaaactgaaggaacggcaagatgtcttttgtgactccaaactcatgagcgctgccatcaaggacaacagagcggtgcacgccgatatgggctactggattgagtctgctctgaacgacacatggaaaatcgaaaaggcctccttcatcgaggtcaagagctgccactggcccaaatctcataccctgtggagcaatggcgtccttgagtccgaaatgattatccctaagaacttcgctgggcccgttagccagcacaattatcgcccgggataccatacgcagacagccggcccttggcacctcgggcggctggagatggattttgacttctgtgaaggaaccaccgtggtggtcacagaggattgcggcaacagagggccctctctgcggaccacgacagcctccggaaaactcattaccgaatggtgctgtcgcagctgcacactgccccctcttagataccggggcgaggacggctgttggtatgggatggagatcagaccgctgaaggaaaaagaggaaaatctcgtgaactccctggttaccgctggacatggccagattgataatttttctctgggggtgcttggaatggcgctgttcctggaggaaatgctgcgcacacgggtcggcaccaagcacgccatcctcctggtggctgttagctttgtgacgcttattaccgggaacatgtccttcagagacctgggacgcgtcatggtgatggttggcgccacaatgaccgatgacatcggcatgggggtgacatacctcgccctgctggctgcctttaaggtcagacccaccttcgcggctggacttctgctccggaaactgacgtctaaggagctcatgatgacaaccatcggcattgtgctgcttagccaatccacaatccctgagtctattctggaactcaccgatgccctggccctggggatgatggtgcttaaaatcgtccgcaatatggagaagtatcagctggctgttaccattatggccatcagctgcgtgcccaacgcggtgatcctccagaatgcttggaaagtctcctgtacaacgctggccgtggttagcgtgtctcctctcctgcttacctccagccaacagaaggccgactggattcccctggctctcacaatcaagggactgaaccctaccgccatttttctgacaaccctttctagaacgtccaaaaagcggagctggcccctgaatgaagctatcatggccgtcggcatggtgtctattctcgcgtccagcctgctcaaaaacgatatcccgatgacagggcctctggttgccggaggccttctgaccgtgtgctacgtcctgaccggccgctccgctgacctcgagctggaaagagccgctgacgtgcggtgggaggagcaggccgaaatcagcgggtctagccccattctttccatcacaatttctgaggatggaagcatgtccatcaagaatgaagaggaggaacagaccctgacaattctcatccgcacgggcctgctcgtcatttctgggctgttccctgtgagcatccccatcaccgccgctgcgtggtatctttgggaggttaaaaagcaaagagccggagtgctgtgggacgtcccgtcccctccccctgtgggcaaagctgaactggaggatggggcctaccggattaagcagaagggaatcctcggctattctcagattggcgccggggtttacaaagaaggaacatttcacaccatgtggcatgtgacacgcggcgctgtcctgatgcacaaggggaaaagaatcgagcccagctgggccgacgtgaagaaagatcttatttcctacggaggcgggtggaagctggagggagaatggaaggagggcgaagaggtgcaggttctcgcgctggaacccggcaaaaaccctcgggctgtccaaaccaagccgggactcttcaaaacgaacaccggaacaatcggcgccgtgagcctggacttttctcccgggacctccggaagccctatcgtggataagaaaggcaaggtcgtggggctttatggaaatggcgttgtgacaagatctggcacctacgtctccgccattgctcagacagaaaagagcatcgaggacaaccccgaaattgaggatgacatcttccgcaaaaagcggctgacgattatggatctgcatcctggggccggaaaaaccaagagatatctccccgcgatcgtgcgcgaagctatcaaacggggcctgagaacacttattctggcccctacccgcgttgtggccgctgagatggaagaggccctccgggggctgccgatcagataccagacccccgctattcgcgccgagcacacaggacgggaaatcgtcgacctcatgtgtcatgcgacgttcaccatgagactgctttcccctattcgggtgcccaattataacctgatcattatggatgaggcccactttacagaccctgcttctatcgccgctcgcggctacatcagcaccagagttgaaatgggggaggccgccggcattttcatgacagctacacccccgggatcccgggacccttttccccagagcaatgcgcccatcatggatgaggaacgcgagattcctgaaagatcttggaactccggccacgagtgggtgacggacttcaaggggaagacagtctggtttgtgcccagcatcaaagccggaaatgatattgctgcctgcctgcggaagaacggcaaaaaggtgatccaactctctagaaaaaccttcgacagcgaatatatcaagacccgcacaaatgattgggactttgtcgttaccacagatatttccgagatgggggccaacttcaaggctgagcgggtgatcgaccctagacgctgtatgaaaccggtgattctgaccgatggagaggaacgggtcatccttgccggccccatgcctgtgacgcattctagcgcggctcagagacgcgggcgggttggcagaaatcccaagaacgaaaatgaccagtacatttacatgggagagcctctggaaaacgatgaggactgcgcccactggaaagaggccaagatgctcctggacaatatcaacacacccgaaggcatcattccgtccatgtttgagcctgaacgcgagaaagtggatgctatcgacggggaatatagactgcggggagaggcccgcaagaccttcgtcgatctcatgagacggggcgaccttcccgtgtggctggcgtaccgcgttgccgctgaggggattaactatgccgatagacggtggtgttttgacggagtgaaaaataaccaaatcctggaagagaatgtcgaagtggagatttggacaaaggagggcgaaagaaagaaactcaagcctcgctggctggatgctcggatctactctgacccccttgccctgaaagagttcaaggagttcgctgccgggagaaaaagcctcaccctgaacctgattacggagatgggccgcctccctacctttatgacacagaaggcgaagaatgcccttgataacctggctgtcctgcataccgccgaagctggaggccgggcctataatcacgccctctccgagctgcccgagacacttgaaaccctgctcctgctgacactccttgctaccgtgacagggggaatcttcctgtttctgatgagcggcaaagggatcggaaagatgacactcggcatgtgctgcattatcaccgcgtctattctgctttggtacgcccagatccagccgcactggattgctgcctccatcatcctggagttctttctcattgttctgctgatccctgaacccgagaaacaaagaacaccccaggacaaccagctcacatatgtggtgattgccatccttaccgtcgttgctgccacaatggcgaatgaaatgggcttcctggagaagacgaaaaaggattttgggctgggaagcattaccacacagcaacctgagtccaacatcctcgacatcgatctgcggccggcctctgcttggaccctttacgccgtggctacaaccttcattacgcccatgctgcgccatagcatcgaaaattcctctgtgaacgtcagcctcaccgccattgcgaatcaggccacagtgctgatgggcctggggaagggatggcctctctccaaaatggacatcggcgttccccttctggctattgggtgttacagccaggtgaaccctatcaccctgacagccgctctcctgcttctggtcgcccactatgctattatcggacccggcctccaggccaaggcgaccagagaggcccaaaaacgggctgccgctggcatcatgaagaatcctacggtggacgggatgacagtcattgatctggacccgatcccctacgatcctaaatttgaaaagcagctgggacaggtgatgctccttgttctgtgcgtgacccaggtcctgatgatgcgcacaacctgggccctctgtgaggccctgacccttgcgacaggccccatttctacgctgtgggaagggaaccctggaagattctggaataccacaatcgctgtgtccatggccaacatttttcggggcagctatctcgctggggccggactgctgttctctatcatgaagaacaccgccaatacacgcagaggcaccggcaacacgggggagacactcggagagaaatggaagaatcggcttaacgctctgggcaaatccgaatttcaaatctacaagaaaagcgggattcaggaggttgaccgcaccctggccaaggaaggaatcaaaagaggcgagaccgatcatcacgcggtgtctcgggggagcgccaagctcagatggttcgtcgagcgcaatctggtgacacccgaaggaaaggtggttgaccttggctgcggcagagggggatggtcctattactgtggcgggctgaaaaacgtcaaggaggtgaaaggactcaccaagggcgggccgggacatgaagaacctattcccatgtctacatatggctggaatctggtgagactgcagagcggcgtcgatgttttctttacgccccctgaaaaatgcgacaccctcctttgtgatatcggggagtccagccccaaccctacagtggaggctggacgcaccctgcgggtgctgaatctcgtcgaaaactggctgaataacaatacacaattctgcattaaggtgcttaacccgtacatgccctccgttatcgagaagatggaagccctgcagagaaaatacggcggggctctcgtgcgcaatcctctgtctcggaacagcacccacgagatgtattgggtctccaacgcctctggaaatatcgtgagctccgttaacatgatttctagaatgctgatcaatcgctttacgatgcggcacaagaaagcgacctacgaacccgacgtggatctcggcagcgggacaagaaacattggaatcgagtccgagacccctaatcttgacattatcggcaagcgcatcgagaagattaagcaggagcatgaaacaagctggcactatgatcaggaccatccctacaagacctgggcctatcacggctcttacgagacaaaacaaaccgggtccgctagctctatggtcaacggagtggtgcggctgctgacgaagccgtgggacgtcatccctatggttacacagatggccatgaccgataccacacccttcggccagcagagagtgtttaaagaaaaggtggacacgcgcacccaagagcctaaagaggggacaaagaagctcatgaaaattaccgctgaatggctgtggaaggagcttggcaaaaagaaaacacccagaatgtgtacccgggaagagttcacacgcaaggtcagatccaatgccgctctgggcgccatctttaccgatgagaacaaatggaaaagcgcgcgggaagccgtggaggactctgggttctgggaactcgttgatagagagcggaatctgcacctggaaggaaagtgcgagacgtgtgtgtataacatgatgggcaaacgcgagaagaaactcggcgaatttgggaaggctaaaggatccagagccatttggtacatgtggctgggcgctcggttccttgagtttgaagccctggggttcctcaatgaggaccattggtttagccgcgaaaactccctgagcggagtcgagggcgaggggcttcacaagctgggctacatcctcagagatgtgtctaagaaagaaggaggcgccatgtatgcggacgataccgctgggtgggacacacggattaccctggaggatctgaagaatgaagagatggttacaaaccatatggaaggagagcacaaaaagctcgccgaggccatcttcaaactgacctaccagaataaggtggtccgcgtgcagagacctacgccccggggcacagttatggacatcattagccgcagagaccagcgggggtccggacaagtggtcacctatggccttaacacattcaccaacatggaagctcagctgatccgccagatggagggggaaggcgtgtttaagtctattcaacagctcacggtcaaagaggagatcgccgtgaagaattggctgattagagttggacgggaacgccttagcagaatggctatctccggcgatgactgcgtggtcaaaccgctggatgaccggttcgcctctgcgctcaccgccctgaacgatatggggaaggtgagaaaagacatccagcagtgggagcctagccgcggatggaatgattggacacaagtgcccttttgctcccatcacttccacgaactgattatgaaggacggccgggttctcgtggtcccctgtagaaaccaggatgagctgatcgggcgcgctcggatttctcagggagccggctggagccttagagaaaccgcttgcctggggaagtcctacgcccagatgtggagcctcatgtattttcatcgccgggacctgagacttgcggccaatgctatctgttctgccgtgccttcccactggattccgacaagccgcaccacatggtctatccatgctacccacgagtggatgacgacagaggatatgctgaccgtttggaaccgggtgtggatccaagaaaatccctggatggaggacaaaacccctgtcgaatcctgggaggaaattccctacctcggcaagagagaggatcagtggtgcggaagcctgatcggcctgacatcccgcgccacctgggctaaaaacattcagacagccatcaatcaggtgcggtctctcattgggaacgaggaatatacggactacatgcctagcatgaagagattccggagagaggaagaggaagcgggagtcctgtggtga

SEQ ID NO: 19587 - RNA, 9876 nt, synthetic construct
  misc_feature 1..9876: note = derived and/or modified CDS sequence (opt5) from DENV-2__KX380818__SS-prME
  source 1..9876: mol_type = other RNA
accgctggaatcattatcatgatgattcccaccgtgatggctttccacctgacgaccagaaacggggagcctcatatgatcgtgagccggcaggaaaagggcaagagcctcctgtttaagacagagaatggggttaacatgtgcacccttatggccatggacctgggggaactctgtgaggatacaattacctacaattgcccgctgcttcgccaaaacgaacccgaggacatcgattgttggtgcaattctacaagcacctgggtgacgtatggaacctgtacagcgaccggcgagcacagacgggaaaagcgctccgtggctctggtccctcatgtggggatgggactcgagacaagaaccgaaacgtggatgtctagcgagggcgcctggaagcacgcccagcggatcgagacatgggttctgcgccatcccggcttcaccattatggctgccatcctggcttacacaattgggaccacctattttcagagagtgctcatcttcattctgcttacagccgtcgcgccttccatgacgatgcggtgcatcggaatttctaaccgcgactttgtggaaggcgttagcgggggatcctgggtggatatcgtcctggagcacggcagctgtgtgaccacaatggccaaaaataagcccaccctcgacttcgaactgatcaagacagaggctaaacaccctgccacccttagaaagtactgcattgaagctaaactgacgaacacaaccaccgcctctcggtgtccgacacagggggagccctccctcaatgaggaacaagataagcgctttgtgtgcaaacatagcatggtcgacagaggatggggcaacggctgtgggctgttcggaaagggcgggatcgttacctgcgcgatgtttacatgcaagaaaaatatggagggaaagattgtgcagcctgaaaacctggagtatacgatcgtgattacaccccactctggcgaagagaatgccgtcgggaacgatacaggaaaacatggcaaggagatcaaagtgacccctcagtccagcatcacagaagctgagctcaccggctacgggacggttaccatggaatgttctccccggacaggactggacttcaatgagatggtgcttctgcagatggaaaacaaggcctggctcgtccaccgccaatggtttctggatcttccgctgccttggctccccggcgctgacacccaggggtccaactggattcagaaagagacactggtgaccttcaagaatcctcacgccaagaaacaggatgttgtggtcctgggaagccaagagggcgccatgcatacggctctcacaggggcgaccgaaatccagatgtcctctggcaacctgctttttacaggacacctgaagtgcagactccggatggacaaactgcagcttaagggcatgagctattccatgtgtaccgggaaattcaaggtggtcaaggagattgccgaaacccaacatggaacaatcgtgattagagttcagtacgagggcgacgggagcccctgcaaaatccccttcgagatcatggatctggaaaagcgccacgtgctcggacggctgattacggtcaatcctatcgtgaccgagaaagactctccggttaacattgaagctgagcccccttttggcgattcctacatcattatcggggtggaacccggccagctgaagctcagctggttcaaaaagggatctagcattggccagatgtttgagacaaccatgagaggggccaagcgcatggccatcctgggagacacagcttgggatttcggctcccttgggggagtctttacctctatcggcaaagccctgcatcaagtgttcggggcgatttatggcgctgcctttagcggagtgtcctggacgatgaagatcctcattggcgttgtcatcacatggattgggatgaatagccggtctacctccctgagcgtgtctctggtgcttgtcggagtggttaccctctacctgggcgtgatggtccaggccgactccgggtgtgtggttagctggaaaaacaaggagctgaaatgcggatccggcatcttcatcacagataatgtgcacacctggacagaacagtataagtttcagcctgagtctcccagcaagctcgcttccgccattcaaaaagctcacgaagaggggatctgtggcattagatctgtcacgcgcctggaaaaccttatgtggaagcagatcaccccggagctgaatcatattctcacagagaacgaagtgaaactgaccatcatgacaggagacatcaagggcattatgcaggccgggaaacggagcctgagacctcagcccaccgagcttaagtactcctggaaagcgtggggaaaggccaagatgctcagcacggaactgcacaatcataccttcctgatcgatggccctgagacagctgaatgccccaacaccaatcgcgcctggaactctctcgaggttgaggactatgggtttggagtgttcacaaccaatatttggctgaaacttaaggaacggcaagatgtctcctgtgacagcaaactgatgtctgctgccatcaaggacaacagagcggtgcacgccgatatgggctactggattgagtccgctctcaacgacacatggaaaatcgaaaaggccagctttatcgaggtgaagtcttgccactggcctaaaagccataccctgtggtccaatggcgtcctggagagcgaaatgattatccccaagaacttcgctgggccggtttctcagcacaattatcgccctggataccatacgcagacagccggcccctggcaccttgggcggctcgagatggatttcgacttttgtgaaggaaccaccgtggtggtcacagaggattgcggcaacagagggccctccctgcggaccacgacagccagcggaaaactgattaccgaatggtgctgtcgctcctgcacactccctccgctgagataccggggcgaggacggctgttggtatgggatggagatcagaccccttaaggaaaaagaggaaaatctggtgaactctctcgttaccgctggacatggccagattgataatttcagcctgggggtgctgggaatggcgctttttctcgaggaaatgctgcgcacacgggtcggcaccaagcacgccatcctgctcgtggctgtttccttcgtgacgctgattaccgggaacatgtcttttagagaccttggacgcgtcatggtgatggttggcgccacaatgaccgatgacatcggcatgggggtgacatacctggccctcctggctgccttcaaggtcagacctacctttgcggctggactgcttctgcggaaactcacgagcaaggagctgatgatgacaaccatcggcattgtgctcctgtcccaatctacaatccccgagaccattcttgaactgaccgatgccctcgccctggggatgatggtgctgaaaatcgtccgcaatatggagaagtatcagcttgctgttacaattatggccatcctgtgcgtgcctaacgcggtgatcctccagaatgcttggaaagtcagctgtacgaccctggccgtggtttccgtgagccccctcctgcttacatcttcccaacagaagaccgactggattcctctggccctcacaatcaagggactgaaccccaccgctattttcctgacgacacttagcagaacctctaaaaagcggtcctggccgctgaatgaagccatcatggctgtcggcatggtgagcattctcgcctcttcctttctgaaaaacgatatccctatgaccgggcccctcgttgcgggaggcctgcttacagtgtgctacgtcctgaccggccgcagcgccgacctggagctcgaaagagctgccgacatccggtgggaggagcaggctgaaatttccgggagctctcctatcctgagcattacaatctccgaggatggatctatgagcattaagaatgaagaggaggaacagacgcttaccatcctgattcgcacaggcctcctggtgatctccggactcttccccgtctctatcccgattaccgccgccgcttggtatctgtgggaggtgaaaaagcaaagagcgggagttctttgggacgtgccttctccccctcccgtcggcaaagccgaactggaggatggggcttaccggatcaagcagaagggcattctgggctattcccagatcggcgccggggtgtacaaagaaggaacatttcacaccatgtggcatgttacgcgcggcgccgtgctcatgcacaaggggaaaagaattgagccctcctgggctgacgtcaagaaagatctgatcagctacggaggcgggtggaaacttgagggagaatggaaggagggcgaagaggtccaggtgctggccctcgaacctggcaaaaacccgcgggcggttcaaaccaagcccgggctgttcaaaacaaacaccggaacaatcggcgctgtctccctcgactttagccctgggacctctggatcccccattgtggataagaaaggcaaggtggtcgggctgtatggaaatggcgtggttacaagaagcggcacgtacgtgtctgccatcgcccagaccgagaagaacattgaggacaatcctgaaatcgaggatgacattttccgcaaaaagcggcttacaatcatggatctgcatcccggggctggaaaaaccaagagatatctgcctgccatcgtccgcgaagcgattaaacggggcctcagaaccctgatccttgctccgacacgcgtggttgccgccgagatggaagaggctctgcgggggctccccattagataccagacgcctgccatccgcgctgagcacaccggacgggaaattgtggacctgatgtgtcatgccacattcaccatgagactcctgtcccccatccgggtccctaactataatcttattatcatggatgaggcgcactttacagaccccgccagcatcgctgcccgcggctacatttccaccagagtggaaatgggggaggctgccggcatcttcatgacggccacaccgcctggatctcgggacccctttccccagagcaacgctcctattatggatgaggaacgcgagatccccgaaagatcctggaatagcggccacgagtgggttaccgacttcaaggggaagaccgtgtggtttgtcccttctattaaagcgggaaacgatatcgccgcttgcctgcggaagaatggcaaaaaggtgatccaactgtccagaaaaacattcgacagcgaatatgtgaagacccgcacaaacgattgggactttgtcgttaccacggatatttctgagatgggggccaatttcaaggccgagcgggtgatcgacccgagacgctgtatgaaacccgtgattctcacagatggagaagaacgggtcatcctggctggccctatgcccgtgacccatagctccgccgcgcagagacgcgggcgggttggcagaaaccctaagaatgaaaacgaccagtacatttacatgggagagccccttgaaaatgatgaggactgcgctcactggaaagaggccaagatgctgctcgacaacatcaacacaccggaaggcatcattccttctatgtttgagcccgaacgcgagaaagtggatgccatcgacggggaatatagactgcggggagaggctcgcaagaccttcgtcgatctgatgagacggggcgacctccctgtgtggcttgcctaccgcgttgcggccgaggggattaattatgctgatagacggtggtgttttgacggagtgaaaaacaatcaaatcctggaagagaacgtcgaagtggagatttggacgaaggagggcgaaagaaagaaactgaagccccgctggctcgatgcccggatctacagcgaccctctggctcttaaagagttcaaggagttcgccgctgggagaaaatccctgaccctcaatctgattacagagatgggccgcctgcccacctttatgacacagaaggcccggaacgcgctcgataatcttgccgtcctgcataccgctgaagccggaggcagagcttataaccacgccctgtctgagctcccggagacactggaaacccttctgctcctgacgctgctcgccacagtgaccgggggaatcttcctttttctgatgagcggcaaggggatcggaaaaatgaccctgggcatgtgctgcattgttacagcttccatcctcctgtggtacgcgcagattcagcctcactggatcgccgctagcattatccttgagttctttctgatcgtgctcctgattcccgaacccgagaagcaacggacccctcaggacaatcagctgacatatgtggtcatcgccattctcacggttgtggccgctaccatggccaacgaaatgggcttccttgagaaaacaaagaaagattttgggctgggatctatcaccacacagcaaccggagtccaatattctggacatcgatctccgccccgcgagcgcctggaccctgtacgctgtggccacgaccttcatcacacctatgcttagacattccattgaaaactctagcgtcaatgtgtccctgaccgctatcgccaaccaggcgacagttctcatgggcctggggaagggatggcccctgtctaagatggacattggcgtgcctctccttgccatcgggtgttacagccaggtcaatcccattaccctgacggctgccctgctcctgcttgtggctcactatgccatcattggacctggcctgcaggctaaagccacacgggaggcgcaaaagcgcgccgctgccggcatcatgaaaatcccggctgccgacattgggagagtcatcgatctcgaccccattccttacgatcccaagtttgaaaaacagctgggacaggtgatgctgctcgttctttgcgtgacccaggtcctgatgatgcggacaacctgggccctgtgtgaggcgctcaccctggctacaggccctatctccacgctttgggaagggaaccccggacgcttctggaataccacaattgccgtgagcatggctaacatctttagaggctcttatctggccggggccggactcctgttctccatcatgaagaacaccgctaatacacggcgcggcaccggcaacacgggggagacactgggagagaagtggaaaaatcaactcaacgcccttggcaagagcgaatttcagatttacaaaaagtctgggatccaggaggttgacagaaccctggcgaaagaaggaattaagcggggcgagaccgatcatcacgccgtgtccagagggagcgctaaactgcgctggttcgtcgagcggaatctcgtgacaccggaaggaaaggtggttgacctgggctgcggcagagggggatggtcttattactgtggcgggcttaagaacgtcaaagaggtgaagggactgaccaaaggcgggcctggacatgaggaacccatccccatgagcacatatggctggaatctcgtgcgcctgcaatccggcgtcgatgttttctttacgcctcccgaaaagtgcgacaccctgctctgtgatattggggagtctagccctaacccgacagtggaggccggacggacccttagagtgctgaatctggtcgaaaactggctcaataacaatacacagttctgcatcaaagtgctgaacccctacatgccttccgttatcgagaagatggaagcccttcagcgcaagtacggcggggccctggtgcggaatcccctcagcagaaactccacccacgagatgtattgggtctctaacgcgagcggaaatattgtgtcctctgttaacatgatcagccgcatgctgattaatcggtttacgatgagacacaaaaaggccacctacgaacctgacgtggatctgggctccgggacacgcaacatcggaattgagtctgaggtccccaatctcgacatcatcggcaaacggattgaaaagatcaaacaggagcatgaaaccagctggcactatgatcaagaccatccgtacaagacatgggcttatcacggctcctacgagaccaagcagacagggagcgcctcttccatggtgaacggagtggtcagacttctgaccaaaccttgggacgttattcccatggtgacgcagatggctatgacagataccacccctttcggccagcaacgcgtgtttaaggaaaaagtcgacacaagaacgcaggagcccaaggaggggaccaaaaagctgatgaagatcacagccgaatggctctggaaagagctgggaaagaaaaagacccctcggatgtgtacacgcgaagagttcaccagaaaagtgcggagcaatgctgcccttggcgcgatttttacagatgagaacaagtggaaatctgccagagaagctgttgaggactccgggttctgggaactggtggataaggagcggaatctccacctggaaggaaagtgcgagacctgtgtctataacatgatgggcaaacgcgagaagaaactgggcgaatttgggaaggccaaaggaagcagagctatctggtacatgtggctcggcgcccggttcctggagtttgaagcccttgggttcctgaatgaggaccattggttttctcgcgaaaactccctcagcggagtggagggcgaggggctgcacaaacttggctacattctgagagatgtttccaagaaagaaggaggcgcgatgtatgctgacgatacggccgggtgggacacccggatcacactcgaggatctgaagaatgaagagatggtgaccaaccatatggaaggagagcacaaaaagctggccgaggctatcttccgcctcacataccagaataaagtcgtgagagttcagcggcccaccccgcgcggcacggtgatggacattatcagcagacgggaccaacgcgggtctggacaggtcgtgacatatggcctgaacaccttcacaaacatggaagcccagcttattagacaaatggagggggaaggcgtctttaagagcatccagcatctgaccgctacggaggagattgccgtgaagaattggctcgttcgggtgggacgcgaaagactgtcccggatggcgatctctggcgatgactgcgtcgtgaaacctcttgatgacagattcgccaacgctctgaccgccctcaatgatatggggaaggtgcgcaaagacatccagcagtgggagcccagccggggatggaacgattggacacaagttcccttttgctcccaccacttccatgaactgattatgaaggacggcagagtgctggtcgtgccttgtcgcaatcaggatgagctcatcgggcgggctagaatttctcagggagccggctggagcctgcgcgaaaccgcgtgccttgggaaatcctacgcccagatgtggtctctgatgtattttcaccggagagacctccgcctggctgccaacgctatctgtagcgccgttccgtcccattgggtgcccacaagccggaccacatggtctattcacgctacccacgagtggatgacgacagaggatatgcttaccgtctggaatagagtgtggatccaagaaaacccttggatggaggacaagacccccgtcgaatcctgggaggaaatcccttacctgggcaagcgcgaggatcagtggtgcggaagcctcattggcctgacatctcgggccacctgggcgaaaaatatccagacagccattaaccaggtgagatccctgatcgggaatgaggaatatacggactacatgcccagcatgaagcggttcagacgcgaggaagaggaagctggagttctctggtga

SEQ ID NO: 19588 - RNA, 9876 nt, synthetic construct
  misc_feature 1..9876: note = derived and/or modified CDS sequence (opt5) from DENV-2__KX380819__SS-prME
  source 1..9876: mol_type = other RNA
accgccggaatcattatcatgatgattcccaccgtgatggctttccacctgacgaccagaaacggggaacctcatatgatcgttagccggcaggaaaaggggaaaagcctcctgtttaagacggagaatggcgttaacatgtgcacccttatggccatggacctgggggaactctgtgaggatacaattacctacaattgcccgctgcttcgccaaaacgaacccgaggacatcgattgttggtgcaattctacaagcacctgggtgacgtatggaacctgtacagcgaccggcgagcacagacgggaaaaacgctccgtggctctggtccctcatgtggggatgggactcgagacaagaaccgaaacgtggatgtctagcgagggcgcctggaagcacgcccagcggatcgagacatgggttctgcgccatcccggcttcaccgtgatggctgccattctggcttacacaatcgggaccacctattttcagagagtcctcattttcatcctgcttacagccgtggcgccttccatgacgatgcggtgcattggaatctctaaccgcgactttgttgaaggcattagcgggggatcctgggtggatatcgtcctggagcacggcagctgtgtgaccacaatggccaaaaataagcccaccctcgacttcgaactgatcaagacagaggctaaacaccctgccacccttagaaagtactgcattgaagctaaactgacgaacacaaccaccgcctctcggtgtccgacacagggggagccctccctcaatgaggaacaagataagcgctttgtgtgcaaacatagcatggtcgacagaggatggggcaacggctgtgggctgttcggaaagggcgggatcgttacctgcgcgatgtttacatgcaagaaaaatatggagggaaagattgtgcagcctgaaaacctggagtatacgatcgtgattacaccccactctggcgaagagaatgccgtcgggaacgatacaggaaaacatggcaaggagatcaaagtgacccctcagtccagcatcacagaagctgagctcaccggctacgggacggccaccatggaatgttctccccggacaggactggacttcaatgagatggttcttctgcagatggaaaacaaggcttggctcgtgcaccgccaatggtttctggatcttccgctgccttggctccccggcgccgacacccaggggtccaactggattcagaaagagacactggtcaccttcaagaatcctcacgccaagaaacaggatgtggttgtgctgggaagccaagagggcgctatgcatacggcgctcacaggggccaccgaaatccagatgtcctctggcaacctgctttttacaggacacctgaagtgcagactccggatggacaaactgcagcttaagggcatgagctattccatgtgtaccgggaaattcaaggtcgtgaaggagattgctgaaacccaacatggaacaatcgtcattagagtgcagtacgagggcgacgggagcccctgcaaaatccccttcgagatcatggatctggaaaagcgccacgttctcggacggctgattacggtgaatcctatcgtcaccgagaaagactctccggtgaacattgaagccgagcccccttttggcgattcctacatcattatcggggttgaacccggccagctgaagctcagctggttcaaaaagggatctagcattggccagatgtttgagacaaccatgagaggggccaagcgcatggctatcctgggagacacagcctgggatttcggctcccttgggggagtgtttacctctatcggcaaagcgctgcatcaagtcttcggggctatttatggcgccgcctttagcggagtgtcctggacgatgaagatcctcattggcgtggttatcacatggattgggatgaatagccggtctacctccctgagcgtctctctggtgcttgtgggaatcgtcaccctctacctgggcgtgatggttcaggctgactccgggtgtgtggtcagctggaaaaacaaggagctgaaatgcggatccggcatcttcattacagataatgtgcacacctggacagaacagtataagtttcagcctgagtctcccagcaagctcgcctccgctatccaaaaagcccacgaagaggggatttgtggcatcagatctgttacgcgcctggaaaaccttatgtggaagcagattaccccggagctgaatcatatcctcagcgagaacgaagtgaaactgacaatcatgaccggagacattaagggcatcatgcaggcggggaaacggtccctgagacctcagcccacagagcttaagtacagctggaaagcctggggaaaggctaagatgctctctaccgaactgcacaatcatacgttcctgattgatggccctgagaccgccgaatgccccaacacaaatcgcgcttggaactccctcgaggtcgaggactatgggtttggagtgttcaccacaaatatctggctgaaacttaaggaacggcaagatgtcttttgtgacagcaaactgatgtctgccgcgattaaggacaacagagccgtgcacgctgatatgggctactggatcgagtccgccctcaacgacacctggaaaatcgaaaaggctagcttcattgaggtcaagtcttgccactggcctaaaagccatacactgtggtccaatggcgtgctggagagcgaaatgatcattcccaagaacttcgccgggccggtgtctcagcacaattatcgccctggataccatacccagacggccggcccctggcaccttgggcggctcgagatggattttgacttctgtgaaggaacaaccgtcgttgtgaccgaggattgcggcaacagagggccctccctgcggacaaccacggctagcggaaaactgatcacagaatggtgctgtcgctcctgcaccctccctccgctgagataccggggcgaggacggctgttggtatgggatggagattagaccccttaaggaaaaagaggaaaatctggtgaactctctcgtcacagcgggacatggccagatcgataattttagcctgggggtgctgggaatggcccttttcctcgaggaaatgctgcgcacccgggttggcacaaagcacgctattctgctcgtggccgtctcctttgtgaccctgatcacggggaacatgtctttcagagaccttggacgcgttatggtgatggtcggcgccaccatgacagatgacatcggcatgggggtgacctacctggctctcctggccgcgtttaaggttagacctacattcgctgccggactgcttctgcggaaactcaccagcaaggagctgatgatgacgacaattggcatcgtgctcctgtcccaatctaccattcccgagacaatccttgaactgaccgatgccctcgctctggggatgatggtcctgaaaattgtgcgcaatatggagaagtatcagcttgccgtgaccatcatggcgatcctgtgcgtccctaacgctgttattctccagaatgcctggaaagtgagctgtacaatcctggccgtggtctccgtgagccccctcctgcttacgtcttcccaacagaaggctgactggattcctctggccctcaccatcaagggactgaaccccacagctatttttctgaccacacttagcagaacctctaaaaagcggtcctggccgctgaatgaagccatcatggcggttggcatggtgagcatcctcgcctcttccctgctcaaaaacgatattcctatgacggggcccctggtcgctggaggccttctgacagtgtgctacgttctgaccggccgcagcgccgacctcgagctggaaagagctgccgacgtgcggtgggaggagcaggccgaaatctccgggagctctcctattcttagcatcaccatttccgaggatggatctatgagcatcaagaatgaagaggaggaacagacactgaccattctcatccgcacaggcctgctcgtcatctccgggctgttccccgtgtctattccgatcacggctgcggcctggtatctttgggaggtcaaaaagcaaagagctggagtgctgtgggacgttccttctccccctcccgtgggcaaagccgaactggaggatggggcctaccggattaagcagaagggaatcctcggctattcccagattggcgctggggtctacaaagaaggaacctttcacacaatgtggcatgtgacccgcggcgccgttctgatgcacaaggggaaaagaatcgagccctcctgggcggacgtgaagaaagatcttatcagctacggaggcgggtggaagctggagggagaatggaaggagggcgaagaggtccaggtgctcgctctggaacctggcaaaaacccgcgggccgtgcaaacaaagcccggactgttcaaaaccaacacgggaaccattggcgccgtttccctggactttagccctgggacatctggatcccccatcgtcgataagaaaggcaaggtggtggggctttatggaaatggcgtcgtgaccagaagcggcacatacgtttctgctattgcccagaccgagaagtccatcgaggacaaccctgaaattgaggatgacatcttccgcaaaaagcggctgacaatcatggatctgcatcccggggcgggaaaaacgaagagatatctccctgctattgtgcgcgaagccatcaaacggggcctgagaacccttattctggccccgacacgcgtcgtggctgccgagatggaagaggctctccgggggctgcccatcagataccagacccctgccattcgcgcggagcacaccggacgggaaatcgttgacctcatgtgtcatgccacattcacgatgagactgcttagccccattcgggtgcctaattataacctgatcatcatggatgaggctcactttaccgaccccgcctccattgctgcccgcggctacatctctacaagagtcgaaatgggggaggccgctggcattttcatgaccgcgacaccgcctggaagccgggacccctttccccagtccaatgcccctatcatggatgaggaacgcgagattcccgaaagaagctggaactctggccacgagtgggtgaccgacttcaaggggaagacggtttggtttgtgccttccatcaaagctggaaatgatatcgccgcctgcctgcggaagaacggcaaaaaggtcattcaactcagcagaaaaacattcgactctgaatatatcaagacccgcaccaatgattgggactttgtggtgacaaccgatattagcgagatgggggctaacttcaaggccgagcgggtcatcgacccgagacgctgtatgaaacccgttattctgacagatggagaagaacgggtgatccttgcgggccctatgcccgtgacccattcctctgctgcccagagacgcgggcgggtcggcagaaatcctaagaacgaaaatgaccagtacatctacatgggagagcccctggaaaacgatgaggactgcgcccactggaaagaggctaagatgctcctggacaatattaacacgccggaaggcatcattcctagcatgtttgagcccgaacgcgagaaagtggatgccatcgacggggaatatagactgcggggagaggcgcgcaagacattcgttgatctcatgagacggggcgaccttcctgtgtggctggcctaccgcgtcgctgccgaggggattaactatgctgatagacggtggtgttttgacggagtgaaaaataaccaaatcctggaagagaatgttgaagtggagatttggaccaaggagggcgaaagaaagaaactcaagccccgctggctggatgcccggatctactccgaccctcttgctctgaaagagttcaaggagttcgccgcggggagaaaatctctcacactgaacctgatcaccgagatgggccgcctccccacgtttatgacccagaaggcccggaatgctcttgataacctggccgtcctgcatacagctgaagccggaggcagagcctataatcacgctctcagcgagctgccggagacccttgaaacactgctcctgctgaccctccttgcgacagtgaccgggggaattttcctgtttctgatgtccggcaaggggatcggaaaaatgacgctcggcatgtgctgcattatcacagccagcattctgctttggtacgctcagatccagcctcactggatcgccgcctctattatcctggagttctttctcattgtcctgctgatccccgaacccgagaagcaacggacccctcaggacaaccagctcacctatgtggttattgctatccttacagtggtggccgcgaccatggccaatgaaatgggcttcctggagaaaacaaagaaagattttgggctgggatccatcacgacccagcaaccggacagcaacattctcgatatcgacctgcgccccgcttccgcctggacactttacgctgtcgccaccacattcattacccctatgctgagacattctatcgagaatagctccgttaacgtgtctctcacggcgattgccaatcaggctaccgtgctgatgggcctggggaagggatggcccctcagcaagatggacatcggcgtccctcttctggccattgggtgttactcccaggtgaaccccatcacactgaccgctgccctcctgcttctggttgctcactatgccatcattggacctggcctccaggcgaaagccacacgggaagctcaaaagcgcgccgctgccggcatcatgaaaattccggccgcgctgatcgggagagtgattgatctggaccccatcccttacgatcccaagtttgagaaacagctcggacaggtcatgcttctggtgctgtgcgtcacccaggtgctcatgatgcggacgacatgggctctgtgtgaagcccttaccctggctacaggccctatcagcaccctctgggaggggaatcccggacgcttctggaacaccacaattgccgtttctatggccaatatctttagaggctcctatctggctggggccggactcctcttcagcattatgaagaacacggcgaacacccggcgcggcacaggcaataccggggaaacacttggagagaagtggaaaaacagactgaatgccctgggcaagtctgagtttcaaatctacaaaaagtccgggattcaggaagtggaccggaccctcgctaaagagggaatcaagagaggcgaaacggatcatcacgccgtcagccgcgggtctgctaaactgcggtggttcgtggagagaaaccttgttacaccggagggaaaggtggtcgacctgggctgcggccgcgggggatggagctattactgtggcgggctcaagaatgtgaaagaagtgaagggactgaccaaaggcgggcctggacatgaggaacccatccccatgtccacctatggctggaacctggttcggctccagtctggcgtcgatgtgttctttacacctcccgagaagtgcgacacccttctgtgtgatattggggaaagctcccctaatccgacagtggaggccggaagaacgctgcgcgtcctcaacctggttgagaattggcttaacaataacacccaattctgcatcaaagtgctgaatccctacatgcctagcgtgattgaaaagatggaggcgctccagcggaagtacggcggggccctggtcagaaaccccctgtcccgcaattctacacacgaaatgtattgggtgagcaacgcttccggaaacatcgtttctagcgtgaatatgatttcccggatgctcatcaacagatttaccatgaaacacaagaaagccacatacgagcctgacgtcgatcttggctctgggacccgcaatatcggaattgaaagcgagacgcccaacctggacatcattggcaagcggatcgagaaaattaagcaggaacatgagacctcctggcactatgatcaggaccatccgtacaagacatgggcttatcacggcagctacgaaaccaaacaaacagggtctgcctccagcatggtgaatggagttgtgagactgctcaccaagccttgggacgtcatccccatggtgacacagatggctatgaccgatacgacacctttcggccagcagcgcgtgtttaaagagaaggtcgacaccagaacccaagaacccaaagaggggacaaagaagctgatgaaaattacggccgagtggctttggaaggaactgggcaaaaagaaaacccctcggatgtgtacacgcgaggagttcaccagaaaggttcggtctaacgcggccctcggcgctatctttacagatgagaataaatggaagtccgccagagaggctgtggaagacagcgggttctgggagctggtggataaggaacggaacctgcacctcgagggaaaatgcgaaacctgtgtctataatatgatgggcaagcgcgagaaaaagctgggcgagtttgggaaagccaagggatctagagccatctggtacatgtggcttggcgcgcggttcctggaatttgaggctctcgggttcctgaacgaagaccattggttttcccgcgagaatagcctttccggagtggaaggcgaggggctgcacaagctcggctacattctgagagatgttagcaaaaaggagggaggcgccatgtatgccgacgatacagctgggtgggacacccggatcacgctggaagatctcaaaaacgaggaaatggtgaccaatcatatggagggagaacaccgcaagctggccgaggctattttcagacttacataccagaacaaagtcgtgcgggttcagcgccccaccccgagaggcacagtgatggacatcatttctcggcgcgaccagagagggagcggacaagtcgtgacctatggcctgaatacgttcacaaacatggaggcccagctcatccggcagatggaaggggagggcgtttttaagtccatccaacatctgaccgtgacagaagagattgcggtcaagaactggcttgagcgcgtgggaagagaacggctgtctagaatggccatcagcggcgatgactgcgtcgtgaaacctctcgatgaccgcttcgcttccgccctgaccgctctgaatgatatggggaaggttcggaaagacattcagcagtgggagccctctagaggatggaacgattggacacaggtgcccttttgcagccaccacttccatgaactcatcatgaaggacggccgcgtcctggtggtgccttgtcggaatcaagatgagcttattgggagagcccgcatctcccagggagcgggctggtctctgcgggaaaccgcctgcctcgggaaaagctacgctcagatgtggtccctgatgtattttcacagacgcgaccttcggctggccgctaacgccatctgtagcgctgttccgtctcattgggtgcccatttccagaacaacctggagcatccacgccacacacgagtggatgaccacagaggatatgctcaccgcgtggaatcgcgtctggattcaggaaaacccttggatggaggacaagacgcccgtggaatcttgggaggaaatcccttacctgggcaagcgggaggatcaatggtgcggatccctgattggcctcacaagcagagccacctgggctaaaaatatccagaccgccattaaccaggttcggtccctgatcgggaatgaggaatatacagactacatgccctctatgaagagattccgccgggaggaagaggaagccggagtgctttggtga

SEQ ID NO: 19589 - RNA, 9876 nt, synthetic construct
  misc_feature 1..9876: note = derived and/or modified CDS sequence (opt5) from DENV-2__KX380821__SS-prME
  source 1..9876: mol_type = other RNA
accgccggcatcattatcatgatgattcccacagtgatggctttccacctgacgaccagaaacggggagcctcatatgatcgtcagccggcaggaaaagggaaaatccctcctgtttaagacagagaatggcgttaacatgtgcacccttatggccatggacctgggggaactctgtgaggatacaattacctacaattgcccgctgcttcgccaaaacgaacccgaggacatcgattgttggtgcaattctacaagcacctgggtgacgtatggaacctgtacagcgaccggcgagcacagacgggaaaaacgctccgtggctctggtccctcatgtggggatgggactcgagacaagaaccgaaacgtggatgtctagcgagggcgcctggaagcacgcccagcggatcgagacatgggttctgcgccatcccggcttcaccgtgatggctgccattctggcttacacaatcgggaccacctattttcagagagtcctcattttcatcctgcttacagccgtggcgccttccatgacgatgcggtgcattggaatctctaaccgcgactttgttgaaggcgtgagcgggggatcctgggtcgatattgtgctggagcacggcagctgtgtgaccacaatggccaaaaataagcccaccctcgacttcgaactgatcaagacagaggctaaacaccctgccacccttagaaagtactgcatcgaagctaaactgacgaacacaaccaccgcctctcggtgtccgacacagggggagccctccctcaatgaggaacaagataagcgctttgtctgcaaacatagcatggttgacagaggatggggcaacggctgtgggctgttcggaaagggcgggattgtgacctgcgcgatgtttacatgcaagaaaaatatggagggaaagatcgtgcagcctgaaaacctggagtatacgattgtcatcaccccccactctggcgaagagaatgccgtggggaacgatacaggaaaacatggcaaggagattaaagttacccctcagtccagcatcacagaagctgagctcaccggctacgggacggccaccatggaatgttctccccggacaggactggacttcaatgagatggtgcttctgcagatggaaaacaaggcttggctcgtccaccgccaatggtttctggatcttccgctgccttggctccccggcgccgacacccaggggtccaactggatccagaaagagacactggtgaccttcaagaatcctcacgccaagaaacaggatgttgtggtcctgggaagccaagagggcgctatgcatacggcgctcacaggggccaccgaaattcagatgtcctctggcaacctgctttttacaggacacctgaagtgcagactccggatggacaaactgcagcttaagggcatgagctattccatgtgtaccgggaaattcaaggtggtcaaggagatcgctgaaacccaacatggaacaattgtgatcagagttcagtacgagggcgacgggagcccctgcaaaattcccttcgagatcatggatctggaaaagcgccacgtgctcggacggctgatcacggtcaatcctattgtgaccgagaaagactctccggttaacatcgaagccgagcccccttttggcgattcctacattatcattggggtggaacccggccagctgaagctcagctggttcaaaaagggatctagcatcggccagatgtttgagacaaccatgagaggggccaagcgcatggctattctgggagacacagcctgggatttcggctcccttgggggagtctttacctctatcggcaaagcgctgcatcaagtgttcggggctatctatggcgccgcctttagcggagtgtcctggacgatgaagattctcatcggcgttgtcattacatggatcgggatgaatagccggtctacctccctgagcgtgtctctggtgcttgtcggagtggttaccctctacctgggcgtgatggtccaggctgactccgggtgtgtggttagctggaaaaacaaggagctgaaatgcggatccggcattttcatcacagataatgtgcacacctggacagaacagtataagtttcagcctgagtctcccagcaagctcgcctccgctatccaaaaagcccacgaagaggggatttgtggcatcagatctgtcacgcgcctggaaaaccttatgtggaagcagattaccccggagctgaatcatatcctcacagagaacgaagtgaaactgaccattatgacaggagacatcaagggcatcatgcaggcggggaaacggaccctgagacctcagcccacggagcttaagtacagctggaaagcctggggaaaggctaagatgctctccaccgaactgcacaatcatacattcctgattgatggccctgagaccgccgaatgccccaacacaaatcgcgcttggaacagcctcgaggttgaggactatgggtttggagtgttcaccacaaatatctggctgaaacttaaggaacggcaagatgtcttttgtgactctaaactgatgtccgccgcgattaaggacaacagagccgtgcacgctgatatgggctactggatcgagagcgccctcaacgacacctggaaaattgaaaaggcttctttcatcgaggtgaagtcctgccactggcctaaaagccatacgctgtggtctaatggcgtcctggagagcgaaatgatcattcccaagaacttcgccgggccggtttcccagcacaattatcgccctggataccatacacagaccgccggcccctggcaccttgggcggctcgagatggattttgacttctgtgaaggaaccacagtggtggtcaccgaggattgcggcaacagagggcccagcctgcggacgacaaccgcttctggaaaactgatcacagaatggtgctgtcgctcctgcaccctccctccgctgagataccggggcgaggacggctgttggtatgggatggagattagaccccttaaggaaaaagaggaaaatctggtgaacagcctcgttacagcgggacatggccagatcgataatttttccctgggggtgctgggaatggcccttttcctcgaggaaatgctgcgcacccgggtcggcacgaagcacgctattctgctcgtggccgtttcttttgtgaccctgatcacagggaacatgagcttcagagaccttggacgcgtcatggtgatggttggcgccaccatgacagatgacattggcatgggggtgacctacctggctctcctggccgcgtttaagatcagacctacgttcgctgccggactgcttctgcggaaactcacatccaaggagctgatgatgaccacaatcggcattgtcctcctgtctcaaagcaccatccccgagtccattcttgaactgaccgatgccctcgctctggggatgatggtgctgaaaatcgtgcgcaatatggagaagtatcagcttgccgtcacaattatggcgatcctgtgcgttcctaacgctgtgatcctccagaatgcctggaaagtgtcttgtacgaccctggccgtcgtgagcgtttcccccctcctgcttacaagctctcaacagaaggctgactggattcctctggccctcaccatcaagggactgaaccccacagctatttttctgaccacgctttccagaacaagcaaaaagcggtcttggccgctgaatgaagccatcatggcggtgggcatggtctccattctcgccagctctctgctcaaaaacgatatccctatgaccgggcccctggtggctggaggccttctgaccgtttgctacgtgctgacaggccgctccgccgacctcgagctggaaagagctgccgacgtccggtgggaggagcaggccgaaatcagcgggtccagccctattctttctatcaccattagcgaggatggatccatgtctatcaagaatgaagaggaggaacagacactgacgattctcatccgcaccggcctgctcgtgattagcgggctgttccccgtctccatcccgatcacagctgcggcctggtatctttgggaggtgaaaaagcaaagagctggagttctgtgggacgtgccttctccccctcccgtcggcaaagccgaactggaggatggggcctaccggattaagcagaagggaatcctcggctatagccagattggcgctggggtgtacaaagaaggaacctttcacacaatgtggcatgttacccgcggcgccgtgctgatgcacaaggggaaaagaatcgagccctcctgggcggacgtcaagaaagatcttatttcttacggaggcgggtggaagctggagggagaatggaaggagggcgaagaggtgcaggtgctcgctctggaacctggcaaaaacccgcgggccgttcaaacgaagcccgggctcttcaaaaccaacacaggaaccatcggcgccgtcagcctggacttttcccctgggacaagcggatctcccatcgtggataagaaaggcaaggtggtcgggctttatggaaatggcgtggttaccagatccggcacatacgtgagcgctattgcccagacggagaagtctatcgaggacaaccctgaaattgaggatgacatcttccgcaaaaagcggctgaccattatggatctgcatcccggggcgggaaaaacaaagagatatctccctgctatcgtccgcgaagccatcaaacggggcctgagaacccttattctggccccgacccgcgtggttgctgccgagatggaagaggctctccgggggctgcccatcagataccagacacctgccattcgcgcggagcacacgggacgggaaatcgtggacctcatgtgtcatgccaccttcacaatgagactgctttcccccattcgggtccctaattataacctgatcattatggatgaggctcactttaccgaccccgccagcatcgctgcccgcggctacatctccacaagagtggaaatgggggaggccgctggcattttcatgaccgcgacgccgcctggatctcgggacccctttccccagagcaatgcccctatcatggatgaggaaaaggagattcccgaacgctcctggaacagcggccacgagtgggttacagacttcaaggggaaaaccgtgtggtttgtcccttctatcaaggctggaaatgatattgccgcctgcctgagaaaaaacggcaagaaagtgatccaactctcccggaagaccttcgacagcgaatatatcaagacaagaaccaatgattgggactttgtggtcacaaccgatatttctgagatgggggctaacttcaaagccgagcgcgttatcgacccgcggagatgtatgaagcccgtgattctgacggatggagaagagcgcgtgatccttgcgggccctatgcccgtcacacatagctccgctgcccagcggagagggcgcgtgggccggaatcctaaaaacgaaaatgaccagtacatttacatgggagagcccctggaaaacgatgaggactgcgcccactggaaggaggctaaaatgctcctggacaatatcaacaccccggaaggcatcattccttctatgtttgagcccgaaagagagaaggttgatgccatcgacggggaatatcgcctgagaggagaggcgcggaaaacattcgtggatctcatgcgcagaggcgaccttcctgtctggctggcctaccgggtggctgccgaggggattaactatgctgatcgcagatggtgttttgacggagttaagaataaccaaatcctggaagagaatgtggaagtcgagatttggaccaaggagggcgaacggaaaaagctcaaacccagatggctggatgcccgcatctacagcgaccctcttgctctgaaggagttcaaagaattcgccgcggggcggaagtccctcacgctgaacctgattaccgagatgggcagactccccacatttatgacccagaaggccaaaaatgctcttgataacctggccgtgctgcatacagctgaagccggaggccgcgcctataatcacgctctctctgagctgccggagacccttgaaacactgctcctgctgaccctccttgcgacggtcacagggggaatcttcctgtttctgatgagcggcaaggggatcggaaaaatgaccctcggcatgtgctgcattatcaccgcctccattctgctttggtacgctcagatccagcctcactggattgccgccagcatcatcctggagttctttctcattgtgctgctgatccccgaacccgagaagcaacggacacctcaggacaaccagctcacctatgttgtgattgctatccttacagtggtcgccgcgacgatggccaatgaaatgggcttcctggagaaaaccaagaaggattttgggctgggatctattacaacccagcaaccggagtccaacatcctcgacatcgatctgagacccgctagcgcctggacactttacgctgttgccaccacgttcattacccctatgctgcggcattccatcgaaaattctagcgtgaacgtgtccctcacagcgattgccaatcaggctaccgtcctgatgggcctggggaaaggatggcccctctctaagatggacatcggcgtgcctcttctggccattgggtgttacagccaggttaaccccatcacactgaccgctgccctcctgcttctggtggctcactatgccattatcggacctggcctccaggcgaaagccacgcgcgaggctcaaaagagagccgctgccggcatcatgaaaaatccgacagtcgacgggatgaccgtgattgatctggaccccatcccttacgatcccaagtttgaaaagcagctgggacaggtcatgctccttgtgctgtgcgttacacaggtgctgatgatgcggaccacctgggccctctgtgaggcgctgacacttgctacgggccctatttccaccctgtgggaagggaaccccggacgcttctggaatacaaccatcgccgtcagcatggctaacatttttagaggctcttatctcgccggggccggactgctgttctccatcatgaaaaacacagctaatacccggcgcggcacgggcaacacaggggagaccctcggagagaagtggaaaaatagacttaacgccctgggcaagagcgaatttcaaatctacaaaaagtctgggattcaggaggtggaccggaccctggcgaaagaaggaatcaagcgcggcgagacagatcatcacgccgtttccagagggagcgctaagctccggtggttcgtggagagaaatctggtcaccccggaaggaaaagtggtggaccttggctgcggccgcgggggatggtcttattactgtggcgggctgaagaacgttaaagaggtcaagggactcacaaaaggcgggcctggacatgaagagcccattcccatgagcacgtatggctggaatctggtgcggctgcagtccggcgtggatgtcttctttacccctcccgaaaagtgcgacacactcctttgtgatatcggggagtctagccctaacccgaccgttgaggccggaagaacactgcgcgtgctgaatctcgtggaaaactggctgaataacaatacccaattctgcattaaggtccttaacccctacatgccttccgtgatcgagaaaatggaagctctgcagcggaagtacggcggggccctcgttagaaatcccctgagccgcaactccacgcacgagatgtattgggtgtctaacgcgagcggaaatatcgtctcctctgtgaacatgattagccggatgctgatcaatagatttaccatgcgccacaaaaaggccacatacgaacctgacgttgatctcggctccgggacccggaacattggaatcgagtctgagacacccaatcttgacattatcggcaaaagaatcgaaaagattaagcaggagcatgaaaccagctggcactatgatcaggaccatccgtacaaaacatgggcttatcacggctcctacgagaccaagcaaacggggagcgcctcttccatggtgaacggagtcgtgcgcctgctgacaaaaccttgggacgtgatccccatggtcacccagatggctatgaccgatacaacgcctttcggccagcagcgggtttttaaggaaaaagtggacaccagaacacaagagcccaaggaggggaccaagaaactcatgaagattacagccgaatggctgtggaaagagcttggaaagaaaaagacccctcgcatgtgtacaagagaagagttcacccggaaagtgcgcagcaatgctgccctgggcgcgatctttacggatgagaacaagtggaagtctgccagagaagctgtcgaggactccgggttctgggaactcgtggataaagagcggaatctgcacctggaaggaaagtgcgagacctgtgtttataacatgatgggcaaaagagagaagaaactcggcgaatttgggaaggccaagggaagccgggctatttggtacatgtggctgggcgcccgcttccttgagtttgaagccctggggttcctcaatgaggaccattggttttctagagaaaactccctgagcggagtggagggcgaggggcttcacaaactgggctacatcctccgggatgtctccaagaaagaaggaggcgcgatgtatgctgacgatacagccgggtgggacacccgcattacactggaggatctgaagaatgaagagatggtgaccaaccatatggaaggagagcacaaaaagctcgccgaggctatcttcaagctgacgtaccagaataaagttgtgagagtccagcggcccacaccgcgcggcaccgtgatggacatcattagcagacgggaccagcgcgggtctggacaagttgtgacatatggccttaacaccttcacgaacatggaagcccagctgatcagacagatggagggggaaggcgtctttaagagcattcaacagctcaccgtgaaagaggagatcgctgtcaagaattggctgattcgggtgggacgcgaaagactttcccggatggccatctctggcgatgactgcgttgtgaaacctctggatgaccgcttcgcgagcgccctcacagctctgaacgatatggggaaggtcagaaaggacatccagcagtgggagccctcccggggatggaatgattggacccaagtgcccttttgctctcatcacttccacgaactgattatgaaagacggcagagtgctcgttgtgccttgtcgcaaccaggatgagctgatcgggcgggccagaattagccagggagctggctggtcccttcgcgaaacagcctgcctggggaagtcttacgcgcagatgtggagcctcatgtattttcatcggagagacctgcgccttgccgctaatgccatctgttccgctgtcccgagccactggattcccacctctcggacaacctggtccatccatgccacgcacgagtggatgacaaccgaggatatgctgaccgtgtggaacagagtttggatccaagaaaatccttggatggaggacaaaacacccgtggaaagctgggaggaaattccttacctcggcaagcgcgaggatcagtggtgcggatctctgatcggcctgacctcccgggctacatgggccaaaaacattcagacggcgatcaatcaggtcagaagcctcattgggaacgaggaatataccgactacatgccctccatgaagcgcttccggagagaggaagaggaagccggagtgctgtggtga

SEQ ID NO: 19590 - RNA, 9876 nt, synthetic construct
  misc_feature 1..9876: note = derived and/or modified CDS sequence (opt5) from DENV-2__KX380822__SS-prME
  source 1..9876: mol_type = other RNA
accgccggaatcattatcatgatgattcccaccgtgatggctttccacctgacgaccagaaacggggaacctcatatgatcgtgagccggcaggaaaaggggaaaagcctcctgtttaagacagagaatggagttaacatgtgcacccttatggccatggacctgggggaactctgtgaggatacaattacctacaattgcccgctgcttcgccaaaacgaacccgaggacatcgattgttggtgcaattctacaagcacctgggtgacgtatggaacctgtacagcgaccggcgagcacagacgggaaaaacgctccgtggctctggtccctcatgtggggatgggactcgagacaagaaccgaaacgtggatgtctagcgagggcgcctggaagcacgcccagcggatcgagacatgggttctgcgccatcccggcttcaccgtgatggctgccattctggcttacacaatcgggaccacctattttcagagagtcctcattttcatcctgcttacagccgtggcgccttccatgacgatgcggtgcattggaatctctaaccgcgactttgttgaaggcgtgagcgggggatcctgggtcgatattgtgctggagcacggcagctgtgtgaccacaatggccaaaaataagcccaccctcgacttcgaactgatcaagacagaggctaaacaccctgccacccttagaaagtactgcatcgaagctaaactgacgaacacaaccaccgcctctcggtgtccgacacagggggagccctccctcaatgaggaacaagataagcgctttgtctgcaaacatagcatggttgacagaggatggggcaacggctgtgggctgttcggaaagggcgggattgtgacctgcgcgatgtttacatgcaagaaaaatatggagggaaagatcgtgcagcctgaaaacctggagtatacgattgtcatcacaccccactctggcgaagagaatgccgtggggaacgatacaggaaaacatggcaaggagattaaagttacccctcagtccagcatcacagaagctgagctcaccggctacgggacggccaccatggaatgttctccccggacaggactggacttcaatgagatggtgcttctgcagatggaaaacaaggcttggctcgtccaccgccaatggtttctggatcttccgctgccttggctccccggcgccgacacccaggggtccaactggatccagaaagagacactggtgaccttcaagaatcctcacgccaagaaacaggatgttgtggtcctgggaagccaagagggcgctatgcatacggcgctcacaggggccaccgaaattcagatgtcctctggcaacctgctttttacaggacacctgaagtgcagactccggatggacaaactgcagcttaagggcatgagctattccatgtgtaccgggaaattcaaggtggtcaaggagatcgctgaaacccaacatggaacaattgtgatcagagttcagtacgagggcgacgggagcccctgcaaaattcccttcgagatcatggatctggaaaagcgccacgtgctcggacggctgatcacggtcaatcctattgtgaccgagaaagactctccggttaacatcgaagccgagcccccttttggcgattcctacattatcattggggtggaacccggccagctgaagctcagctggttcaaaaagggatctagcatcggccagatgtttgagacaaccatgagaggggccaagcgcatggctattctgggagacacagcctgggatttcggctcccttgggggagtctttacctctatcggcaaagcgctgcatcaagtgttcggggctatctatggcgccgcctttagcggagtgtcctggacgatgaagattctcatcggcgttgtcattacatggatcgggatgaatagccggtctacctccctgagcgtgtctctggtgcttgtcggaattgtgaccctctacctgggcgttatggtgcaggctgactccgggtgtgtcgtgagctggaaaaacaaggagctgaaatgcggatccggcatcttcatcacagataatgttcacacctggacagaacagtataagtttcagcctgagtctcccagcaagctcgcctccgctattcaaaaagcccacgaagaggggatctgtggcattagatctgtgacgcgcctggaaaaccttatgtggaagcagatcaccccggagctgaatcatattctcagcgagaacgaagtcaaactgacaatcatgaccggagacatcaagggcattatgcaggcggggaaacggtccctgagacctcagcccacagagcttaagtacagctggaaagcctggggaaaggctaagatgctctctaccgaactgcacaatcatacgttcctgatcgatggccctgagaccgccgaatgccccaacacaaatcgcgcttggaactccctcgaggtggaggactatgggtttggagttttcaccacaaatatttggctgaaacttaaggaacggcaagatgtgttttgtgacagcaaactgatgtctgccgcgatcaaggacaacagagccgtccacgctgatatgggctactggattgagtccgccctcaacgacacctggaaaatcgaaaaggctagcttcatcgaggtgaagtcttgccactggcctaaaagccatacactgtggtccaatggcgtgctggagagcgaaatgattatccccaagaacttcgccgggccggtctctcagcacaattatcgccctggataccatacccagacggccggcccctggcaccttgggcggctcgagatggattttgacttctgtgaaggaacaaccgttgtggtgaccgaggattgcggcaacagagggccctccctgcggacaaccacggctagcggaaaactgattacagaatggtgctgtcgctcctgcaccctccctccgctgagataccggggcgaggacggctgttggtatgggatggagatcagaccccttaaggaaaaagaggaaaatctggtcaactctctcgtgacagcgggacatggccagattgataattttagcctgggggttctgggaatggcccttttcctcgaggaaatgctgcgcacccgggtgggcacaaagcacgctatcctgctcgtcgccgtgtcctttgttaccctgattacggggaacatgtctttcagagaccttggacgcgtgatggtcatggtgggcgccaccatgacagatgacatcggcatgggggttacctacctggctctcctggccgcgtttaaggtgagacctacattcgctgccggactgcttctgcggaaactcaccagcaaggagctgatgatgacgacaatcggcattgtcctcctgtcccaatctaccatccccgagacaattcttgaactgaccgatgccctcgctctggggatgatggtgctgaaaatcgtgcgcaatatggagaagtatcagcttgccgtcaccattatgacaatcctgtgcgttcctaacgcggtgatcctccagaatgcttggaaagtgagctgtacgattctggccgtcgtgtccgttagccccctcctgcttacctcttcccaacagaaggccgactggatccctctggctctcacaattaagggactgaaccccaccgccatctttctgacaacccttagcagaacgtctaaaaagcggtcctggccgctgaatgaagctattatggccgtgggcatggtcagcatcctcgcgtcttccctgctcaaaaacgatatccctatgacagggcccctggtggccggaggccttctgaccgtttgctacgtgctgaccggccgcagcgctgacctcgagctggaaagagccgctgacgtccggtgggaggagcaggccgaaatttccgggagctctcctatccttagcattacaatctccgaggatggatctatgagcattaagaatgaagaggaggaacagaccctgacaatcctcattcgcacgggcctgctcgtgatctccgggctgttccccgtctctatcccgattaccgccgctgcgtggtatctttgggaggtgaaaaagcaaagagccggagttctgtgggacgtgccttctccccctcccgtcggcaaagctgaactggaggatggggcctaccggatcaagcagaagggcattctcggctattcccagatcggcgccggggtgtacaaagaaggaacatttcacaccatgtggcatgttacacgcggcgctgtgctgatgcacaaggggaaaagaattgagccctcctgggccgacgtcaagaaagatcttatcagctacggaggcgggtggaagctggagggagaatggaaggagggcgaagaggtccaggtgctcgcgctggaacctggcaaaaacccgcgggctgttcaaaccaagcccggactcttcaaaacgaacaccggaacaatcggcgccgtctccctggactttagccctgggacctctggatcccccattgtggataagaaaggcaaggtggtcgggctttatggaaatggcgtggttacaagaagcggcacctacgtgtctgccatcgctcagacagagaagtccattgaggacaaccctgaaatcgaggatgacattttccgcaaaaagcggctgacgatcatggatctgcatcccggggccggaaaaaccaagagatatctccctgcgatcgtccgcgaagctattaaacggggcctgagaacacttatcctggccccgacccgcgtggttgccgctgagatggaagaggccctccgggggctgcccattagataccagacccctgctatccgcgccgagcacacaggacgggaaattgtggacctcatgtgtcatgcgacgttcaccatgagactgcttagccccatccgggtccctaattataacctgattatcatggatgaggcccactttacagaccccgcttccatcgccgctcgcggctacatttctaccagagtggaaatgggggaggccgccggcatcttcatgacagctaccccgcctggaagccgggacccctttccccagtccaatgcgcctattatggatgaggaacgcgagatccccgaaagaagctggaactctggccacgagtgggttacggacttcaaggggaagacagtgtggtttgtcccttccattaaagccggaaatgatatcaccgcttgcctgcggaagaacggcaaaaaggtgatccaactcagcagaaaaaccttcgactctgaatatattaagacacgcaccaatgattgggactttgtggtcacaaccgatatcagcgagatgggggccaacttcaaggccgagcgggttattgacccgagacgctgtatgaaacccgtgatcctgacggatggagaagaacgggtgattcttgctggccctatgcccgtcacacattcctctgccgcgcagagacgcgggcgggtgggcagaaatcctaagaacgaaaatgaccagtacatctacatgggagagcccctggaaaacgatgaggactgcgctcactggaaagaggccaagatgctcctggacaatatcaacaccccggaaggcattatccctagcatgtttgagcccgaacgcgagaaagttgatgccattgacggggaatatagactgcggggagaggctcgcaagacattcgtggatctcatgagacggggcgaccttcctgtctggctggcctaccgcgtggcggccgaggggatcaactatgctgatagacggtggtgttttgacggagttaaaaataaccaaattctggaagagaatgtggaagtcgagatctggaccaaggagggcgaaagaaagaaactcaagccccgctggctggatgcccggatttactccgaccctcttgctctgaaagagttcaaggagttcgccgctgggagaaaatctctcacgctgaacctgatcaccgagatgggccgcctccccacatttatgacccagaaggcccggaatgcgcttgataacctggccgtgctgcatacagctgaagccggaggcagagcttataatcacgccctcagcgagctgccggagacccttgaaacactgctcctgctgaccctccttgccacggtcacagggggaatcttcctgtttctgatgtccggcaaggggattggaaaaatgaccctcggcatgtgctgcatcattaccgctagcatcctgctttggtacgcgcagattcagcctcactggatcgccgcttctatcattctggagttctttctcatcgtgctgctgattcccgaacccgagaagcaacggacacctcaggacaaccagctcacctatgttgtgatcgccattcttacagtggtcgccgctacgatggccaatgaaatgggcttcctggagaaaaccaagaaagattttgggctgggatccatcacaacccagcaaccggacagcaacatcctcgatattgacctgcgccccgcgtccgcctggacactttacgctgttgccaccacgttcatcacccctatgctgagacattctattgagaatagctccgtgaacgtgtctctcacagctatcgccaatcaggcgaccgtcctgatgggcctggggaagggatggcccctcagcaagatggacattggcgtgcctcttctggccatcgggtgttactcccaggttaaccccattacactgaccgctgccctcctgcttctggtggctcactatgccatcatcggacctggcctccaggctaaagccacgcgggaagcgcaaaagcgcgccgctgccggcattatgaaaatcccggctgccgatgggatgacagtcattgacctggatcccatcccttacgaccccaagtttgagaaacagctgggacaggtgatgctccttgtcctgtgcgtgacccaggttctgatgatgagaacaacctgggccctctgtgaagcgctgacccttgctacaggccctattagcacgctgtgggaggggaatcccggacggttctggaacaccacaatcgccgtgtctatggctaatatctttcgcggctcctatctcgccggggccggactgctgttcagcattatgaagaacaccgctaacacaagacggggcaccggcaatacgggggaaacactcggagagaagtggaaaaaccgccttaatgccctgggcaagtctgagtttcaaatctacaaaaagtccgggattcaggaagtcgatagaaccctggcgaaagagggaatcaagcggggcgaaaccgaccatcacgccgtgagcagagggtctgctaaactccgctggttcgttgagcggaacctggtgacaccggagggaaaggtcgtggatcttggctgcggcagagggggatggagctattactgtggcgggctgaagaatgtgaaagaagttaagggactcaccaaaggcgggcctggacatgaggaacccattcccatgtccacatatggctggaacctggtccgcctgcagtctggcgtggacgtgttctttacgcctcccgagaagtgcgataccctcctttgtgacatcggggaaagctcccctaatccgacagtcgaggccggacggaccctgagagttctgaacctcgtggagaattggctgaacaataacacacaattctgcatcaaagtgcttaatccctacatgcctagcgtcattgaaaagatggaggctctgcagcgcaagtacggcggggccctcgtgcggaaccccctgtccagaaattctacccacgaaatgtattgggttagcaacgcgtccggaaacatcgtgtctagcgtcaatatgatttcccgcatgctgatcaaccggtttacgatgaaacacaagaaagccacctacgagcctgatgtggacctcggctctgggacaagaaatattggaatcgaaagcgagacccccaaccttgatatcattggcaagcgcatcgagaaaattaagcaggaacatgagacatcctggcactatgaccaggaccatccgtacaagacctgggcttatcacggcagctacgaaacaaaacaaaccgggtctgcctccagcatggttaatggagtggtccggctgctgacgaagccttgggatgtgatccccatggtgacacagatggctatgaccgacaccacacctttcggccagcagagagtctttaaagagaaggttgatacgcgcacccaagaacccaaagaggggacaaagaagctcatgaaaattaccgccgagtggctgtggaaggaacttggcaaaaagaaaacacctagaatgtgtacccgggaggagttcacacgcaaggtgagatctaacgctgccctgggcgcgatctttaccgacgagaataaatggaagtccgcccgggaggctgtggaagatagcgggttctgggagctcgtcgacaaggaaagaaacctgcacctggagggaaaatgcgaaacgtgtgtgtataatatgatgggcaagcgggagaaaaagctcggcgagtttgggaaagccaagggatctcgcgctatttggtacatgtggctgggcgccagattccttgaatttgaggccctggggttcctcaacgaagatcattggttttcccgggagaatagcctgtccggagttgaaggcgaggggcttcacaagctgggctacatcctccgcgacgtgagcaaaaaggagggaggcgcgatgtatgctgatgacaccgccgggtgggatacaagaatcaccctggaagacctgaaaaacgaggaaatggtcacaaatcatatggagggagaacaccggaagctcgccgaggctattttccgcctgacctaccagaacaaagtggttagagtgcagcggcccacgccgcgcggcacagtcatggacatcatttctagacgggatcagcgcgggagcggacaagtggttacctatggccttaatacattcaccaacatggaggcccagctgatcagacagatggaaggggagggcgtgtttaagtccattcaacatctcacggtcaccgaagagatcgctgtgaagaactggctggagcgggtcggacgcgaaagactttctcggatggccatcagcggcgacgattgcgtggttaaacctctggacgatagattcgcgtccgccctcacagctctgaatgacatggggaaggtgcgcaaagatattcagcagtgggagccctctcggggatggaacgactggacccaggtccccttttgcagccaccacttccatgaactgatcatgaaggatggcagagtgctcgtggttccttgtcgcaatcaagacgagctgattgggcgggccagaatctcccagggagctggctggtctcttcgcgaaacagcctgcctggggaaaagctacgcgcagatgtggtccctcatgtattttcaccggagagatctgcgccttgccgctaacgccatttgtagcgctgtgccgtctcattgggtccccacctcccggacaacctggagcatccacgccacgcacgagtggatgacaaccgaggacatgctgaccgtgtggaatagagtttggatccaggaaaacccttggatggaggataagacacccgtggaatcttgggaggaaattccttacctcggcaagcgcgaggaccaatggtgcggatccctgatcggcctgaccagccgggctacatgggccaaaaatattcagacggcgatcaaccaggtcagatccctcattgggaatgaggaatataccgactacatgccctctatgaagcggttcagacgcgaggaagaggaagccggagtgctgtggtga

SEQ ID NO: 19591 - RNA, 9876 nt, synthetic construct
  misc_feature 1..9876: note = derived and/or modified CDS sequence (opt5) from DENV-2__KX380828__SS-prME
  source 1..9876: mol_type = other RNA
accgccggcgtgatcattatgctgatccccaccgctatggccttccacctcacgaccagaaacggggaacctcatatgattgtcagccggcaggaaaagggaaaatccctgctttttaagacagaggacggcgttaatatgtgcaccctgatggcgatggatctcggggaactgtgtgaggacacaatcacctacaactgcccccttctgagacaaaatgaacccgaggatattgactgttggtgcaactctacaagcacctgggtgacgtatggaacctgtacagctaccggcgagcacagacgggaaaaacgctccgtggccctcgtccctcatgtggggatgggactggagacaagaaccgaaacgtggatgtctagcgagggcgcctggaagcacgctcagcggatcgagacatggatcctgcgccatcccggcttcaccattatggccgctatcctcgcctacacaattgggaccacctattttcagagagttctgatcttcattcttctgacagcggtggccccttccatgacgatgcggtgcatcggaatttctaatcgcgattttgtcgaaggcgtgagcgggggatcctgggttgacatcgtgctcgagcacggcagctgtgtcaccacaatggctaaaaacaagcccaccctggatttcgaacttatcaagacagaggccaaacagcctgctaccctgagaaagtactgcattgaagccaaactcacgaatacaaccaccgcgtctcggtgtccgacacaaggggagccctccctgaacgaggaacaggacaagcgctttgtgtgcaaacacagcatggtggatagaggatggggcaatggctgtgggctgttcggaaagggcgggatcgtgacctgcgccatgtttacatgcaagaaaaacatggagggaaagattgttcagcctgaaaatctcgagtatacgatcgtggtgacaccccattctggcgaagagaacgctgtcgggaatgacacaggaaaacacggcaaggagattaaagtgacccctcagtccagcatcacagaagccgagctgaccggctacgggacggttaccatggaatgttctccccggacaggacttgatttcaacgagatggtgctgctccaaatggaaaataaggcttggctggtccatcgccagtggtttcttgacctgccgctcccttggctgcccggcgccgatacccaggggtccaactggatccagaaagagatgctggtgacattcaagaaccctcacgccaagaaacaagacgttgtggtcctcggaagccaggagggcgctatgcacaccgcgctgacgggggccacagaaattcagatgtcctctggcaatcttctgtttaccggacatctcaagtgcagactgcggatggacaaacttcaactgaagggcatgagctattccatgtgtacagggaaattcaaggtggtcaaggagatcgctgaaacccagcacggaaccattgtggttagagtgcagtacgagggcgatgggagcccctgcaaaatccccttcgagattatggacctcgaaaagcgccatgtcctgggacggctgatcacagtgaaccctatcgttacggagaaagattctccggtgaatattgaagccgagcccccttttggcgactcctacatcattatcggggtcgaacccggccagctcaagctgagctggttcaaaaagggatctagcattggccaaatgtttgagaccacaatgagaggggccaagcgcatggctatccttggagataccgcctgggacttcggctccctcggcggggtgtttacatctattgggaaagcgctccaccaggtgttcggggctatctatggcgccgcctttagcggagtttcctggaccatgaagatcctgattggcgtcgtgatcacgtggattgggatgaacagccggtctacatccctgagcgtgtctcttgtcctcgtgggagttgtgaccctgtacctgggcgtcatggtgcaggctgattccgggtgtgttgtgagctggaaaaataaggagctcaaatgcggatccggcatcttcattaccgacaacgtccatacatggaccgaacagtataagtttcaacctgagtctcccagcaagctggcctccgctatccagaaagcccacgaagaggggatctgtggcattagatctgtgacacgccttgaaaatctgatgtggaagcagatcacgccggagctcaaccacattctgagcgagaatgaagttaaactgaccatcatgacaggagatattaagggcatcatgcaggcggggaaacggtcccttagacctcaacccaccgagctcaagtacagctggaaaacatggggaaaggccaagatgctgtctaccgaacctcataaccagacgttcctgatcgacggccccgagaccgctgaatgccctaatacaaaccgcgcctggaactccctcgaggtggaggattatgggtttggagtcttcaccacaaacatttggctgaaacttaaggaacggcaggacgtgttttgtgacagcaaactgatgtctgctgccatcaaggataatagagcggtgcacgccgacatgggctactggattgagtccgctctcaacgatacctggaaaatcgaaaaggccagcttcattgaggtcaagtcttgccattggcccaaaagccacacactgtggtccaacggcgttctggagagcgaaatgatcatcccgaagaatttcgctgggcctgtgtctcagcacaactatcgccccggataccatacccaaacggccggcccctggcaccttgggaaactcgagatggactttgatttctgtgaaggaacaaccgtggtcgtgaccgaggactgcggcaatcgggggccttccctgagaacaaccacggccagcggaaagctgattacagaatggtgctgtcggtcctgcaccctcccgcccctgcgctacaaaggcgaggatggctgttggtatgggatggagatcagacctcttaaggaaaaggaggaaaacctggttaattctctcgtgacagctggacatggccagattgacaactttagcctgggggtcctgggaatggcgcttttcctcgaggaaatgctgcggaccagagtgggcacaaaacacgccgttctgctcgtggctgtctcctttatgaccctgatcacggggaatatgtctttccgcgatcttggacgggtgatggttatggtgggcgccgccatgaccgacgatattggcatgggggtcacatacctggctctcctggccgcgtttaaggtgagacccaccttcgctgccggactgcttctgcgcaaactcacaagcaaggagctgatgatgaccacgatcggcattgtgctcctgtcccagtctacaatccctgagaccatccttgaactgacagacgccctcgctctggggatgatgattctgaaaatcgtcagaaacatggagaagtatcaacttgccgttaccattatggcgatcctgtgcgctcccaatgccgtgattctccagaacgcctggaaggtgagctgtaccatcctggctgtcgtgtccgttagccctctcctgcttacatcttcccagcagaaagccgattggatccccctggctctcacgattaagggactgaatccgaccgccatctttctgacaacccttagccggacaaacaaaaagcgctcttggcctctgaatgaagcgattatggccgtgggcatggtctccatcctcgctagctctctgctcaaaaacgacattcccatgaccgggcctctggtggccggaggccttctgacggtttgctacgtgctgacaggcagatccgctgacctcgagctggaacgggccgccgatgtccgctgggaggaccaagctgagatcagcgggtccagccccatcctttctattaccatcagcgaagatggatccatgtctattaagaatgaggaagaggagcagaccctgacaatcctcattagaaccggcctgctcgtgatcagcgggctgttcccggtctccattcctatcacagcggccgcttggtatctttgggaagtgaaaaagcagcgggccggagttctgtgggacgtgccctctcctccgcccgtcggcaaggccgagctggaagatggggcttaccgcatcaaacagaaggggattctgggctatagccaaatcggcgccggggtgtacaaagagggaacgtttcataccatgtggcacgttacaagaggcgcggtgctgatgcacaaggggaaacggattgaaccttcctgggctgacgtccgcaaggatcttatctcttacggaggcgggtggaagctggagggagagtggaaagaaggcgaggaagtccaggtgctcgccctggagccgggcaagaaccccagagccgttcagaccaaacctggactcttcaagacaaacaccggaacgattggcgctgtcagcctggacttttcccccgggaccagcggatctcctatcgtggataaaaagggcaaggtggtcgggctttatggaaatggcgtggttacacggtccggcacctacgtgagcgccatcgcgcagacagaaaaatctattgaggacaaccccgagatcgaagatgacattttcagaaagaaacgcctgaccatcatggatctgcatcctggggctggaaagacaaaacggtatctcccggccattgtcagagaggccatcaagcgcggcctgcggacgcttatcctggctcccaccagagtggttgccgctgaaatggaggaagccctccgcgggctgcctattcggtaccaaacacccgcgatcagagccgagcacaccggacgcgagattgtggacctcatgtgtcatgctaccttcacaatgcggctgctttcccctgtcagagtgcccaattataacctgatcattatggacgaagcccactttacggatccggctagcatcgccgcccggggctacatttccacccgcgttgagatgggggaagctgcgggcatcttcatgacagccacccctcccggatctagagacccctttcctcagagcaatgctcccatcatggatgaggagcgggaaattcctgagcgctcctggaacagcggccatgaatgggtgacagacttcaaggggaaaaccgtctggtttgtgccgtctatcaaggccggaaatgatattgccgcttgcctgcgcaaaaatggcaagaaagtgatccagctctcccggaagacgttcgacagcgagtatattaagacaagaaccaatgattgggactttgtcgttaccacagatatctctgaaatgggggccaacttcaaagcggagcgcgtgatcgacccccggagatgtatgaagcctgtgattctgaccgatggagaggaacgcgtcatccttgctggccccatgcctgtgacacacagctccgccgcccaacggagagggcgcattggccggaatcccaaaaacgagaatgaccagtacatctacatgggagaaccgctggagaacgacgaagattgcgctcactggaaggaggccaaaatgctcctggacaatattaacacccctgagggcatcatcccctctatgtttgaacctgagagagaaaaggttgatgcgattgacggggagtatcgcctgagaggagaagcccggaaaacgttcgtggagctcatgcgcagaggcgatcttcccgtctggctggcttaccgggtggccgctgaggggatcaactatgccgaccgcagatggtgttttgatggaattaagaataaccagatcctggaagagaatgttgaagtggagatttggacaaaggagggcgagaaaaagaaactcaagcctcggtggctggacgctagaatctacagcgatccccttgccctgaaagagttcaaggagttcgcggccgggcgcaagtccctcaccatgaacctgattacagagatgggccggctgccgacctttatgacgcagaaagctagaaatgccctcgacaaccttgctgtcctgcataccgccgaagccggaggccgcgcttataatcacgcgctgtctgagctccctgagacactggaaacccttctgctcctgacactgctcgccaccgtgacagggggaatcttcctttttctgatgagcggcaaggggatcggaaaaatgaccctgggcatgtgctgcattatcacggcttccattctcctgtggtacgcccaaatccagccccattggattgccgctagcatcatccttgagttctttctgattgtcctcctgatccccgaacctgagaagcagcggacaccgcaggataaccaactgacctatgtggttattgccatcctcaccgtggtggcggccacaatggctaatgaaatgggcttccttgagaaaaccaagaaggactttgggctgggatctattgtcgcccagcagcccgagtccaacatcctggatatcgacctcagacctgctagcgcctggacactgtacgcggttgccacgaccttcattacacccatgcttcggcactccatcgaaaattctagcgtgaacgtgtccctgaccgctattgccaatcaggctacagtcctcatgggcctggggaaaggatggcctctgtctaagatggacatcggcgtgcccctccttgccattgggtgttacagccaagttaaccctatcaccctgacggctgccctgctcctgcttgtggcgcactatgccattatcggaccgggcctgcaggctaaagccacccgcgaggctcagaagagagccgccgcgggcatcatgaaaattcccacagtcgatgggatcaccgtgattgacctcgatcctatcccctacgaccctaagtttgaaaagcagctgggacaagtcatgctgctcgtgctttgcgttacacaggtgctgatgatgcggaccacgtgggctctgtgtgaggccctcacactggctaccggccccatttccacactttgggaagggaatccgggacgcttctggaacaccaccatcgccgtcagcatggccaatatctttagaggctcttatctggctggggccggactcctgttctccattatgaaaaacacaacgaacacccggcgcggcacaggcaataccggggagacactgggagagaagtggaaaaacagactcaatagccttggcaagtctgaatttcagatctacaaacggtccgggattcaagaggtggatcgcaccctggcgaaggaaggaatcaaaagaggcgagacggaccatcacgccgttagccgggggtctgctaagctgagatggttcgtggagcgcaacctcgtcacacctgaaggaaaggtgatggatctgggctgcggcagagggggatggagctattactgtggcgggcttaaaaatgtgcgggaggttaagggactgaccaaaggcgggcccggacatgaagaacccattcctatgtccacctatggctggaacctcgtccgcctgcagtctggcgtggacgtgttctttacaccccctgaaaagtgcgataccctgctctgtgacatcggggagagctccccgaatcccacagtcgaggccggacggacgcttagagttctgaacctggtggaaaattggctcaacaataacacccagttctgcatcaaagtgctgaatccttacatgcccagcgtcattgagaagatggaaacacttcagcgcaagtacggcggggctctggtgcggaaccctctctccagaaattctacccacgagatgtattgggttagcaacgcctccggaaacatcgtgtctagcgtcaatatgatttcccgcatgctgatcaaccggtttacaatgagacataaaaaggcgacctacgaacccgatgtggacctgggctctgggacgcgcaatattggaatcgagagcgagaccccgaacctcgatatcattggcaaacggatcgaaaagattaaacaagagcacgaaacatcctggcactatgaccaggaccatccttacaagacctgggcctatcacggcagctacgagacaaagcagaccgggtctgcttccagcatggttaatggagtggtcagacttctgacaaaaccctgggatgtgatccctatggtgacccagatggccatgacggacacaacccccttcggccaacagcgcgtctttaaggaaaaagttgataccagaacacaggagcctaaggaggggacgaaaaagctgatgaagattaccgctgaatggctctggaaagagctgggaaagaaaaagacaccccggatgtgtacccgcgaagagttcacaagaaaagtgcggtctaacgccgctcttggcgccatctttaccgacgagaataagtggaaatccgcgagagaagccgtggaggatagccggttctgggaactggtcgacaaggagcgcaacctccatctggaagggaagtgcgagacatgtgtgtataatatgatgggaaaaagagagaagaaaattggcgaatttggccgggctaaggggtctcgcgccatctggtacatgtggctgggagctagattcctcgagtttgaagccctgggcttccttaacgaggatcactggttttcccgggaaaatagcctgtccggggttgagggagagggcctccacaaactggggtacatccttcgcgaagtgagcaagaaggagggcggagccatgtatgcggacgataccgctggctgggacacgagaattaccctggaagatctcaaaaacgaggaaatggtcacaaatcatatggagggggagcacaagaaactggccgaagccatcttcaagctgacctaccagaacaaagtggttcgggtgcaacgcccgacacctagaggaaccgtcatggacattatctctcggcgcgaccagagaggcagcggacaggtgggaacgtatggcctcaatacattcaccaacatgggggctcaactgattcggcagatggagggcgaaggagtttttaagtccatccagcatcttacaaccacggaggaggtggccgtccaggattggctggctcgcgtgggcagagaacggctctctagaatggccatcagcggggacgattgcgtcgtgaagcccctggacgatcgcttcgcgtccgcccttaccgctctgaacgacatgggaaaagttcggaaggatattcaacagtgggagccctctaaaggctggaatgactggacacaggtgcctttttgcagccaccatttccacgaactcatcatgaaggatgggagagtcctggtggtgccgtgtcgcaaccaggacgagctgattggacgggccagaatctcccaaggcgctgggtggtctctccgcgaaaccgcctgcctgggcaaaagctacgcgcagatgtggtcccttatgtattttcaccggagagatctgcgcctcgccgctaatgccatttgtagcgctgttccctctcattgggtgcctacatcccggaccacatggagcatccacgccagacatgagtggatgaccacggaggacatgctgacagtctggaaccgcgtgtggatccaggaaaatccctggatggaggataagacccctgttgaatcttgggaggaaattccctaccttggaaagcgggaggaccagtggtgcggctccctgatcgggctcaccagcagagctacatgggccaaaaacattcaaaccgcgatcaatcaggtgcggtccctgattggatctgaggaatatacagactacatgcctagcatgaagagattccgccgggaggaagaggaagccggcgtcctgtggtga

SEQ ID NO: 19592 - RNA, 9876 nt, synthetic construct
  misc_feature 1..9876: note = derived and/or modified CDS sequence (opt5) from DENV-2__KX380829__SS-prME
  source 1..9876: mol_type = other RNA
accgccggcgtgatcattatgctgatccccaccgctatggccttccacctcacgaccagaaacggggaacctcatatgattgtcagccggcaggaaaagggaaaatccctgctttttaagacagaggacggcgttaatatgtgcaccctgatggcgatggatctcggggaactgtgtgaggacacaatcacctacaactgcccccttctgagacaaaatgaacccgaggatattgactgttggtgcaactctacaagcacctgggtgacgtatggaacctgtacagctaccggcgagcacagacgggaaaaacgctccgtggccctcgtccctcatgtggggatgggactggagacaagaaccgaaacgtggatgtctagcgagggcgcctggaagcacgctcagcggatcgagacatggatcctgcgccatcccggcttcaccattatggccgctatcctcgcctacacaattgggaccacctattttcagagagttctgatcttcattcttctgacagcggtggccccttccatgacgatgcggtgcatcggaatttctaatcgcgattttgtcgaaggcgtgagcgggggatcctgggttgacatcgtgctcgagcacggcagctgtgtcaccacaatggctaaaaacaagcccaccctggatttcgaacttatcaagacagaggccaaacagcctgctaccctgagaaagtactgcattgaagccaaactcacgaatacaaccaccgcgtctcggtgtccgacacaaggggagccctccctgaacgaggaacaggacaagcgctttgtgtgcaaacacagcatggtggatagaggatggggcaatggctgtgggctgttcggaaagggcgggatcgtgacctgcgccatgtttacatgcaagaaaaacatggagggaaagattgttcagcctgaaaatctcgagtatacgatcgtggtgacaccccattctggcgaagagaacgctgtcgggaatgacacaggaaaacacggcaaggagattaaagtgacccctcagtccagcatcacagaagccgagctgaccggctacgggacggttaccatggaatgttctccccggacaggacttgatttcaacgagatggtgctgctccaaatggaaaataaggcttggctggtccatcgccagtggtttcttgacctgccgctcccttggctgcccggcgccgatacccaggggtccaactggatccagaaagagatgctggtgacattcaagaaccctcacgccaagaaacaagacgttgtggtcctcggaagccaggagggcgctatgcacaccgcgctgacgggggccacagaaattcagatgtcctctggcaatcttctgtttaccggacatctcaagtgcagactgcggatggacaaacttcaactgaagggcatgagctattccatgtgtacagggaaattcaaggtggtcaaggagatcgctgaaacccagcacggaaccattgtggttagagtgcagtacgagggcgatgggagcccctgcaaaatccccttcgagattatggacctcgaaaagcgccatgtcctgggacggctgatcacagtgaaccctatcgttacggagaaagattctccggtgaatattgaagccgagcccccttttggcgactcctacatcattatcggggtcgaacccggccagctcaagctgagctggttcaaaaagggatctagcattggccaaatgtttgagaccacaatgagaggggccaagcgcatggctatccttggagataccgcctgggacttcggctccctcggcggggtgtttacatctattgggaaagcgctccaccaggtgttcggggctatctatggcgccgcctttagcggagtttcctggaccatgaagatcctgattggcgtcgtgatcacgtggattgggatgaacagccggtctacatccctgagcgtgtctcttgtcctcgtgggagttgtgaccctgtacctgggcgtcatggtgcaggctgattccgggtgtgttgtgagctggaaaaataaggagctcaaatgcggatccggcatcttcattaccgacaacgtccatacatggaccgaacagtataagtttcaacctgagtctcccagcaagctggcctccgctatccagaaagcccacgaagaggggatctgtggcattagatctgtgacacgccttgaaaatctgatgtggaagcagatcacgccggagctcaaccacattctgagcgagaatgaagttaaactgaccatcatgacaggagatattaagggcatcatgcaggcggggaaacggtcccttagacctcaacccaccgagctcaagtacagctggaaaacatggggaaaggccaagatgctgtctaccgaacctcataaccagacgttcctgatcgacggccccgagaccgctgaatgccctaatacaaaccgcgcctggaactccctcgaggtggaggattatgggtttggagtcttcaccacaaacatttggctgaaacttaaggaacggcaggacgtgttttgtgacagcaaactgatgtctgctgccatcaaggataatagagcggtgcacgccgacatgggctactggattgagtccgctctcaacgatacctggaaaatcgaaaaggccagcttcattgaggtcaagtcttgccattggcccaaaagccacacactgtggtccaacggcgttctggagagcgaaatgatcatcccgaagaatttcgctgggcctgtgtctcagcacaactatcgccccggataccatacccaaacggccggcccctggcaccttgggaaactcgagatggactttgatttctgtgaaggaacaaccgtggtcgtgaccgaggactgcggcaatcgggggccttccctgagaacaaccacggccagcggaaagctgattacagaatggtgctgtcggtcctgcaccctcccgcccctgcgctacaaaggcgaggatggctgttggtatgggatggagatcagacctcttaaggaaaaggaggaaaacctggttaattctctcgtgacagctggacatggccagattgacaactttagcctgggggtcctgggaatggcgcttttcctcgaggaaatgctgcggaccagagtgggcacaaaacacgccgttctgctcgtggctgtctcctttatgaccctgatcacggggaatatgtctttccgcgatcttggacgggtgatggttatggtgggcgccgccatgaccgacgatattggcatgggggtcacatacctggctctcctggccgcgtttaaggtgagacccaccttcgctgccggactgcttctgcgcaaactcacaagcaaggagctgatgatgaccacgatcggcattgtgctcctgtcccagtctacaatccctgagaccatccttgaactgacagacgccctcgctctggggatgatgattctgaaaatcgtcagaaacatggagaagtatcaacttgccgttaccattatggcgatcctgtgcgctcccaatgccgtgattctccagaacgcctggaaggtgagctgtaccatcctggctgtcgtgtccgttagccctctcctgcttacatcttcccagcagaaagccgattggatccccctggctctcacgattaagggactgaatccgaccgccatctttctgacaacccttagccggacaaacaaaaagcgctcttggcctctgaatgaagcgattatggccgtgggcatggtctccatcctcgctagctctctgctcaaaaacgacattcccatgaccgggcctctggtggccggaggccttctgacggtttgctacgtgctgacaggcagatccgctgacctcgagctggaacgggccgccgatgtccgctgggaggaccaagctgagatcagcgggtccagccccatcctttctattaccatcagcgaagatggatccatgtctattaagaatgaggaagaggagcagaccctgacaatcctcattagaaccggcctgctcgtgatcagcgggctgttcccggtctccattcctatcacagcggccgcttggtatctttgggaagtgaaaaagcagcgggccggagttctgtgggacgtgccctctcctccgcccgtcggcaaggccgagctggaagatggggcttaccgcatcaaacagaaggggattctgggctatagccaaatcggcgccggggtgtacaaagagggaacgtttcataccatgtggcacgttacaagaggcgcggtgctgatgcacaaggggaaacggattgaaccttcctgggctgacgtccgcaaggatcttatctcttacggaggcgggtggaagctggagggagagtggaaagaaggcgaggaagtccaggtgctcgccctggagccgggcaagaaccccagagccgttcagaccaaacctggactcttcaagacaaacaccggaacgattggcgctgtcagcctggacttttcccccgggaccagcggatctcctatcgtggataaaaagggcaaggtggtcgggctttatggaaatggcgtggttacacggtccggcacctacgtgagcgccatcgcgcagacagaaaaatctattgaggacaaccccgagatcgaagatgacattttcagaaagaaacgcctgaccatcatggatctgcatcctggggctggaaagacaaaacggtatctcccggccattgtcagagaggccatcaagcgcggcctgcggacgcttatcctggctcccaccagagtggttgccgctgaaatggaggaagccctccgcgggctgcctattcggtaccaaacacccgcgatcagagccgagcacaccggacgcgagattgtggacctcatgtgtcatgctaccttcacaatgcggctgctttcccctgtcagagtgcccaattataacctgatcattatggacgaagcccactttacggatccggctagcatcgccgcccggggctacatttccacccgcgttgagatgggggaagctgcgggcatcttcatgacagccacccctcccggatctagagacccctttcctcagagcaatgctcccatcatggatgaggagcgggaaattcctgagcgctcctggaacagcggccatgaatgggtgacagacttcaaggggaaaaccgtctggtttgtgccgtctatcaaggccggaaatgatattgccgcttgcctgcgcaaaaatggcaagaaagtgatccagctctcccggaagacgttcgacagcgagtatattaagacaagaaccaatgattgggactttgtcgttaccacagatatctctgaaatgggggccaacttcaaagcggagcgcgtgatcgacccccggagatgtatgaagcctgtgattctgaccgatggagaggaacgcgtcatccttgctggccccatgcctgtgacacacagctccgccgcccaacggagagggcgcattggccggaatcccaaaaacgagaatgaccagtacatctacatgggagaaccgctggagaacgacgaagattgcgctcactggaaggaggccaaaatgctcctggacaatattaacacccctgagggcatcatcccctctatgtttgaacctgagagagaaaaggttgatgcgattgacggggagtatcgcctgagaggagaagcccggaaaacgttcgtggagctcatgcgcagaggcgatcttcccgtctggctggcttaccgggtggccgctgaggggatcaactatgccgaccgcagatggtgttttgatggaattaagaataaccagatcctggaagagaatgttgaagtggagatttggacaaaggagggcgagaaaaagaaactcaagcctcggtggctggacgctagaatctacagcgatccccttgccctgaaagagttcaaggagttcgcggccgggcgcaagtccctcaccatgaacctgattacagagatgggccggctgccgacctttatgacgcagaaagctagaaatgccctcgacaaccttgctgtcctgcataccgccgaagccggaggccgcgcttataatcacgcgctgtctgagctccctgagacactggaaacccttctgctcctgacactgctcgccaccgtgacagggggaatcttcctttttctgatgagcggcaaggggatcggaaaaatgaccctgggcatgtgctgcattatcacggcttccattctcctgtggtacgcccaaatccagccccattggattgccgctagcatcatccttgagttctttctgattgtcctcctgatccccgaacctgagaagcagcggacaccgcaggataaccaactgacctatgtggttattgccatcctcaccgtggtggcggccacaatggctaatgaaatgggcttccttgagaaaaccaagaaggactttgggctgggatctattgtcgcccagcagcccgagtccaacatcctggatatcgacctcagacctgctagcgcctggacactgtacgcggttgccacgaccttcattacacccatgcttcggcactccatcgaaaattctagcgtgaacgtgtccctgaccgctattgccaatcaggctacagtcctcatgggcctggggaaaggatggcctctgtctaagatggacatcggcgtgcccctccttgccattgggtgttacagccaagttaaccctatcaccctgacggctgccctgctcctgcttgtggcgcactatgccattatcggaccgggcctgcaggctaaagccacccgcgaggctcagaagagagccgccgcgggcatcatgaaaaatcccacagtcgatgggatgaccgtgattgacctcgatcctatcccctacgaccctaagtttgaaaagcagctgggacaagtcatgctgctcgtgctttgcgttacacaggtgctgatgatgcggaccacgtgggctctgtgtgaggccctcacactggctaccggccccatttccacactttgggaagggaacccgggacgcttctggaataccaccatcgccgtcagcatggccaacatttttagaggctcttatctggctggggccggactcctgttctccatcatgaaaaacacaacgaatacccggcgcggcacaggcaacaccggggagacactgggagagaagtggaaaaatagactcaacagccttggcaagtctgaatttcagatctacaaacggtccgggattcaagaggtggatcgcaccctggcgaaggaaggaatcaaaagaggcgagacggaccatcacgccgttagccgggggtctgctaagctgagatggttcgtggagcgcaatctcgtcacacctgaaggaaaggtgatggatctgggctgcggcagagggggatggagctattactgtggcgggcttaaaaacgtgcgggaggttaagggactgaccaaaggcgggcccggacatgaagaacccattcctatgtccacctatggctggaatctcgtccgcctgcagtctggcgtggacgtgttctttacaccccctgaaaagtgcgataccctgctctgtgacatcggggagagctccccgaaccccacagtcgaggccggacggacgcttagagttctgaatctggtggaaaactggctcaataacaatacccagttctgcattaaagtgctgaacccttacatgcccagcgtcatcgagaagatggaaacacttcagcgcaagtacggcggggctctggtgcggaatcctctctccagaaactctacccacgagatgtattgggttagcaacgcctccggaaatatcgtgtctagcgtcaacatgatttcccgcatgctgatcaatcggtttacaatgagacataaaaaggcgacctacgaacccgatgtggacctgggctctgggacgcgcaacattggaatcgagagcgagaccccgaatctcgatattatcggcaaacggatcgaaaagattaaacaagagcacgaaacatcctggcactatgaccaggaccatccttacaagacctgggcctatcacggcagctacgagacaaagcagaccgggtctgcttccagcatggttaacggagtggtcagacttctgacaaaaccctgggatgtgatccctatggtgacccagatggccatgacggacacaacccccttcggccaacagcgcgtctttaaggaaaaagttgataccagaacacaggagcctaaggaggggacgaaaaagctgatgaagattaccgctgaatggctctggaaagagctgggaaagaaaaagacaccccggatgtgtacccgcgaagagttcacaagaaaagtgcggtctaatgccgctcttggcgccatctttaccgacgagaacaagtggaaatccgcgagagaagccgtggaggatagccggttctgggaactggtcgacaaggagcgcaatctccatctggaagggaagtgcgagacatgtgtgtataacatgatgggaaaaagagagaagaaaattggcgaatttggccgggctaaggggtctcgcgccatctggtacatgtggctgggagctagattcctcgagtttgaagccctgggcttccttaatgaggatcactggttttcccgggaaaacagcctgtccggggttgagggagagggcctccacaaactggggtacattcttcgcgaagtgagcaagaaggagggcggagccatgtatgcggacgataccgctggctgggacacgagaatcaccctggaagatctcaaaaatgaggaaatggtcacaaaccatatggagggggagcacaagaaactggccgaagccatcttcaagctgacctaccagaataaagtggttcgggtgcaacgcccgacacctagaggaaccgtcatggacattatctctcggcgcgaccagagaggcagcggacaggtgggaacgtatggcctcaacacattcaccaacatgggggctcaactgattcggcagatggagggcgaaggagtttttaagtccatccagcatcttacaaccacggaggaggtggccgtccaggattggctggctcgcgtgggcagagaacggctctctagaatggccattagcggggacgattgcgtcgtgaagcccctggacgatcgcttcgcgtccgcccttaccgctctgaatgacatgggaaaagttcggaaggatatccaacagtgggagccctctaaaggctggaacgactggacacaggtgcctttttgcagccaccatttccacgaactcatcatgaaggatgggagagtcctggtggtgccgtgtcgcaatcaggacgagctgattggacgggccagaatctcccaaggcgctgggtggtctctccgcgaaaccgcctgcctgggcaaaagctacgcgcagatgtggtcccttatgtattttcaccggagagatctgcgcctcgccgctaacgccatttgtagcgctgttccctctcattgggtgcctacatcccggaccacatggagcatccacgccagacatgagtggatgaccacggaggacatgctgacagtctggaatcgcgtgtggattcaggaaaacccctggatggaggataagacccctgttgaatcttgggaggaaatcccctaccttggaaagcgggaggaccagtggtgcggctccctgatcgggctcaccagcagagctacatgggccaaaaatattcaaaccgcgatcaaccaggtgcggtccctgattggatctgaggaatatacagactacatgcctagcatgaagagattccgccgggaggaagaggaagccggcgtcctgtggtga

SEQ ID NO: 19593 - RNA, 9876 nt, synthetic construct
  misc_feature 1..9876: note = derived and/or modified CDS sequence (opt5) from DENV-2__KX380830__SS-prME
  source 1..9876: mol_type = other RNA
accgccggaatcattatcatgatgattcccaccgtgatggctttccacctgacgaccagaaacggggaacctcatatgatcgtgagccggcaggaaaaggggaaaagcctcctgtttaagacagagaatggagttaacatgtgcacccttatggccatggacctgggggaactctgtgaggatacaattacctacaattgcccgctgcttcgccaaaacgaacccgaggacatcgattgttggtgcaattctacaagcacctgggtgacgtatggaacctgtacagcgaccggcgagcacagacgggaaaaacgctccgtggctctggtccctcatgtggggatgggactcgagacaagaaccgaaacgtggatgtctagcgagggcgcctggaagcacgcccagcggatcgagacatgggttctgcgccatcccggcttcaccgtgatggctgccattctggcttacacaatcgggaccacctattttcagagagtcctcattttcatcctgcttacagccgtggcgccttccatgacgatgcggtgcattggaatctctaaccgcgactttgttgaaggcgtgagcgggggatcctgggtcgatattgtgctggagcacggcagctgtgtgaccacaatggccaaaaataagcccaccctcgacttcgaactgatcaagacagaggctaaacaccctgccacccttagaaagtactgcatcgaagctaaactgacgaacacaaccaccgcctctcggtgtccgacacagggggagccctccctcaatgaggaacaagataagcgctttgtctgcaaacatagcatggttgacagaggatggggcaacggctgtgggctgttcggaaagggcgggattgtgacctgcgcgatgtttacatgcaagaaaaatatggagggaaagatcgtgcagcctgaaaacctggagtatacgattgtcatcacaccccactctggcgaagagaatgccgtggggaacgatacaggaaaacatggcaaggagattaaagttacccctcagtccagcatcacagaagctgagctcaccggctacgggacggccaccatggaatgttctccccggacaggactggacttcaatgagatggtgcttctgcagatggaaaacaaggcttggctcgtccaccgccaatggtttctggatcttccgctgccttggctccccggcgccgacacccaggggtccaactggatccagaaagagacactggtgaccttcaagaatcctcacgccaagaaacaggatgttgtggtcctgggaagccaagagggcgctatgcatacggcgctcacaggggccaccgaaattcagatgtcctctggcaacctgctttttacaggacacctgaagtgcagactccggatggacaaactgcagcttaagggcatgagctattccatgtgtaccgggaaattcaaggtggtcaaggagatcgctgaaacccaacatggaacaattgtgatcagagttcagtacgagggcgacgggagcccctgcaaaattcccttcgagatcatggatctggaaaagcgccacgtgctcggacggctgatcacggtcaatcctattgtgaccgagaaagactctccggttaacatcgaagccgagcccccttttggcgattcctacattatcattggggtggaacccggccagctgaagctcagctggttcaaaaagggatctagcatcggccagatgtttgagacaaccatgagaggggccaagcgcatggctattctgggagacacagcctgggatttcggctcccttgggggagtctttacctctatcggcaaagcgctgcatcaagtgttcggggctatctatggcgccgcctttagcggagtgtcctggacgatgaagattctcatcggcgttgtcattacatggatcgggatgaatagccggtctacctccctgagcgtgtctctggtgcttgtcggaattgtgaccctctacctgggcgttatggtgcaggctgactccgggtgtgtcgtgagctggaaaaacaaggagctgaaatgcggatccggcatcttcatcacagataatgttcacacctggacagaacagtataagtttcagcctgagtctcccagcaagctcgcctccgctattcaaaaagcccacgaagaggggatctgtggcattagatctgtgacgcgcctggaaaaccttatgtggaagcagatcaccccggagctgaatcatattctcagcgagaacgaagtcaaactgacaatcatgaccggagacatcaagggcattatgcaggcggggaaacggtccctgagacctcagcccacagagcttaagtacagctggaaagcctggggaaaggctaagatgctctctaccgaactgcacaatcatacgttcctgatcgatggccctgagaccgccgaatgccccaacacaaatcgcgcttggaactccctcgaggtggaggactatgggtttggagttttcaccacaaatatttggctgaaacttaaggaacggcaagatgtgttttgtgacagcaaactgatgtctgccgcgatcaaggacaacagagccgtccacgctgatatgggctactggattgagtccgccctcaacgacacctggaaaatcgaaaaggctagcttcatcgaggtgaagtcttgccactggcctaaaagccatacactgtggtccaatggcgtgctggagagcgaaatgattatccccaagaacttcgccgggccggtctctcagcacaattatcgccctggataccatacccagacggccggcccctggcaccttgggcggctcgagatggattttgacttctgtgaaggaacaaccgttgtggtgaccgaggattgcggcaacagagggccctccctgcggacaaccacggctagcggaaaactgattacagaatggtgctgtcgctcctgcaccctccctccgctgagataccggggcgaggacggctgttggtatgggatggagatcagaccccttaaggaaaaagaggaaaatctggtcaactctctcgtgacagcgggacatggccagattgataattttagcctgggggttctgggaatggcccttttcctcgaggaaatgctgcgcacccgggtgggcacaaagcacgctatcctgctcgtcgccgtgtcctttgttaccctgattacggggaacatgtctttcagagaccttggacgcgtgatggtcatggtgggcgccaccatgacagatgacatcggcatgggggttacctacctggctctcctggccgcgtttaaggtgagacctacattcgctgccggactgcttctgcggaaactcaccagcaaggagctgatgatgacgacaatcggcattgtcctcctgtcccaatctaccatccccgagacaattcttgaactgaccgatgccctcgctctggggatgatggtgctgaaaatcgtgcgcaatatggagaagtatcagcttgccgtcaccattatggcgatcctgtgcgttcctaacgctgtgatcctccagaatgcctggaaagtgagctgtacaattctggccgtcgtgtccgttagccccctcctgcttacgtcttcccaacagaaggctgactggatccctctggccctcaccattaagggactgaaccccacagctatctttctgaccacacttagcagaacctctaaaaagcggtcctggccgctgaatgaagccattatggcggtgggcatggtcagcatcctcgcctcttccctgctcaaaaacgatatccctatgacggggcccctggtggctggaggccttctgacagtttgctacgtgctgaccggccgcagcgccgacctcgagctggaaagagctgccgacgtccggtgggaggagcaggccgaaatttccgggagctctcctatccttagcattaccatctccgaggatggatctatgagcattaagaatgaagaggaggaacagacactgaccatcctcattcgcacaggcctgctcgtgatctccgggctgttccccgtctctatcccgattacggctgcggcctggtatctttgggaggtgaaaaagcaaagagctggagttctgtgggacgtgccttctccccctcccgtcggcaaagccgaactggaggatggggcctaccggatcaagcagaagggcattctcggctattcccagatcggcgctggggtgtacaaagaaggaacctttcacacaatgtggcatgttacccgcggcgccgtgctgatgcacaaggggaaaagaattgagccctcctgggcggacgtcaagaaagatcttatcagctacggaggcgggtggaagctggagggagaatggaaggagggcgaagaggtccaggtgctcgctctggaacctggcaaaaacccgcgggccgttcaaacaaagcccggactcttcaaaaccaacacgggaaccatcggcgccgtctccctggactttagccctgggacatctggatcccccattgtggataagaaaggcaaggtggtcgggctttatggaaatggcgtggttaccagaagcggcacatacgtgtctgctatcgcccagaccgagaagtccattgaggacaaccctgaaatcgaggatgacattttccgcaaaaagcggctgacaatcatggatctgcatcccggggcgggaaaaacgaagagatatctccctgctatcgtccgcgaagccattaaacggggcctgagaacccttatcctggccccgacacgcgtggttgctgccgagatggaagaggctctccgggggctgcccattagataccagacccctgccatccgcgcggagcacaccggacgggaaattgtggacctcatgtgtcatgccacattcacgatgagactgcttagccccatccgggtccctaattataacctgattatcatggatgaggctcactttaccgaccccgcctccatcgctgcccgcggctacatttctacaagagtggaaatgggggaggccgctggcatcttcatgaccgcgacaccgcctggaagccgggacccctttccccagtccaatgcccctattatggatgaggaacgcgagatccccgaaagaagctggaactctggccacgagtgggttaccgacttcaaggggaagacggtgtggtttgtcccttccattaaagctggaaatgatatcgccgcctgcctgcggaagaacggcaaaaaggtgatccaactcagcagaaaaacattcgactctgaatatattaagacccgcaccaatgattgggactttgtggtcacaaccgatatcagcgagatgggggctaacttcaaggccgagcgggttattgacccgagacgctgtatgaaacccgtgatcctgacagatggagaagaacgggtgattcttgcgggccctatgcccgtcacccattcctctgctgcccagagacgcgggcgggtgggcagaaatcctaagaacgaaaatgaccagtacatctacatgggagagcccctggaaaacgatgaggactgcgcccactggaaagaggctaagatgctcctggacaatatcaacacgccggaaggcattatccctagcatgtttgagcccgaacgcgagaaagttgatgccattgacggggaatatagactgcggggagaggcgcgcaagacattcgtggatctcatgagacggggcgaccttcctgtctggctggcctaccgcgtggctgccgaggggatcaactatgctgatagacggtggtgttttgacggagttaaaaataaccaaattctggaagagaatgtggaagtcgagatctggaccaaggagggcgaaagaaagaaactcaagccccgctggctggatgcccggatttactccgaccctcttgctctgaaagagttcaaggagttcgccgcggggagaaaatctctcacactgaacctgatcaccgagatgggccgcctccccacgtttatgacccagaaggcccggaatgctcttgataacctggccgtgctgcatacagctgaagccggaggcagagcctataatcacgctctcagcgagctgccggagacccttgaaacactgctcctgctgaccctccttgcgacagtcaccgggggaatcttcctgtttctgatgtccggcaaggggattggaaaaatgacgctcggcatgtgctgcatcattacagccagcatcctgctttggtacgctcagattcagcctcactggatcgccgcctctatcattctggagttctttctcatcgtgctgctgattcccgaacccgagaagcaacggacccctcaggacaaccagctcacctatgttgtgatcgctattcttacagtggtcgccgcgaccatggccaatgaaatgggcttcctggagaaaacaaagaaagattttgggctgggatccatcacgacccagcaaccggacagcaacatcctcgatattgacctgcgccccgcttccgcctggacactttacgctgttgccaccacattcatcacccctatgctgagacattctattgagaatagctccgtgaacgtgtctctcacggcgatcgccaatcaggctaccgtcctgatgggcctggggaagggatggcccctcagcaagatggacattggcgtgcctcttctggccatcgggtgttactcccaggttaaccccattacactgaccgctgccctcctgcttctggtggctcactatgccatcatcggacctggcctccaggcgaaagccacacgggaagctcaaaagcgcgccgctgccggcattatgaaaatcccggccgcggatgggatgaccgtcattgacctggatcccatcccttacgaccccaagtttgagaaacagctgggacaggtgatgctccttgtcctgtgcgtgacgcaggttctgatgatgagaacaacctgggctctctgtgaagccctgacacttgctaccggccctattagcaccctgtgggaggggaatcccggacggttctggaacacaacgatcgccgtgtctatggccaatatctttcgcggctcctatctcgctggggccggactgctgttcagcattatgaagaacaccgcgaacacaagacggggcaccggcaatacaggggaaaccctcggagagaagtggaaaaaccgccttaatgccctgggcaagtctgagtttcaaatctacaaaaagtccgggattcaggaagtcgatagaacgctggctaaagagggaatcaagcggggcgaaacagaccatcacgccgtgagcagagggtctgctaaactccgctggttcgttgagcggaacctggtgaccccggagggaaaggtcgtggatcttggctgcggcagagggggatggagctattactgtggcgggctgaagaatgtgaaagaagttaagggactcaccaaaggcgggcctggacatgaggaacccattcccatgtccacatatggctggaacctggtccgcctgcagtctggcgtggacgtgttctttacccctcccgagaagtgcgatacactcctttgtgacatcggggaaagctcccctaatccgacggtcgaggccggacggaccctgagagttctgaacctcgtggagaattggctgaacaataacacacaattctgcatcaaagtgcttaatccctacatgcctagcgtcattgaaaagatggaggcgctgcagcgcaagtacggcggggccctcgtgcggaaccccctgtccagaaattctacccacgaaatgtattgggttagcaacgcttccggaaacatcgtgtctagcgtcaatatgatttcccgcatgctgatcaaccggtttacaatgaaacacaagaaagccacctacgagcctgatgtggacctcggctctgggacgagaaatattggaatcgaaagcgagacccccaaccttgatatcattggcaagcgcatcgagaaaattaagcaggaacatgagacatcctggcactatgaccaggaccatccgtacaagacctgggcttatcacggcagctacgaaacaaaacaaaccgggtctgcctccagcatggttaatggagtggtccggctgctgacaaagccttgggatgtgatccccatggtgacccagatggctatgacggacacaacccctttcggccagcagagagtctttaaagagaaggttgatacccgcacacaagaacccaaagaggggacgaagaagctcatgaaaattaccgccgagtggctgtggaaggaacttggcaaaaagaaaacacctagaatgtgtacccgggaggagttcacacgcaaggtgagatctaacgcggccctgggcgctatctttaccgacgagaataaatggaagtccgcccgggaggctgtggaagatagcgggttctgggagctcgtcgacaaggaaagaaacctgcacctggagggaaaatgcgaaacatgtgtgtataatatgatgggcaagcgggagaaaaagctcggcgagtttgggaaagccaagggatctcgcgccatttggtacatgtggctgggcgcgagattccttgaatttgaggctctggggttcctcaacgaagatcattggttttcccgggagaatagcctgtccggagttgaaggcgaggggcttcacaagctgggctacatcctccgcgacgtgagcaaaaaggagggaggcgccatgtatgccgatgacaccgctgggtgggatacgagaatcaccctggaagacctgaaaaacgaggaaatggtcacaaatcatatggagggagaacaccggaagctcgccgaggctattttccgcctgacctaccagaacaaagtggttagagtgcagcggcccacaccgcgcggcaccgtcatggacatcatttctagacgggatcagcgcgggagcggacaagtggttacgtatggccttaatacattcaccaacatggaggcccagctgatcagacagatggaaggggagggcgtgtttaagtccattcaacatctcacagtcaccgaagagatcgcggtgaagaactggctggagcgggtcggacgcgaaagactttctcggatggccatcagcggcgacgattgcgtggttaaacctctggacgatagattcgcttccgccctcacggctctgaatgacatggggaaggtgcgcaaagatattcagcagtgggagccctctcggggatggaacgactggacccaggtccccttttgcagccaccacttccatgaactgatcatgaaggatggcagagtgctcgtggttccttgtcgcaatcaagacgagctgattgggcgggccagaatctcccagggagcgggctggtctcttcgcgaaacagcctgcctggggaaaagctacgctcagatgtggtccctcatgtattttcaccggagagatctgcgccttgccgctaacgccatttgtagcgctgtgccgtctcattgggtccccatctcccggaccacatggagcatccacgccacccacgagtggatgacaaccgaggacatgctgacggtgtggaatagagtttggattcaggaaaacccttggatggaggataagacacccgtggaatcttgggaggaaatcccttacctcggcaagcgcgaggaccaatggtgcggatccctgattggcctgaccagccgggcgacctgggccaaaaatatccagacagctattaaccaggtcagatccctcatcgggaatgaggaatataccgactacatgccctctatgaagcggttcagacgcgaggaagaggaagccggagtgctgtggtga

SEQ ID NO: 19594 - RNA, 9876 nt, synthetic construct
  misc_feature 1..9876: note = derived and/or modified CDS sequence (opt5) from DENV-2__KX380831__SS-prME
  source 1..9876: mol_type = other RNA
accgccggaatcattatcatgatgattcccaccgtgatggctttccacctgacgaccagaaatggggagcctcatatgatcgtcagccggcaggaaaagggaaaatccctcctgtttaagaccgagaatggcgttaacatgtgcacccttatggccatggacctgggggaactctgtgaggataccattacctacaattgcccgctgcttcgccaaaacgaacccgaggacatcgattgttggtgcaattctacgagcacctgggtgacgtatggaacctgtacagcgaccggcgagcaccggcgggaaaaacgctccgtggctctggtccctcatgtggggatgggactcgagacaagaaccgaaacgtggatgtctagcgagggcgcctggaagcacgcccagcggatcgagacatggattctgcgccatcccggcttcaccatcatggctgccattctggcttacacaatcgggaccacctattttcagagagttctcattttcatcctgcttacagccgtgacgccttccatggcgatgcggtgcattggaatctctaaccgcgactttgtcgaaggcgtgagcgggggatcctgggttgatatcgtgctggagcacggcagctgtgtcaccacaatggccaaaaataagcccaccctcgacttcgaactgattaagacagaggctaaacaccttgccaccctgagaaagtactgcgtggaagctaaactcacgaacacaaccaccgcctctcggtgtcctacacagggggagccgtccctgaatgaggaacaagataagcgctttgtgtgcaaacatagcatggtcgacagaggatggggcaacggctgtgggctgttcggaaagggcgggatcgttacctgcgcgatgtttacatgcaagaaaaatatggagggaaaggtggtgcagcccgaaaacctcgagtatacgattgtcatcacccctcactctggcgaagagaatgccgtggggaacgatacaggaaaacatggcaaggagattaaagttacaccccagtccagcatcacagaagctgagctgaccggctacgggacggtgaccatggaatgttctcctcggacaggacttgacttcaatgagatggtcctgctccagatggaaaacaaggcctggctggtgcaccgccaatggtttcttgatctgcccctcccgtggctgcctggcgctgacacccaggggtccaactggatccagaaagagacactggttaccttcaagaatccccacgccaagaaacaggatgtggtcgtgctcggaagccaagagggcgccatgcatacggctctgacaggggcgaccgaaattcagatgtcctctggcaaccttctgtttacaggacacctcaagtgcagactgcggatggacaaacttcagctgaagggcatgagctattccatgtgtaccgggaaattcaaggtcgtgaaggagatcgccgaaacccaacatggaacaattgttatcagagtgcagtacgagggcgacgggagcccttgcaaaattcccttcgagatcatggatctcgaaaagcgccacgtcctgggacggctgatcacggtgaatcccattgttaccgagaaagactctcctgtgaacatcgaagctgagccgccctttggcgattcctacattatcattggggtcgaacctggccagctcaagctgagctggttcaaaaagggatctagcatcggccagatgtttgagacaaccatgagaggggccaagcgcatggccattcttggagacacagcttgggatttcggctccctcggcggggtgtttacctctatcgggaaagccctccatcaagtgttcggggcgatctatggcgctgcctttagcggagtttcctggacgatgaagattctgatcggcgtcgtgattacatggatcgggatgaatagccggtctacctccctgagcgtgtctcttgtcctcgtgggagttgtgaccctgtacctgggcgtcatggtgcaggccgactccgggtgtgttgtgagctggaaaaacaaggagctcaaatgcggatccggcattttcatcacagataatgtccacacctggacagaacagtataagtttcagcccgagtctcctagcaagctggcttccgccatccaaaaagctcacgaagaggggatttgtggcatcagatctgtgacgcgccttgaaaacctgatgtggaagcagattacccccgagctcaatcatatcctgacagagaacgaagttaaactgaccattatgacaggagacatcaagggcatcatgcaggccgggaaacggagccttagaccgcagcctaccgagctcaagtactcctggaaagcgtggggaaaggccaagatgctgagcacggaactgcacaatcataccttcctcattgatggccccgagacagctgaatgccctaacaccaatcgcgcctggaactctctggaggtggaggactatgggtttggagtcttcacaaccaatatctggcttaaactgaaggaacggcaagatgtgttttgtgactccaacctcatgagcgctgccattaaagacaacagagcggtgcacgccgatatgggctactggatcgagtctgctctgaatgacacatggaagattgaaaaagcctccttcatcgaggtcaagagctgccactggcccaagtctcataccctgtggagcaacggcgttcttgagtccgaaatgatcattcctaaaaatttcgctgggcccgtgagccagcacaactatcgcccgggataccatacgcagacagccggcccttggcacctcgggcggctggagatggattttgacttctgtgaaggaaccaccgtggtcgtgacagaggattgcggcaatagagggccctctctgcggaccacgacagcctccggaaagctcatcaccgaatggtgctgtcgcagctgcacactgccccctcttagataccggggcgaggacggctgttggtatgggatggagattagaccgctgaaagaaaaggaggaaaacctcgttaattccctggtgaccgctggacatggccagatcgataacttttctctgggggtccttggaatggcgctgttcctggaggaaatgctgcgcacacgggtgggcaccaaacacgccattctcctggttgctgtgagctttgtcacgcttatcaccgggaatatgtccttcagagacctgggacgcgtgatggttatggtgggcgccacaatgaccgatgacattggcatgggggtcacatacctcgccctgctggctgcctttaaggtgagacccaccttcgcggctggacttctgctccggaagctgacgtctaaagagctcatgatgacaaccatcggcatcgtgctgcttagccaatccacaattcctgagtctatcctggaactcaccgatgccctggccctggggatgatggtccttaagattgttcgcaacatggagaaatatcagctggctgtgaccatcatggccattctctgcgtgcccaatgcggtcatcctgcagaacgcttggaaggtgagctgtacaacgctcgccgttgtgtccgtcagccctctgcttctgacctcttcccaacagaaagccgactggatccccctcgctctgacaattaagggactgaatcctaccgccatctttcttacaaccctgagcagaacgtctaagaaacggtcctggcccctcaacgaagctattatggccgtgggcatggttagcatcctggcgtcttccctcctgaagaatgatattccgatgacagggcctcttgtggccggaggcctgctgaccgtctgctacgtgctcaccggccgcagcgctgacctggagcttgaaagagccgctgacgtccggtgggaggagcaggccgaaatctccgggagctctcccatcctgagcattacaatctccgaggatggatctatgagcattaaaaacgaagaggaggaacagaccctcacaatcctgattcgcacgggcctcctggtgatctccgggcttttccctgtttctattcccatcaccgccgctgcgtggtatctgtgggaggtgaagaaacaaagagccggagtcctgtgggacgtgccgagccctccccctgttggcaaggctgaactcgaggatggggcctaccggatcaaacagaagggcattctgggctattcccagatcggcgccggggtgtacaaggaaggaacatttcacaccatgtggcatgtcacacgcggcgctgtgcttatgcacaaagggaagagaattgagccctcttgggccgacgtgaaaaaggatctgatcagctacggaggcgggtggaaactcgagggagaatggaaggagggcgaagaggttcaggtcctggcgctcgaacccggcaagaaccctcgggctgtgcaaaccaaaccggggctgttcaagacgaataccggaacaattggcgccgtgtcccttgactttagccccgggacctctggatcccctatcgtcgataaaaagggcaaagtggttgggctgtatggaaacggcgtggtcacaagaagcggcacctacgtgtctgccatcgctcagacagagaagtccattgaggacaatcccgaaatcgaggatgacattttccgcaagaaacggctgacgatcatggatctccatcctggggccggaaagaccaaaagatatctgcccgcgattgttcgcgaagctatcaagcggggccttagaacactgatcctcgcccctacccgcgtggtcgccgctgagatggaagaggccctgcgggggctcccgattagataccagacccccgctatccgcgccgagcacacaggacgggaaattgtggacctgatgtgtcatgcgacgttcaccatgagacttctgagccctatccgggttcccaactataatctgattatcatggatgaggcccactttacagaccctgcttccattgccgctcgcggctacatctctaccagagtggaaatgggggaggccgccggcatcttcatgacagctacacccccgggaagccgggacccttttccccagtccaacgcgcccattatggatgaggaacgcgagatccctgaaagaagctggaactctggccacgagtgggtcacggacttcaaagggaagacagtgtggtttgtgccctccattaaggccggaaacgatatcgctgcctgcctccggaaaaatggcaagaaagtcattcaactgagcagaaagaccttcgactctgaatatatcaaaacccgcacaaacgattgggactttgttgtgaccacagatatcagcgagatgggggccaatttcaaggctgagcgggtgattgaccctagacgctgtatgaagccggtcatccttaccgatggagaggaacgggtgattctggccggccccatgcctgttacgcattcctctgcggctcagagacgcgggcgggtgggcagaaaccccaaaaatgaaaacgaccagtacatctacatgggagagcctctcgaaaatgatgaggactgcgcccactggaaggaggccaaaatgctgctggacaacattaacacacccgaaggcatcatcccgagcatgtttgagcctgaacgcgagaaggtcgatgctattgacggggaatatagactccggggagaggcccgcaaaaccttcgtggatcttatgagacggggcgacctgcccgtttggctggcgtaccgcgtggccgctgaggggatcaattatgccgatagacggtggtgttttgacggagtcaagaacaatcaaattctcgaagagaacgtggaagtcgagatctggacaaaagagggcgaaagaaagaagctgaaacctcgctggcttgatgctcggatttactccgaccccctggccctcaaggagttcaaagagttcgctgccgggagaaagtctctgaccctgaatctcatcacggagatgggccgccttcctacctttatgacacagaaagcgaagaacgccctggataatctggctgtgctccataccgccgaagctggaggccgggcctataaccacgccctgagcgagcttcccgagacactggaaaccctcctgctgctcacacttctggctaccgttacagggggaattttcctgtttctcatgtccggcaaggggatcggaaaaatgacactgggcatgtgctgcatcattaccgcgagcatccttctgtggtacgcccagattcagccgcactggatcgctgcctctattatcctcgagttctttctgatcgtgctgctcattcctgaacccgagaagcaaagaacaccccaggacaatcagcttacatatgtggtcatcgccattctgaccgttgtggctgccacaatggcgaacgaaatgggcttcctggagaaaacgaagaaagattttgggctcggatccatcaccacacagcaacctgagagcaatattctggacatcgatcttcggccggcctccgcttggaccctgtacgccgtggctacaaccttcatcacgcccatgctccgccattctattgaaaacagctccgtcaatgtgtctctgaccgccatcgcgaaccaggccacagttctgatgggcctcgggaagggatggcctcttagcaagatggacattggcgtgcccctgctggctatcgggtgttactcccaggtcaatcctattaccctcacagccgctctgcttctgctcgtggcccactatgctatcattggacccggcctgcaggccaaagcgaccagagaggcccaaaagcgggctgccgctggcatcatgaaaaaccctacggtcgacgggatgacagtgatcgatctggacccgattccctacgatcctaagtttgaaaaacagctcggacaggttatgcttctggtgctgtgcgtcacccaggtgctcatgatgcgcacaacctgggccctgtgtgaggcccttaccctggcgacaggccccatcagcacgctctgggaagggaatcctggaagattctggaacaccacaattgctgtttctatggccaacatctttcggggctcctatctggctggggccggactcctgttcagcattatgaagaataccgccaacacacgcagaggcaccggcaatacgggggagacacttggagagaagtggaaaaaccggctgaatgctctgggcaagtctgaatttcaaatctacaaaaagtccgggatccaggaggtggaccgcaccctcgccaaagaaggaattaagagaggcgagaccgatcatcacgcggtcagccgggggtctgccaaactgagatggttcgtggagcgcaaccttgtgacacccgaaggaaaggttgtcgacctgggctgcggcagagggggatggagctattactgtggcgggctcaagaatgtgaaagaggtgaagggactgaccaaaggcgggccgggacatgaagaacctatccccatgtccacatatggctggaacctggtcagactccagtctggcgttgatgtgttctttacgccccctgaaaagtgcgacacccttctgtgtgatattggggagagctcccccaatcctacagtggaggctggacgcaccctgcgggtcctcaacctggtggaaaattggcttaacaataacacacaattctgcatcaaagttctgaatccgtacatgcccagcgtgattgagaagatggaagccctccagagaaagtacggcggggctctggtccgcaaccctctgtcccggaactctacccacgagatgtattgggtgagcaatgcctccggaaacatcgtttctagcgtgaatacgatctccagaatgctcattaaccgctttaccatgcggcacaaaaaggcgacatacgaacccgacgtcgatcttggctctgggaccagaaatatcggaattgagagcgagacacctaacctggacatcattggcaaacgcatcgaaaagatcaaacaggagcatgaaacctcctggcactatgatcaggaccatccctacaagacatgggcctatcacggcagctacgagaccaagcaaacggggtctgcttccagcatggtgaatggagtggtccggctgctcacaaaaccgtgggacgttattcctatggtgacccagatggccatgaccgatacaacgcccttcggccagcagagagtgtttaaggaaaaagtcgacacccgcacacaagagcctaaggaggggaccaaaaagctgatgaagatcacagctgaatggctttggaaagagctgggaaagaaaaagacccccagaatgtgtacacgggaagagttcacccgcaaagtgagatctaacgccgctctcggcgccatttttacggatgagaataagtggaaatccgcgcgggaagccgttgaggacagcgggttctgggaactggtggataaggagagaaacctgcacctcgaaggaaagtgcgagacctgtgtctataatatgatgggcaaacgggagaagaaactgggcgaatttgggaaggctaaaggatctcgcgccatctggtacatgtggcttggcgctagattcctggagtttgaagccctcgggttcctgaacgaggaccattggttttcccgggaaaatagcctttccggagtggagggcgaggggctgcacaagctcggctacattctgcgcgatgttagcaagaaagaaggaggcgccatgtatgcggacgatacagctgggtgggacaccagaatcacactggaggatctcaagaacgaagagatggtgaccaatcatatggaaggagagcacaaaaagctggccgaggccattttcaaacttacgtaccagaacaaggtcgtgcgggttcagcgccctacacccagaggcaccgtgatggacatcatctctcggcgcgaccagagagggagcggacaagtcgtgacatatggcctgaacaccttcacgaatatggaagctcagctcattcggcagatggagggggaaggcgtctttaagtccatccaacagctgaccgtgaaagaggagattgccgttaagaactggcttatccgcgtgggaagagaacggctgtctcgcatggctattagcggcgatgactgcgtcgtgaaaccgctcgatgacagattcgcctccgcgctgacagccctgaatgatatggggaaggtgcggaaagacatccagcagtgggagccttctagaggatggaacgattggacccaagttcccttttgcagccatcacttccacgaactcatcatgaaggacggccgcgtgctggtcgtgccctgtcggaatcaggatgagcttattgggagagctcgcatctcccagggagccggctggtctctgcgggaaacagcttgcctcggaaagagctacgcccagatgtggtccctgatgtattttcatagacgcgaccttcggctggcggccaacgctatttgtagcgccgttccttctcactggatcccgacctccagaacaacctggagcattcatgctacgcacgagtggatgacaaccgaggatatgctcaccgtgtggaatcgcgtctggatccaagaaaacccctggatggaggacaaaacacctgtggaatcttgggaggaaatcccctacctgggcaagcgggaggatcagtggtgcggatccctgattggcctcaccagcagagccacatgggctaaaaatatccagacggccattaaccaggtccgctccctgatcgggaatgaggaatataccgactacatgccttctatgaagcggttcagacgggaggaagaggaagcgggagtgctttggtga

SEQ ID NO: 19595 - RNA, 9876 nt, synthetic construct
  misc_feature 1..9876: note = derived and/or modified CDS sequence (opt5) from DENV-2__KX380808__SS-prME
  source 1..9876: mol_type = other RNA
accgccggaatcattatcatgatgattcccaccgtcatggctttccacctgacgaccagaaacggggaacctcatatgatcgtcagccggcaggaaaagggaaaatccctcctgtttaagacagagaatggcgttaacatgtgcacccttatggccatggacctgggggaactctgtgaggatacaattacctacaattgcccgctgcttaaacaaaacgaacccgaggacatcgattgttggtgcaattctacaagcacctgggtgacgtatggaacctgtacagcgaccggcgagcaccgccgggaaaagcggtccgtggctctggtccctcatgtggggatgggactcgagacacgcaccgaaacgtggatgtctagcgagggcgcctggaaacacgcccagagaatcgagacatgggttctgcggcatcccggcttcaccattatggctgccatcctggcttacacaattgggaccacctattttcagcgcgtgctcatcttcattctgcttacagccatcgcgccttccatgacgatgagatgcattggaatctctaaccgggactttgtcgaaggcgtgagcgggggatcctgggttgatatcgtgctggagcacggcagctgtgtcaccacaatggccaagaataagcccaccctcgacttcgaactgattaaaacagaggctaagcaccctgccacccttcgcaaatactgcatcgaagctaagctgacgaacacaaccaccgcctctagatgtccgacacagggggagccctccctcaatgaggaacaagataaacggtttgtgtgcaagcatagcatggtggaccgcggatggggcaacggctgtgggctgttcggaaagggcgggattgtgacctgcgcgatgtttacatgcaaaaagaatatggagggaaaaatcgttcagcctgaaaacctggagtatacgattgtgatcacaccccactctggcgaagagaatgccgtggggaacgatacaggaaagcatggcaaagagatcaaggtcacccctcagtccagcattacagaagctgagctcaccggctacgggacggtgaccatggaatgttctcccagaacaggactggacttcaatgagatggttcttctgcagatggaaaacaaagcctggctcgtgcaccggcaatggtttctggatcttccgctgccttggctccccggcgctgacacccaggggtccaactggatccagaaggagacactggtcaccttcaagaatcctcacgccaaaaagcaggatgtggttgtgctgggaagccaagagggcgccatgcatacggctctcacaggggcgaccgaaattcagatgtcctctggcaacctgctttttacaggacacctgaaatgccgcctcagaatggacaagctgcagcttaaaggcatgagctattccatgtgtaccgggaagttcaaggtcgtgaaagagatcgccgaaacccaacatggaacaattgtcatccgggtgcagtacgagggcgacgggagcccctgcaagatccccttcgagattatggatctggagaagcggcacgttctcggacgcctgatcacggtgaatcctattgtcaccgagaaggactctccggtgaacatcgaagctgagcccccttttggcgattcctacattatcattggggttgaacccggccagctgaaactcagctggttcaagaagggatctagcatcggccagatgtttgagacaaccatgagaggggccaaaagaatggccatcctgggagacacagcttgggatttcggctcccttgggggagtgtttacctctattggcaaggccctgcatcaagtcttcggggcgatctatggcgctgcctttagcggagtgtcctggacgatgaaaattctcatcggcgtggttattacatggatcgggatgaatagccgctctacctccctgagcgtctctctggtgcttgtgggagtcgtgaccctctacctgggcgttatggtgcaggccgactccgggtgtgtcgtgagctggaagaacaaagagctgaagtgcggatccggcatcttcattacagataatgttcacacctggacagaacagtataagtttcagcctgagtctcccagcaaactcgcttccgccatccaaaaggctcacgaagaggggatttgtggcatccggtctgtgacgagactggaaaaccttatgtggaaacagattaccccggagctgaatcatatcctcagcgagaacgaagtcaagctgacaatcatgaccggagacattaaaggcatcatgcaggccgggaagcgctccctgcggcctcagcccacagagcttaaatacagctggaaggcgtggggaaaggccaaaatgctctctaccgaactgcacaatcatacgttcctgattgatggccctgagaccgctgaatgccccaacacaaatagagcctggaactccctcgaggtggaggactatgggtttggagttttcaccacaaatatctggctgaaacttaaagaacgccaagatgtgttttgtgacagcaagctgatgtctgctgccattaaagacaaccgggcggtccacgccgatatgggctactggatcgagtccgctctcaacgacacctggaagatcgaaaaggccagcttcattgagatcaaatcttgccactggcctaagagccatacactgtggtccaatggcgtgctggagagcgaaatgattatccccaaaaacttcgctgggccggtgtctcagcacaattatagacctggataccatacccagacggccggcccctggcaccttgggcgcctcgagatggattttgacttctgtgaaggaacaaccgtcgttgtgaccgaggattgcggcaaccgggggccctccctgagaacaaccacggccagcggaaagctgattacagaatggtgctgtcggtcctgcaccctccctccgctgcgctacagaggcgaggacggctgttggtatgggatggagatccggccccttaaagaaaaggaggaaaatctggtgaactctctcgtcacagctggacatggccagattgataattttagcctgggggtgctgggaatggcgcttttcctcgaggaaatgctgagaacccgcgttggcacaaagcacgccatcctgctcgtggctgtctcctttgtgaccctgatcacggggaacatgtctttccgggaccttggaagagttatggtgatggtcggcgccaccatgacagatgacattggcatgggggtgacctacctggccctcctggctgcctttaaagttcgccctacattcgcggctggactgcttctgagaaagctcaccagcaaagagctgatgatgacgacaatcggcattgtgctcctgtcccaatctaccatccccgagacaattcttgaactgaccgatgccctcgccctggggatgatggtcctgaagatcgtgcggaatatggagaaatatcagcttgctgtgaccatcatggccattctgtgcgtccctaacgcggttatcctccagaatgcttggaaggtgagctgtacaacgctggccgtggtctccgtgagccccctcctgcttacctcttcccaacagaaggccgactggattcctctggctctcacaatcaaaggactgaaccccaccgccatttttctgacaacccttagccgcacgtctaagaaaagatcctggccgctgaatgaagctatcatggccgttggcatggtgagcatcctcgcgtcttccctgctcaagaacgatattcctatgacagggcccctggtcgccggaggccttctgaccgtgtgctacgttctgaccggccggagcgctgacctcgagctggaacgcgccgctgacgtgagatgggaggagcaggccgaaatctccgggagctctcctattcttagcatcacaatttccgaggatggatctatgagcatcaaaaatgaagaggaggaacagaccctgacaattctcatccggacgggcctgctcgtcatctccgggctgttccccgtgtctattccgatcaccgccgctgcgtggtatctttgggaggtcaagaaacaacgcgccggagtgctgtgggacgttccttctccccctcccgtgggcaaggctgaactggaggatggggcctacagaattaagcagaaaggaatcctcggctattcccagattggcgccggggtctacaaggaaggaacatttcacaccatgtggcatgtgacacggggcgctgttctgatgcacaaagggaagcgcatcgagccctcctgggccgacgtgaaaaaggatcttatcagctacggaggcgggtggaagctggagggagaatggaaagagggcgaagaggtccaggtgctcgcgctggaacctggcaagaacccgagagctgtgcaaaccaaacccggactcttcaagacgaacaccggaacaattggcgccgtttccctggactttagccctgggacctctggatcccccatcgtcgataaaaagggcaaggtggtggggctttatggaaatggcgtcgtgacacggagcggcacctacgtttctgccattgctcagacagagaaatccatcgaggacaaccctgaaattgaggatgacatcttcagaaagaaacgcctgacgatcatggatctgcatcccggggccggaaagaccaaacggtatctccctgcgattgtgagagaagctatcaagcgcggcctgcggacacttattctggccccgaccagagtcgtggccgctgagatggaagaggccctccgcgggctgcccatccggtaccagacccctgctattagagccgagcacacaggacgcgaaatcgttgacctcatgtgtcatgcgacgttcaccatgcggctgcttagccccattagagtgcctaattataacctgatcatcatggatgaggcccactttacagaccccgcttccattgccgctcggggctacatctctacccgcgtcgaaatgggggaggccgccggcattttcatgacagctaccccgcctggaagcagagacccctttccccagtccaatgcgcctatcatggatgaggaacgggagattcccgaacgcagctggaactctggccacgagtgggtgacggacttcaaggggaaaacagtttggtttgtgccttccatcaaggccggaaatgatatcgctgcctgcctgcgcaaaaacggcaagaaagtcattcaactcagccggaagaccttcgacaccgaatatatcaagacaagaaccaatgattgggactttgtggtgacaaccgatatttctgagatgggggccaacttcaaagctgagcgcgtcatcgacccgcggagatgtatgaagcccgttattctgacggatggagaagaaagagtgatccttgccggccctatgcccgtgacacatagctccgcggctcagcggagagggcgcgtcggccggaatcctaaaaacgaaaatgaccagtacatctacatgggagagcccctggaaaacgatgaggactgcgcccactggaaggaggccaaaatgctcctggacaatattaacaccccggaaggcatcattccttctatgtttgagcccgaaagagagaaggtggatgctatcgacggggaatatcgcctgagaggagaggcccggaaaacattcgttgatctcatgcgcagaggcgaccttcctgtgtggctggcgtaccgggtcgccgctgaggggattaactatgccgatcgcagatggtgttttgacggagtgaagaataaccaaatcctggaagagaatgttgaagtggagatttggaccaaggagggcgaacggaaaaagctcaaacccagatggctggatgctcgcatctacagcgaccctcttgccctgaaggagttcaaagagttcgctgccgggcggaagtccctcacgctgaacctgatcaccgagatgggcagactccccacatttatgacccagaaggcgcgcaatgcccttgataacctggctgtcctgcatacagccgaagctggaggccgggcctataatcacgccctctctgagctgccggagacccttgaaacactgctcctgctgaccctccttgctacggtgacagggggaattttcctgtttctgatgagcggcaaagggatcggaaagatgaccctcggcatgtgctgcattatcaccgcgtccattctgctttggtacgcccagatccagcctcactggatcgctgccagcattatcctggagttctttctcattgtcctgctgatccccgaacccgagaaacaaagaacacctcaggacaaccagctcacctatgtggttattgccatccttacagtggtggctgccacgatggcgaatgaaatgggcttcctggagaagaccaaaaaggattttgggctgggatctatcacaacccagcaaccggagtccaacattctcgacatcgatctgcggcccgccagcgcttggacactttacgccgtcgctaccacgttcattacccctatgctgcgccattccatcgaaaattctagcgttaacgtgtccctcacagccattgcgaatcaggccaccgtgctgatgggcctggggaagggatggcccctctctaaaatggacatcggcgtccctcttctggctattgggtgttacagccaggtgaaccccatcacactgaccgccgctctcctgcttctggttacgcactatgccatcattggacctggcctccaggctaaggccacaagagaggcgcaaaaacgggccgctgccggcatcatgaagattccgaccgtggacgggatcacagtcattgatctggaccccatcccttacgatcccaaatttgaaaagcagctgggacaggtgatgctccttgtcctgtgcgtgacccaggttctgatgatgcgcaccacatgggctctctgtgaggccctgacgcttgccaccggccctatctccacactgtgggaagggaatcccggaagattctggaacaccacaattgcggtgagcatggctaatatctttcggggctcttatctcgccggggctggactgctgttctccattatgaagaacaccgccaacacgcgcagaggcacaggcaataccggggagaccctcggagagaaatggaagaaccggcttaatgccctgggcaaaagcgaatttcaaatctacaagaaatctgggattcaggaggtcgaccgcacactggctaaggaaggaatcaaaagaggcgagaccgatcatcacgccgtgtcccgggggagcgcgaagctcagatggttcgttgagcgcaacctggtgacaccggaaggaaaggtcgtggaccttggctgcggcagaggcgggtggtcttattactgtggagggctgaaaaatgtgaaggaggttaaagggctcacgaagggcgggcctggacatgaagaacccatccccatgagcacctatggctggaacctggtcagactgcagtccggcgtggatgtgttctttacacctcccgaaaaatgcgacaccctcctttgtgatattggggagtctagccctaatccgacagtcgaggccggacgcaccctgcgggttctgaacctcgtggaaaattggctgaacaataacacgcaattctgcatcaaggtgcttaatccctacatgccttccgtcattgagaagatggaagctctgcagagaaaatacggcggggccctcgtgcgcaaccccctgagccggaatagcacccacgagatgtattgggtttctaacgctagcggaaacatcgtgtcctctgtcaatatgattagcagaatgctgatcaaccgctttacaatgcggcacaagaaagccacctacgaacctgacgtggatctcggctccgggacaagaaatatcggaattgagtctgagacccccaaccttgacatcattggcaagcgcatcgagaaaattaagcaggagcatgaaacaagctggcactatgatcaggaccatccgtacaagacctgggcgtatcacggctcctacgagacgaaacaaacagggagcgcctcttccatggttaatggagtggtccggctgctgaccaagccttgggacgtgatccccatggtgacccagatggctatgacagatacgacccctttcggccagcagagagtctttaaagaaaaggttgacacacgcacccaagagcccaaagaggggacaaagaagctcatgaaaattaccgccgaatggctgtggaaggagcttggcaaaaagaaaacacctagaatgtgtacccgggaagagttcacgcgcaaggtgagaagcaacgctgccctgggcgctatctttaccgatgagaataaatggaagtctgcccgggaagcggtggaggactccgggttctgggaactcgtcgataaggagagaaacctgcacctggaaggaaaatgcgagacatgtgtgtataatatgatgggcaagcgggagaaaaagctcggcgaatttgggaaagccaagggaagccgcgctatctggtacatgtggctgggcgccagattccttgagtttgaagctctggggttcctcaacgaggaccattggttttctcgggaaaattccctgagcggagttgagggcgaggggcttcacaagctgggctacattctccgcgatgtgtccaaaaaggaaggaggcgccatgtatgccgacgataccgcggggtgggacacaagaatcaccctggaggatctgaaaaacgaagagatggtcacgaatcatatggaaggagagcacaagaaactcgctgaggccattttccggctgacataccagaacaaggtggttcgcgtgcagagacccaccccgcggggcacagtcatggacatcattagccgcagagaccagcgggggtctggacaagtggttacctatggccttaatacgttcaccaacatggaagcccagctgatccgccagatggagggggaaggcctctttaagagcatccaacatctgacagtgaccgaggagattgctgtcaaaaactggcttgtgagagtcggacgggaacgcctgtccagaatggccatctctggcgatgactgcgtggttaagcctctcgatgaccggttcgctagcgccctgacagcgctgaatgatatggggaaagtgagaaaggacattcagcagtgggagccctcccgcggatggaacgattggacccaggtccccttttgctctcaccacttccatgaactcatcatgaaagacggccgggtgctggtggttccttgtagaaatcaagatgagcttattgggcgcgcccggatcagccagggagctggctggtccctgagagaaacagcctgcctcgggaagtcttacgctcagatgtggagcctgatgtattttcaccgccgggaccttagactggccgcgaacgccatctgttccgctgtgccgagccattgggtccccacctctcgcacgacatggtccattcacgccacccacgagtggatgaccacagaggatatgctcaccgtgtggaatcgggtttggatccaggaaaacccttggatggaggacaagacacccgtggaaagctgggaggaaattccttacctgggcaaaagagaggatcaatggtgcggatctctgatcggcctcacgtcccgcgctacctgggccaagaatattcagacagctatcaaccaggtccggagcctgattgggaatgaggaatataccgactacatgccctccatgaaaagattccggagagaggaagaggaagccggagtgctttggtga

SEQ ID NO: 19596 - RNA, 9876 nt, synthetic construct
  misc_feature 1..9876: note = derived and/or modified CDS sequence (opt5) from DENV-2__KX380832__SS-prME
  source 1..9876: mol_type = other RNA
accgccggaatcattatcatgatgattcccaccgtgatggctttccacctgacgaccagaaacggggaacctcatatgatcgtgagccggcaggaaaaggggaaaagcctcctgtttaagacagagaatggagttaacatgtgcacccttatggccatggacctgggggaactctgtgaggatacaattacctacaattgcccgctgcttcgccaaaacgaacccgaggacatcgattgttggtgcaattctacaagcacctgggtgacgtatggaacctgtacagcgaccggcgagcacagacgggaaaaacgctccgtggctctggtccctcatgtggggatgggactcgagacaagaaccgaaacgtggatgtctagcgagggcgcctggaagcacgcccagcggatcgagacatgggttctgcgccatcccggcttcaccgtgatggctgccattctggcttacacaatcgggaccacctattttcagagagtcctcattttcatcctgcttacagccgtggcgccttccatgacgatgcggtgcattggaatctctaaccgcgactttgttgaaggcgtgagcgggggatcctgggtcgatattgtgctggagcacggcagctgtgtgaccacaatggccaaaaataagcccaccctcgacttcgaactgatcaagacagaggctaaacaccctgccacccttagaaagtactgcatcgaagctaaactgacgaacacaaccaccgcctctcggtgtccgacacagggggagccctccctcaatgaggaacaagataagcgctttgtctgcaaacatagcatggttgacagaggatggggcaacggctgtgggctgttcggaaagggcgggattgtgacctgcgcgatgtttacatgcaagaaaaatatggagggaaagatcgtgcagcctgaaaacctggagtatacgattgtcatcacaccccactctggcgaagagaatgccgtggggaacgatacaggaaaacatggcaaggagattaaagttacccctcagtccagcatcacagaagctgagctcaccggctacgggacggccaccatggaatgttctccccggacaggactggacttcaatgagatggtgcttctgcagatggaaaacaaggcttggctcgtccaccgccaatggtttctggatcttccgctgccttggctccccggcgccgacacccaggggtccaactggatccagaaagagacactggtgaccttcaagaatcctcacgccaagaaacaggatgttgtggtcctgggaagccaagagggcgctatgcatacggcgctcacaggggccaccgaaattcagatgtcctctggcaacctgctttttacaggacacctgaagtgcagactccggatggacaaactgcagcttaagggcatgagctattccatgtgtaccgggaaattcaaggtggtcaaggagatcgctgaaacccaacatggaacaattgtgatcagagttcagtacgagggcgacgggagcccctgcaaaattcccttcgagatcatggatctggaaaagcgccacgtgctcggacggctgatcacggtcaatcctattgtgaccgagaaagactctccggttaacatcgaagccgagcccccttttggcgattcctacattatcattggggtggaacccggccagctgaagctcagctggttcaaaaagggatctagcatcggccagatgtttgagacaaccatgagaggggccaagcgcatggctattctgggagacacagcctgggatttcggctcccttgggggagtctttacctctatcggcaaagcgctgcatcaagtgttcggggctatctatggcgccgcctttagcggagtgtcctggacgatgaagattctcatcggcgttgtcattacatggatcgggatgaatagccggtctacctccctgagcgtgtctctggtgcttgtcggaattgtgaccctctacctgggcgttatggtgcaggctgactccgggtgtgtcgtgagctggaaaaacaaggagctgaaatgcggatccggcatcttcatcacagataatgttcacacctggacagaacagtataagtttcagcctgagtctcccagcaagctcgcctccgctattcaaaaagcccacgaagaggggatctgtggcattagatctgtgacgcgcctggaaaaccttatgtggaagcagatcaccccggagctgaatcatattctcagcgagaacgaagtcaaactgacaatcatgaccggagacatcaagggcattatgcaggcggggaaacggtccctgagacctcagcccacagagcttaagtacagctggaaagcctggggaaaggctaagatgctctctaccgaactgcacaatcatacgttcctgatcgatggccctgagaccgccgaatgccccaacacaaatcgcgcttggaactccctcgaggtggaggactatgggtttggagttttcaccacaaatatttggctgaaacttaaggaacggcaagatgtgttttgtgacagcaaactgatgtctgccgcgatcaaggacaacagagccgtccacgctgatatgggctactggattgagtccgccctcaacgacacctggaaaatcgaaaaggctagcttcatcgaggtgaagtcttgccactggcctaaaagccatacactgtggtccaatggcgtgctggagagcgaaatgattatccccaagaacttcgccgggccggtctctcagcacaattatcgccctggataccatacccagacggccggcccctggcaccttgggcggctcgagatggattttgacttctgtgaaggaacaaccgttgtggtgaccgaggattgcggcaacagagggccctccctgcggacaaccacggctagcggaaaactgattacagaatggtgctgtcgctcctgcaccctccctccgctgagataccggggcgaggacggctgttggtatgggatggagatcagaccccttaaggaaaaagaggaaaatctggtcaactctctcgtgacagcgggacatggccagattgataattttagcctgggggttctgggaatggcccttttcctcgaggaaatgctgcgcacccgggtgggcacaaagcacgctatcctgctcgtcgccgtgtcctttgttaccctgattacggggaacatgtctttcagagaccttggacgcgtgatggtcatggtgggcgccaccatgacagatgacatcggcatgggggttacctacctggctctcctggccgcgtttaaggtgagacctacattcgctgccggactgcttctgcggaaactcaccagcaaggagctgatgatgacgacaatcggcattgtcctcctgtcccaatctaccatccccgagacaattcttgaactgaccgatgccctcgctctggggatgatggtgctgaaaatcgtgcgcaatatggagaagtatcagcttgccgtcaccattatgacaatcctgtgcgttcctaacgcggtgatcctccagaatgcttggaaagtgagctgtacgattctggccgtcgtgtccgttagccccctcctgcttacctcttcccaacagaaggccgactggatccctctggctctcacaattaagggactgaaccccaccgccatctttctgacaacccttagcagaacgtctaaaaagcggtcctggccgctgaatgaagctattatggccgtgggcatggtcagcatcctcgcgtcttccctgctcaaaaacgatatccctatgacagggcccctggtggccggaggccttctgaccgtttgctacgtgctgaccggccgcagcgctgacctcgagctggaaagagccgctgacgtccggtgggaggagcaggccgaaatttccgggagctctcctatccttagcattacaatctccgaggatggatctatgagcattaagaatgaagaggaggaacagaccctgacaatcctcattcgcacgggcctgctcgtgatctccgggctgttccccgtctctatcccgattaccgccgctgcgtggtatctttgggaggtgaaaaagcaaagagccggagttctgtgggacgtgccttctccccctcccgtcggcaaagctgaactggaggatggggcctaccggatcaagcagaagggcattctcggctattcccagatcggcgccggggtgtacaaagaaggaacatttcacaccatgtggcatgttacacgcggcgctgtgctgatgcacaaggggaaaagaattgagccctcctgggccgacgtcaagaaagatcttatcagctacggaggcgggtggaagctggagggagaatggaaggagggcgaagaggtccaggtgctcgcgctggaacctggcaaaaacccgcgggctgttcaaaccaagcccggactcttcaaaacgaacaccggaacaatcggcgccgtctccctggactttagccctgggacctctggatcccccattgtggataagaaaggcaaggtggtcgggctttatggaaatggcgtggttacaagaagcggcacctacgtgtctgccatcgctcagacagagaagtccattgaggacaaccctgaaatcgaggatgacattttccgcaaaaagcggctgacgatcatggatctgcatcccggggccggaaaaaccaagagatatctccctgcgatcgtccgcgaagctattaaacggggcctgagaacacttatcctggccccgacccgcgtggttgccgctgagatggaagaggccctccgggggctgcccattagataccagacccctgctatccgcgccgagcacacaggacgggaaattgtggacctcatgtgtcatgcgacgttcaccatgagactgcttagccccatccgggtccctaattataacctgattatcatggatgaggcccactttacagaccccgcttccatcgccgctcgcggctacatttctaccagagtggaaatgggggaggccgccggcatcttcatgacagctaccccgcctggaagccgggacccctttccccagtccaatgcgcctattatggatgaggaacgcgagatccccgaaagaagctggaactctggccacgagtgggttacggacttcaaggggaagacagtgtggtttgtcccttccattaaagccggaaatgatatcaccgcttgcctgcggaagaacggcaaaaaggtgatccaactcagcagaaaaaccttcgactctgaatatattaagacacgcaccaatgattgggactttgtggtcacaaccgatatcagcgagatgggggccaacttcaaggccgagcgggttattgacccgagacgctgtatgaaacccgtgatcctgacggatggagaagaacgggtgattcttgctggccctatgcccgtcacacattcctctgccgcgcagagacgcgggcgggtgggcagaaatcctaagaacgaaaatgaccagtacatctacatgggagagcccctggaaaacgatgaggactgcgctcactggaaagaggccaagatgctcctggacaatatcaacaccccggaaggcattatccctagcatgtttgagcccgaacgcgagaaagttgatgccattgacggggaatatagactgcggggagaggctcgcaagacattcgtggatctcatgagacggggcgaccttcctgtctggctggcctaccgcgtggcggccgaggggatcaactatgctgatagacggtggtgttttgacggagttaaaaataaccaaattctggaagagaatgtggaagtcgagatctggaccaaggagggcgaaagaaagaaactcaagccccgctggctggatgcccggatttactccgaccctcttgctctgaaagagttcaaggagttcgccgctgggagaaaatctctcacgctgaacctgatcaccgagatgggccgcctccccacatttatgacccagaaggcccggaatgcgcttgataacctggccgtgctgcatacagctgaagccggaggcagagcttataatcacgccctcagcgagctgccggagacccttgaaacactgctcctgctgaccctccttgccacggtcacagggggaatcttcctgtttctgatgtccggcaaggggattggaaaaatgaccctcggcatgtgctgcatcattaccgctagcatcctgctttggtacgcgcagattcagcctcactggatcgccgcttctatcattctggagttctttctcatcgtgctgctgattcccgaacccgagaagcaacggacacctcaggacaaccagctcacctatgttgtgatcgccattcttacagtggtcgccgctacgatggccaatgaaatgggcttcctggagaaaaccaagaaagattttgggctgggatccatcacaacccagcaaccggacagcaacatcctcgatattgacctgcgccccgcgtccgcctggacactttacgctgttgccaccacgttcatcacccctatgctgagacattctattgagaatagctccgtgaacgtgtctctcacagctatcgccaatcaggcgaccgtcctgatgggcctggggaagggatggcccctcagcaagatggacattggcgtgcctcttctggccatcgggtgttactcccaggttaaccccattacactgaccgctgccctcctgcttctggtggctcactatgccatcatcggacctggcctccaggctaaagccacgcgggaagcgcaaaagcgcgccgctgccggcattatgaaaatcccggctgccgatgggattacagtcatcgacctggatcccattccttacgaccccaagtttgagaaacagctgggacaggtgatgctccttgtcctgtgcgtgacccaggttctgatgatgagaacaacctgggccctctgtgaagcgctgacccttgctacaggccctatcagcacgctgtgggaggggaatcccggacggttctggaacaccacaatcgccgtgtctatggctaatatttttcgcggctcctatctcgccggggccggactgctgttcagcatcatgaagaacaccgctaacacaagacggggcaccggcaatacgggggaaacactcggagagaagtggaaaaaccgccttaatgccctgggcaagtctgagtttcaaatttacaaaaagtccgggatccaggaagtcgatagaaccctggcgaaagagggaattaagcggggcgaaaccgaccatcacgccgtgagcagagggtctgctaaactccgctggttcgttgagcggaacctggtgacaccggagggaaaggtcgtggatcttggctgcggcagagggggatggagctattactgtggcgggctgaagaatgtgaaagaagttaagggactcaccaaaggcgggcctggacatgaggaacccatccccatgtccacatatggctggaacctggtccgcctgcagtctggcgtggacgtgttctttacgcctcccgagaagtgcgataccctcctttgtgacatcggggaaagctcccctaatccgacagtcgaggccggacggaccctgagagttctgaacctcgtggagaattggctgaacaataacacacaattctgcattaaagtgcttaatccctacatgcctagcgtcatcgaaaagatggaggctctgcagcgcaagtacggcggggccctcgtgcggaaccccctgtccagaaattctacccacgaaatgtattgggttagcaacgcgtccggaaacattgtgtctagcgtcaatatgatctcccgcatgctgattaaccggtttacgatgaaacacaagaaagccacctacgagcctgatgtggacctcggctctgggacaagaaatatcggaatcgaaagcgagacccccaaccttgatattatcggcaagcgcattgagaaaatcaagcaggaacatgagacatcctggcactatgaccaggaccatccgtacaagacctgggcttatcacggcagctacgaaacaaaacaaaccgggtctgcctccagcatggttaatggagtggtccggctgctgacgaagccttgggatgtgattcccatggtgacacagatggctatgaccgacaccacacctttcggccagcagagagtctttaaagagaaggttgatacgcgcacccaagaacccaaagaggggacaaagaagctcatgaaaatcaccgccgagtggctgtggaaggaacttggcaaaaagaaaacacctagaatgtgtacccgggaggagttcacacgcaaggtgagatctaacgctgccctgggcgcgatttttaccgacgagaataaatggaagtccgcccgggaggctgtggaagatagcgggttctgggagctcgtcgacaaggaaagaaacctgcacctggagggaaaatgcgaaacgtgtgtgtataatatgatgggcaagcgggagaaaaagctcggcgagtttgggaaagccaagggatctcgcgctatctggtacatgtggctgggcgccagattccttgaatttgaggccctggggttcctcaacgaagatcattggttttcccgggagaatagcctgtccggagttgaaggcgaggggcttcacaagctgggctacatcctccgcgacgtgagcaaaaaggagggaggcgcgatgtatgctgatgacaccgccgggtgggatacaagaattaccctggaagacctgaaaaacgaggaaatggtcacaaatcatatggagggagaacaccggaagctcgccgaggctatcttccgcctgacctaccagaacaaagtggttagagtgcagcggcccacgccgcgcggcacagtcatggacattatctctagacgggatcagcgcgggagcggacaagtggttacctatggccttaatacattcaccaacatggaggcccagctgattagacagatggaaggggagggcgtgtttaagtccatccaacatctcacggtcaccgaagagatcgctgtgaagaactggctggagcgggtcggacgcgaaagactttctcggatggccattagcggcgacgattgcgtggttaaacctctggacgatagattcgcgtccgccctcacagctctgaatgacatggggaaggtgcgcaaagatatccagcagtgggagccctctcggggatggaacgactggacccaggtccccttttgcagccaccacttccatgaactgattatgaaggatggcagagtgctcgtggttccttgtcgcaatcaagacgagctgatcgggcgggccagaatttcccagggagctggctggtctcttcgcgaaacagcctgcctggggaaaagctacgcgcagatgtggtccctcatgtattttcaccggagagatctgcgccttgccgctaacgccatctgtagcgctgtgccgtctcattgggtccccacctcccggacaacctggagcatccacgccacgcacgagtggatgacaaccgaggacatgctgaccgtgtggaatagagtttggattcaggaaaacccttggatggaggataagacacccgtggaatcttgggaggaaatcccttacctcggcaagcgcgaggaccaatggtgcggatccctgattggcctgaccagccgggctacatgggccaaaaatatccagacggcgattaaccaggtcagatccctcatcgggaatgaggaatataccgactacatgccctctatgaagcggttcagacgcgaggaagaggaagccggagtgctgtggtga

SEQ ID NO: 19597 - RNA, 9876 nt, synthetic construct
  misc_feature 1..9876: note = derived and/or modified CDS sequence (opt5) from DENV-2__KX380833__SS-prME
  source 1..9876: mol_type = other RNA
accgccggaatcattatcatgatgattcccaccgtgatggctttccacctgacgaccagaaacggggaacctcatatgatcgtgagccggcaggaaaaggggaaaagcctcctgtttaagacagagaatggagttaacatgtgcacccttatggccatggacctgggggaactctgtgaggatacaattacctacaattgcccgctgcttcgccaaaacgaacccgaggacatcgattgttggtgcaattctacaagcacctgggtgacgtatggaacctgtacagcgaccggcgagcacagacgggaaaaacgctccgtggctctggtccctcatgtggggatgggactcgagacaagaaccgaaacgtggatgtctagcgagggcgcctggaagcacgcccagcggatcgagacatgggttctgcgccatcccggcttcaccgtgatggctgccattctggcttacacaatcgggaccacctattttcagagagtcctcattttcatcctgcttacagccgtggcgccttccatgacgatgcggtgcattggaatctctaaccgcgactttgttgaaggcgtgagcgggggatcctgggtcgatattgtgctggagcacggcagctgtgtgaccacaatggccaaaaataagcccaccctcgacttcgaactgatcaagacagaggctaaacaccctgccacccttagaaagtactgcatcgaagctaaactgacgaacacaaccaccgcctctcggtgtccgacacagggggagccctccctcaatgaggaacaagataagcgctttgtctgcaaacatagcatggttgacagaggatggggcaacggctgtgggctgttcggaaagggcgggattgtgacctgcgcgatgtttacatgcaagaaaaatatggagggaaagatcgtgcagcctgaaaacctggagtatacgattgtcatcacaccccactctggcgaagagaatgccgtggggaacgatacaggaaaacatggcaaggagattaaagttacccctcagtccagcatcacagaagctgagctcaccggctacgggacggccaccatggaatgttctccccggacaggactggacttcaatgagatggtgcttctgcagatggaaaacaaggcttggctcgtccaccgccaatggtttctggatcttccgctgccttggctccccggcgccgacacccaggggtccaactggatccagaaagagacactggtgaccttcaagaatcctcacgccaagaaacaggatgttgtggtcctgggaagccaagagggcgctatgcatacggcgctcacaggggccaccgaaattcagatgtcctctggcaacctgctttttacaggacacctgaagtgcagactccggatggacaaactgcagcttaagggcatgagctattccatgtgtaccgggaaattcaaggtggtcaaggagatcgctgaaacccaacatggaacaattgtgatcagagttcagtacgagggcgacgggagcccctgcaaaattcccttcgagatcatggatctggaaaagcgccacgtgctcggacggctgatcacggtcaatcctattgtgaccgagaaagactctccggttaacatcgaagccgagcccccttttggcgattcctacattatcattggggtggaacccggccagctgaagctcagctggttcaaaaagggatctagcatcggccagatgtttgagacaaccatgagaggggccaagcgcatggctattctgggagacacagcctgggatttcggctcccttgggggagtctttacctctatcggcaaagcgctgcatcaagtgttcggggctatctatggcgccgcctttagcggagtgtcctggacgatgaagattctcatcggcgttgtcattacatggatcgggatgaatagccggtctacctccctgagcgtgtctctggtgcttgtcggaattgtgaccctctacctgggcgttatggtgcaggctgactccgggtgtgtcgtgagctggaaaaacaaggagctgaaatgcggatccggcatcttcatcacagataatgttcacacctggacagaacagtataagtttcagcctgagtctcccagcaagctcgcctccgctattcaaaaagcccacgaagaggggatctgtggcattagatctgtgacgcgcctggaaaaccttatgtggaagcagatcaccccggagctgaatcatattctcagcgagaacgaagtcaaactgacaatcatgaccggagacatcaagggcattatgcaggcggggaaacggtccctgagacctcagcccacagagcttaagtacagctggaaagcctggggaaaggctaagatgctctctaccgaactgcacaatcatacgttcctgatcgatggccctgagaccgccgaatgccccaacacaaatcgcgcttggaactccctcgaggtggaggactatgggtttggagttttcaccacaaatatttggctgaaacttaaggaacggcaagatgtgttttgtgacagcaaactgatgtctgccgcgatcaaggacaacagagccgtccacgctgatatgggctactggattgagtccgccctcaacgacacctggaaaatcgaaaaggctagcttcatcgaggtgaagtcttgccactggcctaaaagccatacactgtggtccaatggcgtgctggagagcgaaatgattatccccaagaacttcgccgggccggtctctcagcacaattatcgccctggataccatacccagacggccggcccctggcaccttgggcggctcgagatggattttgacttctgtgaaggaacaaccgttgtggtgaccgaggattgcggcaacagagggccctccctgcggacaaccacggctagcggaaaactgattacagaatggtgctgtcgctcctgcaccctccctccgctgagataccggggcgaggacggctgttggtatgggatggagatcagaccccttaaggaaaaagaggaaaatctggtcaactctctcgtgacagcgggacatggccagattgataattttagcctgggggttctgggaatggcccttttcctcgaggaaatgctgcgcacccgggtgggcacaaagcacgctatcctgctcgtcgccgtgtcctttgttaccctgattacggggaacatgtctttcagagaccttggacgcgtgatggtcatggtgggcgccaccatgacagatgacatcggcatgggggttacctacctggctctcctggccgcgtttaaggtgagacctacattcgctgccggactgcttctgcggaaactcaccagcaaggagctgatgatgacgacaatcggcattgtcctcctgtcccaatctaccatccccgagacaattcttgaactgaccgatgccctcgctctggggatgatggtgctgaaaatcgtgcgcaatatggagaagtatcagcttgccgtcaccattatggcgatcctgtgcgttcctaacgctgtgatcctccagaatgcctggaaagtgagctgtacaattctggccgtcgtgtccgttagccccctcctgcttacgtcttcccaacagaaggctgactggatccctctggccctcaccattaagggactgaaccccacagctatctttctgaccacacttagcagaacctctaaaaagcggtcctggccgctgaatgaagccattatggcggtgggcatggtcagcatcctcgcctcttccctgctcaaaaacgatatccctatgacggggcccctggtggctggaggccttctgacagtttgctacgtgctgaccggccgcagcgccgacctcgagctggaaagagctgccgacgtccggtgggaggagcaggccgaaatttccgggagctctcctatccttagcattaccatctccgaggatggatctatgagcattaagaatgaagaggaggaacagacactgaccatcctcattcgcacaggcctgctcgtgatctccgggctgttccccgtctctatcccgattacggctgcggcctggtatctttgggaggtgaaaaagcaaagagctggagttctgtgggacgtgccttctccccctcccgtcggcaaagccgaactggaggatggggcctaccggatcaagcagaagggcattctcggctattcccagatcggcgctggggtgtacaaagaaggaacctttcacacaatgtggcatgttacccgcggcgccgtgctgatgcacaaggggaaaagaattgagccctcctgggcggacgtcaagaaagatcttatcagctacggaggcgggtggaagctggagggagaatggaaggagggcgaagaggtccaggtgctcgctctggaacctggcaaaaacccgcgggccgttcaaacaaagcccggactcttcaaaaccaacacgggaaccatcggcgccgtctccctggactttagccctgggacatctggatcccccattgtggataagaaaggcaaggtggtcgggctttatggaaatggcgtggttaccagaagcggcacatacgtgtctgctatcgcccagaccgagaagtccattgaggacaaccctgaaatcgaggatgacattttccgcaaaaagcggctgacaatcatggatctgcatcccggggcgggaaaaacgaagagatatctccctgctatcgtccgcgaagccattaaacggggcctgagaacccttatcctggccccgacacgcgtggttgctgccgagatggaagaggctctccgggggctgcccattagataccagacccctgccatccgcgcggagcacaccggacgggaaattgtggacctcatgtgtcatgccacattcacgatgagactgcttagccccatccgggtccctaattataacctgattatcatggatgaggctcactttaccgaccccgcctccatcgctgcccgcggctacatttctacaagagtggaaatgggggaggccgctggcatcttcatgaccgcgacaccgcctggaagccgggacccctttccccagtccaatgcccctattatggatgaggaacgcgagatccccgaaagaagctggaactctggccacgagtgggttaccgacttcaaggggaagacggtgtggtttgtcccttccattaaagctggaaatgatatcgccgcctgcctgcggaagaacggcaaaaaggtgatccaactcagcagaaaaacattcgactctgaatatattaagacccgcaccaatgattgggactttgtggtcacaaccgatatcagcgagatgggggctaacttcaaggccgagcgggttattgacccgagacgctgtatgaaacccgtgatcctgacagatggagaagaacgggtgattcttgcgggccctatgcccgtcacccattcctctgctgcccagagacgcgggcgggtgggcagaaatcctaagaacgaaaatgaccagtacatctacatgggagagcccctggaaaacgatgaggactgcgcccactggaaagaggctaagatgctcctggacaatatcaacacgccggaaggcattatccctagcatgtttgagcccgaacgcgagaaagttgatgccattgacggggaatatagactgcggggagaggcgcgcaagacattcgtggatctcatgagacggggcgaccttcctgtctggctggcctaccgcgtggctgccgaggggatcaactatgctgatagacggtggtgttttgacggagttaaaaataaccaaattctggaagagaatgtggaagtcgagatctggaccaaggagggcgaaagaaagaaactcaagccccgctggctggatgcccggatttactccgaccctcttgctctgaaagagttcaaggagttcgccgcggggagaaaatctctcacactgaacctgatcaccgagatgggccgcctccccacgtttatgacccagaaggcccggaatgctcttgataacctggccgtgctgcatacagctgaagccggaggcagagcctataatcacgctctcagcgagctgccggagacccttgaaacactgctcctgctgaccctccttgcgacagtcaccgggggaatcttcctgtttctgatgtccggcaaggggattggaaaaatgacgctcggcatgtgctgcatcattacagccagcatcctgctttggtacgctcagattcagcctcactggatcgccgcctctatcattctggagttctttctcatcgtgctgctgattcccgaacccgagaagcaacggacccctcaggacaaccagctcacctatgttgtgatcgctattcttacagtggtcgccgcgaccatggccaatgaaatgggcttcctggagaaaacaaagaaagattttgggctgggatccatcacgacccagcaaccggacagcaacatcctcgatattgacctgcgccccgcttccgcctggacactttacgctgttgccaccacattcatcacccctatgctgagacattctattgagaatagctccgtgaacgtgtctctcacggcgatcgccaatcaggctaccgtcctgatgggcctggggaagggatggcccctcagcaagatggacattggcgtgcctcttctggccatcgggtgttactcccaggttaaccccattacactgaccgctgccctcctgcttctggtggctcactatgccatcatcggacctggcctccaggcgaaagccacacgggaagctcaaaagcgcgccgctgccggcattatgaaaatcccggccgcggatgggattaccgtcatcgacctggatcccattccttacgaccccaagtttgagaaacagctgggacaggtgatgctccttgtcctgtgcgtgacgcaggttctgatgatgagaacaacctgggctctctgtgaagccctgacacttgctaccggccctatcagcaccctgtgggaggggaatcccggacggttctggaacacaacgatcgccgtgtctatggccaatatttttcgcggctcctatctcgctggggccggactgctgttcagcatcatgaagaacaccgcgaacacaagacggggcaccggcaatacaggggaaaccctcggagagaagtggaaaaaccgccttaatgccctgggcaagtctgagtttcaaatttacaaaaagtccgggatccaggaagtcgatagaacgctggctaaagagggaattaagcggggcgaaacagaccatcacgccgtgagcagagggtctgctaaactccgctggttcgttgagcggaacctggtgaccccggagggaaaggtcgtggatcttggctgcggcagagggggatggagctattactgtggcgggctgaagaatgtgaaagaagttaagggactcaccaaaggcgggcctggacatgaggaacccatccccatgtccacatatggctggaacctggtccgcctgcagtctggcgtggacgtgttctttacccctcccgagaagtgcgatacactcctttgtgacatcggggaaagctcccctaatccgacggtcgaggccggacggaccctgagagttctgaacctcgtggagaattggctgaacaataacacacaattctgcattaaagtgcttaatccctacatgcctagcgtcatcgaaaagatggaggcgctgcagcgcaagtacggcggggccctcgtgcggaaccccctgtccagaaattctacccacgaaatgtattgggttagcaacgcttccggaaacattgtgtctagcgtcaatatgatctcccgcatgctgattaaccggtttacaatgaaacacaagaaagccacctacgagcctgatgtggacctcggctctgggacgagaaatatcggaatcgaaagcgagacccccaaccttgatattatcggcaagcgcattgagaaaatcaagcaggaacatgagacatcctggcactatgaccaggaccatccgtacaagacctgggcttatcacggcagctacgaaacaaaacaaaccgggtctgcctccagcatggttaatggagtggtccggctgctgacaaagccttgggatgtgattcccatggtgacccagatggctatgacggacacaacccctttcggccagcagagagtctttaaagagaaggttgatacccgcacacaagaacccaaagaggggacgaagaagctcatgaaaatcaccgccgagtggctgtggaaggaacttggcaaaaagaaaacacctagaatgtgtacccgggaggagttcacacgcaaggtgagatctaacgcggccctgggcgctatttttaccgacgagaataaatggaagtccgcccgggaggctgtggaagatagcgggttctgggagctcgtcgacaaggaaagaaacctgcacctggagggaaaatgcgaaacatgtgtgtataatatgatgggcaagcgggagaaaaagctcggcgagtttgggaaagccaagggatctcgcgccatctggtacatgtggctgggcgcgagattccttgaatttgaggctctggggttcctcaacgaagatcattggttttcccgggagaatagcctgtccggagttgaaggcgaggggcttcacaagctgggctacatcctccgcgacgtgagcaaaaaggagggaggcgccatgtatgccgatgacaccgctgggtgggatacgagaattaccctggaagacctgaaaaacgaggaaatggtcacaaatcatatggagggagaacaccggaagctcgccgaggctatcttccgcctgacctaccagaacaaagtggttagagtgcagcggcccacaccgcgcggcaccgtcatggacattatctctagacgggatcagcgcgggagcggacaagtggttacgtatggccttaatacattcaccaacatggaggcccagctgattagacagatggaaggggagggcgtgtttaagtccatccaacatctcacagtcaccgaagagatcgcggtgaagaactggctggagcgggtcggacgcgaaagactttctcggatggccattagcggcgacgattgcgtggttaaacctctggacgatagattcgcttccgccctcacggctctgaatgacatggggaaggtgcgcaaagatatccagcagtgggagccctctcggggatggaacgactggacccaggtccccttttgcagccaccacttccatgaactgattatgaaggatggcagagtgctcgtggttccttgtcgcaatcaagacgagctgatcgggcgggccagaatttcccagggagcgggctggtctcttcgcgaaacagcctgcctggggaaaagctacgctcagatgtggtccctcatgtattttcaccggagagatctgcgccttgccgctaacgccatctgtagcgctgtgccgtctcattgggtccccatctcccggaccacatggagcattcacgccacccacgagtggatgacaaccgaggacatgctgacggtgtggaatagagtttggatccaggaaaacccttggatggaggataagacacccgtggaatcttgggaggaaattccttacctcggcaagcgcgaggaccaatggtgcggatccctgatcggcctgaccagccgggcgacctgggccaaaaatattcagacagctatcaaccaggtcagatccctcattgggaatgaggaatataccgactacatgccctctatgaagcggttcagacgcgaggaagaggaagccggagtgctgtggtga

SEQ ID NO: 19598 - RNA, 9876 nt, synthetic construct
  misc_feature 1..9876: note = derived and/or modified CDS sequence (opt5) from DENV-2__KX380834__SS-prME
  source 1..9876: mol_type = other RNA
accgccggaatcattatcatgatgattcccaccgtgatggctttccacctgacgaccagaaatggggagcctcatatgatcgtcagccggcaggaaaagggaaaatccctcctgtttaagaccgagaatggcgttaacatgtgcacccttatggccatggacctgggggaactctgtgaggatacgattacctacaattgcccgctgcttcgccaaaacgaacccgaggacatcgattgttggtgcaattctacaagcacctgggtgacgtatggaacctgtacagcgaccggcgagcaccggcgggaaaaacgctccgtggctctggtccctcatgtggggatgggactcgagacaagaaccgaaacgtggatgtctagcgagggcgcctggaagcacgcccagcggatcgagacatggattctgcgccatcccggcttcaccatcatggctgccattctggcttacacaatcgggaccacctattttcagagagttctcattttcatcctgcttacagccgtgacgccttccatggcgatgcggtgcattggaatctctaaccgcgactttgtcgaaggcgtgagcgggggatcctgggttgatatcgtgctggagcacggcagctgtgtcaccacaatggccaaaaataagcccaccctcgacttcgaactgattaagacagaggctaaacaccttgccaccctgagaaagtactgcgtggaagctaaactcacgaacacaaccaccgcctctcggtgtcctacacagggggagccgtccctgaatgaggaacaagataagcgctttgtgtgcaaacatagcatggtcgacagaggatggggcaacggctgtgggctgttcggaaagggcgggatcgttacctgcgcgatgtttacatgcaagaaaaatatggagggaaaggtggtgcagcccgaaaacctcgagtatacgattgtcatcacccctcactctggcgaagagaatgccgtggggaacgatacaggaaaacatggcaaggagattaaagttacaccccagtccagcatcacagaagctgagctgaccggctacgggacggtgaccatggaatgttctcctcggacaggacttgacttcaatgagatggtcctgctccagatggaaaacaaggcctggctggtgcaccgccaatggtttcttgatctgcccctcccgtggctgcctggcgctgacacccaggggtccaactggatccagaaagagacactggttaccttcaagaatccccacgccaagaaacaggatgtggtcgtgctcggaagccaagagggcgccatgcatacggctctgacaggggcgaccgaaattcagatgtcctctggcaaccttctgtttacaggacacctcaagtgcagactgcggatggacaaacttcagctgaagggcatgagctattccatgtgtaccgggaaattcaaggtcgtgaaggagatcgccgaaacccaacatggaacaattgttatcagagtgcagtacgagggcgacgggagcccttgcaaaattcccttcgagatcatggatctcgaaaagcgccacgtcctgggacggctgatcacggtgaatcccattgttaccgagaaagactctcctgtgaacatcgaagctgagccgccctttggcgattcctacattatcattggggtcgaacctggccagctcaagctgagctggttcaaaaagggatctagcatcggccagatgtttgagacaaccatgagaggggccaagcgcatggccattcttggagacacagcttgggatttcggctccctcggcggggtgtttacctctatcgggaaagccctccatcaagtgttcggggcgatctatggcgctgcctttagcggagtttcctggacgatgaagattctgatcggcgtcgtgattacatggatcgggatgaatagccggtctacctccctgagcgtgtctcttgtcctcgtgggagttgtgaccctgtacctgggcgtcatggtgcaggccgactccgggtgtgttgtgagctggaaaaacaaggagctcaaatgcggatccggcattttcatcacagataatgtccacacctggacagaacagtataagtttcagcccgagtctcctagcaagctggcttccgccatccaaaaagctcacgaagaggggatttgtggcatcagatctgtgacgcgccttgaaaacctgatgtggaagcagattacccccgagctcaatcatatcctgacagagaacgaagttaaactgaccattatgacaggagacatcaagggcatcatgcaggccgggaaacggagccttagaccgcagcctaccgagctcaagtactcctggaaagcgtggggaaaggccaagatgctgagcacggaactgcacaatcataccttcctcattgatggccccgagacagctgaatgccctaacaccaatcgcgcctggaactctctggaggtggaggactatgggtttggagtcttcacaaccaatatctggcttaaactgaaggaacggcaagatgtgttttgtgactccaacctcatgagcgctgccattaaagacaacagagcggtgcacgccgatatgggctactggatcgagtctgctctgaatgacacatggaagattgaaaaagcctccttcatcgaggtcaagagctgccactggcccaagtctcataccctgtggagcaacggcgttcttgagtccgaaatgatcattcctaaaaatttcgctgggcccgtgagccagcacaactatcgcccgggataccatacgcagacagccggcccttggcacctcgggcggctggagatggattttgacttctgtgaaggaaccaccgtggtcgtgacagaggattgcggcaatagagggccctctctgcggaccacgacagcctccggaaagctcatcaccgaatggtgctgtcgcagctgcacactgccccctcttagataccggggcgaggacggctgttggtatgggatggagattagaccgctgaaagaaaaggaggaaaacctcgttaattccctggtgaccgctggacatggccagatcgataacttttctctgggggtccttggaatggcgctgttcctggaggaaatgctgcgcacacgggtgggcaccaaacacgccattctcctggttgctgtgagctttgtcacgcttatcaccgggaatatgtccttcagagacctgggacgcgtgatggttatggtgggcgccacaatgaccgatgacattggcatgggggtcacatacctcgccctgctggctgcctttaaggtgagacccaccttcgcggctggacttctgctccggaagctgacgtctaaagagctcatgatgacaaccatcggcatcgtgctgcttagccaatccacaattcctgagtctatcctggaactcaccgatgccctggccctggggatgatggtccttaagattgttcgcaacatggagaaatatcagctggctgtgaccatcatggccattctctgcgtgcccaatgcggtcatcctgcagaacgcttggaaggtgagctgtacaacgctcgccgttgtgtccgtcagccctctgcttctgacctcttcccaacagaaagccgactggatccccctcgctctgacaattaagggactgaatcctaccgccatctttcttacaaccctgagcagaacgtctaagaaacggtcctggcccctcaacgaagctattatggccgtgggcatggttagcatcctggcgtcttccctcctgaagaatgatattccgatgacagggcctcttgtggccggaggcctgctgaccgtctgctacgtgctcaccggccgcagcgctgacctggagcttgaaagagccgctgacgtccggtgggaggagcaggccgaaatctccgggagctctcccatcctgagcattacaatctccgaggatggatctatgagcattaaaaacgaagaggaggaacagaccctcacaatcctgattcgcacgggcctcctggtgatctccgggcttttccctgtttctattcccatcaccgccgctgcgtggtatctgtgggaggtgaagaaacaaagagccggagtcctgtgggacgtgccgagccctccccctgttggcaaggctgaactcgaggatggggcctaccggatcaaacagaagggcattctgggctattcccagatcggcgccggggtgtacaaggaaggaacatttcacaccatgtggcatgtcacacgcggcgctgtgcttatgcacaaagggaagagaattgagccctcttgggccgacgtgaaaaaggatctgatcagctacggaggcgggtggaaactcgagggagaatggaaggagggcgaagaggttcaggtcctggcgctcgaacccggcaagaaccctcgggctgtgcaaaccaaaccggggctgttcaagacgaataccggaacaattggcgccgtgtcccttgactttagccccgggacctctggatcccctatcgtcgataaaaagggcaaagtggttgggctgtatggaaacggcgtggtcacaagaagcggcacctacgtgtctgccatcgctcagacagagaagtccattgaggacaatcccgaaatcgaggatgacattttccgcaagaaacggctgacgatcatggatctccatcctggggccggaaagaccaaaagatatctgcccgcgattgttcgcgaagctatcaagcggggccttagaacactgatcctcgcccctacccgcgtggtcgccgctgagatggaagaggccctgcgggggctcccgattagataccagacccccgctatccgcgccgagcacacaggacgggaaattgtggacctgatgtgtcatgcgacgttcaccatgagacttctgagccctatccgggttcccaactataatctgattatcatggatgaggcccactttacagaccctgcttccattgccgctcgcggctacatctctaccagagtggaaatgggggaggccgccggcatcttcatgacagctacacccccgggaagccgggacccttttccccagtccaacgcgcccattatggatgaggaacgcgagatccctgaaagaagctggaactctggccacgagtgggtcacggacttcaaagggaagacagtgtggtttgtgccctccattaaggccggaaacgatatcgctgcctgcctccggaaaaatggcaagaaagtcattcaactgagcagaaagaccttcgactctgaatatatcaaaacccgcacaaacgattgggactttgttgtgaccacagatatcagcgagatgggggccaatttcaaggctgagcgggtgattgaccctagacgctgtatgaagccggtcatccttaccgatggagaggaacgggtgattctggccggccccatgcctgttacgcattcctctgcggctcagagacgcgggcgggtgggcagaaaccccaaaaatgaaaacgaccagtacatctacatgggagagcctctcgaaaatgatgaggactgcgcccactggaaggaggccaaaatgctgctggacaacattaacacacccgaaggcatcatcccgagcatgtttgagcctgaacgcgagaaggtcgatgctattgacggggaatatagactccggggagaggcccgcaaaaccttcgtggatcttatgagacggggcgacctgcccgtttggctggcgtaccgcgtggccgctgaggggatcaattatgccgatagacggtggtgttttgacggagtcaagaacaatcaaattctcgaagagaacgtggaagtcgagatctggacaaaagagggcgaaagaaagaagctgaaacctcgctggcttgatgctcggatttactccgaccccctggccctcaaggagttcaaagagttcgctgccgggagaaagtctctgaccctgaatctcatcacggagatgggccgccttcctacctttatgacacagaaagcgaagaacgccctggataatctggctgtgctccataccgccgaagctggaggccgggcctataaccacgccctgagcgagcttcccgagacactggaaaccctcctgctgctcacacttctggctaccgttacagggggaattttcctgtttctcatgtccggcaaggggatcggaaaaatgacactgggcatgtgctgcatcattaccgcgagcatccttctgtggtacgcccagattcagccgcactggatcgctgcctctattatcctcgagttctttctgatcgtgctgctcattcctgaacccgagaagcaaagaacaccccaggacaatcagcttacatatgtggtcatcgccattctgaccgttgtggctgccacaatggcgaacgaaatgggcttcctggagaaaacgaagaaagattttgggctcggatccatcaccacacagcaacctgagagcaatattctggacatcgatcttcggccggcctccgcttggaccctgtacgccgtggctacaaccttcatcacgcccatgctccgccattctattgaaaacagctccgtcaatgtgtctctgaccgccatcgcgaaccaggccacagttctgatgggcctcgggaagggatggcctcttagcaagatggacattggcgtgcccctgctggctatcgggtgttactcccaggtcaatcctattaccctcacagccgctctgcttctgctcgtggcccactatgctatcattggacccggcctgcaggccaaagcgaccagagaggcccaaaagcgggctgccgctggcatcatgaaaaaccctacggtcgacgggatgacagtgatcgatctggacccgattccctacgatcctaagtttgaaaaacagctcggacaggttatgcttctggtgctgtgcgtcacccaggtgctcatgatgcgcacaacctgggccctgtgtgaggcccttaccctggcgacaggccccatcagcacgctctgggaagggaatcctggaagattctggaacaccacaattgctgtttctatggccaacatctttcggggctcctatctggctggggccggactcctgttcagcattatgaagaataccgccaacacacgcagaggcaccggcaatacgggggagacacttggagagaagtggaaaaaccggctgaatgctctgggcaagtctgaatttcaaatctacaaaaagtccgggatccaggaggtggaccgcaccctcgccaaagaaggaattaagagaggcgagaccgatcatcacgcggtcagccgggggtctgccaaactgagatggttcgtggagcgcaaccttgtgacacccgaaggaaaggttgtcgacctgggctgcggcagagggggatggagctattactgtggcgggctcaagaatgtgaaagaggtgaagggactgaccaaaggcgggccgggacatgaagaacctatccccatgtccacatatggctggaacctggtcagactccagtctggcgttgatgtgttctttacgccccctgaaaagtgcgacacccttctgtgtgatattggggagagctcccccaatcctacagtggaggctggacgcaccctgcgggtcctcaacctggtggaaaattggcttaacaataacacacaattctgcatcaaagttctgaatccgtacatgcccagcgtgattgagaagatggaagccctccagagaaagtacggcggggctctggtccgcaaccctctgtcccggaactctacccacgagatgtattgggtgagcaatgcctccggaaacatcgtttctagcgtgaatatgatctccagaatgctcattaaccgctttacgatgcggcacaaaaaggcgacctacgaacccgacgtcgatcttggctctgggacaagaaatatcggaattgagagcgagacccctaacctggacatcattggcaaacgcatcgaaaagatcaaacaggagcatgaaacatcctggcactatgatcaggaccatccctacaagacctgggcctatcacggcagctacgagacaaagcaaaccgggtctgcttccagcatggtgaatggagtggtccggctgctcacgaaaccgtgggacgttattcctatggtgacacagatggccatgaccgataccacacccttcggccagcagagagtgtttaaggaaaaagtcgacacgcgcacccaagagcctaaggaggggaccaaaaagctgatgaagatcaccgctgaatggctttggaaagagctgggaaagaaaaagacacccagaatgtgtacccgggaagagttcacacgcaaagtgagatctaacgccgctctcggcgccatttttaccgatgagaataagtggaaatccgcgcgggaagccgttgaggacagcgggttctgggaactggtggataaggagagaaacctgcacctcgaaggaaagtgcgagacgtgtgtctataatatgatgggcaaacgggagaagaaactgggcgaatttgggaaggctaaaggatctcgcgccatctggtacatgtggcttggcgctagattcctggagtttgaagccctcgggttcctgaacgaggaccattggttttcccgggaaaatagcctttccggagtggagggcgaggggctgcacaagctcggctacattctgcgcgatgttagcaagaaagaaggaggcgccatgtatgcggacgataccgctgggtgggacacaagaatcaccctggaggatctcaagaacgaagagatggtgacaaatcatatggaaggagagcacaaaaagctggccgaggccattttcaaacttacctaccagaacaaggtcgtgcgggttcagcgccctacgcccagaggcacagtgatggacatcatctctcggcgcgaccagagagggagcggacaagtcgtgacctatggcctgaacacattcaccaatatggaagctcagctcattcggcagatggagggggaaggcgtctttaagtccatccaacagctgacggtgaaagaggagattgccgttaagaactggcttatccgcgtgggaagagaacggctgtctcgcatggctattagcggcgatgactgcgtcgtgaaaccgctcgatgacagattcgcctccgcgctgaccgccctgaatgatatggggaaggtgcggaaagacatccagcagtgggagccttctagaggatggaacgattggacacaagttcccttttgcagccatcacttccacgaactcatcatgaaggacggccgcgtgctggtcgtgccctgtcggaatcaggatgagcttattgggagagctcgcatctcccagggagccggctggtctctgcgggaaaccgcttgcctcggaaagagctacgcccagatgtggtccctgatgtattttcatagacgcgaccttcggctggcggccaacgctatttgtagcgccgttccttctcactggatcccgacatccagaaccacatggagcattcatgctacccacgagtggatgacgacagaggatatgctcaccgtgtggaatcgcgtctggatccaagaaaacccctggatggaggacaaaacccctgtggaatcttgggaggaaatcccctacctgggcaagcgggaggatcagtggtgcggatccctgattggcctcacaagcagagccacctgggctaaaaatatccagacagccattaaccaggtccgctccctgatcgggaatgaggaatatacggactacatgccttctatgaagcggttcagacgggaggaagaggaagcgggagtgctttggtga

SEQ ID NO: 19599 - RNA, 9876 nt, synthetic construct
  misc_feature 1..9876: note = derived and/or modified CDS sequence (opt5) from DENV-2__KX380835__SS-prME
  source 1..9876: mol_type = other RNA
accgccggaatcattatcatgatgattcccaccgtgatggctttccacctgacgaccagaaacggggaacctcatatgatcgtgagccggcaggaaaaggggaaaagcctcctgtttaagacagagaatggagttaacatgtgcacccttatggccatggacctgggggaactctgtgaggatacaattacctacaattgcccgctgcttcgccaaaacgaacccgaggacatcgattgttggtgcaattctacaagcacctgggtgacgtatggaacctgtacagcgaccggcgagcacagacgggaaaaacgctccgtggctctggtccctcatgtggggatgggactcgagacaagaaccgaaacgtggatgtctagcgagggcgcctggaagcacgcccagcggatcgagacatgggttctgcgccatcccggcttcaccgtgatggctgccattctggcttacacaatcgggaccacctattttcagagagtcctcattttcatcctgcttacagccgtggcgccttccatgacgatgcggtgcattggaatctctaaccgcgactttgttgaaggcgtgagcgggggatcctgggtcgatattgtgctggagcacggcagctgtgtgaccacaatggccaaaaataagcccaccctcgacttcgaactgatcaagacagaggctaaacaccctgccacccttagaaagtactgcatcgaagctaaactgacgaacacaaccaccgcctctcggtgtccgacacagggggagccctccctcaatgaggaacaagataagcgctttgtctgcaaacatagcatggttgacagaggatggggcaacggctgtgggctgttcggaaagggcgggattgtgacctgcgcgatgtttacatgcaagaaaaatatggagggaaagatcgtgcagcctgaaaacctggagtatacgattgtcatcacaccccactctggcgaagagaatgccgtggggaacgatacaggaaaacatggcaaggagattaaagttacccctcagtccagcatcacagaagctgagctcaccggctacgggacggccaccatggaatgttctccccggacaggactggacttcaatgagatggtgcttctgcagatggaaaacaaggcttggctcgtccaccgccaatggtttctggatcttccgctgccttggctccccggcgccgacacccaggggtccaactggatccagaaagagacactggtgaccttcaagaatcctcacgccaagaaacaggatgttgtggtcctgggaagccaagagggcgctatgcatacggcgctcacaggggccaccgaaattcagatgtcctctggcaacctgctttttacaggacacctgaagtgcagactccggatggacaaactgcagcttaagggcatgagctattccatgtgtaccgggaaattcaaggtggtcaaggagatcgctgaaacccaacatggaacaattgtgatcagagttcagtacgagggcgacgggagcccctgcaaaattcccttcgagatcatggatctggaaaagcgccacgtgctcggacggctgatcacggtcaatcctattgtgaccgagaaagactctccggttaacatcgaagccgagcccccttttggcgattcctacattatcattggggtggaacccggccagctgaagctcagctggttcaaaaagggatctagcatcggccagatgtttgagacaaccatgagaggggccaagcgcatggctattctgggagacacagcctgggatttcggctcccttgggggagtctttacctctatcggcaaagcgctgcatcaagtgttcggggctatctatggcgccgcctttagcggagtgtcctggacgatgaagattctcatcggcgttgtcattacatggatcgggatgaatagccggtctacctccctgagcgtgtctctggtgcttgtcggaattgtgaccctctacctgggcgttatggtgcaggctgactccgggtgtgtcgtgagctggaaaaacaaggagctgaaatgcggatccggcatcttcatcacagataatgttcacacctggacagaacagtataagtttcagcctgagtctcccagcaagctcgcctccgctattcaaaaagcccacgaagaggggatctgtggcattagatctgtgacgcgcctggaaaaccttatgtggaagcagatcaccccggagctgaatcatattctcagcgagaacgaagtcaaactgacaatcatgaccggagacatcaagggcattatgcaggcggggaaacggtccctgagacctcagcccacagagcttaagtacagctggaaagcctggggaaaggctaagatgctctctaccgaactgcacaatcatacgttcctgatcgatggccctgagaccgccgaatgccccaacacaaatcgcgcttggaactccctcgaggtggaggactatgggtttggagttttcaccacaaatatttggctgaaacttaaggaacggcaagatgtgttttgtgacagcaaactgatgtctgccgcgatcaaggacaacagagccgtccacgctgatatgggctactggattgagtccgccctcaacgacacctggaaaatcgaaaaggctagcttcatcgaggtgaagtcttgccactggcctaaaagccatacactgtggtccaatggcgtgctggagagcgaaatgattatccccaagaacttcgccgggccggtctctcagcacaattatcgccctggataccatacccagacggccggcccctggcaccttgggcggctcgagatggattttgacttctgtgaaggaacaaccgttgtggtgaccgaggattgcggcaacagagggccctccctgcggacaaccacggctagcggaaaactgattacagaatggtgctgtcgctcctgcaccctccctccgctgagataccggggcgaggacggctgttggtatgggatggagatcagaccccttaaggaaaaagaggaaaatctggtcaactctctcgtgacagcgggacatggccagattgataattttagcctgggggttctgggaatggcccttttcctcgaggaaatgctgcgcacccgggtgggcacaaagcacgctatcctgctcgtcgccgtgtcctttgttaccctgattacggggaacatgtctttcagagaccttggacgcgtgatggtcatggtgggcgccaccatgacagatgacatcggcatgggggttacctacctggctctcctggccgcgtttaaggtgagacctacattcgctgccggactgcttctgcggaaactcaccagcaaggagctgatgatgacgacaatcggcattgtcctcctgtcccaatctaccatccccgagacaattcttgaactgaccgatgccctcgctctggggatgatggtgctgaaaatcgtgcgcaatatggagaagtatcagcttgccgtcaccattatggcgatcctgtgcgttcctaacgctgtgatcctccagaatgcctggaaagtgagctgtacaattctggccgtcgtgtccgttagccccctcctgcttacgtcttcccaacagaaggctgactggatccctctggccctcaccattaagggactgaaccccacagctatctttctgaccacacttagcagaacctctaaaaagcggtcctggccgctgaatgaagccattatggcggtgggcatggtcagcatcctcgcctcttccctgctcaaaaacgatatccctatgacggggcccctggtggctggaggccttctgacagtttgctacgtgctgaccggccgcagcgccgacctcgagctggaaagagctgccgacgtccggtgggaggagcaggccgaaatttccgggagctctcctatccttagcattaccatctccgaggatggatctatgagcattaagaatgaagaggaggaacagacactgaccatcctcattcgcacaggcctgctcgtgatctccgggctgttccccgtctctatcccgattacggctgcggcctggtatctttgggaggtgaaaaagcaaagagctggagttctgtgggacgtgccttctccccctcccgtcggcaaagccgaactggaggatggggcctaccggatcaagcagaagggcattctcggctattcccagatcggcgctggggtgtacaaagaaggaacctttcacacaatgtggcatgttacccgcggcgccgtgctgatgcacaaggggaaaagaattgagccctcctgggcggacgtcaagaaagatcttatcagctacggaggcgggtggaagctggagggagaatggaaggagggcgaagaggtccaggtgctcgctctggaacctggcaaaaacccgcgggccgttcaaacaaagcccggactcttcaaaaccaacacgggaaccatcggcgccgtctccctggactttagccctgggacatctggatcccccattgtggataagaaaggcaaggtggtcgggctttatggaaatggcgtggttaccagaagcggcacatacgtgtctgctatcgcccagaccgagaagtccattgaggacaaccctgaaatcgaggatgacattttccgcaaaaagcggctgacaatcatggatctgcatcccggggcgggaaaaacgaagagatatctccctgctatcgtccgcgaagccattaaacggggcctgagaacccttatcctggccccgacacgcgtggttgctgccgagatggaagaggctctccgggggctgcccattagataccagacccctgccatccgcgcggagcacaccggacgggaaattgtggacctcatgtgtcatgccacattcacgatgagactgcttagccccatccgggtccctaattataacctgattatcatggatgaggctcactttaccgaccccgcctccatcgctgcccgcggctacatttctacaagagtggaaatgggggaggccgctggcatcttcatgaccgcgacaccgcctggaagccgggacccctttccccagtccaatgcccctattatggatgaggaacgcgagatccccgaaagaagctggaactctggccacgagtgggttaccgacttcaaggggaagacggtgtggtttgtcccttccattaaagctggaaatgatatcgccgcctgcctgcggaagaacggcaaaaaggtgatccaactcagcagaaaaacattcgactctgaatatattaagacccgcaccaatgattgggactttgtggtcacaaccgatatcagcgagatgggggctaacttcaaggccgagcgggttattgacccgagacgctgtatgaaacccgtgatcctgacagatggagaagaacgggtgattcttgcgggccctatgcccgtcacccattcctctgctgcccagagacgcgggcgggtgggcagaaatcctaagaacgaaaatgaccagtacatctacatgggagagcccctggaaaacgatgaggactgcgcccactggaaagaggctaagatgctcctggacaatatcaacacgccggaaggcattatccctagcatgtttgagcccgaacgcgagaaagttgatgccattgacggggaatatagactgcggggagaggcgcgcaagacattcgtggatctcatgagacggggcgaccttcctgtctggctggcctaccgcgtggctgccgaggggatcaactatgctgatagacggtggtgttttgacggagttaaaaataaccaaattctggaagagaatgtggaagtcgagatctggaccaaggagggcgaaagaaagaaactcaagccccgctggctggatgcccggatttactccgaccctcttgctctgaaagagttcaaggagttcgccgcggggagaaaatctctcacactgaacctgatcaccgagatgggccgcctccccacgtttatgacccagaaggcccggaatgctcttgataacctggccgtgctgcatacagctgaagccggaggcagagcctataatcacgctctcagcgagctgccggagacccttgaaacactgctcctgctgaccctccttgcgacagtcaccgggggaatcttcctgtttctgatgtccggcaaggggattggaaaaatgacgctcggcatgtgctgcatcattacagccagcatcctgctttggtacgctcagattcagcctcactggatcgccgcctctatcattctggagttctttctcatcgtgctgctgattcccgaacccgagaagcaacggacccctcaggacaaccagctcacctatgttgtgatcgctattcttacagtggtcgccgcgaccatggccaatgaaatgggcttcctggagaaaacaaagaaagattttgggctgggatccatcacgacccagcaaccggacagcaacatcctcgatattgacctgcgccccgcttccgcctggacactttacgctgttgccaccacattcatcacccctatgctgagacattctattgagaatagctccgtgaacgtgtctctcacggcgatcgccaatcaggctaccgtcctgatgggcctggggaagggatggcccctcagcaagatggacattggcgtgcctcttctggccatcgggtgttactcccaggttaaccccattacactgaccgctgccctcctgcttctggtggctcactatgccatcatcggacctggcctccaggcgaaagccacacgggaagctcaaaagcgcgccgctgccggcattatgaaaaatccgaccgtcgatgggatgacggtgatcgacctggatcccattccttacgaccccaagtttgagaaacagctgggacaggtcatgctccttgtgctgtgcgttacacaggtgctgatgatgagaaccacatgggccctctgtgaagcgctgacccttgctaccggccctatcagcacactgtgggaggggaaccccggacggttctggaatacgaccattgccgtctctatggctaacatctttcgcggctcctatctcgccggggccggactgctgttcagcatcatgaagaacacagctaataccagacggggcacaggcaacaccggggaaacgctcggagagaagtggaaaaatcgccttaacgccctgggcaagtctgagtttcaaatttacaaaaagtccgggatccaggaagtggatagaacactggcgaaagagggaattaagcggggcgaaaccgaccatcacgccgttagcagagggtctgctaaactccgctggttcgtggagcggaatctggtcaccccggagggaaaggtggtggatcttggctgcggcagagggggatggagctattactgtggcgggctgaagaacgttaaagaagtcaagggactcacaaaaggcgggcctggacatgaggaacccatccccatgtccacctatggctggaatctggtgcgcctgcagtctggcgtggacgtcttctttacacctcccgagaagtgcgatacgctcctttgtgacattggggaaagctcccctaacccgaccgttgaggccggacggacactgagagtgctgaatctcgtggagaactggctgaataacaatacccaattctgcatcaaagtccttaacccctacatgcctagcgtgatcgaaaagatggaggctctgcagcgcaagtacggcggggccctcgttcggaatcccctgtccagaaactctacacacgaaatgtattgggtgagcaacgcgtccggaaatattgtctctagcgtgaacatgatctcccgcatgctgattaatcggtttaccatgaaacacaagaaagccacgtacgagcctgatgttgacctcggctctgggaccagaaacatcggaattgaaagcgagacacccaatcttgatatcatcggcaagcgcattgagaaaatcaagcaggaacatgagacctcctggcactatgaccaggaccatccgtacaagacatgggcttatcacggcagctacgaaaccaaacaaacagggtctgcctccagcatggtgaacggagtcgtgcggctgctgaccaagccttgggatgtgattcccatggtcacgcagatggctatgacagacaccacccctttcggccagcagagagtttttaaagagaaggtggatacacgcacgcaagaacccaaagaggggaccaagaagctcatgaaaatcacagccgagtggctgtggaaggaacttggcaaaaagaaaacccctagaatgtgtacacgggaggagttcacccgcaaggtgagatctaatgctgccctgggcgcgatttttacagacgagaacaaatggaagtccgcccgggaggctgtcgaagatagcgggttctgggagctcgtggacaaggaaagaaatctgcacctggagggaaaatgcgaaacctgtgtttataacatgatgggcaagcgggagaaaaagctcggcgagtttgggaaagccaagggatctcgcgctatctggtacatgtggctgggcgccagattccttgaatttgaggccctggggttcctcaatgaagatcattggttttcccgggagaacagcctgtccggagtggaaggcgaggggcttcacaagctgggctacattctccgcgacgtcagcaaaaaggagggaggcgcgatgtatgctgatgacacggccgggtgggataccagaatcacactggaagacctgaaaaatgaggaaatggtgaccaaccatatggagggagaacaccggaagctcgccgaggctatcttccgcctgacataccagaataaagttgtgagagtccagcggcccaccccgcgcggcacggtgatggacattatctctagacgggatcagcgcgggagcggacaagttgtgacatatggccttaacaccttcacaaacatggaggcccagctgattagacagatggaaggggagggcgtctttaagtccatccaacatctcaccgtgacggaagagattgctgtcaagaattggctggagcgggtgggacgcgaaagactttctcggatggccatcagcggcgacgattgcgttgtgaaacctctggacgatagattcgcgtccgccctcaccgctctgaacgacatggggaaggtccgcaaagatatccagcagtgggagccctctcggggatggaatgactggacacaggtgcccttttgcagccaccacttccatgaactgattatgaaggatggcagagtgctcgttgtgccttgtcgcaaccaagacgagctgatcgggcgggccagaatttcccagggagctggctggtctcttcgcgaaaccgcctgcctggggaaaagctacgcgcagatgtggtccctcatgtattttcaccggagagatctgcgccttgccgctaatgccatctgtagcgctgtcccgtctcattgggtgcccatttcccggacaacctggagcatccacgccacacacgagtggatgaccacggaggacatgctgacagtttggaacagagtgtggatccaggaaaatccttggatggaggataagacccccgtcgaatcttgggaggaaattccttacctcggcaagcgcgaggaccaatggtgcggatccctgatcggcctgaccagccgggctacatgggccaaaaacattcagaccgcgatcaatcaggtgagatccctcattgggaacgaggaatatacagactacatgccctctatgaagcggttcagacgcgaggaagaggaagccggagtcctgtggtga

SEQ ID NO: 19600 - RNA, 9876 nt, synthetic construct
  misc_feature 1..9876: note = derived and/or modified CDS sequence (opt5) from DENV-2__KX380836__SS-prME
  source 1..9876: mol_type = other RNA
accgccggaatcattatcatgatgattcccacagtgatggctttccacctgacgaccagaaacggggagcctcatatgatcgtgagccggcaggaaaaggggaaaagcctcctgtttaagacagagaatggcgttaacatgtgcacccttatggccatggacctgggggaactctgtgaggatacaattacctacaattgcccgctgcttcgccaaaacgaacccgaggacatcgattgttggtgcaattctacaagcacctgggtgacgtatggaacctgtacagcgaccggcgagcaccggcgggaaaaacgctccgtggctctggtccctcatgtggggatgggactcgagacaagaaccgaaacgtggatgtctagcgagggcgcctggaagcacgcccagcggatcgagacatgggttctgcgccatcccggcttcaccgtgatggctgccattctggcttacacaatcgggaccacctattttcagagagtcctcattttcatcctgcttacagccgtggcgccttccatgacgatgcggtgcattggaatctctaaccgcgactttgttgaaggcgtgagcgggggatcctgggtcgatattgtgctggagcacggcagctgtgtgaccacaatggccaaaaataagcccaccctcgacttcgaactgatcaagacagaggctaaacaccctgccacccttagaaagtactgcatcgaagctaaactgacgaacacaaccaccgcctctcggtgtccgacacagggggagccctccctcaatgaggaacaagataagcgctttgtctgcaaacatagcatggttgacagaggatggggcaacggctgtgggctgttcggaaagggcgggattgtgacctgcgcgatgtttacatgcaagaaaaatatggagggaaagatcgtgcagcctgaaaacctggagtatacgattgtcatcacaccccactctggcgaagagaatgccgtggggaacgatacaggaaaacatggcaaggagattaaagttacccctcagtccagcatcacagaagctgagctcaccggctacgggacggccaccatggaatgttctccccggacaggactggacttcaatgagatggtgcttctgcagatggaaaacaaggcttggctcgtccaccgccaatggtttctggatcttccgctgccttggctccccggcgccgacacccaggggtccaactggatccagaaagagacactggtgaccttcaagaatcctcacgccaagaaacaggatgttgtggtcctgggaagccaagagggcgctatgcatacggcgctcacaggggccaccgaaattcagatgtcctctggcaacctgctttttacaggacacctgaagtgcagactccggatggacaaactgcagcttaagggcatgagctattccatgtgtaccgggaaattcaaggtggtcaaggagatcgctgaaacccaacatggaacaattgtgatcagagttcagtacgagggcgacgggagcccctgcaaaattcccttcgagatcatggatctggaaaagcgccacgtgctcggacggctgatcacggtcaatcctattgtgaccgagaaagactctccggttaacatcgaagccgagcccccttttggcgattcctacattatcattggggtggaacccggccagctgaagctcagctggttcaaaaagggatctagcatcggccagatgtttgagacaaccatgagaggggccaagcgcatggctattctgggagacacagcctgggatttcggctcccttgggggagtctttacctctatcggcaaagcgctgcatcaagtgttcggggctatctatggcgccgcctttagcggagtgtcctggacgatgaagattctcatcggcgttgtcattacatggatcgggatgaatagccggtctacctccctgagcgtgtctctggtgcttgtcggaattgtgaccctctacctgggcgttatggtgcaggctgactccgggtgtgtcgtgagctggaaaaacaaggagctgaaatgcggatccggcatcttcatcacagataatgttcacacctggacagaacagtataagtttcagcctgagtctcccagcaagctcgcctccgctattcaaaaagcccacgaagaggggatctgtggcattagatctgtgacgcgcctggaaaaccttatgtggaagcagatcaccccggagctgaatcatattctcagcgagaacgaagtcaaactgacaatcatgaccggagacatcaagggcattatgcaggcggggaaacggtccctgagacctcagcccacagagcttaagtacagctggaaagcctggggaaaggctaagatgctctctaccgaactgcacaatcatacgttcctgatcgatggccctgagaccgccgaatgccccaacacaaatcgcgcttggaactccctcgaggtggaggactatgggtttggagttttcaccacaaatatttggctgaaacttaaggaacggcaagatgtgttttgtgacagcaaactgatgtctgccgcgatcaaggacaacagagccgtccacgctgatatgggctactggattgagtccgccctcaacgacacctggaaaatcgaaaaggctagcttcatcgaggtgaagtcttgccactggcctaaaagccatacactgtggtccaatggcgtgctggagagcgaaatgattatccccaagaacttcgccgggccggtctctcagcacaattatcgccctggataccatacccagacggccggcccctggcaccttgggcggctcgagatggattttgacttctgtgaaggaacaaccgttgtggtgaccgaggattgcggcaacagagggccctccctgcggacaaccacggctagcggaaaactgattacagaatggtgctgtcgctcctgcaccctccctccgctgagataccggggcgaggacggctgttggtatgggatggagatcagaccccttaaggaaaaagaggaaaatctggtcaactctctcgtgacagcgggacatggccagattgataattttagcctgggggttctgggaatggcccttttcctcgaggaaatgctgcgcacccgggtgggcacaaagcacgctatcctgctcgtcgccgtgtcctttgttaccctgattacggggaacatgtctttcagagaccttggacgcgtgatggtcatggtgggcgccaccatgacagatgacatcggcatgggggttacctacctggctctcctggccgcgtttaaggtgagacctacattcgctgccggactgcttctgcggaaactcaccagcaaggagctgatgatgacgacaatcggcattgtcctcctgtcccaatctaccatccccgagacaattcttgaactgaccgatgccctcgctctggggatgatggtgctgaaaatcgtgcgcaatatggagaagtatcagcttgccgtcaccattatggcgatcctgtgcgttcctaacgctgtgatcctccagaatgcctggaaagtgagctgtacaattctggccgtcgtgtccgttagccccctcctgcttacgtcttcccaacagaaggctgactggatccctctggccctcaccattaagggactgaaccccacagctatctttctgaccacacttagcagaacctctaaaaagcggtcctggccgctgaatgaagccattatggcggtgggcatggtcagcatcctcgcctcttccctgctcaaaaacgatatccctatgacggggcccctggtggctggaggccttctgacagtttgctacgtgctgaccggccgcagcgccgacctcgagctggaaagagctgccgacgtccggtgggaggagcaggccgaaatttccgggagctctcctatccttagcattaccatctccgaggatggatctatgagcattaagaatgaagaggaggaacagacactgaccatcctcattcgcacaggcctgctcgtgatctccgggctgttccccgtctctatcccgattacggctgcggcctggtatctttgggaggtgaaaaagcaaagagctggagttctgtgggacgtgccttctccccctcccgtcggcaaagccgaactggaggatggggcctaccggatcaagcagaagggcattctcggctattcccagatcggcgctggggtgtacaaagaaggaacctttcacacaatgtggcatgttacccgcggcgccgtgctgatgcacaaggggaaaagaattgagccctcctgggcggacgtcaagaaagatcttatcagctacggaggcgggtggaagctggagggagaatggaaggagggcgaagaggtccaggtgctcgctctggaacctggcaaaaacccgcgggccgttcaaacaaagcccggactcttcaaaaccaacacgggaaccatcggcgccgtctccctggactttagccctgggacatctggatcccccattgtggataagaaaggcaaggtggtcgggctttatggaaatggcgtggttaccagaagcggcacatacgtgtctgctatcgcccagaccgagaagtccattgaggacaaccctgaaatcgaggatgacattttccgcaaaaagcggctgacaatcatggatctgcatcccggggcgggaaaaacgaagagatatctccctgctatcgtccgcgaagccattaaacggggcctgagaacccttatcctggccccgacacgcgtggttgctgccgagatggaagaggctctccgggggctgcccattagataccagacccctgccatccgcgcggagcacaccggacgggaaattgtggacctcatgtgtcatgccacattcacgatgagactgcttagccccatccgggtccctaattataacctgattatcatggatgaggctcactttaccgaccccgcctccatcgctgcccgcggctacatttctacaagagtggaaatgggggaggccgctggcatcttcatgaccgcgacaccgcctggaagccgggacccctttccccagtccaatgcccctattatggatgaggaacgcgagatccccgaaagaagctggaactctggccacgagtgggttaccgacttcaaggggaagacggtgtggtttgtcccttccattaaagctggaaatgatatcgccgcctgcctgcggaagaacggcaaaaaggtgatccaactcagcagaaaaacattcgactctgaatatattaagacccgcaccaatgattgggactttgtggtcacaaccgatatcagcgagatgggggctaacttcaaggccgagcgggttattgacccgagacgctgtatgaaacccgtgatcctgacagatggagaagaacgggtgattcttgcgggccctatgcccgtcacccattcctctgctgcccagagacgcgggcgggtgggcagaaatcctaagaacgaaaatgaccagtacatctacatgggagagcccctggaaaacgatgaggactgcgcccactggaaagaggctaagatgctcctggacaatatcaacacgccggaaggcattatccctagcatgtttgagcccgaacgcgagaaagttgatgccattgacggggaatatagactgcggggagaggcgcgcaagacattcgtggatctcatgagacggggcgaccttcctgtctggctggcctaccgcgtggctgccgaggggatcaactatgctgatagacggtggtgttttgacggagttaaaaataaccaaattctggaagagaatgtggaagtcgagatctggaccaaggagggcgaaagaaagaaactcaagccccgctggctggatgcccggatttactccgaccctcttgctctgaaagagttcaaggagttcgccgcggggagaaaatctctcacactgaacctgatcaccgagatgggccgcctccccacgtttatgacccagaaggccaagaatgctcttgataacctggccgtgctgcatacagctgaagccggaggccgggcctataatcacgctctcagcgagctgccggagacccttgaaacactgctcctgctgaccctccttgcgacagtcaccgggggaatcttcctgtttctgatgtccggcaaagggattggaaagatgacgctcggcatgtgctgcatcattacagccagcatcctgctttggtacgctcagattcagcctcactggatcgccgcctctatcattctggagttctttctcatcgtgctgctgattcccgaacccgagaaacaaagaacccctcaggacaaccagctcacctatgttgtgatcgctattcttacagtggtcgccgcgaccatggccaatgaaatgggcttcctggagaagaccaaaaaggattttgggctgggatccatcacgacccagcaaccggagagcaacatcctcgacattgatctgcggcccgcttccgcctggacactttacgctgttgccaccacattcatcacccctatgctgcgccattctattgaaaatagctccgtgaacgtgtctctcacggcgatcgccaatcaggctaccgtcctgatgggcctggggaagggatggcccctcagcaaaatggacattggcgtgcctcttctggccatcgggtgttactcccaggttaaccccattacactgaccgctgccctcctgcttctggtggctcactatgccatcatcggacctggcctccaggcgaaggccacaagagaggctcaaaaacgggccgctgccggcattatgaagaatccgaccgtcgacgggatgacggtgatcgatctggaccccattccttacgatcccaaatttgaaaagcagctgggacaggtcatgctccttgtgctgtgcgttacacaggtgctgatgatgcgcaccacatgggccctctgtgaggcgctgacccttgctaccggccctatcagcacactgtgggaagggaaccccggaagattctggaatacgaccattgccgtctctatggctaacatctttcggggctcctatctcgccggggccggactgctgttcagcatcatgaagaacacagctaatacccgcagaggcacaggcaacaccggggagacgctcggagagaaatggaagaatcggcttaacgccctgggcaaatctgaatttcaaatttacaagaaatccgggatccaggaggtggaccgcacactggcgaaggaaggaattaaaagaggcgagaccgatcatcacgccgttagccgggggtctgctaagctcagatggttcgtggagcgcaatctggtcaccccggaaggaaaggtggtggaccttggctgcggcagaggcgggtggagctattactgtggagggctgaaaaacgttaaggaggtcaaagggctcacaaagggcgggcctggacatgaggaacccatccccatgtccacctatggctggaatctggtgagactgcagtctggcgtggatgtcttctttacacctcccgaaaaatgcgacacgctcctttgtgatattggggagagctcccctaacccgaccgttgaggccggacgcacactgcgggtgctgaatctcgtggaaaactggctgaataacaatacccaattctgcatcaaggtccttaacccctacatgcctagcgtgatcgagaagatggaagctctgcagagaaaatacggcggggccctcgttcgcaatcccctgtcccggaactctacacacgagatgtattgggtgagcaacgcgtccggaaatattgtctctagcgtgaacatgatctccagaatgctgattaatcgctttaccatgaagcacaaaaaggccacgtacgaacctgacgttgatctcggctctgggacccggaacatcggaattgagagcgagacacccaatcttgacatcatcggcaaaagaattgaaaagatcaagcaggagcatgaaacctcctggcactatgatcaggaccatccgtacaaaacatgggcttatcacggcagctacgagaccaagcaaacagggtctgcctccagcatggtgaacggagtcgtgcgcctgctgaccaaaccttgggacgtgattcccatggtcacgcagatggctatgacagataccacccctttcggccagcagcgggtttttaaggaaaaagtggacacaagaacgcaagagcccaaggaggggaccaagaaactcatgaagatcacagccgaatggctgtggaaagagcttggaaagaaaaagacccctcgcatgtgtacaagagaagagttcacccggaaagtgcgctctaatgctgccctgggcgcgatttttacagatgagaacaagtggaagtccgccagagaagctgtcgaggacagcgggttctgggaactcgtggataaagagcggaatctgcacctggaaggaaagtgcgagacctgtgtttataacatgatgggcaaaagagagaagaaactcggcgaatttgggaaggccaagggatctcgggctatctggtacatgtggctgggcgcccgcttccttgagtttgaagccctggggttcctcaatgaggaccattggttttccagagaaaacagcctgtccggagtggagggcgaggggcttcacaaactgggctacattctccgggatgtcagcaagaaagaaggaggcgcgatgtatgctgacgatacggccgggtgggacacccgcatcacactggaggatctgaagaatgaagagatggtgaccaaccatatggaaggagagcacagaaaactcgccgaggctatcttccggctgacataccagaataaggttgtgcgcgtccagagacccaccccgcggggcacggtgatggacattatctctcgcagagaccagcgggggagcggacaagttgtgacatatggccttaacaccttcacaaacatggaagcccagctgattcgccagatggagggggaaggcgtctttaagtccatccaacatctcaccgtgacggaggagattgctgtcaaaaattggctggaaagagtgggacgggagcgcctttctagaatggccatcagcggcgatgactgcgttgtgaagcctctggatgaccggttcgcgtccgccctcaccgctctgaacgatatggggaaagtcagaaaggacatccagcagtgggaaccctctcgcggatggaatgattggacacaggtgcccttttgcagccaccacttccatgagctgattatgaaagacggccgggtgctcgttgtgccttgtagaaaccaagatgaactgatcgggcgcgcccggatttcccagggagctggctggtctcttagagagaccgcctgcctgggaaagagctacgcgcagatgtggtccctcatgtattttcaccgccgggacctgagacttgccgctaatgccatctgtagcgctgtcccgtctcattgggtgcccatttcccgcacaacctggagcatccacgccacacacgagtggatgaccacggaagatatgctgacagtttggaaccgggtgtggatccaggagaatccttggatggaagacaagacccccgtcgagtcttgggaagagattccttacctcggcaaaagagaggatcaatggtgcggatccctgatcggcctgaccagccgcgctacatgggccaagaacattcagaccgcgatcaatcaggtgcggtccctcattgggaacgaagagtatacagactacatgccctctatgaaaagattccggagagaagaggaagaggccggagtcctgtggtga

SEQ ID NO: 19601 - RNA, 9876 nt, synthetic construct
  misc_feature 1..9876: note = derived and/or modified CDS sequence (opt5) from DENV-2__KX380838__SS-prME
  source 1..9876: mol_type = other RNA
accgccggaatcattatcatgatgattcccaccgtgatggctttccacctgacgaccagaaacggggaacctcatatgatcgtgagccggcaggaaaagggaaaaagcctcctgtttaagacggagaatggcgttaacatgtgcacccttatggccatggacctgggggaactctgtgaggatacaattacctacaattgcccgctgcttcgccaaaacgaacccgaggacatcgattgttggtgcaattctacaagcacctgggtgacgtatggaacctgtacagcgaccggcgagcacagacgggaaaaacgctccgtggctctggtccctcatgtggggatgggactcgagacaagaaccgaaacgtggatgtctagcgagggcgcctggaagcacgcccagcggatcgagacatgggttctgcgccatcccggcttcaccgtgatggctgccattctggcttacacaatcgggaccacctattttcagagagtcctcattttcatcctgcttacagccgtggcgccttccatgacgatgcggtgcattggaatctctaaccgcgactttgttgaaggcgtgagcgggggatcctgggtcgatattgtgctggagcacggcagctgtgtgaccacaatggccaaaaataagcccaccctcgacttcgaactgatcaagacagaggctaaacaccctgccacccttagaaagtactgcatcgaagctaaactgacgaacacaaccaccgcctctcggtgtccgacacagggggagccctccctcaatgaggaacaagataagcgctttgtctgcaaacatagcatggttgacagaggatggggcaacggctgtgggctgttcggaaagggcgggattgtgacctgcgcgatgtttacatgcaagaaaaatatggagggaaagatcgtgcagcctgaaaacctggagtatacgattgtcatcacaccccactctggcgaagagaatgccgtggggaacgatacaggaaaacatggcaaggagattaaagttacccctcagtccagcatcacagaagctgagctcaccggctacgggacggccaccatggaatgttctccccggacaggactggacttcaatgagatggtgcttctgcagatggaaaacaaggcttggctcgtccaccgccaatggtttctggatcttccgctgccttggctccccggcgccgacacccaggggtccaactggatccagaaagagacactggtgaccttcaagaatcctcacgccaagaaacaggatgttgtggtcctgggaagccaagagggcgctatgcatacggcgctcacaggggccaccgaaattcagatgtcctctggcaacctgctttttacaggacacctgaagtgcagactccggatggacaaactgcagcttaagggcatgagctattccatgtgtaccgggaaattcaaggtggtcaaggagatcgctgaaacccaacatggaacaattgtgatcagagttcagtacgagggcgacgggagcccctgcaaaattcccttcgagatcatggatctggaaaagcgccacgtgctcggacggctgatcacggtcaatcctattgtgaccgagaaagactctccggttaacatcgaagccgagcccccttttggcgattcctacattatcattggggtggaacccggccagctgaagctcagctggttcaaaaagggatctagcatcggccagatgtttgagacaaccatgagaggggccaagcgcatggctattctgggagacacagcctgggatttcggctcccttgggggagtctttacctctatcggcaaagcgctgcatcaagtgttcggggctatctatggcgccgcctttagcggagtgtcctggacgatgaagattctcatcggcgttgtcattacatggatcgggatgaatagccggtctacctccctgagcgtgtctctggtgcttgtcggaattgtgaccctctacctgggcgttatggtgcaggctgactccgggtgtgtcgtgagctggaaaaacaaggagctgaaatgcggatccggcatcttcatcacagataatgttcacacctggacagaacagtataagtttcagcctgagtctcccagcaagctcgcctccgctattcaaaaagcccacgaagaggggatctgtggcattagatctgtgacgcgcctggaaaaccttatgtggaagcagatcaccccggagctgaatcatattctcagcgagaacgaagtcaaactgacaatcatgaccggagacatcaagggcattatgcaggcggggaaacggtccctgagacctcagcccacagagcttaagtacagctggaaagcctggggaaaggctaagatgctctctaccgaactgcacaatcatacgttcctgatcgatggccctgagaccgccgaatgccccaacacaaatcgcgcttggaactccctcgaggtggaggactatgggtttggagttttcaccacaaatatttggctgaaacttaaggaacggcaagatgtgttttgtgacagcaaactgatgtctgccgcgatcaaggacaacagagccgtccacgctgatatgggctactggattgagtccgccctcaacgacacctggaaaatcgaaaaggctagcttcatcgaggtgaagtcttgccactggcctaaaagccatacactgtggtccaatggcgtgctggagagcgaaatgattatccccaagaacttcgccgggccggtctctcagcacaattatcgccctggataccatacccagacggccggcccctggcaccttgggcggctcgagatggattttgacttctgtgaaggaacaaccgttgtggtgaccgaggattgcggcaacagagggccctccctgcggacaaccacggctagcggaaaactgattacagaatggtgctgtcgctcctgcaccctccctccgctgagataccggggcgaggacggctgttggtatgggatggagatcagaccccttaaggaaaaagaggaaaatctggtcaactctctcgtgacagcgggacatggccagattgataattttagcctgggggttctgggaatggcccttttcctcgaggaaatgctgcgcacccgggtgggcacaaagcacgctatcctgctcgtcgccgtgtcctttgttaccctgattacggggaacatgtctttcagagaccttggacgcgtgatggtcatggtgggcgccaccatgacagatgacatcggcatgggggttacctacctggctctcctggccgcgtttaaggtgagacctacattcgctgccggactgcttctgcggaaactcaccagcaaggagctgatgatgacgacaatcggcattgtcctcctgtcccaatctaccatccccgagacaattcttgaactgaccgatgccctcgctctggggatgatggtgctgaaaatcgtgcgcaatatggagaagtatcagcttgccgtcaccattatggcgacactgtgcgttcctaacgctgtgatcctccagaatgcctggaaagtgagctgtacgatcctggccgtcgtgtccgttagccccctcctgcttacctcttcccaacagaaggctgactggattcctctggccctcacaatcaagggactgaaccccaccgctatttttctgacaacccttagcagaacgtctaaaaagcggtcctggccgctgaatgaagccatcatggcggtgggcatggtcagcattctcgcctcttccctgctcaaaaacgatatccctatgacagggcccctggtggctggaggccttctgaccgtttgctacgtgctgaccggccgcagcgccgacctcgagctggaaagagctgccgacgtccggtgggaggagcaggccgaaatctccgggagctctcctattcttagcatcacaatttccgaggatggatctatgagcatcaagaatgaagaggaggaacagaccctgacaattctcatccgcacgggcctgctcgtgatttccgggctgttccccgtctctatcccgatcaccgctgcggcctggtatctttgggaggtgaaaaagcaaagagctggagttctgtgggacgtgccttctccccctcccgtcggcaaagccgaactggaggatggggcctaccggattaagcagaagggaatcctcggctattcccagattggcgctggggtgtacaaagaaggaacatttcacaccatgtggcatgttacacgcggcgccgtgctgatgcacaaggggaaaagaatcgagccctcctgggcggacgtcaagaaagatcttattagctacggaggcgggtggaagctggagggagaatggaaggagggcgaagaggtccaggtgctcgctctggaacctggcaaaaacccgcgggccgttcaaaccaagcccggactcttcaaaacgaacaccggaacaatcggcgccgtctccctggactttagccctgggacctctggatcccccatcgtggataagaaaggcaaggtggtcgggctttatggaaatggcgtggttacaagaagcggcacctacgtgtctgctattgcccagacagagaagtccatcgaggacaaccctgaaattgaggatgacatcttccgcaaaaagcggctgacgattatggatctgcatcccggggcgggaaaaaccaagagatatctccctgctatcgtccgcgaagccatcaaacggggcctgagaacacttattctggccccgacccgcgtggttgctgccgagatggaagaggctctccgggggctgcccatcagataccagacccctgccattcgcgcggagcacacaggacgggaaatcgtggacctcatgtgtcatgccacgttcaccatgagactgcttagccccattcgggtccctaattataacctgatcattatggatgaggctcactttacagaccccgcctccatcgctgcccgcggctacatctctaccagagtggaaatgggggaggccgctggcattttcatgacagcgaccccgcctggaagccgggacccctttccccagtccaatgcccctatcatggatgaggaacgcgagattcccgaaagaagctggaactctggccacgagtgggttacggacttcaaggggaagacagtgtggtttgtcccttccatcaaagctggaaatgatattgccgcctgcctgcggaagaacggcaaaaaggtgatccaactcagcagaaaaaccttcgactctgaatatatcaagacccgcacaaatgattgggactttgtggtcaccacagatattagcgagatgggggctaacttcaaggccgagcgggttatcgacccgagacgctgtatgaaacccgtgattctgaccgatggagaagaacgggtgatccttgcgggccctatgcccgtcacgcattcctctgctgcccagagacgcgggcgggtgggcagaaatcctaagaacgaaaatgaccagtacatttacatgggagagcccctggaaaacgatgaggactgcgcccactggaaagaggctaagatgctcctggacaatatcaacacaccggaaggcatcattcctagcatgtttgagcccgaacgcgagaaagttgatgccatcgacggggaatatagactgcggggagaggcgcgcaagaccttcgtggatctcatgagacggggcgaccttcctgtctggctggcctaccgcgtggctgccgaggggattaactatgctgatagacggtggtgttttgacggagttaaaaataaccaaatcctggaagagaatgtggaagtcgagatttggacaaaggagggcgaaagaaagaaactcaagccccgctggctggatgcccggatctactccgaccctcttgctctgaaagagttcaaggagttcgccgcggggagaaaatctctcaccctgaacctgattacggagatgggccgcctccccacctttatgacacagaaggcccggaatgctcttgataacctggccgtgctgcataccgctgaagccggaggcagagcctataatcacgctctcagcgagctgccggagacacttgaaaccctgctcctgctgacactccttgcgaccgtcacaggcgggatcttcctgtttctgatgtccgggaaggggatcggaaaaatgacactcggcatgtgctgcattatcaccgccagcattctgctttggtacgctcagatccagcctcactggattgccgcctctatcatcctggagttctttctcattgtgctgctgatccccgaacccgagaagcaacggacccctcaggacaaccagctcacatatgttgtgattgctatccttaccgtggtcgccgcgacaatggccaatgaaatgggcttcctggagaaaacgaagaaagattttgggctgggatccattaccacacagcaaccggacagcaacatcctcgatatcgacctgcgccccgcttccgcctggaccctttacgctgttgccacaaccttcattacgcctatgctgagacattctatcgagaatagctccgtgaacgtgtctctcaccgcgattgccaatcaggctacagtcctgatgggcctggggaagggatggcccctcagcaagatggacatcggcgtgcctcttctggccattgggtgttactcccaggttaaccccatcaccctgacagctgccctcctgcttctggtggctcactatgccattatcggacctggcctccaggcgaaagccacccgggaagctcaaaagcgcgccgctgccggcatcatgaaaattccggccgcggatgggatcacggtcattgacctggatcccatcccttacgaccccaagtttgagaaacagctgggacaggtgatgctccttgtcctgtgcgtgacacaggttctgatgatgagaaccacatgggctctctgtgaagccctgacccttgctaccggccctattagcacactgtgggaggggaatcccggacggttctggaacacgaccatcgccgtgtctatggccaatatctttcgcggctcctatctcgctggggccggactgctgttcagcattatgaagaacacagcgaacaccagacggggcacaggcaataccggggaaacgctcggagagaagtggaaaaaccgccttaatgccctgggcaagtctgagtttcaaatctacaaaaagtccgggattcaggaagtcgatagaacactggctaaagagggaatcaagcggggcgaaaccgaccatcacgccgtgagcagagggtctgctaaactccgctggttcgttgagcggaacctggtgaccccggagggaaaggtcgtggatcttggctgcggcagagggggatggagctattactgtggcgggctgaagaatgtgaaagaagttaagggactcacaaaaggcgggcctggacatgaggaacccattcccatgtccacctatggctggaacctggtccgcctgcagtctggcgtggacgtgttctttacacctcccgagaagtgcgatacgctcctttgtgacatcggggaaagctcccctaatccgaccgtcgaggccggacggacactgagagttctgaacctcgtggagaattggctgaacaataacacccaattctgcatcaaagtgcttaatccctacatgcctagcgtcattgaaaagatggaggcgctgcagcgcaagtacggcggggccctcgtgcggaaccccctgtccagaaattctacacacgaaatgtattgggttagcaacgcttccggaaacatcgtgtctagcgtcaatatgatttcccgcatgctgatcaaccggtttaccatgaaacacaagaaagccacgtacgagcctgatgtggacctcggctctgggaccagaaatattggaatcgaaagcgagacacccaaccttgatatcattggcaagcgcatcgagaaaattaagcaggaacatgagacctcctggcactatgaccaggaccatccgtacaagacatgggcttatcacggcagctacgaaaccaaacaaacagggtctgcctccagcatggttaatggagtggtccggctgctgaccaagccttgggatgtgatccccatggtgacgcagatggctatgacagacaccacccctttcggccagcagagagtctttaaagagaaggttgatacacgcacgcaagaacccaaagaggggaccaagaagctcatgaaaattacagccgagtggctgtggaaggaacttggcaaaaagaaaacccctagaatgtgtacacgggaggagttcacccgcaaggtgagatctaacgcggccctgggcgctatctttacagacgagaataaatggaagtccgcccgggaggctgtggaagatagcgggttctgggagctcgtcgacaaggaaagaaacctgcacctggagggaaaatgcgaaacctgtgtgtataatatgatgggcaagcgggagaaaaagctcggcgagtttgggaaagccaagggatctcgcgccatttggtacatgtggctgggcgcgagattccttgaatttgaggctctggggttcctcaacgaagatcattggttttcccgggagaatagcctgtccggagttgaaggcgaggggcttcacaagctgggctacatcctccgcgacgtgagcaaaaaggagggaggcgccatgtatgccgatgacacggctgggtgggataccagaatcacactggaagacctgaaaaacgaggaaatggtcaccaatcatatggagggagaacaccggaagctcgccgaggctattttccgcctgacataccagaacaaagtggttagagtgcagcggcccaccccgcgcggcacggtcatggacatcatttctagacgggatcagcgcgggagcggacaagtggttacatatggccttaataccttcacaaacatggaggcccagctgatcagacagatggaaggggagggcgtgtttaagtccattcaacatctcaccgtcacggaagagatcgcggtgaagaactggctggagcgggtcggacgcgaaagactttctcggatggccatcagcggcgacgattgcgtggttaaacctctggacgatagattcgcttccgccctcaccgctctgaatgacatggggaaggtgcgcaaagatattcagcagtgggagccctctcggggatggaacgactggacacaggtccccttttgcagccaccacttccatgaactgatcatgaaggatggcagagtgctcgtggttccttgtcgcaatcaagacgagctgattgggcgggccagaatctcccagggagcgggctggtctcttcgcgaaaccgcctgcctggggaaaagctacgctcagatgtggtccctcatgtattttcaccggagagatctgcgccttgccgctaacgccatttgtagcgctgtgccgtctcattgggtccccatctcccggacaacctggagcatccacgccacacacgagtggatgaccacggaggacatgctgacagtgtggaatagagtttggattcaggaaaacccttggatggaggataagacccccgtggaatcttgggaggaaatcccttacctcggcaagcgcgaggaccaatggtgcggatccctgattggcctgaccagccgggcgacatgggccaaaaatatccagaccgctattaaccaggtcagatccctcatcgggaatgaggaatatacagactacatgccctctatgaagcggttcagacgcgaggaagaggaagccggagtgctgtggtga

SEQ ID NO: 19602 - RNA, 9876 nt, synthetic construct
  misc_feature 1..9876: note = derived and/or modified CDS sequence (opt5) from DENV-2__KM279515__SS-prME
  source 1..9876: mol_type = other RNA
accgccggaatcattatcatgatgattcccaccgtgatggctttccacctgacgaccagaaacggggaacctcatatgatcgtgagccggcaggaaaagggaaaatccctcctgtttaagaccgagaatggagttaacatgtgcacccttatggccatggacctgggggaactctgtgaggataccattacctacaattgcccgctgcttcgccaaaacgaacccgaggacatcgattgttggtgcaattctacgagcacctgggtgacgtatggaacctgtacagcgaccggcgagcaccggcgggaaaaacgctccgtggctctggtccctcatgtggggatgggactcgagacaagaaccgaaacgtggatgtctagcgagggcgcctggaagcacgcccagcggatcgagacatggattctgcgccatcccggcttcaccatcatggctgccattctggcttacacaatcgggaccacctattttcagagagttctcattttcatcctgcttacagccgtgacgccttccatggcgatgcggtgcattggaatctctaaccgcgactttgtcgaaggcgtgagcgggggatcctgggttgatatcgtgctggagcacggcagctgtgtcaccacaatggccaaaaataagcccaccctcgacttcgaactgattaagacagaggctaaacaccttgccaccctgagaaagtactgcgtggaagctaaactcacgaacacaaccaccgcctctcggtgtcctacacagggggagccgtccctgaatgaggaacaagataagcgctttgtgtgcaaacatagcatggtcgacagaggatggggcaacggctgtgggctgttcggaaagggcgggatcgttacctgcgcgatgtttacatgcaagaaaaatatggagggaaaggtggtgcagcccgaaaacctcgagtatacgattgtcatcacccctcactctggcgaagagaatgccgtggggaacgatacaggaaaacatggcaaggagattaaagttacaccccagtccagcatcacagaagctgagctgaccggctacgggacggtgaccatggaatgttctcctcggacaggacttgacttcaatgagatggtcctgctccagatggaaaacaaggcctggctggtgcaccgccaatggtttcttgatctgcccctcccgtggctgcctggcgctgacacccaggggtccaactggatccagaaagagacactggttaccttcaagaatccccacgccaagaaacaggatgtggtcgtgctcggaagccaagagggcgccatgcatacggctctgacaggggcgaccgaaattcagatgtcctctggcaaccttctgtttacaggacacctcaagtgcagactgcggatggacaaacttcagctgaagggcatgagctattccatgtgtaccgggaaattcaaggtcgtgaaggagatcgccgaaacccaacatggaacaattgttatcagagtgcagtacgagggcgacgggagcccttgcaaaattcccttcgagatcatggatctcgaaaagcgccacgctctgggacggctgatcacggtcaatcccattgtgaccgagaaagactctcctgttaacatcgaagccgagccgccctttggcgattcctacattatcattggggtggaacctggccagctcaagctgagctggttcaaaaagggatctagcatcggccagatgtttgagacaaccatgagaggggccaagcgcatggctattcttggagacacagcctgggatttcggctccctcgggggagtctttacctctatcggcaaagcgctccatcaagtgttcggggctatctatggcgccgcctttagcggagtgtcctggacgatgaagattctgatcggcgttgtcattacatggatcgggatgaatagccggtctacctccctgagcgtgtctcttgtgctcgtcggagtggttaccctgtacctgggcgtgatggtccaggctgactccgggtgtgtggttagctggaaaaacaaggagctcaaatgcggatccggcattttcatcacagataatgtgcacacctggacagaacagtataagtttcagcccgagtctcctagcaagctggcctccgctatccaaaaagcccacgaagaggggatttgtggcatcagatctgtcacgcgccttgaaaacctgatgtggaagcagattacccccgagctcaatcatatcctgacagagaacgaagtgaaactgaccattatgacaggagacatcaagggcatcatgcaggcggggaaacggagccttagaccgcagcctaccgagctcaagtactcctggaaagcctggggaaaggctaagatgctgagcacggaactgcacaatcataccttcctcattgatggccccgagacagccgaatgccctaacaccaatcgcgcttggaactctctggaggttgaggactatgggtttggagtgttcacaaccaatatctggcttaaactgaaggaacggcaagatgtcttttgtgactccaaactcatgagcgccgcgattaaggacaacagagccgtgcacgctgatatgggctactggatcgagtctgccctgaacgacacatggaaaattgaaaaggcttccttcatcgaggtcaagagctgccactggcccaaatctcataccctgtggagcaatggcgtccttgagtccgaaatgatcattcctaagaacttcgccgggcccgttagccagcacaattatcgcccgggataccatacgcagacagccggcccttggcacctcgggcggctggagatggattttgacttctgtgaaggaaccaccgtggtggtcacagaggattgcggcaacagagggccctctctgcggaccacgacagcttccggaaaactcatcaccgaatggtgctgtcgcagctgcacactgccccctcttagataccggggcgaggacggctgttggtatgggatggagattagaccgctgaaggaaaaagaggaaaatctcgtgaactccctggttaccgcgggacatggccagatcgataatttttctctgggggtgcttggaatggccctcttcctggaggaaatgctgcgcacacgggtcggcaccaagcacgctattctcctggtggccgttagctttgtgacgcttatcaccgggaacatgtccttcagagacctgggacgcgtcatggtgatggttggcgccacaatgaccgatgacattggcatgggggtgacatacctcgctctgctggccgcgtttaaggtcagacccaccttcgctgccggacttctgctccggaaactgacgtctaaggagctcatgatgacaaccatcggcatcgtgctgcttagccaatccacaattcctgagtctatcctggaactcaccgatgccctggctctggggatgatggtgcttaaaattgtccgcaatatggagaagtatcagctggccgttaccatcatggcgattctctgcgtgcccaacgctgtgatcctgcagaatgcctggaaagtcagctgtacaacgctcgccgtggtttccgtgagccctctgcttctgacctcttcccaacagaaggctgactggatccccctcgccctgacaattaagggactgaaccctaccgctatctttcttacaaccctgagcagaacgtctaaaaagcggtcctggcccctcaatgaagccattatggcggtcggcatggtgagcatcctggcctcttccctcctgaaaaacgatattccgatgacagggcctcttgttgctggaggcctgctgaccgtgtgctacgtcctcaccggccgcagcgccgacctggagcttgaaagagctgccgacgtgcggtgggaggagcaggccgaaatctccgggagctctcccatcctgagcattacaatctccgaggatggatctatgagcattaagaatgaagaggaggaacagaccctcacaatcctgattcgcacgggcctcctggtcatctccgggcttttccctgtgtctattcccatcaccgctgcggcctggtatctgtgggaggttaaaaagcaaagagctggagtgctgtgggacgtcccgagccctccccctgtgggcaaagccgaactcgaggatggggcctaccggatcaagcagaagggcattctgggctattcccagatcggcgctggggtttacaaagaaggaacatttcacaccatgtggcatgtgacacgcggcgccgtccttatgcacaaggggaaaagaattgagccctcttgggcggacgtgaagaaagatctgatcagctacggaggcgggtggaagctcgagggagaatggaaggagggcgaagaggtgcaggttctggctctcgaacccggcaaaaaccctcgggccgtccaaaccaagccggggctgttcaaaacgaacaccggaacaattggcgccgtgtcccttgactttagccccgggacctctggatcccctatcgtggataagaaaggcaaggtcgtggggctgtatggaaatggcgttgtgacaagaagcggcacctacgtctctgctatcgcccagacagagaagtccattgaggacaaccccgaaatcgaggatgacattttccgcaaaaagcggctgacgatcatggatctccatcctggggcgggaaaaaccaagagatatctgcccgctattgtgcgcgaagccatcaaacggggccttagaacactgatcctcgcccctacccgcgttgtggctgccgagatggaagaggctctgcgggggctcccgattagataccagacccccgccatccgcgcggagcacacaggacgggaaattgtcgacctgatgtgtcatgccacgttcaccatgagacttctgagccctatccgggtgcccaattataacctgattatcatggatgaggctcactttacagaccctgcctccattgctgcccgcggctacatctctaccagagttgaaatgggggaggccgctggcatcttcatgacagcgacacccccgggaagccgggacccttttccccagtccaatgcccccattatggatgaggaacgcgagatccctgaaagaagctggaactctggccacgagtgggtgacggacttcaaggggaagacagtctggtttgtgccctccattaaagctggaaatgatatcgccgcctgcctccggaagaacggcaaaaaggtgattcaactgagcagaaaaaccttcgactctgaatatatcaagacccgcacaaatgattgggactttgtcgttaccacagatatcagcgagatgggggctaacttcaaggccgagcgggtgattgaccctagacgctgtatgaaaccggtgatccttaccgatggagaggaacgggtcattctggcgggccccatgcctgtgacgcattcctctgctgcccagagacgcgggcgggttggcagaaatcccaagaacgaaaatgaccagtacatctacatgggagagcctctcgaaaacgatgaggactgcgcccactggaaagaggctaagatgctgctggacaatattaacacacccgaaggcatcatcccgagcatgtttgagcctgaacgcgagaaagtggatgccattgacggggaatatagactccggggagaggcgcgcaagaccttcgtcgatcttatgagacggggcgacctgcccgtgtggctggcctaccgcgttgctgccgaggggatcaactatgctgatagacggtggtgttttgacggagtgaaaaataaccaaattctcgaagagaatgtcgaagtggagatctggacaaaggagggcgaaagaaagaaactgaagcctcgctggcttgatgcccggatttactccgaccccctggctctcaaagagttcaaggagttcgccgcggggagaaaatctctgaccctgaacctcatcacggagatgggccgccttcctacctttatgacacagaaggccaagaatgctctggataacctggccgtcctccataccgctgaagccggaggccgggcctataatcacgctctgagcgagcttcccgagacactggaaaccctcctgctgctcacacttctggcgaccgtgacagggggaattttcctgtttctcatgtccggcaaagggatcggaaagatgacactgggcatgtgctgcatcattaccgccagcatccttctgtggtacgctcagattcagccgcactggatcgccgcctctattatcctcgagttctttctgatcgttctgctcattcctgaacccgagaaacaaagaacaccccaggacaaccagcttacatatgtggtgatcgctattctgaccgtcgttgccgcgacaatggccaatgaaatgggcttcctggagaagacgaaaaaggattttgggctcggatccatcaccacacagcaacctgagagcaacattctggacatcgatcttcggccggcttccgcctggaccctgtacgctgtggccacaaccttcatcacgcccatgctccgccattctattgaaaatagctccgtgaacgtctctctgaccgcgatcgccaatcaggctacagtgctgatgggcctcgggaagggatggcctcttagcaaaatggacattggcgttcccctgctggccatcgggtgttactcccaggtgaaccctattaccctcacagctgccctgcttctgctcgtcgctcactatgccatcattggacccggcctgcaggcgaaggccaccagagaggctcaaaaacgggccgctgccggcatcatgaagaatcctacggtggacgggatgacagtcatcgatctggacccgattccctacgatcctaaatttgaaaagcagctcggacaggtgatgcttctggttctgtgcgtgacccaggtcctcatgatgcgcacaacctgggccctgtgtgaggcgcttaccctggctacaggccccatcagcacgctctgggaagggaaccctggaagattctggaataccacaattgccgtgtctatggctaacatctttcggggctcctatctggccggggccggactgctgttcagcattatgaagaacaccgctaatacacgcagaggcaccggcaacacgggggagacacttggagagaaatggaagaatcggctgaacgccctgggcaaatctgaatttcaaatctacaagaaatccgggatccaggaggttgaccgcaccctcgcgaaggaaggaattaaaagaggcgagaccgatcatcacgccgtgagccgggggtctgctaagctgagatggttcgtcgagcgcaatcttgtgacacccgaaggaaaggtggttgacctgggctgcggcagagggggatggagctattactgtggcgggctcaaaaacgtcaaggaggtgaaaggactgaccaagggcgggccgggacatgaagaacctatccccatgtccacatatggctggaatctggtgagactccagtctggcgtcgatgttttctttacgccccctgaaaaatgcgacacccttctgtgtgatattggggagagctcccccaaccctacagtggaggccggacgcaccctgcgggtgctcaatctggtcgaaaactggcttaataacaatacacaattctgcatcaaggtgctgaacccgtacatgcccagcgttattgagaagatggaagctctccagagaaaatacggcggggccctggtgcgcaatcctctgtcccggaactctacccacgagatgtattgggtcagcaacgcgtccggaaatatcgtgtctagcgttaacatgatctccagaatgctcattaatcgctttacgatgcggcacaagaaagccacctacgaacccgacgtggatcttggctctgggacaagaaacatcggaattgagagcgagacccctaatctggacatcattggcaagcgcatcgagaagatcaagcaggagcatgaaacatcctggcactatgatcaggaccatccctacaagacctgggcttatcacggcagctacgagacaaaacaaaccgggtctgcctccagcatggtcaacggagtggtgcggctgctcacgaagccgtgggacgtcattcctatggttacacagatggctatgaccgataccacacccttcggccagcagagagtgtttaaagaaaaggtggacacgcgcacccaagagcctaaagaggggacaaagaagctgatgaaaatcaccgccgaatggctttggaaggagctgggcaaaaagaaaacacccagaatgtgtacccgggaagagttcacacgcaaggtcagatctaatgctgccctcggcgcgatttttaccgatgagaacaaatggaagtccgcccgggaagctgtggaggacagcgggttctgggaactggttgataaggagagaaatctgcacctcgaaggaaaatgcgagacgtgtgtgtataacatgatgggcaagcgggagaaaaagctgggcgaatttgggaaagccaagggatctcgcgctatctggtacatgtggcttggcgccagattcctggagtttgaagccctcgggttcctgaatgaggaccattggttttcccgggaaaacagcctttccggagtcgagggcgaggggctgcacaagctcggctacattctgcgcgatgtgagcaaaaaggaaggaggcgcgatgtatgctgacgataccgccgggtgggacacaagaatcaccctggaggatctcaaaaatgaagagatggttacaaaccatatggaaggagagcacaagaaactggccgaggctattttcaaacttacctaccagaataaggtggtccgggtgcagcgccctacgcccagaggcacagttatggacatcatctctcggcgcgaccagagagggagcggacaagtggtcacctatggcctgaacacattcaccaacatggaagcccagctcattcggcagatggagggggaaggcgtgtttaaatccatccaacagctgacggtcaaggaggagattgctgtgaaaaattggcttatccgcgttggaagagaacggctgtctcgcatggccattagcggcgatgactgcgtggtcaagccgctcgatgacagattcgcgtccgccctgaccgctctgaacgatatggggaaagtgcggaaggacatccagcagtgggagccttctagaggatggaatgattggacacaagtgcccttttgcagccatcacttccacgaactcatcatgaaggacggccgcgttctggtggtcccctgtcggaaccaggatgagcttattgggagagcccgcatctcccagggagctggctggtctctgcgggaaaccgcctgcctcgggaaaagctacgcgcagatgtggtccctgatgtattttcatagacgcgaccttcggctggccgctaatgccatttgtagcgctgtgccttctcactggatcccgacatccagaaccacatggagcattcatgccacccacgagtggatgacgacagaggatatgctcaccgtttggaaccgcgtgtggatccaagaaaatccctggatggaggacaagacccctgtcgaaacatgggaggaaatcccctacctgggcaaacgggaggatcagtggtgcggatctctgattggcctcacctccagagctacatgggccaagaacatccagacggcgattaatcaggtgcgcagcctgatcgggaacgaggaatataccgactacatgccttccatgaaacggttcagacgggaggaagaggaagccggagtcctttggtga

SEQ ID NO: 19603 - RNA, 9876 nt, synthetic construct
  misc_feature 1..9876: note = derived and/or modified CDS sequence (opt5) from DENV-2__KM279516__SS-prME
  source 1..9876: mol_type = other RNA
accgccggaatcattatcatgatgattcccaccgtgatggctttccacctgacgaccagaaacggggaacctcatatgatcgtcagccggcaggaaaagggaaaatccctcctgtttaagaccgagaatggagttaacatgtgcacccttatggccatggacctgggggaactctgtgaggataccattacctacaattgcccgctgcttcgccaaaacgaacccgaggacatcgattgttggtgcaattctacgagcacctgggtgacgtatggaacctgtacagcgaccggcgagcaccggcgggaaaaacgctccgtggctctggtccctcatgtggggatgggactcgagacaagaaccgaaacgtggatgtctagcgagggcgcctggaagcacgcccagcggatcgagacatggattctgcgccatcccggcttcaccatcatggctgccattctggcttacacaatcgggaccacctattttcagagagttctcattttcatcctgcttacagccgtgacgccttccatggcgatgcggtgcattggaatctctaaccgcgactttgtcgaaggcgtgagcgggggatcctgggttgatatcgtgctggagcacggcagctgtgtcaccacaatggccaaaaataagcccaccctcgacttcgaactgattaagacagaggctaaacaccttgccaccctgagaaagtactgcgtggaagctaaactcacgaacacaaccaccgcctctcggtgtcctacacagggggagccgtccctgaatgaggaacaagataagcgctttgtgtgcaaacatagcatggtcgacagaggatggggcaacggctgtgggctgttcggaaagggcgggatcgttacctgcgcgatgtttacatgcaagaaaaatatggagggaaaggtggtgcagcccgaaaacctcgagtatacgattgtcatcacccctcactctggcgaagagaatgccgtggggaacgatacaggaaaacatggcaaggagattaaagttacaccccagtccagcatcacagaagctgagctgaccggctacgggacggtgaccatggaatgttctcctcggacaggacttgacttcaatgagatggtcctgctccagatggaaaacaaggcctggctggtgcaccgccaatggtttcttgatctgcccctcccgtggctgcctggcgctgacacccaggggtccaactggatccagaaagagacactggttaccttcaagaatccccacgccaagaaacaggatgtggtcgtgctcggaagccaagagggcgccatgcatacggctctgacaggggcgaccgaaattcagatgtcctctggcaaccttctgtttacaggacacctcaagtgcagactgcggatggacaaacttcagctgaagggcatgagctattccatgtgtaccgggaaattcaaggtcgtgaaggagatcgccgaaacccaacatggaacaattgttatcagagtgcagtacgagggcgacgggagcccttgcaaaattcccttcgagatcatggatctcgaaaagcgccacgtcctgggacggctgatcacggtgaatcccattgttaccgagaaagactctcctgtgaacatcgaagctgagccgccctttggcgattcctacattatcattggggtcgaacctggccagctcaagctgagctggttcaaaaagggatctagcatcggccagatgtttgagacaaccatgagaggggccaagcgcatggccattcttggagacacagcttgggatttcggctccctcgggggagtgtttacctctatcggcaaagccctccatcaagtgttcggggcgatctatggcgctgcctttagcggagtttcctggacgatgaagattctgatcggcgtcgtgattacatggatcgggatgaatagccggtctacctccctgagcgtgtctcttgtcctcgtgggagttgtgaccctgtacctgggcgtcatggtgcaggccgactccgggtgtgttgtgagctggaaaaacaaggagctcaaatgcggatccggcattttcatcacagataatgtccacacctggacagaacagtataagtttcagcccgagtctcctagcaagctggcttccgccatccaaaaagctcacgaagaggggatttgtggcatcagatctgtgacgcgccttgaaaacctgatgtggaagcagattacccccgagctcaatcatatcctgacagagaacgaagttaaactgaccattatgacaggagacatcaagggcatcatgcaggccgggaaacggagccttagaccgcagcctaccgagctcaagtactcctggaaagcgtggggaaaggccaagatgctgagcacggaactgcacaatcataccttcctcattgatggccccgagacagctgaatgccctaacaccaatcgcgcctggaactctctggaggtggaggactatgggtttggagtcttcacaaccaatatctggcttaaactgaaggaacggcaagatgtgttttgtgactccaaactcatgagcgctgccattaaggacaacagagcggtgcacgccgatatgggctactggatcgagtctgctctgaacgacacatggaaaattgaaaaggcctccttcatcgaggtcaagagctgccactggcccaaatctcataccctgtggagcaatggcgttcttgagtccgaaatgatcattcctaagaacttcgctgggcccgtgagccagcacaattatcgcccgggataccatacgcagacagccggcccttggcacctcgggcggctggagatggattttgacttctgtgaaggaaccaccgtggtcgtgacagaggattgcggcaacagagggccctctctgcggaccacgacagcctccggaaaactcatcaccgaatggtgctgtcgcagctgcacactgccccctcttagataccggggcgaggacggctgttggtatgggatggagattagaccgctgaaggaaaaagaggaaaatctcgttaactccctggtgaccgctggacatggccagatcgataatttttctctgggggtccttggaatggcgctgttcctggaggaaatgctgcgcacacgggtgggcaccaagcacgccattctcctggttgctgtgagctttgtcacgcttatcaccgggaacatgtccttcagagacctgggacgcgtgatggttatggtgggcgccacaatgaccgatgacattggcatgggggtcacatacctcgccctgctggctgcctttaaggtgagacccaccttcgcggctggacttctgctccggaaactgacgtctaaggagctcatgatgacaaccatcggcatcgtgctgcttagccaatccacaattcctgagaatatcctggaactcaccgatgccctggccctggggatgatggtccttaaaattgttcgcaacatggagaagtatcagctggctgtgaccatcatggccattctctgcgtgcccaatgcggtcatcctgcagaacgcttggaaagtgtcttgtacaacgctcgccgttgtgagcgtctcccctctgcttctgaccagctctcaacagaaggccgactggatccccctcgctctgacaattaagggactgaatcctaccgccatctttcttacaaccctgtccagaacgagcaaaaagcggtcttggcccctcaacgaagctattatggccgtgggcatggtttccatcctggcgagctctctcctgaaaaatgatattccgatgacagggcctcttgtggccggaggcctgctgaccgtctgctacgtgctcaccggccgctccgctgacctggagcttgaaagagccgctgacgtccggtgggaggagcaggccgaaatcagcgggtccagccccatcctgtctattacaatcagcgaggatggatccatgtctattaagaacgaagaggaggaacagaccctcacaatcctgattcgcacgggcctcctggtgatcagcgggcttttccctgtttccattcccatcaccgccgctgcgtggtatctgtgggaggtgaaaaagcaaagagccggagtcctgtgggacgtgccgtctcctccccctgttggcaaagctgaactcgaggatggggcctaccggatcaagcagaagggcattctgggctatagccagatcggcgccggggtgtacaaagaaggaacatttcacaccatgtggcatgtcacacgcggcgctgtgcttatgcacaaggggaaaagaattgagccctcctgggccgacgtgaagaaagatctgatctcttacggaggcgggtggaagctcgagggagaatggaaggagggcgaagaggttcaggtcctggcgctcgaacccggcaaaaaccctcgggctgtgcaaaccaagccggggctgttcaaaacgaataccggaacaattggcgccgtgagccttgacttttcccccgggaccagcggatctcctatcgtcgataagaaaggcaaggtggttgggctgtatggaaacggcgtggtcacaagatccggcacctacgtgagcgccatcgctcagacagagaagtctattgaggacaatcccgaaatcgaggatgacattttccgcaaaaagcggctgacgatcatggatctccatcctggggccggaaaaaccaagagatatctgcccgcgattgttcgcgaagctatcaaacggggccttagaacactgatcctcgcccctacccgcgtggtcgccgctgagatggaagaggccctgcgggggctcccgattagataccagacccccgctatccgcgccgagcacacaggacgggaaattgtggacctgatgtgtcatgcgacgttcaccatgagacttctgtcccctatccgggttcccaactataatctgattatcatggatgaggcccactttacagaccctgctagcattgccgctcgcggctacatctccaccagagtggaaatgggggaggccgccggcatcttcatgacagctacacccccgggatctcgggacccttttccccagagcaacgcgcccattatggatgaggaacgcgagatccctgaaagatcctggaatagcggccacgagtgggtcacggacttcaaggggaagacagtgtggtttgtgccctctattaaagccggaaacgatatcgctgcctgcctccggaagaatggcaaaaaggtcattcaactgtccagaaaaaccttcgacagcgaatatatcaagacccgcacaaacgattgggactttgttgtgaccacagatatctctgagatgggggccaatttcaaggctgagcgggtgattgaccctagacgctgtatgaaaccggtcatccttaccgatggagaggaacgggtgattctggccggccccatgcctgttacgcatagctccgcggctcagagacgcgggcgggtgggcagaaaccccaagaatgaaaacgaccagtacatctacatgggagagcctctcgaaaatgatgaggactgcgcccactggaaagaggccaagatgctgctggacaacattaacacacccgaaggcatcatcccgtctatgtttgagcctgaacgcgagaaagtcgatgctattgacggggaatatagactccggggagaggcccgcaagaccttcgtggatcttatgagacggggcgacctgcccgtttggctggcgtaccgcgtggccgctgaggggatcaattatgccgatagacggtggtgttttgacggagtcaaaaacaatcaaattctcgaagagaacgtggaagtcgagatctggacaaaggagggcgaaagaaagaaactgaagcctcgctggcttgatgctcggatttacagcgaccccctggccctcaaagagttcaaggagttcgctgccgggagaaaatccctgaccctgaatctcatcacggagatgggccgccttcctacctttatgacacagaaggcgaagaacgccctggataatctggctgtgctccataccgccgaagctggaggccgggcctataaccacgccctgtctgagcttcccgagacactggaaaccctcctgctgctcacacttctggctaccgttacagggggaattttcctgtttctcatgagcggcaaagggatcggaaagatgacactgggcatgtgctgcatcattaccgcgtccatccttctgtggtacgcccagattcagccgcactggatcgctgccagcattatcctcgagttctttctgatcgtgctgctcattcctgaacccgagaaacaaagaacaccccaggacaatcagcttacatatgtggtcatcgccattctgaccgttgtggctgccacaatggcgaacgaaatgggcttcctggagaagacgaaaaaggattttgggctcggatctatcaccacacagcaacctgagtccaatattctggacatcgatcttcggccggccagcgcttggaccctgtacgccgtggctacaaccttcatcacgcccatgctccgccattccattgaaaactctagcgtcaatgtgtccctgaccgccatcgcgaaccaggccacagttctgatgggcctcgggaagggatggcctctttctaaaatggacattggcgtgcccctgctggctatcgggtgttacagccaggtcaatcctattaccctcacagccgctctgcttctgctcgtggcccactatgctatcattggacccggcctgcaggccaaggcgaccagagaggcccaaaaacgggctgccgctggcatcatgaagaaccctacggtcgacgggatgacagtgatcgatctggacccgattccctacgatcctaaatttgaaaagcagctcggacaggttatgcttctggtgctgtgcgtcacccaggtgctcatgatgcgcacaacctgggccctgtgtgaggcccttaccctggcgacaggccccatctccacgctctgggaagggaatcctggaagattctggaacaccacaattgctgttagcatggccaacatctttcggggctcttatctggctggggccggactcctgttctccattatgaagaataccgccaacacacgcagaggcaccggcaatacgggggagacacttggagagaaatggaagaaccggctgaatgctctgggcaaaagcgaatttcaaatctacaagaaatctgggatccaggaggtggaccgcaccctcgccaaggaaggaattaaaagaggcgagaccgatcatcacgcggtctcccgggggagcgccaagctgagatggttcgtggagcgcaaccttgtgacacccgaaggaaaggttgtcgacctgggctgcggcagagggggatggtcttattactgtggcgggctcaaaaatgtgaaggaggtgaaaggactgaccaagggcgggccgggacatgaagaacctatccccatgagcacatatggctggaacctggtcagactccagtccggcgttgatgtgttctttacgccccctgaaaaatgcgacacccttctgtgtgatattggggagtctagccccaatcctacagtggaggctggacgcaccctgcgggtcctcaacctggtggaaaattggcttaacaataacacacaattctgcatcaaggttctgaatccgtacatgccctccgtgattgagaagatggaagccctccagagaaaatacggcggggctctggtccgcaaccctctgagccggaactccacccacgagatgtattgggtgtctaatgccagcggaaacatcgtttcctctgtgaatatgatcagcagaatgctcattaaccgctttacgatgcggcacaagaaagcgacctacgaacccgacgtcgatcttggctccgggacaagaaatatcggaattgagtctgagacccctaacctggacatcattggcaagcgcatcgagaagatcaagcaggagcatgaaacaagctggcactatgatcaggaccatccctacaagacctgggcctatcacggctcctacgagacaaaacaaaccgggagcgcttcttccatggtgaatggagtggtccggctgctcacgaagccgtgggacgttattcctatggtgacacagatggccatgaccgataccacacccttcggccagcagagagtgtttaaagaaaaggtcgacacgcgcacccaagagcctaaagaggggacaaagaagctgatgaaaatcaccgctgaatggctttggaaggagctgggcaaaaagaaaacacccagaatgtgtacccgggaagagttcacacgcaaggtgagaagcaacgccgctctcggcgccatttttaccgatgagaataaatggaagtctgcgcgggaagccgttgaggactccgggttctgggaactggtggataaggagagaaacctgcacctcgaaggaaaatgcgagacgtgtgtctataatatgatgggcaagcgggagaaaaagctgggcgaatttgggaaagctaagggaagccgcgccatctggtacatgtggcttggcgctagattcctggagtttgaagccctcgggttcctgaacgaggaccattggttttctcgggaaaattcccttagcggagtggagggcgaggggctgcacaagctcggctacattctgcgcgatgtttccaaaaaggaaggaggcgccatgtatgcggacgataccgctgggtgggacacaagaatcaccctggaggatctcaaaaacgaagagatggtgacaaatcatatggaaggagagcacaagaaactggccgaggccattttcaaacttacctaccagaacaaggtcgtgcgggttcagcgccctacgcccagaggcacagtgatggacatcatcagccggcgcgaccagagagggtctggacaagtcgtgacctatggcctgaacacattcaccaatatggaagctcagctcattcggcagatggagggggaaggcgtctttaaaagcatccaacagctgacggtgaaggaggagattgccgttaaaaactggcttatccgcgtgggaagagaacggctgtcccgcatggctatttctggcgatgactgcgtcgtgaagccgctcgatgacagattcgccagcgcgctgaccgccctgaatgatatggggaaagtgcggaaggacatccagcagtgggagccttccagaggatggaacgattggacacaagttcccttttgctctcatcacttccacgaactcatcatgaaggacggccgcgtgctggtcgtgccctgtcggaatcaggatgagcttattgggagagctcgcatcagccagggagccggctggtccctgcgggaaaccgcttgcctcgggaaatcttacgcccagatgtggagcctgatgtattttcatagacgcgaccttcggctggcggccaacgctatttgttccgccgttcctagccactggatcccgacatctagaaccacatggtccattcatgctacccacgagtggatgacgacagaggatatgctcaccgtgtggaatcgcgtctggatccaagaaaacccctggatggaggacaagacccctgtggaaagctgggaggaaatcccctacctgggcaaacgggaggatcagtggtgcggatctctgattggcctcacatccagagccacctgggctaagaatatccagacagccattaaccaggtccgcagcctgatcgggaatgaggaatatacggactacatgccttccatgaaacggttcagacgggaggaagaggaagcgggagtgctttggtga

SEQ ID NO: 19604 - RNA, 9876 nt, synthetic construct
  misc_feature 1..9876: note = derived and/or modified CDS sequence (opt5) from DENV-2__KM279517__SS-prME
  source 1..9876: mol_type = other RNA
accgccggaatcattatcatgatgattcccaccgtgatggctttccacctgacgaccagaaacggggaacctcatatgatcgtctcccggcaggaaaagggaaaatccctcctgtttaagacggagaatggagttaacatgtgcacccttatggccatggacctgggggaactctgtgaggatacaattacctacaattgcccgctgcttcgccaaaacgaacccgaggacatcgattgttggtgcaattctacaagcacctgggtgacgtatggaacctgtacagcgaccggcgagcaccggcgggaaaaacgctccgtggctctggtccctcatgtggggatgggactcgagacaagaaccgaaacgtggatgtctagcgagggcgcctggaagcacgcccagcggatcgagacatggattctgcgccatcccggcttcaccatcatggctgccattctggcttacacaatcgggaccacctattttcagagagttctcattttcatcctgcttacagccgtgacgccttccatggcgatgcggtgcattggaatctctaaccgcgactttgtcgaaggcgtgagcgggggatcctgggttgatatcgtgctggagcacggcagctgtgtcaccacaatggccaaaaataagcccaccctcgacttcgaactgattaagacagaggctaaacaccttgccaccctgagaaagtactgcgtggaagctaaactcacgaacacaaccaccgcctctcggtgtcctacacagggggagccgtccctgaatgaggaacaagataagcgctttgtgtgcaaacatagcatggtcgacagaggatggggcaacggctgtgggctgttcggaaagggcgggatcgttacctgcgcgatgtttacatgcaagaaaaatatggagggaaaggtggtgcagcccgaaaacctcgagtatacgattgtcatcacccctcactctggcgaagagaatgccgtggggaacgatacaggaaaacatggcaaggagattaaagttacaccccagtccagcatcacagaagctgagctgaccggctacgggacggtgaccatggaatgttctcctcggacaggacttgacttcaatgagatggtcctgctccagatggaaaacaaggcctggctggtgcaccgccaatggtttcttgatctgcccctcccgtggctgcctggcgctgacacccaggggtccaactggatccagaaagagacactggttaccttcaagaatccccacgccaagaaacaggatgtggtcgtgctcggaagccaagagggcgccatgcatacggctctgacaggggcgaccgaaattcagatgtcctctggcaaccttctgtttacaggacacctcaagtgcagactgcggatggacaaacttcagctgaagggcatgagctattccatgtgtaccgggaaattcaaggtcgtgaaggagatcgccgaaacccaacatggaacaattgttatcagagtgcagtacgagggcgacgggagcccttgcaaaattcccttcgagatcatggatctcgaaaagcgccacgtcctgggacggctgatcacggtgaatcccattgttaccgagaaagactctcctgtgaacatcgaagctgagccgccctttggcgattcctacattatcattggggtcgaacctggccagctcaagctgagctggttcaaaaagggatctagcatcggccagatgtttgagacaaccatgagaggggccaagcgcatggccattcttggagacacagcttgggatttcggctccctcgggggagtgtttacctctatcggcaaagccctccatcaagtgttcggggcgatctatggcgctgcctttagcggagtttcctggacgatgaagattctgatcggcgtcgtgattacatggatcgggatgaatagccggtctacctccctgagcgtgtctcttgtcctcgtgggagttgtgaccctgtacctgggcgtcatggtgcaggccgactccgggtgtgttgtgagctggaaaaacaaggagctcaaatgcggatccggcattttcatcacagataatgtccacacctggacagaacagtataagtttcagcccgagtctcctcccaagctggctagcgccatccaaaaagctcacgaagaggggatttgtggcatcagatccgtgacgcgccttgaaaacctgatgtggaagcagattaccccggagctcaatcatatcctgacagagaacgaagttaaactgaccattatgacaggagacatcaagggcatcatgcaggccgggaaacggtctcttagacctcagcccaccgagctcaagtacagctggaaagcgtggggaaaggccaagatgctgtccacggaactgcacaatcataccttcctcattgatggccctgagacagctgaatgccccaacaccaatcgcgcctggaacagcctggaggtggaggactatgggtttggagtcttcacaaccaatatctggcttaaactgaaggaacggcaagatgtgttttgtgactctaaactcatgtccgctgccattaaggacaacagagcggtgcacgccgatatgggctactggatcgagagcgctctgaacgacacatggaaaattgaaaaggcctctttcatcgaggtcaagtcctgccactggcctaaaagccataccctgtggtctaatggcgttcttgagagcgaaatgatcattcccaagaacttcgctgggccggtgtcccagcacaattatcgccctggataccatacgcagacagccggcccctggcacctcgggcggctggagatggattttgacttctgtgaaggaaccaccgtggtcgtgacagaggattgcggcaacagagggcccagcctgcggaccacgacagcctctggaaaactcatcaccgaatggtgctgtcgctcctgcacactgcctccgcttagataccggggcgaggacggctgttggtatgggatggagattagacccctgaaggaaaaagaggaaaatctcgttaacagcctggtgaccgctggacatggccagatcgataatttttccctgggggtccttggaatggcgctgttcctggaggaaatgctgcgcacacgggtgggcaccaagcacgccattctcctggttgctgtgtcttttgtcacgcttatcaccgggaacatgagcttcagagacctgggacgcgtgatggttatggtgggcgccacaatgaccgatgacattggcatgggggtcacatacctcgccctgctggctgcctttaaggtgagacctaccttcgcggctggacttctgctccggaaactgacgtccaaggagctcatgatgacaaccatcggcatcgtgctgctttctcaaagcacaattcccgagtccatcctggaactcaccgatgccctggccctggggatgatggtccttaaaattgttcgcaatatggagaagtatcagctggctgtgaccatcatggccattctctgcgtgcctaacgcggtcatcctgcagaatgcttggaaagtgtcttgtacaacgctcgccgttgtgagcgtcagccccctgcttctgaccagctctcaacagaaggccgactggatccctctcgctctgacaattaagggactgaaccccaccgccatctttcttacaaccctgtccagaacgagcaaaaagcggtcttggccgctcaatgaagctattatggccgtgggcatggtttccatcctggcgagctctctcctgaaaaacgatattcctatgacagggccccttgtggccggaggcctgctgaccgtctgctacgtgctcaccggccgctccgctgacctggagcttgaaagagccgctgacgtccggtgggaggagcaggccgaaatcagcgggtccagccctatcctgtctattacaatcagcgaggatggatccatgtctattaagaatgaagaggaggaacagaccctcacaatcctgattcgcacgggcctcctggtgatcagcgggcttttccccgtttccattccgatcaccgccgctgcgtggtatctgtgggaggtgaaaaagcaaagagccggagtcctgtgggacgtgccttctccccctcccgttggcaaagctgaactcgaggatggggcctaccggatcaagcagaagggcattctgggctatagccagatcggcgccggggtgtacaaagaaggaacatttcacaccatgtggcatgtcacacgcggcgctgtgcttatgcacaaggggaaaagaattgagccctcctgggccgacgtgaagaaagatctgatctcttacggaggcgggtggaagctcgagggagaatggaaggagggcgaagaggttcaggtcctggcgctcgaacctggcaaaaacccgcgggctgtgcaaaccaagcccgggctgttcaaaacgaacaccggaacaattggcgccgtgagccttgacttttcccctgggaccagcggatctcccatcgtcgataagaaaggcaaggtggttgggctgtatggaaatggcgtggtcacaagatccggcacctacgtgagcgccatcgctcagacagagaagtctattgaggacaaccctgaaatcgaggatgacattttccgcaaaaagcggctgacgatcatggatctccatcccggggccggaaaaaccaagagatatctgcctgcgattgttcgcgaagctatcaaacggggccttagaacactgatcctcgccccgacccgcgtggtcgccgctgagatggaagaggccctgcgggggctccccattagataccagacccctgctatccgcgccgagcacacaggacgggaaattgtggacctgatgtgtcatgcgacgttcaccatgagacttctgtcccccatccgggttcctaattataacctgattatcatggatgaggcccactttacagaccccgctagcattgccgctcgcggctacatctccaccagagtggaaatgggggaggccgccggcatcttcatgacagctaccccgcctggatctcgggacccctttccccagagcaatgcgcctattatggatgaggaacgcgagatccccgaaagatcctggaacagcggccacgagtgggtcacggacttcaaggggaagacagtgtggtttgtgccttctattaaagccggaaatgatatcgctgcctgcctccggaagaacggcaaaaaggtcattcaactgtccagaaaaaccttcgacagcgaatatatcaagacccgcacaaatgattgggactttgttgtgaccacagatatctctgagatgggggccaacttcaaggctgagcgggtgattgacccgagacgctgtatgaaacccgtcatccttaccgatggagaggaacgggtgattctggccggccctatgcccgttacgcatagctccgcggctcagagacgcgggcgggtgggcagaaatcctaagaacgaaaatgaccagtacatctacatgggagagcccctcgaaaacgatgaggactgcgcccactggaaagaggccaagatgctgctggacaatattaacacaccggaaggcatcatcccttctatgtttgagcccgaacgcgagaaagtcgatgctattgacggggaatatagactccggggagaggcccgcaagaccttcgtggatcttatgagacggggcgacctgcctgtttggctggcgtaccgcgtggccgctgaggggatcaactatgccgatagacggtggtgttttgacggagtcaaaaataaccaaattctcgaagagaatgtggaagtcgagatctggacaaaggagggcgaaagaaagaaactgaagccccgctggcttgatgctcggatttacagcgaccctctggccctcaaagagttcaaggagttcgctgccgggagaaaatccctgaccctgaacctcatcacggagatgggccgccttcccacctttatgacacagaaggcgaagaatgccctggataacctggctgtgctccataccgccgaagctggaggccgggcctataatcacgccctgtctgagcttccggagacactggaaaccctcctgctgctcacacttctggctaccgttacagggggaattttcctgtttctcatgagcggcaaagggatcggaaagatgacactgggcatgtgctgcatcattaccgcgtccatccttctgtggtacgcccagattcagcctcactggatcgctgccagcattatcctcgagttctttctgatcgtgctgctcattcccgaacccgagaaacaaagaacccctcaggacaaccagcttacatatgtggtcatcgccattctgaccgttgtggctgccacaatggcgaatgaaatgggcttcctggagaagacgaaaaaggattttgggctcggatctatcaccacacagcaaccggagtccaacattctggacatcgatcttcggcccgccagcgcttggaccctgtacgccgtggctacaaccttcatcacgcctatgctccgccattccattgaaaattctagcgtcaacgtgtccctgaccgccatcgcgaatcaggccacagttctgatgggcctcgggaagggatggcccctttctaaaatggacattggcgtgcctctgctggctatcgggtgttacagccaggtcaaccccattaccctcacagccgctctgcttctgctcgtggcccactatgctatcattggacctggcctgcaggccaaggcgaccagagaggcccaaaaacgggctgccgctggcatcatgaagaatccgacggtcgacgggatgacagtgatcgatctggaccccattccttacgatcccaaatttgaaaagcagctcggacaggttatgcttctggtgctgtgcgtcacccaggtgctcatgatgcgcacaacctgggccctgtgtgaggcccttaccctggcgacaggccctatctccacgctctgggaagggaaccccggaagattctggaataccacaattgctgttagcatggccaacatctttcggggctcttatctggctggggccggactcctgttctccattatgaagaacaccgccaatacacgcagaggcaccggcaacacgggggagacacttggagagaaatggaagaatcggctgaacgctctgggcaaaagcgaatttcaaatctacaagaaatctgggatccaggaggtggaccgcaccctcgccaaggaaggaattaaaagaggcgagaccgatcatcacgcggtctcccgggggagcgccaagctgagatggttcgtggagcgcaatcttgtgacaccggaaggaaaggttgtcgacctgggctgcggcagagggggatggtcttattactgtggcgggctcaaaaacgtgaaggaggtgaaaggactgaccaagggcgggcctggacatgaagaacccatccccatgagcacatatggctggaatctggtcagactccagtccggcgttgatgtgttctttacgcctcccgaaaaatgcgacacccttctgtgtgatattggggagtctagccctaacccgacagtggaggctggacgcaccctgcgggtcctcaatctggtggaaaactggcttaataacaatacacaattctgcatcaaggttctgaacccctacatgccttccgtgattgagaagatggaaaccctccagagaaaatacggcggggccctggtccgcaatcccctgagccggaactccacgcacgagatgtattgggtgtctaacgctagcggaaatatcgtttcctctgtgaacatgatcagcagaatgctcattaatcgctttaccatgcggcacaagaaagccacatacgaacctgacgtcgatcttggctccgggaccagaaacatcggaattgagtctgagacacccaatctggacatcattggcaagcgcatcgagaagatcaagcaggagcatgaaaccagctggcactatgatcaggaccatccgtacaagacatgggcgtatcacggctcctacgagaccaaacaaacggggagcgcctcttccatggtgaacggagtggtccggctgctcacaaagccttgggacgttattcccatggtgacccagatggctatgaccgatacaacgcctttcggccagcagagagtgtttaaagaaaaggtcgacacccgcacacaagagcccaaagaggggaccaagaagctgatgaaaatcacagccgaatggctttggaaggagctgggcaaaaagaaaacccctagaatgtgtacacgggaagagttcacccgcaaggtgagaagcaatgctgccctcggcgctatttttacggatgagaacaaatggaagtctgcccgggaagcggttgaggactccgggttctgggaactggtggataaggagagaaatctgcacctcgaaggaaaatgcgagacctgtgtctataacatgatgggcaagcgggagaaaaagctgggcgaatttgggaaagccaagggaagccgcgctatctggtacatgtggcttggcgccagattcctggagtttgaagctctcgggttcctgaatgaggaccattggttttctcgggaaaactcccttagcggagtggagggcgaggggctgcacaagctcggctacattctgcgcgatgtttccaaaaaggaaggaggcgccatgtatgccgacgatacagcggggtgggacaccagaatcacactggaggatctcaaaaatgaagagatggtgaccaaccatatggaaggagagcacaagaaactggctgaggccattttcaaacttacgtaccagaataaggtcgtgcgggttcagcgccccacaccgagaggcaccgtgatggacatcatcagccggcgcgaccagagagggtctggacaagtcgtgacatatggcctgaacaccttcacgaacatggaagcccagctcattcggcagatggagggggaaggcgtctttaaaagcatccaacagctgaccgtgaaggaggagattgctgttaaaaattggcttatccgcgtgggaagagaacggctgtcccgcatggccatttctggcgatgactgcgtcgtgaagcctctcgatgacagattcgctagcgccctgacagcgctgaacgatatggggaaagtgcggaaggacatccagcagtgggagccctccagaggatggaatgattggacccaagttcccttttgctctcatcacttccacgaactcatcatgaaggacggccgcgtgctggtcgtgccttgtcggaaccaggatgagcttattgggagagcccgcatcagccagggagctggctggtccctgcgggaaacagcctgcctcgggaaatcttacgctcagatgtggagcctgatgtattttcatagacgcgaccttcggctggccgcgaatgccatttgttccgctgttccgagccactggatccccacctctagaacaacctggtccattcatgccacgcacgagtggatgacaaccgaggatatgctcaccgtgtggaaccgcgtctggatccaagaaaatccttggatggaggacaagacacccgtggaaagctgggaggaaatcccttacctgggcaaacgggaggatcagtggtgcggatctctgattggcctcacctccagagctacatgggccaagaacatccagacggctattaatcaggtccgcagcctgatcgggaacgaggaatataccgactacatgccctccatgaaacggttcagacgggaggaagaggaagccggagtgctttggtga

SEQ ID NO: 19605 - RNA, 9876 nt, synthetic construct
  misc_feature 1..9876: note = derived and/or modified CDS sequence (opt5) from DENV-2__KM279518__SS-prME
  source 1..9876: mol_type = other RNA
accgccggaatcattatcatgatgattcccaccgtgatggctttccacctgacgaccagaaacggggaacctcatatgatcgtcagccggcaggaaaagggaaaatccctcctgtttaagaccgagaatggagttaacatgtgcacccttatggccatggacctgggggaactctgtgaggataccattacctacaattgcccgctgcttcgccaaaacgaacccgaggacatcgattgttggtgcaattctacgagcacctgggtgacgtatggaacctgtacagcgaccggcgagcaccggcgggaaaaacgctccgtggctctggtccctcatgtggggatgggactcgagacaagaaccgaaacgtggatgtctagcgagggcgcctggaagcacgcccagcggatcgagacatggattctgcgccatcccggcttcaccatcatggctgccattctggcttacacaatcgggaccacctattttcagagagttctcattttcatcctgcttacagccgtgacgccttccatggcgatgcggtgcattggaatctctaaccgcgactttgtcgaaggcgtgagcgggggatcctgggttgatatcgtgctggagcacggcagctgtgtcaccacaatggccaaaaataagcccaccctcgacttcgaactgattaagacagaggctaaacaccttgccaccctgagaaagtactgcgtggaagctaaactcacgaacacaaccaccgcctctcggtgtcctacacagggggagccgtccctgaatgaggaacaagataagcgctttgtgtgcaaacatagcatggtcgacagaggatggggcaacggctgtgggctgttcggaaagggcgggatcgttacctgcgcgatgtttacatgcaagaaaaatatggagggaaaggtggtgcagcccgaaaacctcgagtatacgattgtcatcacccctcactctggcgaagagaatgccgtggggaacgatacaggaaaacatggcaaggagattaaagttacaccccagtccagcatcacagaagctgagctgaccggctacgggacggtgaccatggaatgttctcctcggacaggacttgacttcaatgagatggtcctgctccagatggaaaacaaggcctggctggtgcaccgccaatggtttcttgatctgcccctcccgtggctgcctggcgctgacacccaggggtccaactggatccagaaagagacactggttaccttcaagaatccccacgccaagaaacaggatgtggtcgtgctcggaagccaagagggcgccatgcatacggctctgacaggggcgaccgaaattcagatgtcctctggcaaccttctgtttacaggacacctcaagtgcagactgcggatggacaaacttcagctgaagggcatgagctattccatgtgtaccgggaaattcaaggtcgtgaaggagatcgccgaaacccaacatggaacaattgttatcagagtgcagtacgagggcgacgggagcccttgcaaaattcccttcgagatcatggatctcgaaaagcgccacgtcctgggacggctgatcacggtgaatcccattgttaccgagaaagactctcctgtgaacatcgaagctgagccgccctttggcgattcctacattatcattggggtcgaacctggccagctcaagctgagctggttcaaaaagggatctagcatcggccagatgtttgagacaaccatgagaggggccaagcgcatggccattcttggagacacagcttgggatttcggctccctcgggggagtgtttacctctatcggcaaagccctccatcaagtgttcggggcgatctatggcgctgcctttagcggagtttcctggacgatgaagattctgatcggcgtcgtgattacatggatcgggatgaatagccggtctacctccctgagcgtgtctcttgtcctcgtgggagttgtgaccctgtacctgggcgtcatggtgcaggccgactccgggtgtgttgtgagctggaaaaacaaggagctcaaatgcggatccggcattttcatcacagataatgtccacacctggacagaacagtataagtttcagcccgagtctcctagcaagctggcttccgccatccaaaaagctcacgaagaggggatttgtggcatcagatctgtgacgcgccttgaaaacctgatgtggaagcagattacccccgagctcaatcatatcctgacagagaacgaagttaaactgaccattatgacaggagacatcaagggcatcatgcaggccgggaaacggagccttagaccgcagcctaccgagctcaagtactcctggaaagcgtggggaaaggccaagatgctgagcacggaactgcacaatcataccttcctcattgatggccccgagacagctgaatgccctaacaccaatcgcgcctggaactctctggaggtggaggactatgggtttggagtcttcacaaccaatatctggcttaaactgaaggaacggcaagatgtgttttgtgactccaaactcatgagcgctgccattaaggacaacagagcggtgcacgccgatatgggctactggatcgagtctgctctgaacgacacatggaaaattgaaaaggcctccttcatcgaggtcaagagctgccactggcccaaatctcataccctgtggagcaatggcgttcttgagtccgaaatgatcattcctaagaacttcgctgggcccgtgagccagcacaattatcgcccgggataccatacgcagacagccggcccttggcacctcgggcggctggagatggattttgacttctgtgaaggaaccaccgtggtcgtgacagaggattgcggcaacagagggccctctctgcggaccacgacagcctccggaaaactcatcaccgaatggtgctgtcgcagctgcacactgccccctcttagataccggggcgaggacggctgttggtatgggatggagattagaccgctgaaggaaaaagaggaaaatctcgttaactccctggtgaccgctggacatggccagatcgataatttttctctgggggtccttggaatggcgctgttcctggaggaaatgctgcgcacacgggtgggcaccaagcacgccattctcctggttgctgtgagctttgtcacgcttatcaccgggaacatgtccttcagagacctgggacgcgtgatggttatggtgggcgccacaatgaccgatgacattggcatgggggtcacatacctcgccctgctggctgcctttaaggtgagacccaccttcgcggctggacttctgctccggaaactgacgtctaaggagctcatgatgacaaccatcggcatcgtgctgcttagccaatccacaattcctgagtctatcctggaactcaccgatgccctggccctggggatgatggtccttaaaattgttcgcaatatggagaagtatcagctggctgtgaccatcatggccattctctgcgtgcccaacgcggtcatcctgcagaatgcttggaaagtgagctgtacaacgctcgccgttgtgtccgtcagccctctgcttctgacctcttcccaacagaaggccgactggatccccctcgctctgacaattaagggactgaaccctaccgccatctttcttacaaccctgagcagaacgtctaaaaagcggtcctggcccctcaatgaagctattatggccgtgggcatggttagcatcctggcgtcttccctcctgaaaaacgatattccgatgacagggcctcttgtggccggaggcctgctgaccgtctgctacgtgctcaccggccgcagcgctgacctggagcttgaaagagccgctgacgtccggtgggaggagcaggccgaaatctccgggagctctcccatcctgagcattacaatctccgaggatggatctatgagcattaagaatgaagaggaggaacagaccctcacaatcctgattcgcacgggcctcctggtgatctccgggcttttccctgtttctattcccatcaccgccgctgcgtggtatctgtgggaggtgaaaaagcaaagagccggagtcctgtgggacgtgccgagccctccccctgttggcaaagctgaactcgaggatggggcctaccggatcaagcagaagggcattctgggctattcccagatcggcgccggggtgtacaaagaaggaacatttcacaccatgtggcatgtcacacgcggcgctgtgcttatgcacaaggggaaaagaattgagccctcttgggccgacgtgaagaaagatctgatcagctacggaggcgggtggaagctcgagggagaatggaaggagggcgaagaggttcaggtcctggcgctcgaacccggcaaaaaccctcgggctgtgcaaaccaagccggggctgttcaaaacgaacaccggaacaattggcgccgtgtcccttgactttagccccgggacctctggatcccctatcgtcgataagaaaggcaaggtggttgggctgtatggaaatggcgtggtcacaagaagcggcacctacgtgtctgccatcgctcagacagagaagtccattgaggacaaccccgaaatcgaggatgacattttccgcaaaaagcggctgacgatcatggatctccatcctggggccggaaaaaccaagagatatctgcccgcgattgttcgcgaagctatcaaacggggccttagaacactgatcctcgcccctacccgcgtggtcgccgctgagatggaagaggccctgcgggggctcccgattagataccagacccccgctatccgcgccgagcacacaggacgggaaattgtggacctgatgtgtcatgcgacgttcaccatgagacttctgagccctatccgggttcccaattataacctgattatcatggatgaggcccactttacagaccctgcttccattgccgctcgcggctacatctctaccagagtggaaatgggggaggccgccggcatcttcatgacagctacacccccgggaagccgggacccttttccccagtccaatgcgcccattatggatgaggaacgcgagatccctgaaagaagctggaactctggccacgagtgggtcacggacttcaaggggaagacagtgtggtttgtgccctccattaaagccggaaatgatatcgctgcctgcctccggaagaacggcaaaaaggtcattcaactgagcagaaaaaccttcgactctgaatatatcaagacccgcacaaatgattgggactttgttgtgaccacagatatcagcgagatgggggccaacttcaaggctgagcgggtgattgaccctagacgctgtatgaaaccggtcatccttaccgatggagaggaacgggtgattctggccggccccatgcctgttacgcattcctctgcggctcagagacgcgggcgggtgggcagaaatcccaagaacgaaaatgaccagtacatctacatgggagagcctctcgaaaacgatgaggactgcgcccactggaaagaggccaagatgctgctggacaatattaacacacccgaaggcatcatcccgagcatgtttgagcctgaacgcgagaaagtcgatgctattgacggggaatatagactccggggagaggcccgcaagaccttcgtggatcttatgagacggggcgacctgcccgtttggctggcgtaccgcgtggccgctgaggggatcaactatgccgatagacggtggtgttttgacggagtcaaaaataaccaaattctcgaagagaatgtggaagtcgagatctggacaaaggagggcgaaagaaagaaactgaagcctcgctggcttgatgctcggatttactccgaccccctggccctcaaagagttcaaggagttcgctgccgggagaaaatctctgaccctgaacctcatcacggagatgggccgccttcctacctttatgacacagaaggcgaagaatgccctggataacctggctgtgctccataccgccgaagctggaggccgggcctataatcacgccctgagcgagcttcccgagacactggaaaccctcctgctgctcacacttctggctaccgttacagggggaattttcctgtttctcatgtccggcaaagggatcggaaagatgacactgggcatgtgctgcatcattaccgcgagcatccttctgtggtacgcccagattcagccgcactggatcgctgcctctattatcctcgagttctttctgatcgtgctgctcattcctgaacccgagaaacaaagaacaccccaggacaaccagcttacatatgtggtcatcgccattctgaccgttgtggctgccacaatggcgaatgaaatgggcttcctggagaagacgaaaaaggattttgggctcggatccatcaccacacagcaacctgagagcaacattctggacatcgatcttcggccggcctccgcttggaccctgtacgccgtggctacaaccttcatcacgcccatgctccgccattctattgaaaatagctccgtcaacgtgtctctgaccgccatcgcgaatcaggccacagttctgatgggcctcgggaagggatggcctcttagcaaaatggacattggcgtgcccctgctggctatcgggtgttactcccaggtcaaccctattaccctcacagccgctctgcttctgctcgtggcccactatgctatcattggacccggcctgcaggccaaggcgaccagagaggcccaaaaacgggctgccgctggcatcatgaagaatcctacggtcgacgggatgacagtgatcgatctggacccgattccctacgatcctaaatttgaaaagcagctcggacaggttatgcttctggtgctgtgcgtcacccaggtgctcatgatgcgcacaacctgggccctgtgtgaggcccttaccctggcgacaggccccatcagcacgctctgggaagggaaccctggaagattctggaataccacaattgctgtttctatggccaacatctttcggggctcctatctggctggggccggactcctgttcagcattatgaagaacaccgccaatacacgcagaggcaccggcaacacgggggagacacttggagagaaatggaagaatcggctgaacgctctgggcaaatctgaatttcaaatctacaagaaatccgggatccaggaggtggaccgcaccctcgccaaggaaggaattaaaagaggcgagaccgatcatcacgcggtcagccgggggtctgccaagctgagatggttcgtggagcgcaatcttgtgacacccgaaggaaaggttgtcgacctgggctgcggcagagggggatggagctattactgtggcgggctcaaaaacgtgaaggaggtgaaaggactgaccaagggcgggccgggacatgaagaacctatccccatgtccacatatggctggaatctggtcagactccagtctggcgttgatgtgttctttacgccccctgaaaaatgcgacacccttctgtgtgatattggggagagctcccccaaccctacagtggaggctggacgcaccctgcgggtcctcaatctggtggaaaactggcttaataacaatacacaattctgcatcaaggttctgaacccgtacatgcccagcgtgattgagaagatggaagccctccagagaaaatacggcggggctctggtccgcaatcctctgtcccggaactctacccacgagatgtattgggtgagcaacgcctccggaaatatcgtttctagcgtgaacatgatctccagaatgctcattaatcgctttacgatgcggcacaagaaagcgacctacgaacccgacgtcgatcttggctctgggacaagaaacatcggaattgagagcgagacccctaatctggacatcattggcaagcgcatcgagaagatcaagcaggagcatgaaacatcctggcactatgatcaggaccatccctacaagacctgggcctatcacggcagctacgagacaaaacaaaccgggtctgcttccagcatggtgaacggagtggtccggctgctcacgaagccgtgggacgttattcctatggtgacacagatggccatgaccgataccacacccttcggccagcagagagtgtttaaagaaaaggtcgacacgcgcacccaagagcctaaagaggggacaaagaagctgatgaaaatcaccgctgaatggctttggaaggagctgggcaaaaagaaaacacccagaatgtgtacccgggaagagttcacacgcaaggtgagatctaatgccgctctcggcgccatttttaccgatgagaacaaatggaagtccgcgcgggaagccgttgaggacagcgggttctgggaactggtggataaggagagaaatctgcacctcgaaggaaaatgcgagacgtgtgtctataacatgatgggcaagcgggagaaaaagctgggcgaatttgggaaagctaagggatctcgcgccatctggtacatgtggcttggcgctagattcctggagtttgaagccctcgggttcctgaatgaggaccattggttttcccgggaaaacagcctttccggagtggagggcgaggggctgcacaagctcggctacattctgcgcgatgttagcaaaaaggaaggaggcgccatgtatgcggacgataccgctgggtgggacacaagaatcaccctggaggatctcaaaaatgaagagatggtgacaaaccatatggaaggagagcacaagaaactggccgaggccattttcaaacttacctaccagaataaggtcgtgcgggttcagcgccagacgcctagaggcacagtgatggacatcatctctcggcgcgaccaaagagggagcggacaggtcgtgacctatggcctgaacacattcaccaacatggaagctcagctcattcggcaaatggagggggaaggcgtctttaaatccatccagcagctgacggtgaaggaggagattgccgttaaaaattggcttatccgcgtgggaagagaacggctgtctcgcatggctattagcggcgatgactgcgtcgtgaagcccctcgatgacagattcgcctccgcgctgaccgccctgaacgatatggggaaagtgcggaaggacatccagcaatgggagccgtctagaggatggaatgattggacacaggttcctttttgcagccatcacttccacgaactcatcatgaaggacggccgcgtgctggtcgtgccctgtcggaaccaggatgagcttattgggagagctcgcatctcccagggagccggctggtctctgcgggaaaccgcttgcctcgggaaaagctacgcccaaatgtggtccctgatgtattttcatagacgcgaccttcggctggcggccaatgctatttgtagcgccgttccctctcactggatccctacatccagaaccacatggagcattcatgctacccacgagtggatgacgacagaggatatgctcaccgtgtggaaccgcgtctggatccaggaaaatccgtggatggaggacaagacccccgtggaatcttgggaggaaatcccttacctgggcaaacgggaggatcagtggtgcggatccctgattggcctcacaagcagagccacctgggctaagaacatccagacagccattaatcaagtccgctccctgatcgggaacgaggaatatacggactacatgccctctatgaaacggttcagacgggaggaagaggaagcgggagtgctttggtga

SEQ ID NO: 19606 - RNA, 9876 nt, synthetic construct
  misc_feature 1..9876: note = derived and/or modified CDS sequence (opt5) from DENV-2__KM279519__SS-prME
  source 1..9876: mol_type = other RNA
accgccggaatcattatcatgatgattcccaccgtgatggctttccacctgacgaccagaaacggggagcctcatatgatcgtcagccggcaggaaaagggaaaatccctcctgtttaagaccgagaatggcgttaacatgtgcacccttatggccatggacctgggggaactctgtgaggataccattacctacaattgcccgctgcttagacaaaacgaacccgaggacatcgattgttggtgcaattctacgagcacctgggtgacgtatggaacctgtacagcgaccggcgagcacagacgggaaaaacgctccgtggctctggtccctcatgtggggatgggactcgagacaagaaccgaaacgtggatgtctagcgagggcgcctggaagcacgcccagcggatcgagacatggattctgcgccatcccggcttcaccatcatggctgccattctggcttacacaatcgggaccacctattttcagagagttctcattttcatcctgcttacagccgtgacgccttccatggcgatgcggtgcattggaatctctaaccgcgactttgtcgaaggcgtgagcgggggatcctgggttgatatcgtgctggagcacggcagctgtgtcaccacaatggccaaaaataagcccaccctcgacttcgaactgattaagacagaggctaaacaccttgccaccctgagaaagtactgcgtggaagctaaactcacgaacacaaccaccgcctctcggtgtcctacacagggggagccgtccctgaatgaggaacaagataagcgctttgtgtgcaaacatagcatggtcgacagaggatggggcaacggctgtgggctgttcggaaagggcgggatcgttacctgcgcgatgtttacatgcaagaaaaatatggagggaaaggtggtgcagcccgaaaacctcgagtatacgattgtcatcacccctcactctggcgaagagaatgccgtggggaacgatacaggaaaacatggcaaggagattaaagttacaccccagtccagcatcacagaagctgagctgaccggctacgggacggtgaccatggaatgttctcctcggacaggacttgacttcaatgagatggtcctgctccagatggaaaacaaggcctggctggtgcaccgccaatggtttcttgatctgcccctcccgtggctgcctggcgctgacacccaggggtccaactggatccagaaagagacactggttaccttcaagaatccccacgccaagaaacaggatgtggtcgtgctcggaagccaagagggcgccatgcatacggctctgacaggggcgaccgaaattcagatgtcctctggcaaccttctgtttacaggacacctcaagtgcagactgcggatggacaaacttcagctgaagggcatgagctattccatgtgtaccgggaaattcaaggtcgtgaaggagatcgccgaaacccaacatggaacaattgttatcagagtgcagtacgagggcgacgggagcccttgcaaaattcccttcgagatcatggatctcgaaaagcgccacgtcctgggacggctgatcacggtgaatcccattgttaccgagaaagactctcctgtgaacatcgaagctgagccgccctttggcgattcctacattatcattggggtcgaacctggccagctcaagctgagctggttcaaaaagggatctagcatcggccagatgtttgagacaaccatgagaggggccaagcgcatggccattcttggagacacagcttgggatttcggctccctcggcggggtgtttacctctatcgggaaagccctccatcaagtgttcggggcgatctatggcgctgcctttagcggagtttcctggacgatgaagattctgatcggcgtcgtgattacatggatcgggatgaatagccggtctacctccctgagcgtgtctcttgtcctcgtgggagttgtgaccctgtacctgggcgtcatggtgcaggccgactccgggtgtgttgtgagctggaaaaacaaggagctcaaatgcggatccggcattttcatcacagataatgtccacacctggacagaacagtataagtttcagcccgagtctcctagcaagctggcttccgccatccaaaaagctcacgaagaggggatttgtggcatcagatctgtgacgcgccttgaaaacctgatgtggaagcagattacccccgagctcaatcatatcctgacagagaacgaagttaaactgaccattatgacaggagacatcaagggcatcatgcaggccgggaaacggagccttagaccgcagcctaccgagctcaagtactcctggaaagcgtggggaaaggccaagatgctgagcacggaactgcacaatcataccttcctcattgatggccccgagacagctgaatgccctaacaccaatcgcgcctggaactctctggaggtggaggactatgggtttggagtcttcacaaccaatatctggcttaaactgaaggaacggcaagatgtgttttgtgactccaaactcatgagcgctgccattaaggacaacagagcggtgcacgccgatatgggctactggatcgagtctgctctgaacgacacatggaaaattgaaaaggcctccttcatcgaggtcaagagctgccactggcccaaatctcataccctgtggagcaatggcgttcttgagtccgaaatgatcattcctaagaacttcgctgggcccgtgagccagcacaattatcgcccgggataccatacgcagacagccggcccttggcacctcgggcggctggagatggattttgacttctgtgaaggaaccaccgtggtcgtgacagaggattgcggcaacagagggccctctctgcggaccacgacagcctccggaaaactcatcaccgaatggtgctgtcgcagctgcacactgccccctcttagataccggggcgaggacggctgttggtatgggatggagattagaccgctgaaggaaaaagaggaaaatctcgttaactccctggtgaccgctggacatggccagatcgataatttttctctgggggtccttggaatggcgctgttcctggaggaaatgctgcgcacacgggtgggcaccaagcacgccattctcctggttgctgtgagctttgtcacgcttatcaccgggaacatgtccttcagagacctgggacgcgtgatggttatggtgggcgccacaatgaccgatgacattggcatgggggtcacatacctcgccctgctggctgcctttaaggtgagacccaccttcgcggctggacttctgctccggaaactgacgtctaaggagctcatgatgacaaccatcggcatcgtgctgcttagccaatccacaattcctgagtctatcctggaactcaccgatgccctggccctggggatgatggtccttaaaattgttcgcaatatggagaagtatcagctggctgtgaccatcatggccattctctgcgtgcccaacgcggtcatcctgcagaatgcttggaaagtgagctgtacaacgctcgccgttgtgtccgtcagccctctgcttctgacctcttcccaacagaaggccgactggatccccctcgctctgacaattaagggactgaaccctaccgccatctttcttacaaccctgagcagaacgtctaaaaagcggtcctggcccctcaatgaagctattatggccgtgggcatggttagcatcctggcgtcttccctcctgaaaaacgatattccgatgacagggcctcttgtggccggaggcctgctgaccgtctgctacgtgctcaccggccgcagcgctgacctggagcttgaaagagccgctgacgtccggtgggaggagcaggccgaaatctccgggagctctcccatcctgagcattacaatctccgaggatggatctatgagcattaagaatgaagaggaggaacagaccctcacaatcctgattcgcacgggcctcctggtgatctccgggcttttccctgtttctattcccatcaccgccgctgcgtggtatctgtgggaggtgaaaaagcaaagagccggagtcctgtgggacgtgccgagccctccccctgttggcaaagctgaactcgaggatggggcctaccggatcaagcagaagggcattctgggctattcccagatcggcgccggggtgtacaaagaaggaacatttcacaccatgtggcatgtcacacgcggcgctgtgcttatgcacaaggggaaaagaattgagccctcttgggccgacgtgaagaaagatctgatcagctacggaggcgggtggaagctcgagggagaatggaaggagggcgaagaggttcaggtcctggcgctcgaacccggcaaaaaccctcgggctgtgcaaaccaagccggggctgttcaaaacgaacaccggaacaattggcgccgtgtcccttgactttagccccgggacctctggatcccctatcgtcgataagaaaggcaaggtggttgggctgtatggaaatggcgtggtcacaagaagcggcacctacgtgtctgccatcgctcagacagagaagtccattgaggacaaccccgaaatcgaggatgacattttccgcaaaaagcggctgacgatcatggatctccatcctggggccggaaaaaccaagagatatctgcccgcgattgttcgcgaagctatcaaacggggccttagaacactgatcctcgcccctacccgcgtggtcgccgctgagatggaagaggccctgcgggggctcccgattagataccagacccccgctatccgcgccgagcacacaggacgggaaattgtggacctgatgtgtcatgcgacgttcaccatgagacttctgagccctatccgggttcccaattataacctgattatcatggatgaggcccactttacagaccctgcttccattgccgctcgcggctacatctctaccagagtggaaatgggggaggccgccggcatcttcatgacagctacacccccgggaagccgggacccttttccccagtccaatgcgcccattatggatgaggaaaaggagatccctgaacgcagctggaactctggccacgagtgggtcacggacttcaaggggaaaacagtgtggtttgtgccctccattaaggccggaaatgatatcgctgcctgcctccgcaagaacggcaagaaagtcattcaactgagccggaagaccttcgactctgaatatatcaagaccagaacaaatgattgggactttgttgtgaccacagatatcagcgagatgggggccaacttcaaagctgagcgcgtgattgaccctcggagatgtatgaagccggtcatccttaccgatggagaggaacgcgtgattctggccggccccatgcctgttacgcattcctctgcggctcagcggagagggcgcgtgggccggaatcccaaaaacgaaaatgaccagtacatctacatgggagagcctctcgaaaacgatgaggactgcgcccactggaaggaggccaaaatgctgctggacaatattaacacacccgaaggcatcatcccgagcatgtttgagcctgaaagagagaaggtcgatgctattgacggggaatatcgcctcagaggagaggcccggaaaaccttcgtggatcttatgcgcagaggcgacctgcccgtttggctggcgtaccgggtggccgctgaggggatcaactatgccgatcgcagatggtgttttgacggagtcaagaataaccaaattctcgaagagaatgtggaagtcgagatctggacaaaggagggcgaacggaaaaagctgaaacctagatggcttgatgctcgcatttactccgaccccctggccctcaaggagttcaaagagttcgctgccgggcggaagtctctgaccctgaacctcatcacggagatgggcagacttcctacctttatgacacagaaggcgaaaaatgccctggataacctggctgtgctccataccgccgaagctggaggccgcgcctataatcacgccctgagcgagcttcccgagacactggaaaccctcctgctgctcacacttctggctaccgttacagggggaattttcctgtttctcatgtccggcaaggggatcggaaaaatgacactgggcatgtgctgcatcattaccgcgagcatccttctgtggtacgcccagattcagccgcactggatcgctgcctctattatcctcgagttctttctgatcgtgctgctcattcctgaacccgagaagcaacggacaccccaggacaaccagcttacatatgtggtcatcgccattctgaccgttgtggctgccacaatggcgaatgaaatgggcttcctggagaaaacgaagaaggattttgggctcggatccatcaccacacagcaacctgagagcaacattctggacatcgatcttagaccggcctccgcttggaccctgtacgccgtggctacaaccttcatcacgcccatgctccggcattctattgaaaatagctccgtcaacgtgtctctgaccgccatcgcgaatcaggccacagttctgatgggcctcgggaaaggatggcctcttagcaagatggacattggcgtgcccctgctggctatcgggtgttactcccaggtcaaccctattaccctcacagccgctctgcttctgctcgtggcccactatgctatcattggacccggcctgcaggccaaagcgacccgcgaggcccaaaagagagctgccgctggcatcatgaaaaatcctacggtcgacgggatgacagtgatcgatctggacccgattccctacgatcctaagtttgaaaagcagctcggacaggttatgcttctggtgctgtgcgtcacccaggtgctcatgatgcggacaacctgggccctgtgtgaggcccttaccctggcgacaggccccatcagcacgctctgggaagggaaccctggacgcttctggaataccacaattgctgtttctatggccaacatctttagaggctcctatctggctggggccggactcctgttcagcattatgaaaaacaccgccaatacacggcgcggcaccggcaacacgggggagacacttggagagaagtggaaaaatagactgaacgctctgggcaagtctgaatttcaaatctacaaaaagtccgggatccaggaggtggaccggaccctcgccaaagaaggaattaagcgcggcgagaccgatcatcacgcggtcagcagagggtctgccaagctgcggtggttcgtggagagaaatcttgtgacacccgaaggaaaagttgtcgacctgggctgcggccgcgggggatggagctattactgtggcgggctcaagaacgtgaaagaggtgaagggactgaccaaaggcgggccgggacatgaagaacctatccccatgtccacatatggctggaatctggtccggctccagtctggcgttgatgtgttctttacgccccctgaaaagtgcgacacccttctgtgtgatattggggagagctcccccaaccctacagtggaggctggaagaaccctgcgcgtcctcaatctggtggaaaactggcttaataacaatacacaattctgcatcaaggttctgaacccgtacatgcccagcgtgattgagaaaatggaagccctccagcggaagtacggcggggctctggtcagaaatcctctgtcccgcaactctacccacgagatgtattgggtgagcaacgcctccggaaatatcgtttctagcgtgaacatgatctcccggatgctcattaatagatttacgatgcgccacaaaaaggcgacctacgaacccgacgtcgatcttggctctgggacacggaacatcggaattgagagcgagacccctaatctggacatcattggcaaaagaatcgaaaagatcaagcaggagcatgaaacatcctggcactatgatcaggaccatccctacaaaacctgggcctatcacggcagctacgagacaaagcaaaccgggtctgcttccagcatggtgaacggagtggtccgcctgctcacgaaaccgtgggacgttattcctatggtgacacagatggccatgaccgataccacacccttcggccagcagcgggtgtttaaggaaaaagtcgacacgagaacccaagagcctaaggaggggacaaagaaactgatgaagatcaccgctgaatggctttggaaagagctgggaaagaaaaagacaccccgcatgtgtaccagagaagagttcacacggaaagtgcgctctaatgccgctctcggcgccatttttaccgatgagaacaagtggaagtccgcgagagaagccgttgaggacagcgggttctgggaactggtggataaagagcggaatctgcacctcgaaggaaagtgcgagacgtgtgtctataacatgatgggcaaaagagagaagaaactgggcgaatttgggaaggctaagggatctcgggccatctggtacatgtggcttggcgctcgcttcctggagtttgaagccctcgggttcctgaatgaggaccattggttttccagagaaaacagcctttccggagtggagggcgaggggctgcacaaactcggctacattctgcgggatgttagcaagaaagaaggaggcgccatgtatgcggacgataccgctgggtgggacacacgcatcaccctggaggatctcaagaatgaagagatggtgacaaaccatatggaaggagagcacaaaaagctggccgaggccattttcaaacttacctaccagaataaagtcgtgagagttcagcggcctacgccccgcggcacagtgatggacatcatctctagacgggaccagcgcgggagcggacaagtcgtgacctatggcctgaacacattcaccaacatggaagctcagctcattagacagatggagggggaaggcgtctttaagtccatccaacagctgacggtgaaagaggagattgccgttaagaattggcttatccgggtgggacgcgaaagactgtctcggatggctattagcggcgatgactgcgtcgtgaaaccgctcgatgaccgcttcgcctccgcgctgaccgccctgaacgatatggggaaggtgagaaaggacatccagcagtgggagccttctcggggatggaatgattggacacaagttcccttttgcagccatcacttccacgaactcatcatgaaagacggcagagtgctggctgtcccctgtcgcaaccaggatgagcttattgggcgggccagaatctcccagggagctggctggtctctgcgcgaaaccgcctgcctcggaaagagctacgcgcagatgtggtccctgatgtattttcatcggagagaccttcgcctggccgctaatgccatttgtagcgctgtgccttctcactggatcccgacatcccggaccacatggagcattcatgccacccacgagtggatgacgacagaggatatgctcaccgtttggaacagagtgtggatccaagaaaatccctggatggaggacaaaacccctgtcgaatcttgggaggaaatcccctacctgggcaagcgcgaggatcagtggtgcggatccctgattggcctcacaagccgggctacctgggccaaaaacatccagacagcgattaatcaggtgagatccctgatcgggaacgaggaatatacggactacatgccttctatgaagcgcttccggagagaggaagaggaagccggagtcctttggtga

SEQ ID NO: 19607 - RNA, 9876 nt, synthetic construct
  misc_feature 1..9876: note = derived and/or modified CDS sequence (opt5) from DENV-2__KM279520__SS-prME
  source 1..9876: mol_type = other RNA
accgccggcatcattatcatgatgattcccaccgtgatggctttccacctgacgaccagaaacggggagcctcatatgatcgtgagccggcaggaaaagggaaaatccctcctgtttaagaccgagaatggcgttaacatgtgcacccttatggccatggacctgggggaactctgtgaggatacgattacctacaattgcccgctgcttagacaaaacgaacccgaggacatcgattgttggtgcaattctacaagcacctgggtgacgtatggaacctgtacagcgaccggcgagcacagacgggaaaaacgctccgtggctctggtccctcatgtggggatgggactcgagacaagaaccgaaacgtggatgtctagcgagggcgcctggaagcacgcccagcggatcgagacatggattctgcgccatcccggcttcaccatcatggctgccattctggcttacacaatcgggaccacctattttcagagagttctcattttcatcctgcttacagccgtgacgccttccatggcgatgcggtgcattggaatctctaaccgcgactttgtcgaaggcgtgagcgggggatcctgggttgatatcgtgctggagcacggcagctgtgtcaccacaatggccagaaataaacccaccctcgacttcgaactgattaagacagaggctaagcaccttgccaccctgcggaaatactgcgtggaagctaagctcacgaacacaaccaccgcctctcgctgtcctacacagggggagccgtccctgaatgaggaacaagataaaagatttgtgtgcaagcatagcatggtcgaccggggatggggcaacggctgtgggctgttcggaaaaggcgggatcgttacctgcgcgatgtttacatgcaagaagaatatggagggaaaagtggtgcagcccgaaaacctcgagtatacgattgtcatcacccctcactctggcgaagagaatgccgtggggaacgatacaggaaagcatggcaaagagattaaggttacaccccagtccagcatcacagaagctgagctgaccggctacgggacggtgaccatggaatgttctcctcgcacaggacttgacttcaatgagatggtcctgctccagatggaaaacaaagcctggctggtgcacagacaatggtttcttgatctgcccctcccgtggctgcctggcgctgacacccaggggtccaactggatccagaaggagacactggttaccttcaaaaatccccacgccaagaagcaggatgtggtcgtgctcggaagccaagagggcgccatgcatacggctctgacaggggcgaccgaaattcagatgtcctctggcaaccttctgtttacaggacacctcaaatgccggctgagaatggacaaacttcagctgaaaggcatgagctattccatgtgtaccgggaagttcaaagtcgtgaaggagatcgccgaaacccaacatggaacaattgttatccgcgtgcagtacgagggcgacgggagcccttgcaagattcccttcgagatcatggatctcgaaaaacggcacgctctgggaagactgatcacggtcaatcccattgtgaccgagaaggactctcctgttaacatcgaagccgagccgccctttggcgattcctacattatcattggggtggaacctggccagctcaaactgagctggttcaagaaaggatctagcatcggccagatgtttgagacaaccatgcgcggggccaagcggatggctattcttggagacacagcctgggatttcggctccctcggaggggtctttacctctatcggcaaggcgctccatcaagtgttcggggctatctatggcgccgcctttagcggagtgtcctggacgatgaaaattctgatcggcgttgtcattacatggatcgggatgaatagcagatctacctccctgagcgtgtctcttgtgctcgtcggagtggttaccctgtacctgggcgtgatggtccaggctgactccgggtgtgtggttagctggaagaacaaagagctcaagtgcggatccggcattttcatcacagataatgtgcacacctggacagaacagtataaatttcagcccgagtctcctagcaagctggcctccgctatccaaaaggcccacgaagaggggatttgtggcatccgctctgtcacgcggcttgaaaacctgatgtggaaacagattacccccgagctcaatcatatcctgacagagaacgaagtgaagctgaccattatgacaggagacatcaaaggcatcatgcaggcggggaagagaagccttcgcccgcagcctaccgagctcaaatactcctggaaggcctggggaaaagctaagatgctgagcacggaactgcacaatcataccttcctcattgatggccccgagacagccgaatgccctaacaccaatcgggcttggaactctctggaggttgaggactatgggtttggagtgttcacaaccaatatctggcttaagctgaaagaaagacaagatgtcttttgtgactccaagctcatgagcgccgcgattaaagacaaccgcgccgtgcacgctgatatgggctactggatcgagtctgccctgaacgacacatggaagattgaaaaggcttccttcatcgaggtcaagagctgccactggcccaagtctcataccctgtggagcaatggcgtccttgagtccgaaatgatcattcctaaaaacttcgccgggcccgttagccagcacaattatcggccgggataccatacgcagacagccggcccttggcacctcgggagactggagatggattttgacttctgtgaaggaaccaccgtggtggtcacagaggattgcggcaaccgggggccctctctgcgcaccacgacagcttccggaaagctcatcaccgaatggtgctgtagaagctgcacactgccccctcttcggtacagaggcgaggacggctgttggtatgggatggagattcgcccgctgaaagaaaaggaggaaaatctcgtgaactccctggttaccgcgggacatggccagatcgataatttttctctgggggtgcttggaatggccctcttcctggaggaaatgctgcggacaagagtcggcaccaaacacgctattctcctggtggccgttagctttgtgacgcttatcaccgggaacatgtccttccgcgacctgggaagagtcatggtgatggttggcgccacaatgaccgatgacattggcatgggggtgacatacctcgctctgctggccgcgtttaaggtccggcccaccttcgctgccggacttctgctccgcaagctgacgtctaaagagctcatgatgacaaccatcggcatcgtgctgcttagccaatccacaattcctgagtctatcctggaactcaccgatgccctggctctggggatgatggtgcttaagattgtcagaaatatggagaaatatcagctggccgttaccatcatggcgattctctgcgtgcccaacgctgtgatcctgcagaatgcctggaaggtcagctgtacaacgctcgccgtggtttccgtgagccctctgcttctgacctcttcccaacagaaagctgactggatccccctcgccctgacaattaagggactgaaccctaccgctatctttcttacaaccctgagccggacgtctaagaaacgctcctggcccctcaatgaagccattatggcggtcggcatggtgagcatcctggcctcttccctcctgaagaacgatattccgatgacagggcctcttgttgctggaggcctgctgaccgtgtgctacgtcctcaccggcagaagcgccgacctggagcttgaacgggctgccgacgtgcgctgggaggagcaggccgaaatctccgggagctctcccatcctgagcattacaatctccgaggatggatctatgagcattaaaaatgaagaggaggaacagaccctcacaatcctgattagaacgggcctcctggtcatctccgggcttttccctgtgtctattcccatcaccgctgcggcctggtatctgtgggaggttaagaaacaacgggctggagtgctgtgggacgtcccgagccctccccctgtgggcaaggccgaactcgaggatggggcctaccgcatcaaacagaaggggattctgggctattcccagatcggcgctggggtttacaaggaaggaacatttcacaccatgtggcatgtgacaagaggcgccgtccttatgcacaaagggaagcggattgagccctcttgggcggacgtgaaaaaggatctgatcagctacggaggcgggtggaaactcgagggagaatggaaggagggcgaagaggtgcaggttctggctctcgaacccggcaagaaccctagagccgtccaaaccaaaccggggctgttcaagacgaacaccggaacaattggcgccgtgtcccttgactttagccccgggacctctggatcccctatcgtggataaaaagggcaaagtcgtggggctgtatggaaatggcgttgtgacacgcagcggcacctacgtctctgctatcgcccagacagagaagtccattgaggacaaccccgaaatcgaggatgacattttccggaagaaaagactgacgatcatggatctccatcctggggcgggaaagaccaaacgctatctgcccgctattgtgcgggaagccatcaagagaggccttcgcacactgatcctcgcccctacccgggttgtggctgccgagatggaagaggctctgagagggctcccgattcgctaccagacccccgccatccgggcggagcacacaggaagagaaattgtcgacctgatgtgtcatgccacgttcaccatgcggcttctgagccctatccgcgtgcccaattataacctgattatcatggatgaggctcactttacagaccctgcctccattgctgccagaggctacatctctacccgggttgaaatgggggaggccgctggcatcttcatgacagcgacacccccgggaagccgcgacccttttccccagtccaatgcccccattatggatgaggaaagagagatccctgaacggagctggaactctggccacgagtgggtgacggacttcaaagggaagacagtctggtttgtgccctccattaaggctggaaatgatatcgccgcctgcctccgcaaaaacggcaagaaagtgattcaactgagccgcaagaccttcgactctgaatatatcaaaacccggacaaatgattgggactttgtcgttaccacagatatcagcgagatgggggctaacttcaaggccgagagagtgattgaccctcgccggtgtatgaagccggtgatccttaccgatggagaagagagagtcattctggcgggccccatgcctgtgacgcattcctctgctgcccagcgccgggggagagttggccgcaatcccaaaaacgaaaatgaccagtacatctacatgggagagcctctcgaaaacgatgaggactgcgcccactggaaggaggctaaaatgctgctggacaatattaacacacccgaaggcatcatcccgagcatgtttgagcctgaaagagagaaggtggatgccattgacggggaatatcggctccgcggagaggcgagaaaaaccttcgtcgatcttatgcggcgcggcgacctgcccgtgtggctggcctacagagttgctgccgaggggatcaactatgctgatcggagatggtgttttgacggagtgaagaataaccaaattctcgaagagaatgtcgaagtggagatctggacaaaagagggcgaacgcaagaagctgaaacctcggtggcttgatgccagaatttactccgaccccctggctctcaaggagttcaaagagttcgccgcggggcgcaagtctctgaccctgaacctcatcacggagatgggccggcttcctacctttatgacacagaaagccaagaatgctctggataacctggccgtcctccataccgctgaagccggaggcagagcctataatcacgctctgagcgagcttcccgagacactggaaaccctcctgctgctcacacttctggcgaccgtgacagggggaattttcctgtttctcatgtccggcaaggggatcggaaaaatgacactgggcatgtgctgcatcattaccgccagcatccttctgtggtacgctcagattcagccgcactggatcgccgcctctattatcctcgagttctttctgatcgttctgctcattcctgaacccgagaagcaacggacaccccaggacaaccagcttacatatgtggtgatcgctattctgaccgtcgttgccgcgacaatggccaatgaaatgggcttcctggagaaaacgaagaaagattttgggctcggatccatcaccacacagcaacctgagagcaacattctggacatcgatcttcgcccggcttccgcctggaccctgtacgctgtggccacaaccttcatcacgcccatgctcagacattctattgaaaatagctccgtgaacgtctctctgaccgcgatcgccaatcaggctacagtgctgatgggcctcgggaagggatggcctcttagcaagatggacattggcgttcccctgctggccatcgggtgttactcccaggtgaaccctattaccctcacagctgccctgcttctgctcgtcgctcactatgccatcattggacccggcctgcaggcgaaagccacccgggaggctcaaaagcgcgccgctgccggcatcatgaaaaatcctacggtggacgggatgacagtcatcgatctggacccgattccctacgatcctaagtttgaaaaacagctcggacaggtgatgcttctggttctgtgcgtgacccaggtcctcatgatgagaacaacctgggccctgtgtgaggcgcttaccctggctacaggccccatcagcacgctctgggaagggaaccctggacggttctggaataccacaattgccgtgtctatggctaacatctttcgcggctcctatctggccggggccggactgctgttcagcattatgaagaacaccgctaatacaagacggggcaccggcaacacgggggagacacttggagagaagtggaaaaatcgcctgaacgccctgggcaagtctgaatttcaaatctacaaaaagtccgggatccaggaggttgacagaaccctcgcgaaagaaggaattaagcggggcgagaccgatcatcacgccgtgagcagagggtctgctaaactgcgctggttcgtcgagcggaatcttgtgacacccgaaggaaaggtggttgacctgggctgcggcagagggggatggagctattactgtggcgggctcaagaacgtcaaagaggtgaagggactgaccaaaggcgggccgggacatgaagaacctatccccatgtccacatatggctggaatctggtgcgcctccagtctggcgtcgatgttttctttacgccccctgaaaagtgcgacacccttctgtgtgatattggggagagctcccccaaccctacagtggaggccggacggaccctgagagtgctcaatctggtcgaaaactggcttaataacaatacacaattctgcatcaaagtgctgaacccgtacatgcccagcgttattgagaagatggaagctctccagcgcaagtacggcggggccctggtgcggaatcctctgtccagaaactctacccacgagatgtattgggtcagcaacgcgtccggaaatatcgtgtctagcgttaacatgatctcccgcatgctcattaatcggtttacgatgagacacaaaaaggccacctacgaacccgacgtggatcttggctctgggacacgcaacatcggaattgagagcgagacccctaatctggacatcattggcaaacggatcgaaaagatcaaacaggagcatgaaacatcctggcactatgatcaggaccatccctacaagacctgggcttatcacggcagctacgagacaaagcaaaccgggtctgcctccagcatggtcaacggagtggtgagactgctcacgaaaccgtgggacgtcattcctatggttacacagatggctatgaccgataccacacccttcggccagcagcgcgtgtttaaggaaaaagtggacacgagaacccaagagcctaaggaggggaccaaaaagctgatgaagatcaccgccgaatggctttggaaagagctgggaaagaaaaagacaccccggatgtgtacccgcgaagagttcacaagaaaagtccggtctaatgctgccctcggcgcgatttttaccgatgagaacaagtggaaatccgccagagaagctgtggaggacagcgggttctgggaactggttgataaggagcggaatctgcacctcgaaggaaagtgcgagacgtgtgtgtataacatgatgggcaaacgcgagaagaaactgggcgaatttgggaaggccaaaggatctagagctatctggtacatgtggcttggcgcccggttcctggagtttgaagccctcgggttcctgaatgaggaccattggttttcccgcgaaaacagcctttccggagtcgagggcgaggggctgcacaagctcggctacattctgagagatgtgagcaagaaagaaggaggcgcgatgtatgctgacgataccgccgggtgggacacacggatcaccctggaggatctcaagaatgaagagatggttacaaaccatatggaaggagagcacaaaaagctggccgaggctattttcaaacttacctaccagaataaggtggtccgcgtgcagagacctacgccccggggcacagttatggacatcatctctcgcagagaccagcgggggagcggacaagtggtcacctatggcctgaacacattcaccaacatggaagcccagctcattcgccagatggagggggaaggcgtgtttaagtccatccaacagctgacggtcaaagaggagattgctgtgaagaattggcttatcagagttggacgggaacgcctgtctagaatggccattagcggcgatgactgcgtggtcaaaccgctcgatgaccggttcgcgtccgccctgaccgctctgaacgatatggggaaggtgagaaaagacatccagcagtgggagccttctcgcggatggaatgattggacacaagtgcccttttgcagccatcacttccacgaactcatcatgaaggacggccgggttctggtggtcccctgtagaaaccaggatgagcttattgggcgcgcccggatctcccagggagctggctggtctctgagagaaaccgcctgcctcggaaagagctacgcgcagatgtggtccctgatgtattttcatcgccgggaccttagactggccgctaatgccatttgtagcgctgtgccttctcactggatcccgacatcccgcaccacatggagcattcatgccacccacgagtggatgacgacagaggatatgctcaccgtttggaaccgggtgtggatccaagaaaatccctggatggaggacaaaacccctgtcgaaacatgggaggaaatcccctacctgggcaagagagaggatcagtggtgcggatctctgattggcctcacctcccgcgctacatgggccaaaaacatccagacggcgattaatcaggtgcggagcctgatcgggaacgaggaatataccgactacatgccttccatgaagagattccggagagaggaagaggaagccggagtcctttggtga

SEQ ID NO: 19608 - RNA, 9876 nt, synthetic construct
  misc_feature 1..9876: note = derived and/or modified CDS sequence (opt5) from DENV-2__KM279521__SS-prME
  source 1..9876: mol_type = other RNA
accgccggaatcattatcatgatgattcccaccgtgatggctttccacctgacgaccagaaacggggaacctcatatgatcgtcagccggcaggaaaagggaaaatccctcctgtttaagacagagaatggagttaacatgtgcacccttatggccatggacctgggggaactctgtgaggataccattacctacaattgccccctgcttcgccaaaacgaacccgaggacatcgattgttggtgcaattctacaagcacctgggtgacgtatggaacctgtacagcgaccggcgagcaccggcgggaaaaacgctccgtggctctggtccctcatgtggggatgggactcgagacaagaaccgaaacgtggatgtctagcgagggcgcctggaagcacgcccagcggatcgagacatggattctgcgccatcccggcttcaccatcatggctgccattctggcttacacaatcgggaccacctattttcagagagttctcattttcatcctgcttacagccgtgacgccttccatggcgatgcggtgcattggaatctctaaccgcgactttgtcgaaggcgtgagcgggggatcctgggttgatatcgtgctggagcacggcagctgtgtcaccacaatggccaaaaataagcccaccctcgacttcgaactgattaagacagaggctaaacaccttgccaccctgagaaagtactgcgtggaagctaaactcacgaacacaaccaccgcctctcggtgtcctacacagggggagccgtccctgaatgaggaacaagataagcgctttgtgtgcaaacatagcatggtcgacagaggatggggcaacggctgtgggctgttcggaaagggcgggatcgttacctgcgcgatgtttacatgcaagaaaaatatggagggaaaggtggtgcagcccgaaaacctcgagtatacgattgtcatcacccctcactctggcgaagagaatgccgtggggaacgatacaggaaaacatggcaaggagattaaagttacaccccagtccagcatcacagaagctgagctgaccggctacgggacggtgaccatggaatgttctcctcggacaggacttgacttcaatgagatggtcctgctccagatggaaaacaaggcctggctggtgcaccgccaatggtttcttgatctgcccctcccgtggctgcctggcgctgacacccaggggtccaactggatccagaaagagacactggttaccttcaagaatccccacgccaagaaacaggatgtggtcgtgctcggaagccaagagggcgccatgcatacggctctgacaggggcgaccgaaattcagatgtcctctggcaaccttctgtttacaggacacctcaagtgcagactgcggatggacaaacttcagctgaagggcatgagctattccatgtgtaccgggaaattcaaggtcgtgaaggagatcgccgaaacccaacatggaacaattgttatcagagtgcagtacgagggcgacgggagcccttgcaaaattcccttcgagatcatggatctcgaaaagcgccacgtcctgggacggctgatcacggtgaatcccattgttaccgagaaagactctacagtgaacatcgaagctgagcctccgtttggcgattcctacattatcattggggtcgaacccggccagctcaagctgagctggttcaaaaagggatctagcatcggccagatgtttgagaccacaatgagaggggccaagcgcatggccattcttggagacaccgcttgggatttcggctccctcgggggagtgtttacgtctatcggcaaagccctccatcaagtgttcggggcgatctatggcgctgcctttagcggagtttcctggacaatgaagattctgatcggcgtcgtgattacctggatcgggatgaatagccggtctacctccctgagcgtgtctcttgtcctcgtgggagttgtgacactgtacctgggcgtcatggtgcaggccgactccgggtgtgttgtgagctggaaaaacaaggagctcaaatgcggatccggcattttcatcaccgataatgtccacacatggacggaacagtataagtttcagcctgagtctcccagcaagctggcttccgccatccaaaaagctcacgaagaggggatttgtggcatcagatctgtgacccgccttgaaaacctgatgtggaagcagattacacctgagctcaatcatatcctgaccgagaacgaagttaaactgacaattatgaccggagacatcaagggcatcatgcaggccgggaaacggagccttagaccccagccgacggagctcaagtactcctggaaagcgtggggaaaggccaagatgctgagcaccgaactgcacaatcatacattcctcattgatggccctgagaccgctgaatgccccaacacaaatcgcgcctggaactctctggaggtggaggactatgggtttggagtcttcaccacaaatatctggcttaaactgaaggaacggcaagatgtgttttgtgactccaaactcatgagcgctgccattaaggacaacagagcggtgcacgccgatatgggctactggatcgagtctgctctgaacgacacctggaaaattgaaaaggcctccttcatcgaggtcaagagctgccactggcctaaatctcatacgctgtggagcaatggcgttcttgagtccgaaatgatcattcccaagaacttcgctgggcctgtgagccagcacaattatcgccccggataccatacacagaccgccggcccgtggcacctcgggcggctggagatggattttgacttctgtgaaggaaccacagtggtcgtgaccgaggattgcggcaacagagggccttctctgcggacgacaaccgcctccggaaaactcatcacagaatggtgctgtcgcagctgcaccctgccgccccttagataccggggcgaggacggctgttggtatgggatggagattagacctctgaaggaaaaagaggaaaatctcgttaactccctggtgacagctggacatggccagatcgataatttttctctgggggtccttggaatggcgctgttcctggaggaaatgctgcgcacccgggtgggcacgaagcacgccattctcctggttgctgtgagctttgtcacccttatcacagggaacatgtccttcagagacctgggacgcgtgatggttatggtgggcgccaccatgacagatgacattggcatgggggtcacctacctcgccctgctggctgcctttaaggtgagaccgacgttcgcggctggacttctgctccggaaactgacatctaaggagctcatgatgaccacaatcggcatcgtgctgcttagccaatccaccattcccgagtctatcctggaactcaccgatgccctggccctggggatgatggtccttaaaattgttcgcaatatggagaagtatcagctggctgtgacaatcatggccattctctgcgtgcctaacgcggtcatcctgcagaatgcttggaaagtgagctgtacgaccctcgccgttgtgtccgtcagccccctgcttctgacatcttcccaacagaaggccgactggatccctctcgctctgaccattaagggactgaaccccacagccatctttcttaccacgctgagcagaacatctaaaaagcggtcctggcctctcaatgaagctattatggccgtgggcatggttagcatcctggcgtcttccctcctgaaaaacgatattcccatgaccgggccgcttgtggccggaggcctgctgaccgtctgctacgtgctcacaggccgcagcgctgacctggagcttgaaagagccgctgacgtccggtgggaggagcaggccgaaatctccgggagctctcctatcctgagcattaccatctccgaggatggatctatgagcattaagaatgaagaggaggaacagacactcacgatcctgattcgcaccggcctcctggtgatctccgggcttttccccgtttctattcctatcacagccgctgcgtggtatctgtgggaggtgaaaaagcaaagagccggagtcctgtgggacgtgcccagcccgcctcccgttggcaaagctgaactcgaggatggggcctaccggatcaagcagaagggcattctgggctattcccagatcggcgccggggtgtacaaagaaggaacctttcacacaatgtggcatgtcacccgcggcgctgtgcttatgcacaaggggaaaagaattgagccttcttgggccgacgtgaagaaagatctgatcagctacggaggcgggtggaagctcgagggagaatggaaggagggcgaagaggttcaggtcctggcgctcgaacccggcaaaaacccccgggctgtgcaaacgaagcctgggctgttcaaaaccaacacaggaaccattggcgccgtgtcccttgactttagcccggggacatctggatcccccatcgtcgataagaaaggcaaggtggttgggctgtatggaaatggcgtggtcaccagaagcggcacatacgtgtctgccatcgctcagacggagaagtccattgaggacaaccctgaaatcgaggatgacattttccgcaaaaagcggctgaccatcatggatctccatcccggggccggaaaaacaaagagatatctgcctgcgattgttcgcgaagctatcaaacggggccttagaaccctgatcctcgcccccacccgcgtggtcgccgctgagatggaagaggccctgcgggggctccctattagataccagacaccggctatccgcgccgagcacacgggacgggaaattgtggacctgatgtgtcatgcgaccttcacaatgagacttctgagccccatccgggttcctaattataacctgattatcatggatgaggcccactttaccgaccccgcttccattgccgctcgcggctacatctctacaagagtggaaatgggggaggccgccggcatcttcatgaccgctacgcctcccggaagccgggacccgtttcctcagtccaatgcgcccattatggatgaggaacgcgagatccccgaaagaagctggaactctggccacgagtgggtcacagacttcaaggggaagaccgtgtggtttgtgccttccattaaagccggaaatgatatcgctgcctgcctccggaagaacggcaaaaaggtcattcaactgagcagaaaaaccttcgactctgaatatatcaagacacgcaccaatgattgggactttgttgtgacaaccgatatcagcgagatgggggccaacttcaaggctgagcgggtgattgaccccagacgctgtatgaaacctgtcatccttacggatggagaggaacgggtgattctggccggcccgatgcccgttacacattcctctgcggctcagagacgcgggcgggtgggcagaaatcctaagaacgaaaatgaccagtacatctacatgggagagcccctcgaaaacgatgaggactgcgcccactggaaagaggccaagatgctgctggacaatattaacacccctgaaggcatcatccccagcatgtttgagccggaacgcgagaaagtcgatgctattgacggggaatatagactccggggagaggcccgcaagacattcgtggatcttatgagacggggcgacctgcctgtttggctggcgtaccgcgtggccgctgaggggatcaactatgccgatagacggtggtgttttgacggagtcaaaaataaccaaattctcgaagagaatgtggaagtcgagatctggaccaaggagggcgaaagaaagaaactgaagccccgctggcttgatgctcggatttactccgaccctctggccctcaaagagttcaaggagttcgctgccgggagaaaatctctgacgctgaacctcatcaccgagatgggccgccttcccacatttatgacccagaaggcgaagaatgccctggataacctggctgtgctccatacagccgaagctggaggccgggcctataatcacgccctgagcgagcttcctgagaccctggaaacactcctgctgctcacccttctggctacggttacagggggaattttcctgtttctcatgtccggcaaagggatcggaaagatgaccctgggcatgtgctgcatcattaccgcgagcatccttctgtggtacgcccagattcagccccactggatcgctgcctctattatcctcgagttctttctgatcgtgctgctcattccggaacctgagaaacaaagaacaccccaggacaaccagcttacctatgtggtcatcgccattctgacagttgtggctgccacgatggcgaatgaaatgggcttcctggagaagaccaaaaaggattttgggctcggatccatcacaacccagcaacccgagagcaacattctggacatcgatcttcggcctgcctccgcttggacactgtacgccgtggctaccacgttcatcaccccgatgctccgccattctattgaaaatagctccgtcaacgtgtctctgacagccatcgcgaatcaggccaccgttctgatgggcctcgggaagggatggccccttagcaaaatggacattggcgtgcctctgctggctatcgggtgttactcccaggtcaaccccattacactcaccgccgctctgcttctgctcgtggcccactatgctatcattggacctggcctgcaggccaaggcgacgagagaggcccaaaaacgggctgccgctggcatcatgaagaatcccacagtcgacgggatgaccgtgatcgatctggaccctattccgtacgatcccaaatttgaaaagcagctcggacaggttatgcttctggtgctgtgcgtcacacaggtgctcatgatgcgcaccacctgggccctgtgtgaggcccttacactggcgacgggccctatcagcaccctctgggaagggaaccccggaagattctggaatacaaccattgctgtttctatggccaacatctttcggggctcctatctggctggggccggactcctgttcagcattatgaagaacacagccaatacccgcagaggcacgggcaacacaggggagacccttggagagaaatggaagaatcggctgaacgctctgggcaaatctgaatttcaaatctacaagaaatccgggatccaggaggtggaccgcaccctcgccaaggaaggaattaaaagaggcgagacagatcatcacgcggtcagccgggggtctgccaagctgagatggttcgtggagcgcaatcttgtgacccctgaaggaaaggttgtcgacctgggctgcggcagagggggatggagctattactgtggcgggctcaaaaacgtgaaggaggtgaaaggactgacaaagggcgggcccggacatgaagaacccatccctatgtccacgtatggctggaatctggtcagactccagtctggcgttgatgtgttctttacaccgcccgaaaaatgcgacacacttctgtgtgatattggggagagctcccctaaccccaccgtggaggctggacgcacactgcgggtcctcaatctggtggaaaactggcttaataacaatacccaattctgcatcaaggttctgaacccttacatgccgagcgtgattgagaagatggaagccctccagagaaaatacggcggggctctggtccgcaatcccctgtcccggaactctacgcacgagatgtattgggtgagcaacgcctccggaaatatcgtttctagcgtgaacatgatctccagaatgctcattaatcgctttaccatgcggcacaagaaagcgacatacgaacctgacgtcgatcttggctctgggaccagaaacatcggaattgagagcgagacacccaatctggacatcattggcaagcgcatcgagaagatcaagcaggagcatgaaacctcctggcactatgatcaggaccatccttacaagacatgggcctatcacggcagctacgagaccaaacaaacggggtctgcttccagcatggtgaacggagtggtccggctgctcacaaagccctgggacgttattccgatggtgacccagatggccatgaccgatacaacgcctttcggccagcagagagtgtttaaagaaaaggtcgacacccgcacacaagagcccaaagaggggaccaagaagctgatgaaaatcacagctgaatggctttggaaggagctgggcaaaaagaaaacccctagaatgtgtacacgggaagagttcacccgcaaggtgagatctaatgccgctctcggcgccatttttacggatgagaacaaatggaagtccgcgcgggaagccgttgaggacagcgggttctgggaactggtggataaggagagaaatctgcacctcgaaggaaaatgcgagacctgtgtctataacatgatgggcaagcgggagaaaaagctgggcgaatttgggaaagctaagggatctcgcgccatctggtacatgtggcttggcgctagattcctggagtttgaagccctcgggttcctgaatgaggaccattggttttcccgggaaaacagcctttccggagtggagggcgaggggctgcacaagctcggctacattctgcgcgatgttagcaaaaaggaaggaggcgccatgtatgcggacgatacagctgggtgggacaccagaatcacactggaggatctcaaaaatgaagagatggtgaccaaccatatggaaggagagcacaagaaactggccgaggccattttcaaacttacgtaccagaataaggtcgtgcgggttcagcgccccacacctagaggcaccgtgatggacatcatctctcggcgcgaccagagagggagcggacaagtcgtgacatatggcctgaacaccttcacgaacatggaagctcagctcattcggcagatggagggggaaggcgtctttaaatccatccaacagctgaccgtgaaggaggagattgccgttaaaaattggcttatccgcgtgggaagagaacggctgtctcgcatggctattagcggcgatgactgcgtcgtgaagcccctcgatgacagattcgcctccgcgctgacagccctgaacgatatggggaaagtgcggaaggacatccagcagtgggagccgtctagaggatggaatgattggacccaagttcctttttgcagccatcacttccacgaactcatcatgaaggacggccgcgtgctggtcgtgccctgtcggaaccaggatgagcttattgggagagctcgcatctcccagggagccggctggtctctgcgggaaacagcttgcctcgggaaaagctacgcccagatgtggtccctgatgtattttcatagacgcgaccttcggctggcggccaatgctatttgtagcgccgttccctctcactggatccctacctccagaacaacctggagcattcatgctacgcacgagtggatgacaaccgaggatatgctcaccgtgtggaaccgcgtctggatccaagaaaatccgtggatggaggacaagacacccgtggaatcttgggaggaaatcccttacctgggcaaacgggaggatcagtggtgcggatccctgattggcctcaccagcagagccacatgggctaagaacatccagacggccattaatcaggtccgctccctgatcgggaacgaggaatataccgactacatgccctctatgaaacggttcagacgggaggaagaggaagcgggagtgctttggtga

SEQ ID NO: 19609 - RNA, 9876 nt, synthetic construct
  misc_feature 1..9876: note = derived and/or modified CDS sequence (opt5) from DENV-2__KM279583__SS-prME
  source 1..9876: mol_type = other RNA
accgccggaatcattatcatgatgattcccaccgtgatggctttccacctgacgaccagaaacggggaacctcatatgatcgtgagccggcaggaaaagggaaaatccctcctgtttaagaccgagaatggagttaacatgtgcacccttatggccatggacctgggggaactctgtgaggataccattacctacaattgcccgctgcttcgccaaaacgaacccgaggacatcgattgttggtgcaattctacgagcacctgggtgacgtatggaacctgtacagcgaccggcgagcaccggcgggaaaaacgctccgtggctctggtccctcatgtggggatgggactcgagacaagaaccgaaacgtggatgtctagcgagggcgcctggaagcacgcccagcggatcgagacatggattctgcgccatcccggcttcaccatcatggctgccattctggcttacacaatcgggaccacctattttcagagagttctcattttcatcctgcttacagccgtgacgccttccatggcgatgcggtgcattggaatctctaaccgcgactttgtcgaaggcgtgagcgggggatcctgggttgatatcgtgctggagcacggcagctgtgtcaccacaatggccaaaaataagcccaccctcgacttcgaactgattaagacagaggctaaacaccttgccaccctgagaaagtactgcgtggaagctaaactcacgaacacaaccaccgcctctcggtgtcctacacagggggagccgtccctgaatgaggaacaagataagcgctttgtgtgcaaacatagcatggtcgacagaggatggggcaacggctgtgggctgttcggaaagggcgggatcgttacctgcgcgatgtttacatgcaagaaaaatatggagggaaaggtggtgcagcccgaaaacctcgagtatacgattgtcatcacccctcactctggcgaagagaatgccgtggggaacgatacaggaaaacatggcaaggagattaaagttacaccccagtccagcatcacagaagctgagctgaccggctacgggacggtgaccatggaatgttctcctcggacaggacttgacttcaatgagatggccctgctccagatggaaaacaaggcttggctggtccaccgccaatggtttcttgatctgcccctcccgtggctgcctggcgccgacacccaggggtccaactggatccagaaagagacactggtgaccttcaagaatccccacgccaagaaacaggatgttgtggtcctcggaagccaagagggcgctatgcatacggcgctgacaggggccaccgaaattcagatgtcctctggcaaccttctgtttacaggacacctcaagtgcagactgcggatggacaaacttcagctgaagggcatgagctattccatgtgtaccgggaaattcaaggtggtcaaggagatcgctgaaacccaacatggaacaattgtgatcagagttcagtacgagggcgacgggagcccttgcaaaattcccttcgagatcatggatctcgaaaagcgccacgtgctgggacggctgatcacggtcaatcccattgtgaccgagaaagactctcctgttaacatcgaagccgagccgccctttggcgattcctacattatcattggggtggaacctggccagctcaagctgagctggttcaaaaagggatctagcatcggccagatgtttgagacaaccatgagaggggccaagcgcatggctattcttggagacacagcctgggatttcggctccctcgggggagtctttacctctatcggcaaagcgctccatcaagtgttcggggctatctatggcgccgcctttagcggagtgtcctggacgatgaagattctgatcggcgttgtcattacatggatcgggatgaatagccggtctacctccctgagcgtgtctcttgtgctcgtcggagtggttaccctgtacctgggcgtgatggtccaggctgactccgggtgtgtggttagctggaaaaacaaggagctcaaatgcggatccggcattttcatcacagataatgtgcacacctggacagaacagtataagtttcagcccgagtctcctagcaagctggcctccgctatccaaaaagcccacgaagaggggatttgtggcatcagatctgtcacgcgccttgaaaacctgatgtggaagcagattacccccgagctcaatcatatcctgacagagaacgaagtgaaactgaccattatgacaggagacatcaagggcatcatgcaggcggggaaacggagccttagaccgcagcctaccgagctcaagtactcctggaaagcctggggaaaggctaagatgctgagcacggaactgcacaatcataccttcctcattgatggccccgagacagccgaatgccctaacaccaatcgcgcttggaactctctggaggttgaggactatgggtttggagtgttcacaaccaatatctggcttaaactgaaggaacggcaagatgtcttttgtgactccaaactcatgagcgccgcgattaaggacaacagagccgtgcacgctgatatgggctactggatcgagtctgccctgaacgacacatggaaaattgaaaaggcttccttcatcgaggtcaagagctgccactggcccaaatctcataccctgtggagcaatggcgtccttgagtccgaaatgatcattcctaagaacttcgccgggcccgttagccagcacaattatcgcccgggataccatacgcagacagccggcccttggcacctcgggcggctggagatggattttgacttctgtgaaggaaccaccgtggtggtcacagaggattgcggcaacagagggccctctctgcggaccacgacagcttccggaaaactcatcaccgaatggtgctgtcgcagctgcacactgccccctcttagataccggggcgaggacggctgttggtatgggatggagattagaccgctgaaggaaaaagaggaaaatctcgtgaactccctggttaccgcgggacatggccagatcgataatttttctctgggggtgcttggaatggccctcttcctggaggaaatgctgcgcacacgggtcggcaccaagcacgctattctcctggtggccgttagctttgtgacgcttatcaccgggaacatgtccttcagagacctgggacgcgtcatggtgatggttggcgccacaatgaccgatgacattggcatgggggtgacatacctcgctctgctggccgcgtttaaggtcagacccaccttcgctgccggacttctgctccggaaactgacgtctaaggagctcatgatgacaaccatcggcatcgtgctgcttagccaatccacaattcctgagtctatcctggaactcaccgatgccctggctctggggatgatggtgcttaaaattgtccgcaatatggagaagtatcagctggccgttaccatcatggcgattctctgcgtgcccaacgctgtgatcctgcagaatgcctggaaagtcagctgtacaacgctcgccgtggtttccgtgagccctctgcttctgacctcttcccaacagaaggctgactggatccccctcgccctgacaattaagggactgaaccctaccgctatctttcttacaaccctgagcagaacgtctaaaaagcggtcctggcccctcaatgaagccattatggcggtcggcatggtgagcatcctggcctcttccctcctgaaaaacgatattccgatgacagggcctcttgttgctggaggcctgctgaccgtgtgctacgtcctcaccggccgcagcgccgacctggagcttgaaagagctgccgacgtgcggtgggaggagcaggccgaaatctccgggagctctcccatcctgagcattacaatctccgaggatggatctatgagcattaagaatgaagaggaggaacagaccctcacaatcctgattcgcacgggcctcctggtcatctccgggcttttccctgtgtctattcccatcaccgctgcggcctggtatctgtgggaggttaaaaagcaaagagctggagtgctgtgggacgtcccgagccctccccctgtgggcaaagccgaactcgaggatggggcctaccggatcaagcagaagggcattctgggctattcccagatcggcgctggggtttacaaagaaggaacatttcacaccatgtggcatgtgacacgcggcgccgtccttatgcacaaggggaaaagaattgagccctcttgggcggacgtgaagaaagatctgatcagctacggaggcgggtggaagctcgagggagaatggaaggagggcgaagaggtgcaggttctggctctcgaacccggcaaaaaccctcgggccgtccaaaccaagccggggctgttcaaaacgaacaccggaacaattggcgccgtgtcccttgactttagccccgggacctctggatcccctatcgtggataagaaaggcaaggtcgtggggctgtatggaaatggcgttgtgacaagaagcggcacctacgtctctgctatcgcccagacagagaagtccattgaggacaaccccgaaatcgaggatgacattttccgcaaaaagcggctgacgatcatggatctccatcctggggcgggaaaaaccaagagatatctgcccgctattgtgcgcgaagccatcaaacggggccttagaacactgatcctcgcccctacccgcgttgtggctgccgagatggaagaggctctgcgggggctcccgattagataccagacccccgccatccgcgcggagcacacaggacgggaaattgtcgacctgatgtgtcatgccacgttcaccatgagacttctgagccctatccgggtgcccaattataacctgattatcatggatgaggctcactttacagaccctgcctccattgctgcccgcggctacatctctaccagagttgaaatgggggaggccgctggcatcttcatgacagcgacacccccgggaagccgggacccttttccccagtccaatgcccccattatggatgaggaacgcgagatccctgaaagaagctggaactctggccacgagtgggtgacggacttcaaggggaagacagtctggtttgtgccctccattaaagctggaaatgatatcgccgcctgcctccggaagaacggcaaaaaggtgattcaactgagcagaaaaaccttcgactctgaatatatcaagacccgcacaaatgattgggactttgtcgttaccacagatatcagcgagatgggggctaacttcaaggccgagcgggtgattgaccctagacgctgtatgaaaccggtgatccttaccgatggagaggaacgggtcattctggcgggccccatgcctgtgacgcattcctctgctgcccagagacgcgggcgggttggcagaaatcccaagaacgaaaatgaccagtacatctacatgggagagcctctcgaaaacgatgaggactgcgcccactggaaagaggctaagatgctgctggacaatattaacacacccgaaggcatcatcccgagcatgtttgagcctgaacgcgagaaagtggatgccattgacggggaatatagactccggggagaggcgcgcaagaccttcgtcgatcttatgagacggggcgacctgcccgtgtggctggcctaccgcgttgctgccgaggggatcaactatgctgatagacggtggtgttttgacggagtgaaaaataaccaaattctcgaagagaatgtcgaagtggagatctggacaaaggagggcgaaagaaagaaactgaagcctcgctggcttgatgcccggatttactccgaccccctggctctcaaagagttcaaggagttcgccgcggggagaaaatctctgaccctgaacctcatcacggagatgggccgccttcctacctttatgacacagaaggccaagaatgctctggataacctggccgtcctccataccgctgaagccggaggccgggcctataatcacgctctgagcgagcttcccgagacactggaaaccctcctgctgctcacacttctggcgaccgtgacagggggaattttcctgtttctcatgtccggcaaagggatcggaaagatgacactgggcatgtgctgcatcattaccgccagcatccttctgtggtacgctcagattcagccgcactggatcgccgcctctattatcctcgagttctttctgatcgttctgctcattcctgaacccgagaaacaaagaacaccccaggacaaccagcttacatatgtggtgatcgctattctgaccgtcgttgccgcgacaatggccaatgaaatgggcttcctggagaagacgaaaaaggattttgggctcggatccatcaccacacagcaacctgagagcaacattctggacatcgatcttcggccggcttccgcctggaccctgtacgctgtggccacaaccttcatcacgcccatgctccgccattctattgaaaatagctccgtgaacgtctctctgaccgcgatcgccaatcaggctacagtgctgatgggcctcgggaagggatggcctcttagcaaaatggacattggcgttcccctgctggccatcgggtgttactcccaggtgaaccctattaccctcacagctgccctgcttctgctcgtcgctcactatgccatcattggacccggcctgcaggcgaaggccaccagagaggctcaaaaacgggccgctgccggcatcatgaagaatcctacggtggacgggatgacagtcatcgatctggacccgattccctacgatcctaaatttgaaaagcagctcggacaggtgatgcttctggttctgtgcgtgacccaggtcctcatgatgcgcacaacctgggccctgtgtgaggcgcttaccctggctacaggccccatcagcacgctctgggaagggaaccctggaagattctggaataccacaattgccgtgtctatggctaacatctttcggggctcctatctggccggggccggactgctgttcagcattatgaagaacaccgctaatacacgcagaggcaccggcaacacgggggagacacttggagagaaatggaagaatcggctgaacgccctgggcaaatctgaatttcaaatctacaagaaatccgggatccaggaggttgaccgcaccctcgcgaaggaaggaattaaaagaggcgagaccgatcatcacgccgtgagccgggggtctgctaagctgagatggttcgtcgagcgcaatcttgtgacacccgaaggaaaggtggttgacctgggctgcggcagagggggatggagctattactgtggcgggctcaaaaacgtcaaggaggtgaaaggactgaccaagggcgggccgggacatgaagaacctatccccatgtccacatatggctggaatctggtgagactccagtctggcgtcgatgttttctttacgccccctgaaaaatgcgacacccttctgtgtgatattggggagagctcccccaaccctacagtggaggccggacgcaccctgcgggtgctcaatctggtcgaaaactggcttaataacaatacacaattctgcatcaaggtgctgaacccgtacatgcccagcgttattgagaagatggaagctctccagagaaaatacggcggggccctggtgcgcaatcctctgtcccggaactctacccacgagatgtattgggtcagcaacgcgtccggaaatatcgtgtctagcgttaacatgatctccagaatgctcattaatcgctttacgatgcggcacaagaaagccacctacgaacccgacgtggatcttggctctgggacaagaaacatcggaattgagagcgagacccctaatctggacatcattggcaagcgcatcgagaagatcaagcaggagcatgaaacatcctggcactatgatcaggaccatccctacaagacctgggcttatcacggcagctacgagacaaaacaaaccgggtctgcctccagcatggtcaacggagtggtgcggctgctcacgaagccgtgggacgtcattcctatggttacacagatggctatgaccgataccacacccttcggccagcagagagtgtttaaagaaaaggtggacacgcgcacccaagagcctaaagaggggacaaagaagctgatgaaaatcaccgccgaatggctttggaaggagctgggcaaaaagaaaacacccagaatgtgtacccgggaagagttcacacgcaaggtcagatctaatgctgccctcggcgcgatttttaccgatgagaacaaatggaagtccgcccgggaagctgtggaggacagcgggttctgggaactggttgataaggagagaaatctgcacctcgaaggaaaatgcgagacgtgtgtgtataacatgatgggcaagcgggagaaaaagctgggcgaatttgggaaagccaagggatctcgcgctatctggtacatgtggcttggcgccagattcctggagtttgaagccctcgggttcctgaatgaggaccattggttttcccgggaaaacagcctttccggagtcgagggcgaggggctgcacaagctcggctacattctgcgcgatgtgagcaaaaaggaaggaggcgcgatgtatgctgacgataccgccgggtgggacacaagaatcaccctggaggatctcaaaaatgaagagatggttacaaaccatatggaaggagagcacaagaaactggccgaggctattttcaaacttacctaccagaataaggtggtccgggtgcagcgccctacgcccagaggcacagttatggacatcatctctcggcgcgaccagagagggagcggacaagtggtcacctatggcctgaacacattcaccaacatggaagcccagctcattcggcagatggagggggaaggcgtgtttaaatccatccaacagctgacggtcaaggaggagattgctgtgaaaaattggcttatccgcgttggaagagaacggctgtctcgcatggccattagcggcgatgactgcgtggtcaagccgctcgatgacagattcgcgtccgccctgaccgctctgaacgatatggggaaagtgcggaaggacatccagcagtgggagccttctagaggatggaatgattggacacaagtgcccttttgcagccatcacttccacgaactcatcatgaaggacggccgcgttctggtggtcccctgtcggaaccaggatgagcttattgggagagcccgcatctcccagggagctggctggtctctgcgggaaaccgcctgcctcgggaaaagctacgcgcagatgtggtccctgatgtattttcatagacgcgaccttcggctggccgctaatgccatttgtagcgctgtgccttctcactggatcccgacatccagaaccacatggagcattcatgccacccacgagtggatgacgacagaggatatgctcaccgtttggaaccgcgtgtggatccaagaaaatccctggatggaggacaagacccctgtcgaatcttgggaggaaatcccctacctgggcaaacgggaggatcagtggtgcggatccctgattggcctcacaagcagagctacctgggccaagaacatccagacagcgattaatcaggtgcgctccctgatcgggaacgaggaatatacggactacatgccttctatgaaacggttcagacgggaggaagaggaagccggagtcctttggtga

SEQ ID NO: 19610 - RNA, 9876 nt, synthetic construct
  misc_feature 1..9876: note = derived and/or modified CDS sequence (opt5) from DENV-2__KM279585__SS-prME
  source 1..9876: mol_type = other RNA
accgccggaatcattatcatgatgattcccaccgtgatggctttccacctgacgaccagaaacggggaacctcatatgatcgtcagccggcaggaaaagggaaaatccctcctgtttaagaccgagaatggcgttaacatgtgcacccttatggccatggacctgggggaactctgtgaggataccattacctacaattgcccgctgcttcgccaaaacgaacccgaggacatcgattgttggtgcaattctacgagcacctgggtgacgtatggaacctgtacagcgaccggcgagcaccggcgggaaaaacgctccgtggctctggtccctcatgtggggatgggactcgagacaagaaccgaaacgtggatgtctagcgagggcgcctggaagcacgcccagcggatcgagacatggattctgcgccatcccggcttcaccatcatggctgccattctggcttacacaatcgggaccacctattttcagagagttctcattttcatcctgcttacagccgtgacgccttccatggcgatgcggtgcattggaatctctaaccgcgactttgtcgaaggcgtgagcgggggatcctgggttgatatcgtgctggagcacggcagctgtgtcaccacaatggccaaaaataagcccaccctcgacttcgaactgattaagacagaggctaaacaccttgccaccctgagaaagtactgcgtggaagctaaactcacgaacacaaccaccgcctctcggtgtcctacacagggggagccgtccctgaatgaggaacaagataagcgctttgtgtgcaaacatagcatggtcgacagaggatggggcaacggctgtgggctgttcggaaagggcgggatcgttacctgcgcgatgtttacatgcaagaaaaatatggagggaaaggtggtgcagcccgaaaacctcgagtatacgattgtcatcacccctcactctggcgaagagaatgccgtggggaacgatacaggaaaacatggcaaggagattaaagttacaccccagtccagcatcacagaagctgagctgaccggctacgggacggtgaccatggaatgttctcctcggacaggacttgacttcaatgagatggtcctgctccagatggaaaacaaggcctggctggtgcaccgccaatggtttcttgatctgcccctcccgtggctgcctggcgctgacacccaggggtccaactggatccagaaagagacactggttaccttcaagaatccccacgccaagaaacaggatgtggtcgtgctcggaagccaagagggcgccatgcatacggctctgacaggggcgaccgaaattcagatgtcctctggcaaccttctgtttacaggacacctcaagtgcagactgcggatggacaaacttcagctgaagggcatgagctattccatgtgtaccgggaaattcaaggtcgtgaaggagatcgccgaaacccaacatggaacaattgttgtgagagtccagtacgagggcgacgggagcccttgcaaaatccccttcgagattatggatctcgaaaagcgccacgtgctgggacggctgatcacggttaatcccatcgtgaccgagaaagactctcctgtcaacattgaagctgagccgccctttggcgattcctacatcattatcggggtggaacctggccagctcaagctgagctggttcaaaaagggatctagcattggccagatgtttgagacaaccatgagaggggccaagcgcatggccatccttggagacacagcttgggatttcggctccctcgggggagtgtttacctctattggcaaagccctccatcaagttttcggggcgatctatggcgctgcctttagcggagtctcctggacgatgaagatcctgattggcgtggtgatcacatggattgggatgaatagccggtctacctccctgagcgtctctcttgtgctcgttggagtggtcaccctgtacctgggcgtgatggttcaggccgactccgggtgtgtggtcagctggaaaaacaaggagctcaaatgcggatccggcatcttcattacagataatgtgcacacctggacagaacagtataagtttcagcccgagtctcctagcaagctggcttccgccatccaaaaagctcacgaagaggggatctgtggcattagatctgttacgcgccttgaaaacctgatgtggaagcagatcacccccgagctcaatcatattctgacagagaacgaagtgaaactgaccatcatgacaggagacattaagggcatcatgcaggccgggaaacggagccttagaccgcagcctaccgagctcaagtactcctggaaagcgtggggaaaggccaagatgctgagcacggaactgcacaatcataccttcctcatcgatggccccgagacagctgaatgccctaacaccaatcgcgcctggaactctctggaggtcgaggactatgggtttggagtgttcacaaccaatatttggcttaaactgaaggaacggcaagatgtgttttgtgactccaaactcatgagcgctgccatcaaggacaacagagcggtccacgccgatatgggctactggattgagtctgctctgaacgacacatggaaaatcgaaaaggcctccttcattgaggttaagagctgccactggcccaaatctcataccctgtggagcaatggcgtgcttgagtccgaaatgatcatccctaagaacttcgctgggcccgtgagccagcacaattatcgcccgggataccatacgcagacagccggcccttggcacctcgggcggctggagatggattttgacttctgtgaaggaaccaccgtcgtggttacagaggattgcggcaacagagggccctctctgcggaccacgacagcctccggaaaactcattaccgaatggtgctgtcgcagctgcacactgccccctcttagataccggggcgaggacggctgttggtatgggatggagatcagaccgctgaaggaaaaagaggaaaatctcgtgaactccctggtcaccgctggacatggccagattgataatttttctctgggggtgcttggaatggcgctgttcctggaggaaatgctgcgcacacgggttggcaccaagcacgccatcctcctggtggctgtcagctttgtgacgcttattaccgggaacatgtccttcagagacctgggacgcgttatggtgatggtcggcgccacaatgaccgatgacatcggcatgggggtgacatacctcgccctgctggctgcctttaaggtgagacccaccttcgcggctggacttctgctccggaaactgacgtctaaggagctcatgatgacaaccattggcatcgtcctgcttagccaatccacaatccctgagtctattctggaactcaccgatgccctggccctggggatgatggttcttaaaatcgtgcgcaatatggagaagtatcagctggctgtgaccattatggccatcctctgcgtccccaacgcggtgattctgcagaatgcttggaaagttagctgtacaacgctcgccgtggtctccgtgagccctctgcttctgacctcttcccaacagaaggccgactggatccccctcgctctgacaatcaagggactgaaccctaccgccatttttcttacaaccctgagcagaacgtctaaaaagcggtcctggcccctcaatgaagctatcatggccgttggcatggtgagcattctggcgtcttccctcctgaaaaacgatatcccgatgacagggcctcttgtcgccggaggcctgctgaccgtgtgctacgtcctcaccggccgcagcgctgacctggagcttgaaagagccgctgacgtgcggtgggaggagcaggccgaaatttccgggagctctcccatcctgagcatcacaatttccgaggatggatctatgagcatcaagaatgaagaggaggaacagaccctcacaattctgatccgcacgggcctcctggttatttccgggcttttccctgtgtctatccccattaccgccgctgcgtggtatctgtgggaggtcaaaaagcaaagagccggagtgctgtgggacgttccgagccctccccctgtgggcaaagctgaactcgaggatggggcctaccggatcaagcagaagggaatcctgggctattcccagattggcgccggggtctacaaagaaggaacatttcacaccatgtggcatgtgacacgcggcgctgtgcttatgcacaaggggaaaagaatcgagccctcttgggccgacgttaagaaagatctgattagctacggaggcgggtggaagctcgagggagaatggaaggagggcgaagaggtccaggtgctggcgctcgaacccggcaaaaaccctcgggctgtgcaaaccaagccggggctgttcaaaacgaacaccggaacaatcggcgccgtctcccttgactttagccccgggacctctggatcccctattgtggataagaaaggcaaggttgtggggctgtatggaaatggcgtcgtgacaagaagcggcacctacgtttctgccatcgctcagacagagaagtccatcgaggacaaccccgaaattgaggatgacatcttccgcaaaaagcggctgacgattatggatctccatcctggggccggaaaaaccaagagatatctgcccgcgatcgtgcgcgaagctattaaacggggccttagaacactgatcctcgcccctacccgcgtcgtggccgctgagatggaagaggccctgcgggggctcccgatcagataccagacccccgctattcgcgccgagcacacaggacgggaaatcgttgacctgatgtgtcatgcgacgttcaccatgagacttctgagccctattcgggtgcccaattataacctgatcattatggatgaggcccactttacagaccctgcttccatcgccgctcgcggctacatttctaccagagtcgaaatgggggaggccgccggcatcttcatgacagctacacccccgggaagccgggacccttttccccagtccaatgcgcccatcatggatgaggaacgcgagattcctgaaagaagctggaactctggccacgagtgggtgacggacttcaaggggaagacagtgtggtttgtcccctccatcaaagccggaaatgatattgctgcctgcctccggaagaacggcaaaaaggttatccaactgagcagaaaaaccttcgactctgaatatattaagacccgcacaaatgattgggactttgtggtgaccacagatatcagcgagatgggggccaacttcaaggctgagcgggtcatcgaccctagacgctgtatgaaaccggtgattcttaccgatggagaggaacgggttatcctggccggccccatgcctgtgacgcattcctctgcggctcagagacgcgggcgggtcggcagaaatcccaagaacgaaaatgaccagtacatttacatgggagagcctctcgaaaacgatgaggactgcgcccactggaaagaggccaagatgctgctggacaatatcaacacacccgaaggcattatcccgagcatgtttgagcctgaacgcgagaaagtggatgctatcgacggggaatatagactccggggagaggcccgcaagaccttcgttgatcttatgagacggggcgacctgcccgtgtggctggcgtaccgcgtcgccgctgaggggattaactatgccgatagacggtggtgttttgacggagtgaaaaataaccaaatcctcgaagagaatgtcgaagtggagatttggacaaaggagggcgaaagaaagaaactgaagcctcgctggcttgatgctcggatctactccgaccccctggccctcaaagagttcaaggagttcgctgccgggagaaaatctctgaccctgaacctcattacggagatgggccgccttcctacctttatgacacagaaggcgaagaatgccctggataacctggctgttctccataccgccgaagctggaggccgggcctataatcacgccctgagcgagcttcccgagacactggaaaccctcctgctgctcacacttctggctaccgtgacagggggaatcttcctgtttctcatgtccggcaaagggattggaaagatgacactgggcatgtgctgcatcatcaccgcgagcattcttctgtggtacgcccagatccagccgcactggattgctgcctctatcattctcgagttctttctgatcgtgctgctcatccctgaacccgagaaacaaagaacaccccaggacaaccagcttacatatgtcgttattgccatcctgaccgtggtggctgccacaatggcgaatgaaatgggcttcctggagaagacgaaaaaggattttgggctcggatccattaccacacagcaacctgagagcaacatcctggacattgatcttcggccggcctccgcttggaccctgtacgccgtcgctacaaccttcatcacgcccatgctccgccattctatcgaaaatagctccgtgaacgtttctctgaccgccattgcgaatcaggccacagtgctgatgggcctcgggaagggatggcctcttagcaaaatggacatcggcgtccccctgctggctattgggtgttactcccaggtgaaccctatcaccctcacagccgctctgcttctgctcgtcgcccactatgctattatcggacccggcctgcaggccaaggcgaccagagaggcccaaaaacgggctgccgctggcattatgaagaatcctacggtggacgggatgacagttatcgatctggacccgatcccctacgatcctaaatttgaaaagcagctcggacaggtgatgcttctggtcctgtgcgtgacccaggttctcatgatgcgcacaacctgggccctgtgtgaggcccttaccctggcgacaggccccattagcacgctctgggaagggaaccctggaagattctggaataccacaatcgctgtgtctatggccaacatttttcggggctcctatctggctggggccggactcctgttcagcatcatgaagaacaccgccaatacacgcagaggcaccggcaacacgggggagacacttggagagaaatggaagaatcggctgaacgctctgggcaaatctgaatttcaaatttacaagaaatccgggatccaggaggtcgaccgcaccctcgccaaggaaggaatcaaaagaggcgagaccgatcatcacgcggtgagccgggggtctgccaagctgagatggttcgtggagcgcaatcttgttacacccgaaggaaaggtcgtggacctgggctgcggcagagggggatggagctattactgtggcgggctcaaaaacgtgaaggaggtcaaaggactgaccaagggcgggccgggacatgaagaacctattcccatgtccacatatggctggaatctggttagactccagtctggcgtggatgtgttctttacgccccctgaaaaatgcgacacccttctgtgtgatatcggggagagctcccccaaccctacagtcgaggctggacgcaccctgcgggtgctcaatctggttgacaactggcttaataacaatacacaattctgcattaaggtgctgaacccgtacatgcccagcgtcatcgaaaagatggaggccctccagagaaaatacggcggggctctggtgcgcaatcctctgtcccggaactctacccacgaaatgtattgggttagcaacgcctccggaaatattgtgtctagcgtcaacatgatctccagaatgctcatcaatcgctttacgatgcggcacaagaaagcgacctacgagcccgatgtggaccttggctctgggacaagaaacattggaatcgaaagcgagacccctaatctggatattatcggcaagcgcattgagaaaatcaagcaggaacatgagacatcctggcactatgaccaggaccatccctacaagacctgggcctatcacggcagctacgaaacaaaacaaaccgggtctgcttccagcatggtgaacggagtcgttcggctgctcacgaagccgtgggatgtgatccctatggtgacacagatggccatgaccgacaccacacccttcggccagcagagagtctttaaagagaaggtggatacgcgcacccaagaacctaaagaggggacaaagaagctgatgaaaattaccgctgagtggctttggaaggaactgggcaagaagaaaacacccagaatgtgtacccgggaggagttcacacgcaaggttagatctaatgccgctctcggcgccatctttaccgacgagaacaaatggaagtccgcgcgggaggccgtggaagatagcgggttctgggagctggtcgacaaggaaagaaatctgcacctcgagggaaaatgcgaaacgtgtgtgtataacatgatgggcaagcgggagaaaaagctgggcgagtttgggaaagctaagggatctcgcgccatttggtacatgtggcttggcgctagattcctggaatttgaggccctcgggttcctgaatgaagatcattggttttcccgggagaacagcctttccggagttgaaggcgaggggctgcacaagctcggctacatcctgcgcgacgtgagcaaaaaggagggaggcgccatgtatgcggatgacaccgctgggtgggatacaagaattaccctggaagacctcaaaaatgaggaaatggtcacaaaccatatggagggagaacacaagaaactggccgaggccatcttcaaacttacctaccagaataaggtggttcgggtgcagcgccctacgcccagaggcacagtcatggacattatctctcggcgcgatcagagagggagcggacaagtggtcacctatggcctgaacacattcaccaacatggaggctcagctcatccggcagatggaaggggagggcgtgtttaaatccattcaacagctgacggttaaggaagagatcgccgtgaaaaattggcttattcgcgtcggaagagagcggctgtctcgcatggctatcagcggcgacgattgcgtggtgaagccgctcgacgatagattcgcctccgcgctgaccgccctgaacgacatggggaaagttcggaaggatattcagcagtgggaaccttctagaggatggaatgactggacacaagtgcccttttgcagccatcacttccacgagctcatcatgaaggatggccgcgtcctggtggttccctgtcggaaccaggacgaacttatcgggagagctcgcatttcccagggagccggctggtctctgcgggagaccgcttgcctcgggaaaagctacgcccagatgtggaatctgatgtattttcatagacgcgatcttcggctggcggccaacgctatctgttccgccgtgcctagccactggattccgacatctagaaccacatggtccatccatgctacccacgaatggatgacgacagaggacatgctcaccgtctggaatcgcgtgtggattcaagagaacccctggatggaagataagacccctgtcgagagctgggaagagatcccctacctgggcaaacgggaagaccagtggtgcggatctctgatcggcctcacatccagagccacctgggctaagaatattcagacagccatcaaccaggtgcgcagcctgattgggaatgaggagtatacggactacatgccttccatgaaacggttcagacgggaagaggaagaggcgggagttctttggtga

SEQ ID NO: 19611 - RNA, 9876 nt, synthetic construct
  misc_feature 1..9876: note = derived and/or modified CDS sequence (opt5) from DENV-2__KM279525__SS-prME
  source 1..9876: mol_type = other RNA
accgccggaatcattatcatgatgattcccaccgtgatggctttccacctgacgaccagaaacggggaacctcatatgatcgtcagccggcaggaaaagggaaaatccctcctgtttaagacagagaatggcgttaacatgtgcacccttatggccatggacctgggggaactctgtgaggatacaattacctacaattgcccgctgcttcgccaaaacgaacccgaggacatcgattgttggtgcaattctacaagcacctgggtgacgtatggaacctgtacagcgaccggcgagcaccggcgggaaaaacgctccgtggctctggtccctcatgtggggatgggactcgagacaagaaccgaaacgtggatgtctagcgagggcgcctggaagcacgcccagcggatcgagacatggattctgcgccatcccggcttcaccatcatggctgccattctggcttacacaatcgggaccacctattttcagagagttctcattttcatcctgcttacagccgtgacgccttccatggcgatgcggtgcattggaatctctaaccgcgactttgtcgaaggcgtgagcgggggatcctgggttgatatcgtgctggagcacggcagctgtgtcaccacaatggccaaaaataagcccaccctcgacttcgaactgattaagacagaggctaaacaccttgccaccctgagaaagtactgcgtggaagctaaactcacgaacacaaccaccgcctctcggtgtcctacacagggggagccgtccctgaatgaggaacaagataagcgctttgtgtgcaaacatagcatggtcgacagaggatggggcaacggctgtgggctgttcggaaagggcgggatcgttacctgcgcgatgtttacatgcaagaaaaatatggagggaaaggtggtgcagcccgaaaacctcgagtatacgattgtcatcacccctcactctggcgaagagaatgccgtggggaacgatacaggaaaacatggcaaggagattaaagttacaccccagtccagcatcacagaagctgagctgaccggctacgggacggtgaccatggaatgttctcctcggacaggacttgacttcaatgagatggtcctgctccagatggaaaacaaggcctggctggtgcaccgccaatggtttcttgatctgcccctcccgtggctgcctggcgctgacacccaggggtccaactggatccagaaagagacactggttaccttcaagaatccccacgccaagaaacaggatgtggtcgtgctcggaagccaagagggcgccatgcatacggctctgacaggggcgaccgaaattcagatgtcctctggcaaccttctgtttacaggacacctcaagtgcagactgcggatggacaaacttcagctgaagggcatgagctattccatgtgtaccgggaaattcaaggtcgtgaaggagatcgccgaaacccaacatggaacaattgttatcagagtgcagtacgagggcgacgggagcccttgcaaaattcccttcgagatcatggatctcgaaaagcgccacgtcctgggacggctgatcacggtgaatcccattgttaccgagaaagactctcctgtgaacatcgaagctgagccgccctttggcgattcctacattatcattggggtcgaacctggccagctcaagctgagctggttcaaaaagggatctagcatcggccagatgtttgagacaaccatgagaggggccaagcgcatggccattcttggagacacagcttgggatttcggctccctcgggggagtgtttacctctatcggcaaagccctccatcaagtgttcggggcgatctatggcgctgcctttagcggagtttcctggacgatgaagattctgatcggcgtcgtgattacatggatcgggatgaatagccggtctacctccctgagcgtgtctcttgtcctcgtgggagttgtgaccctgtacctgggcgtcatggtgcaggccgactccgggtgtgttgtgagctggaaaaacaaggagctcaaatgcggatccggcattttcatcacagataatgtccacacctggacagaacagtataagtttcagcccgagtctcctagcaagctggcttccgccatccaaaaagctcacgaagaggggatttgtggcatcagatctgtgacgcgccttgaaaacctgatgtggaagcagattacccccgagctcaatcatatcctgacagagaacgaagttaaactgaccattatgacaggagacatcaagggcatcatgcaggccgggaaacggagccttagaccgcagcctaccgagctcaagtactcctggaaagcgtggggaaaggccaagatgctgagcacggaactgcacaatcataccttcctcattgatggccccgagacagctgaatgccctaacaccaatcgcgcctggaactctctggaggtggaggactatgggtttggagtcttcacaaccaatatctggcttaaactgaaggaacggcaagatgtgttttgtgactccaaactcatgagcgctgccattaaggacaacagagcggtgcacgccgatatgggctactggatcgagtctgctctgaacgacacatggaaaattgaaaaggcctccttcatcgaggtcaagagctgccactggcccaaatctcataccctgtggagcaatggcgttcttgagtccgaaatgatcattcctaagaacttcgctgggcccgtgagccagcacaattatcgcccgggataccatacgcagacagccggcccttggcacctcgggcggctggagatggattttgacttctgtgaaggaaccaccgtggtcgtgacagaggattgcggcaacagagggccctctctgcggaccacgacagcctccggaaaactcatcaccgaatggtgctgtcgcagctgcacactgccccctcttagataccggggcgaggacggctgttggtatgggatggagattagaccgctgaaggaaaaagaggaaaatctcgttaactccctggtgaccgctggacatggccagatcgataatttttctctgggggtccttggaatggcgctgttcctggaggaaatgctgcgcacacgggtgggcaccaagcacgccattctcctggttgctgtgagctttgtcatccttattacggggaacatgtccttcagagacctgggacgcgtgatggttatggtgggcgccaccatgacagatgacatcggcatgggggtcacctacctcgccctgctggctgcctttaaggtgagacccacattcgcggctggacttctgctccggaaactgacctctaaggagctcatgatgacgacaatcggcattgtgctgcttagccaatccaccatccctgagaatattctggaactcacagatgccctggccctggggatgatggtccttaaaatcgttcgcaacatggagaagtatcagctggctgtgaccattatggccatcctctgcgtgcccaatgcggtcatcctgcagaacgcttggaaagtgtcttgtaccacactcgccgttgtgagcgtctcccctctgcttctgacgagctctcaacagaaggccgactggattcccctcgctctgaccatcaagggactgaatcctacagccatttttcttaccacactgtccagaaccagcaaaaagcggtcttggcccctcaacgaagctatcatggccgtgggcatggtttccattctggcgagctctctcctgaaaaatgatatcccgatgacggggcctcttgtggccggaggcctgctgacagtctgctacgtgctcaccggccgctccgctgacctggagcttgaaagagccgctgacgtccggtgggaggagcaggccgaaatcagcgggtccagccccattctgtctatcaccattagcgaggatggatccatgtctatcaagaacgaagaggaggaacagacactcaccattctgatccgcacaggcctcctggtgattagcgggcttttccctgtttccatccccatcacggccgctgcgtggtatctgtgggaggtgaaaaagcaaagagccggagtcctgtgggacgtgccgtctcctccccctgttggcaaagctgaactcgaggatggggcctaccggattaagcagaagggaatcctgggctatagccagattggcgccggggtgtacaaagaaggaacctttcacacaatgtggcatgtcacccgcggcgctgtgcttatgcacaaggggaaaagaatcgagccctcctgggccgacgtgaagaaagatctgatttcttacggaggcgggtggaagctcgagggagaatggaaggagggcgaagaggttcaggtcctggcgctcgaacccggcaaaaaccctcgggctgtgcaaacaaagccggggctgttcaaaaccaatacgggaaccatcggcgccgtgagccttgacttttcccccgggacaagcggatctcctatcgtcgataagaaaggcaaggtggttgggctgtatggaaacggcgtggtcaccagatccggcacatacgtgagcgccattgctcagaccgagaagtctatcgaggacaatcccgaaattgaggatgacatcttccgcaaaaagcggctgacaattatggatctccatcctggggccggaaaaacgaagagatatctgcccgcgatcgttcgcgaagctatcaaacggggccttagaaccctgattctcgcccctacacgcgtggtcgccgctgagatggaagaggccctgcgggggctcccgatcagataccagacccccgctattcgcgccgagcacaccggacgggaaatcgtggacctgatgtgtcatgcgacattcacgatgagacttctgtcccctattcgggttcccaactataatctgatcattatggatgaggcccactttaccgaccctgctagcatcgccgctcgcggctacatctccacaagagtggaaatgggggaggccgccggcattttcatgaccgctacacccccgggatctcgggacccttttccccagagcaacgcgcccatcatggatgaggaacgcgagattcctgaaagatcctggaatagcggccacgagtgggtcaccgacttcaaggggaagacggtgtggtttgtgccctctatcaaagccggaaacgatattgctgcctgcctccggaagaatggcaaaaaggtcatccaactgtccagaaaaacattcgacagcgaatatatcaagacccgcaccaacgattgggactttgttgtgacaaccgatatttctgagatgggggccaatttcaaggctgagcgggtgatcgaccctagacgctgtatgaaaccggtcattcttacagatggagaggaacgggtgatcctggccggccccatgcctgttacccatagctccgcggctcagagacgcgggcgggtgggcagaaaccccaagaatgaaaacgaccagtacatttacatgggagagcctctcgaaaatgatgaggactgcgcccactggaaagaggccaagatgctgctggacaacatcaacacgcccgaaggcatcattccgtctatgtttgagcctgaacgcgagaaagtcgatgctatcgacggggaatatagactccggggagaggcccgcaagacattcgtggatcttatgagacggggcgacctgcccgtttggctggcgtaccgcgtggccgctgaggggattaattatgccgatagacggtggtgttttgacggagtcaaaaacaatcaaatcctcgaagagaacgtggaagtcgagatttggaccaaggagggcgaaagaaagaaactgaagcctcgctggcttgatgctcggatctacagcgaccccctggccctcaaagagttcaaggagttcgctgccgggagaaaatccctgacactgaatctcattaccgagatgggccgccttcctacgtttatgacccagaaggcgaagaacgccctggataatctggctgtgctccatacagccgaagctggaggccgggcctataaccacgccctgtctgagcttcccgagaccctggaaacactcctgctgctcacccttctggctacagttaccgggggaatcttcctgtttctcatgagcggcaaagggatcggaaagatgacgctgggcatgtgctgcattatcacagcgtccattcttctgtggtacgcccagatccagccgcactggattgctgccagcatcatcctcgagttctttctgattgtgctgctcatccctgaacccgagaaacaaagaacaccccaggacaatcagcttacctatgtggtcattgccatcctgacagttgtggctgccaccatggcgaacgaaatgggcttcctggagaagaccaagaaggattttgggctcggatctattacgacccagcaacctgagtccaatatcctggacatcgatcttcggccggccagcgcttggacactgtacgccgtggctaccacattcattacccccatgctccgccattccatcgaaaactctagcgtcaatgtgtccctgacggccattgcgaaccaggccaccgttctgatgggcctcgggaagggatggcctctttctaaaatggacatcggcgtgcccctgctggctattgggtgttacagccaggtcaatcctatcacactcaccgccgctctgcttctgctcgtggcccactatgctattatcggacccggcctgcaggccaaggcgacaagagaggcccaaaaacgggctgccgctggcatcatgaagaaccctaccgtcgacgggatgacggtgattgatctggacccgatcccctacgatcctaaatttgaaaagcagctcggacaggttatgcttctggtgctgtgcgtcacacaggtgctcatgatgcgcaccacatgggccctgtgtgaggcccttaccctggcgaccggccccatttccacactctgggaagggaatcctggaagattctggaacacgaccatcgctgttagcatggccaacatttttcggggctcttatctggctggggccggactcctgttctccatcatgaagaatacagccaacacccgcagaggcacaggcaataccggggagacgcttggagagaaatggaagaaccggctgaatgctctgggcaaaagcgaatttcaaatctacaagaaatctgggattcaggaggtggaccgcacactcgccaaggaaggaatcaaaagaggcgagaccgatcatcacgcggtctcccgggggagcgccaagctgagatggttcgtggagcgcaaccttgtgacccccgaaggaaaggttgtcgacctgggctgcggcagagggggatggtcttattactgtggcgggctcaaaaatgtgaaggaggtgaaaggactgacaaagggcgggccgggacatgaagaacctattcccatgagcacctatggctggaacctggtcagactccagtccggcgttgatgtgttctttacaccccctgaaaaatgcgacacgcttctgtgtgatatcggggagtctagccccaatcctaccgtggaggctggacgcacactgcgggtcctcaacctggtggaaaattggcttaacaataacacccaattctgcattaaggttctgaatccgtacatgccctccgtgatcgagaagatggaagccctccagagaaaatacggcggggctctggtccgcaaccctctgagccggaactccacacacgagatgtattgggtgtctaatgccagcggaaacatcgtttcctctgtgaatatgattagcagaatgctcatcaaccgctttaccatgcggcacaagaaagcgacgtacgaacccgacgtcgatcttggctccgggaccagaaatattggaatcgagtctgagacacctaacctggacattatcggcaagcgcatcgagaaaattaagcaggagcatgaaaccagctggcactatgatcaggaccatccctacaagacatgggcctatcacggctcctacgagaccaaacaaacagggagcgcttcttccatggtgaatggagtggtccggctgctcaccaagccgtgggacgttatccctatggtgacgcagatggccatgacagataccacccccttcggccagcagagagtgtttaaagaaaaggtcgacacacgcacgcaagagcctaaagaggggaccaagaagctgatgaaaattacagctgaatggctttggaaggagctgggcaaaaagaaaacccccagaatgtgtacacgggaagagttcacccgcaaggtgagaagcaacgccgctctcggcgccatctttacagatgagaataaatggaagtctgcgcgggaagccgttgaggactccgggttctgggaactggtggataaggagagaaacctgcacctcgaaggaaaatgcgagacctgtgtctataatatgatgggcaagcgggagaaaaagctgggcgaatttgggaaagctaagggaagccgcgccatttggtacatgtggcttggcgctagattcctggagtttgaagccctcgggttcctgaacgaggaccattggttttctcgggaaaattcccttagcggagtggagggcgaggggctgcacaagctcggctacatcctgcgcgatgtttccaaaaaggaaggaggcgccatgtatgcggacgatacggctgggtgggacaccagaattacactggaggatctcaaaaacgaagagatggtgaccaatcatatggaaggagagcacaagaaactggccgaggccatcttcaaacttacataccagaacaaggtcgtgcgggttcagcgccctacccccagaggcacggtgatggacatcattagccggcgcgaccagagagggtctggacaagtcgtgacatatggcctgaacaccttcacaaatatggaagctcagctcatccggcagatggagggggaaggcgtctttaaaagcattcaacagctgaccgtgaaggaggagatcgccgttaaaaactggcttattcgcgtgggaagagaacggctgtcccgcatggctatctctggcgatgactgcgtcgtgaagccgctcgatgacagattcgccagcgcgctgacggccctgaatgatatggggaaagtgcggaaggacatccagcagtgggagccttccagaggatggaacgattggacccaagttcccttttgctctcatcacttccacgaactcattatgaaggacggccgcgtgctggtcgtgccctgtcggaatcaggatgagcttatcgggagagctcgcattagccagggagccggctggtccctgcgggaaacagcttgcctcgggaaatcttacgcccagatgtggagcctgatgtattttcatagacgcgaccttcggctggcggccaacgctatctgttccgccgttcctagccactggattccgacctctagaacaacctggtccatccatgctacacacgagtggatgaccacggaggatatgctcacagtgtggaatcgcgtctggatccaagaaaacccctggatggaggacaagacccctgtggaaagctgggaggaaattccctacctgggcaaacgggaggatcagtggtgcggatctctgatcggcctcacctccagagccacatgggctaagaatattcagaccgccatcaaccaggtccgcagcctgattgggaatgaggaatatacagactacatgccttccatgaaacggttcagacgggaggaagaggaagcgggagtgctttggtga

SEQ ID NO: 19612 - RNA, 9876 nt, synthetic construct
  misc_feature 1..9876: note = derived and/or modified CDS sequence (opt5) from DENV-2__KM279528__SS-prME
  source 1..9876: mol_type = other RNA
accgccggaatcattatcatgatgattcccaccgtgatggctttccacctgacgaccagaaacggggaacctcatatgatcgtcagccggcaggaaaagggaaaatccctcctgtttaagaccgaaaatggcgttaacatgtgcacccttatggccatggacctgggggaactctgtgaagataccattacctacaattgcccgctgcttagacaaaacgaacccgaagacatcgattgttggtgcaattctacgagcacctgggtgacgtatggaacctgtacagcgaccggcgagcaccggcgggaaaaacgctccgtggctctggtccctcatgtggggatgggactcgagacaagaaccgaaacgtggatgtctagcgagggcgcctggaagcacgcccagcggatcgagacatggattctgcgccatcccggcttcaccatcatggctgccattctggcttacacaatcgggaccacctattttcagagagttctcattttcatcctgcttacagccgtgacgccttccatggcgatgcggtgcattggaatctctaaccgcgactttgtcgaaggcgtgagcgggggatcctgggttgatatcgtgctggagcacggcagctgtgtcaccacaatggccaaaaataagcccaccctcgacttcgaactgattaagacagaggctaaacaccttgccaccctgagaaagtactgcgtggaagctaaactcacgaacacaaccaccgcctctcggtgtcctacacagggggagccgtccctgaatgaggaacaagataagcgctttgtgtgcaaacatagcatggtcgacagaggatggggcaacggctgtgggctgttcggaaagggcgggatcgttacctgcgcgatgtttacatgcaagaaaaatatggagggaaaggtggtgcagcccgaaaacctcgagtatacgattgtcatcacccctcactctggcgaagagaatgccgtggggaacgatacaggaaaacatggcaaggagattaaagttacaccccagtccagcatcacagaagctgagctgaccggctacgggacggtgaccatggaatgttctcctcggacaggacttgacttcaatgagatggtcctgctccagatggaaaacaaggcctggctggtgcaccgccaatggtttcttgatctgcccctcccgtggctgcctggcgctgacacccaggggtccaactggatccagaaagagacactggttaccttcaagaatccccacgccaagaaacaggatgtggtcgtgctcggaagccaagagggcgccatgcatacggctctgacaggggcgaccgaaattcagatgtcctctggcaaccttctgtttacaggacacctcaagtgcagactgcggatggacaaacttcagctgaagggcatgagctattccatgtgtaccgggaaattcaaggtcgtgaaggagatcgccgaaacccaacatggaacaattgttatcagagtgcagtacgagggcgacgggagcccttgcaaaattcccttcgagatcatggatctcgaaaagcgccacgtcctgggacggctgatcacggtgaatcccattgttaccgagaaagactctcctgtgaacatcgaagctgagccgccctttggcgattcctacattatcattggggtcgaacctggccagctcaagctgagctggttcaaaaagggatctagcatcggccagatgtttgagacaaccatgagaggggccaagcgcatggccattcttggagacacagcttgggatttcggctccctcggcggggtgtttacctctatcgggaaagccctccatcaagtgttcggggcgatctatggcgctgcctttagcggagtttcctggacgatgaagattctgatcggcgtcgtgattacatggatcgggatgaatagccggtctacctccctgagcgtgtctcttgtcctcgtgggagttgtgaccctgtacctgggcgtcatggtgcaggccgactccgggtgtgttgtgagctggaaaaacaaggagctcaaatgcggatccggcattttcatcacagataatgtccacacctggacagaacagtataagtttcagcccgagtctcctagcaagctggcttccgccatccaaaaagctcacgaagaggggatttgtggcatcagatctgtgacgcgccttgaaaacctgatgtggaagcagattacccccgagctcaatcatatcctgacagagaacgaagttaaactgaccattatgacaggagacatcaagggcatcatgcaggccgggaaacggagccttagaccgcagcctaccgagctcaagtactcctggaaagcgtggggaaaggccaagatgctgagcacggaactgcacaatcataccttcctcattgatggccccgagacagctgaatgccctaacaccaatcgcgcctggaactctctggaggtggaggactatgggtttggagtcttcacaaccaatatctggcttaaactgaaggaacggcaagatgtgttttgtgactccaaactcatgagcgctgccattaaggacaacagagcggtgcacgccgatatgggctactggatcgagtctgctctgaacgacacatggaaaattgaaaaggcctccttcatcgaggtcaagagctgccactggcccaaatctcataccctgtggagcaatggcgttcttgagtccgaaatgatcattcctaagaacttcgctgggcccgtgagccagcacaattatcgcccgggataccatacgcagacagccggcccttggcacctcgggcggctggagatggattttgacttctgtgaaggaaccaccgtggtcgtgacagaggattgcggcaacagagggccctctctgcggaccacgacagcctccggaaaactcatcaccgaatggtgctgtcgcagctgcacactgccccctcttagataccggggcgaggacggctgttggtatgggatggagattagaccgctgaaggaaaaagaggaaaatctcgttaactccctggtgaccgctggacatggccagatcgataatttttctctgggggtccttggaatggcgctgttcctggaggaaatgctgcgcacacgggtgggcaccaagcacgccattctcctggttgctgtgagctttgtcacgcttatcaccgggaacatgtccttcagagacctgggacgcgtgatggttatggtgggcgccacaatgaccgatgacattggcatgggggtcacatacctcgccctgctggctgcctttaaggtgagacccaccttcgcggctggacttctgctccggaaactgacgtctaaggagctcatgatgacaaccatcggcatcgtgctgcttagccaatccacaattcctaaatctatcctggagctcaccgatgccctggccctggggatgatggtccttaagattgttcgcaatatggaaaaatatcagctggctgtgaccatcatggccattctctgcgtgcccaacgcggtcatcctgcagaatgcttggaaggtgagctgtacaacgctcgccgttgtgtccgtcagccctctgcttctgacctcttcccaacagaaggccgactggatccccctcgctctgacaattaaaggactgaaccctaccgccatctttcttacaaccctgagcagaacgtctaagaaacggtcctggcccctcaatgaggctattatggccgtgggcatggttagcatcctggcgtcttccctcctgaagaacgatattccgatgacagggcctcttgtggccggaggcctgctgaccgtctgctacgtgctcaccggccgcagcgctgacctggaacttgagagagccgctgacgtccggtgggaagaacaggccgagatctccgggagctctcccatcctgagcattacaatctccgaagatggatctatgagcattaaaaatgaggaagaggagcagaccctcacaatcctgattcgcacgggcctcctggtgatctccgggcttttccctgtttctattcccatcaccgccgctgcgtggtatctgtgggaagtgaagaaacaaagagccggagtcctgtgggacgtgccgagccctccccctgttggcaaggctgagctcgaagatggggcctaccggatcaagcagaaaggcattctgggctattcccagatcggcgccggggtgtacaaggagggaacatttcacaccatgtggcatgtcacacgcggcgctgtgcttatgcacaaagggaagagaattgaaccctcttgggccgacgtgaaaaaggatctgatcagctacggaggcgggtggaagctcgagggagagtggaaagaaggcgaggaagttcaggtcctggcgctcgagcccggcaagaaccctcgggctgtgcaaaccaaaccggggctgttcaagacgaacaccggaacaattggcgccgtgtcccttgactttagccccgggacctctggatcccctatcgtcgataaaaagggcaaggtggttgggctgtatggaaatggcgtggtcacaagaagcggcacctacgtgtctgccatcgctcagacagaaaaatccattgaggacaaccccgagatcgaagatgacattttccgcaagaaacggctgacgatcatggatctccatcctggggccggaaagaccaaaagatatctgcccgcgattgttcgcgaggctatcaagcggggccttagaacactgatcctcgcccctacccgcgtggtcgccgctgaaatggaggaagccctgcgggggctcccgattagataccagacccccgctatccgcgccgagcacacaggacgggagattgtggacctgatgtgtcatgcgacgttcaccatgagacttctgagccctatccgggttcccaattataacctgattatcatggatgaagcccactttacagaccctgcttccattgccgctcgcggctacatctctaccagagtggagatgggggaagccgccggcatcttcatgacagctacacccccgggaagccgggacccttttccccagtccaatgcgcccattatggatgaggagcgcgaaatccctgagagaagctggaactctggccacgaatgggtcacggacttcaaggggaaaacagtgtggtttgtgccctccattaaggccggaaatgatatcgctgcctgcctccggaaaaacggcaagaaagtcattcaactgagcagaaagaccttcgactctgagtatatcaagacccgcacaaatgattgggactttgttgtgaccacagatatcagcgaaatgggggccaacttcaaagctgagcgggtgattgaccctagacgctgtatgaagccggtcatccttaccgatggagaggaacgggtgattctggccggccccatgcctgttacgcattcctctgcggctcagagacgcgggcgggtgggcagaaatcccaaaaacgagaatgaccagtacatctacatgggagaacctctcgagaacgatgaagactgcgcccactggaaggaggccaaaatgctgctggacaatattaacacacccgagggcatcatcccgagcatgtttgaacctgagcgcgaaaaggtcgatgctattgacggggagtatagactccggggagaagcccgcaaaaccttcgtggatcttatgagacggggcgacctgcccgtttggctggcgtaccgcgtggccgctgaggggatcaactatgccgatagacggtggtgttttgacggagtcaagaataaccaaattctcgaggaaaatgtggaggtcgaaatctggacaaaggagggcgagcgcaagaagctgaaacctcgctggcttgatgctcggatttactccgaccccctggccctcaaggagttcaaagagttcgctgccgggagaaagtctctgaccctgaacctcatcacggaaatgggccgccttcctacctttatgacacagaaggcgaaaaatgccctggataacctggctgtgctccataccgccgaggctggaggccgggcctataatcacgccctgagcgaacttcccgagacactggagaccctcctgctgctcacacttctggctaccgttacagggggaattttcctgtttctcatgtccggcaaggggatcggaaaaatgacactgggcatgtgctgcatcattaccgcgagcatccttctgtggtacgcccagattcagccgcactggatcgctgcctctattatcctcgagttctttctgatcgtgctgctcattcctgagcccgaaaagcaaagaacaccccaggacaaccagcttacatatgtggtcatcgccattctgaccgttgtggctgccacaatggcgaatgagatgggcttcctggagaaaacgaagaaggattttgggctcggatccatcaccacacagcaacctgagagcaacattctggacatcgatcttcggccggcctccgcttggaccctgtacgccgtggctacaaccttcatcacgcccatgctccgccattctattgagaatagctccgtcaacgtgtctctgaccgccatcgcgaatcaggccacagttctgatgggcctcgggaaaggatggcctcttagcaagatggacattggcgtgcccctgctggctatcgggtgttactcccaggtcaaccctattaccctcacagccgctctgcttctgctcgtggcccactatgctatcattggacccggcctgcaggccaaagcgaccagagaagcccaaaagcgggctgccgctggcatcatgaaaaatcctacggtcgacgggatgacagtgatcgatctggacccgattccctacgatcctaagtttgagaagcagctcggacaggttatgcttctggtgctgtgcgtcacccaggtgctcatgatgcgcacaacctgggccctgtgtgaagcccttaccctggcgacaggccccatcagcacgctctgggaggggaaccctggaagattctggaataccacaattgctgtttctatggccaacatctttcggggctcctatctggctggggccggactcctgttcagcattatgaaaaacaccgccaatacacgcagaggcaccggcaacacgggggaaacacttggagagaagtggaaaaatcggctgaacgctctgggcaagtctgagtttcaaatctacaaaaagtccgggatccaggaagtggaccgcaccctcgccaaagagggaattaagagaggcgaaaccgatcatcacgcggtcagccgggggtctgccaagctgagatggttcgtggagcgcaatcttgtgacacccgagggaaaagttgtcgacctgggctgcggcagagggggatggagctattactgtggcgggctcaagaacgtgaaagaagtgaagggactgaccaaaggcgggccgggacatgaggaacctatccccatgtccacatatggctggaatctggtcagactccagtctggcgttgatgtgttctttacgccccctgagaagtgcgacacccttctgtgtgatattggggaaagctcccccaaccctacagtggaggctggacgcaccctgcgggtcctcaatctggtggagaactggcttaataacaatacacaattctgcatcaaggttctgaacccgtacatgcccagcgtgattgagaaaatggaggccctccagagaaagtacggcggggctctggtccgcaatcctctgtcccggaactctacccacgaaatgtattgggtgagcaacgcctccggaaatatcgtttctagcgtgaacatgatctccagaatgctcattaatcgctttacgatgcggcacaaaaaggcgacctacgagcccgacgtcgatcttggctctgggacaagaaacatcggaattgaaagcgagacccctaatctggacatcattggcaaacgcatcgagaagatcaagcaggaacatgagacatcctggcactatgatcaggaccatccctacaaaacctgggcctatcacggcagctacgaaacaaagcaaaccgggtctgcttccagcatggtgaacggagtggtccggctgctcacgaaaccgtgggacgttattcctatggtgacacagatggccatgaccgataccacacccttcggccagcagagagtgtttaaggagaaagtcgacacgcgcacccaagaacctaaggaggggacaaagaaactgatgaagatcaccgctgagtggctttggaaagaactgggaaagaaaaagacacccagaatgtgtacccgggaggagttcacacgcaaagtgagatctaatgccgctctcggcgccatttttaccgatgagaacaagtggaagtccgcgcgggaggccgttgaagacagcgggttctgggagctggtggataaagaaagaaatctgcacctcgagggaaagtgcgaaacgtgtgtctataacatgatgggcaaacgggagaagaaactgggcgagtttgggaaggctaagggatctcgcgccatctggtacatgtggcttggcgctagattcctggaatttgaggccctcgggttcctgaatgaagaccattggttttcccgggagaacagcctttccggagtggaaggcgaggggctgcacaaactcggctacattctgcgcgatgttagcaagaaagagggaggcgccatgtatgcggacgataccgctgggtgggacacaagaatcaccctggaagatctcaagaatgaggaaatggtgacaaaccatatggagggagaacacaaaaagctggccgaggccattttcaaacttacctaccagaataaagtcgtgcgggttcagcgccctacgcccagaggcacagtgatggacatcatctctcggcgcgaccagagagggagcggacaagtcgtgacctatggcctgaacacattcaccaacatggaggctcagctcattcggcagatggaaggggagggcgtctttaagtccatccaacagctgacggtgaaagaagagattgccgttaagaattggcttatccgcgtgggaagagagcggctgtctcgcatggctattagcggcgatgactgcgtcgtgaaaccgctcgatgacagattcgcctccgcgctgaccgccctgaacgatatggggaaggtgcggaaggacatccagcagtgggaaccttctagaggatggaatgattggacacaagttcccttttgcagccatcacttccacgagctcatcatgaaagacggccgcgtgctggtcgtgccctgtcggaaccaggatgaacttattgggagagctcgcatctcccagggagccggctggtctctgcgggagaccgcttgcctcggaaagagctacgcccagatgtggtccctgatgtattttcatagacgcgaccttcggctggcggccaatgctatttgtagcgccgttccttctcactggatcccgacatccagaaccacatggagcattcatgctacccacgaatggatgacgacagaggatatgctcaccgtgtggaaccgcgtctggatccaagagaatccctggatggaagacaaaacccctgtggagtcttgggaagagatcccctacctgggcaagcgggaagatcagtggtgcggatccctgattggcctcacaagcagagccacctgggctaaaaacatccagacagccattaatcaggtccgctccctgatcgggaacgaggagtatacggactacatgccttctatgaagcggttcagacgggaagaggaagaggcgggagtgctttggtga

SEQ ID NO: 19613 - RNA, 9876 nt, synthetic construct
  misc_feature 1..9876: note = derived and/or modified CDS sequence (opt5) from DENV-2__KM279533__SS-prME
  source 1..9876: mol_type = other RNA
accgccggaatcattatcatgatgattcccaccgtgatggctttccacctgacgaccagaaacggggaacctcatatgatcgtcagccggcaggaaaagggaaaatccctcctgtttaagaccgagaatggagttaacatgtgcacccttatggccatggacctgggggaactctgtgaggataccattacctacaattgcccgctgcttcgccaaaacgaacccgaggacatcgattgttggtgcaattctacgagcacctgggtgacgtatggaacctgtacagcgaccggcgagcaccggcgggaaaaacgctccgtggctctggtccctcatgtggggatgggactcgagacaagaaccgaaacgtggatgtctagcgagggcgcctggaagcacgcccagcggatcgagacatggattctgcgccatcccggcttcaccatcatggctgccattctggcttacacaatcgggaccacctattttcagagagttctcattttcatcctgcttacagccgtgacgccttccatggcgatgcggtgcattggaatctctaaccgcgactttgtcgaaggcgtgagcgggggatcctgggttgatatcgtgctggagcacggcagctgtgtcaccacaatggccaaaaataagcccaccctcgacttcgaactgattaagacagaggctaaacaccttgccaccctgagaaagtactgcgtggaagctaaactcacgaacacaaccaccgcctctcggtgtcctacacagggggagccgtccctgaatgaggaacaagataagcgctttgtgtgcaaacatagcatggtcgacagaggatggggcaacggctgtgggctgttcggaaagggcgggatcgttacctgcgcgatgtttacatgcaagaaaaatatggagggaaaggtggtgcagcccgaaaacctcgagtatacgattgtcatcacccctcactctggcgaagagaatgccgtggggaacgatacaggaaaacatggcaaggagattaaagttacaccccagtccagcatcacagaagctgagctgaccggctacgggacggtgaccatggaatgttctcctcggacaggacttgacttcaatgagatggtcctgctccagatggaaaacaaggcctggctggtgcaccgccaatggtttcttgatctgcccctcccgtggctgcctggcgctgacacccaggggtccaactggatccagaaagagacactggttaccttcaagaatccccacgccaagaaacaggatgtggtcgtgctcggaagccaagagggcgccatgcatacggctctgacaggggcgaccgaaattcagatgtcctctggcaaccttctgtttacaggacacctcaagtgcagactgcggatggacaaacttcagctgaagggcatgagctattccatgtgtaccgggaaattcaaggtcgtgaaggagatcgccgaaacccaacatggaacaattgttatcagagtgcagtacgagggcgacgggagcccttgcaaaattcccttcgagatcatggatctcgaaaagcgccacgtcctgggacggctgatcacggtgaatcccattgttaccgagaaagactctcctgtgaacatcgaagctgagccgccctttggcgattcctacattatcattggggtcgaacctggccagctcaagctgagctggttcaaaaagggatctagcatcggccagatgtttgagacaaccatgagaggggccaagcgcatggccattcttggagacacagcttgggatttcggctccctcgggggagtgtttacctctatcggcaaagccctccatcaagtgttcggggcgatctatggcgctgcctttagcggagtttcctggacgatgaagattctgatcggcgtcgtgattacatggatcgggatgaatagccggtctacctccctgagcgtgtctcttgtcctcgtgggagttgtgaccctgtacctgggcgtcatggtgcaggccgactccgggtgtgttgtgagctggaaaaacaaggagctcaaatgcggatccggcattttcatcacagataatgtccacacctggacagaacagtataagtttcagcccgagtctcctagcaagctggcttccgccatccaaaaagctcacgaagaggggatttgtggcatcagatctgtgacgcgccttgaaaacctgatgtggaagcagattacccccgagctcaatcatatcctgacagagaacgaagttaaactgaccattatgacaggagacatcaagggcatcatgcaggccgggaaacggagccttagaccgcagcctaccgagctcaagtactcctggaaagcgtggggaaaggccaagatgctgagcacggaactgcacaatcataccttcctcattgatggccccgagacagctgaatgccctaacaccaatcgcgcctggaactctctggaggtggaggactatgggtttggagtcttcacaaccaatatctggcttaaactgaaggaacggcaagatgtgttttgtgactccaaactcatgagcgctgccattaaggacaacagagcggtgcacgccgatatgggctactggatcgagtctgctctgaacgacacatggaaaattgaaaaggcctccttcatcgaggtcaagagctgccactggcccaaatctcataccctgtggagcaatggcgttcttgagtccgaaatgatcattcctaagaacttcgctgggcccgtgagccagcacaattatcgcccgggataccatacgcagacagccggcccttggcacctcgggcggctggagatggattttgacttctgtgaaggaaccaccgtggtcgtgacagaggattgcggcaacagagggccctctctgcggaccacgacagcctccggaaaactcatcaccgaatggtgctgtcgcagctgcacactgccccctcttagataccggggcgaggacggctgttggtatgggatggagattagaccgctgaaggaaaaagaggaaaatctcgttaactccctggtgaccgctggacatggccagatcgataatttttctctgggggtccttggaatggcgctgttcctggaggaaatgctgcgcacacgggtgggcaccaagcacgccattctcctggttgctgtgagctttgtcacgcttatcaccgggaacatgtccttcagagacctgggacgcgtgatggttatggtgggcgccacaatgaccgatgacattggcatgggggtcacatacctcgccctgctggctgcctttaaggtgagacccaccttcgcggctggacttctgctccggaaactgacgtctaaggagctcatgatgacaaccatcggcatcgtgctgcttagccaatccacaattcctgagtctatcctggaactcaccgatgccctggccctggggatgatggtccttaaaattgttcgcaatatggagaagtatcagctggctgtgaccatcatggccattctctgcgtgcccaacgcggtcatcctgcagaatgcttggaaagtgagctgtacaacgctcgccgttgtgtccgtcagccctctgcttctgacctcttcccaacagaaggccgactggatccccctcgctctgacaattaagggactgaaccctaccgccatctttcttacaaccctgagcagaacgtctaaaaagcggtcctggcccctcaatgaagctattatggccgtgggcatggttagcatcctggcgtcttccctcctgaaaaacgatattccgatgacagggcctcttgtggccggaggcctgctgaccgtctgctacgtgctcaccggccgcagcgctgacctggagcttgaaagagccgctgacgtccggtgggaggagcaggccgaaatctccgggagctctcccatcctgagcattacaatctccgaggatggatctatgagcattaagaatgaagaggaggaacagaccctcacaatcctgattcgcacgggcctcctggtgatctccgggcttttccctgtttctattcccatcaccgccgctgcgtggtatctgtgggaggtgaaaaagcaaagagccggagtcctgtgggacgtgccgagccctccccctgttggcaaagctgaactcgaggatggggcctaccggatcaagcagaagggcattctgggctattcccagatcggcgccggggtgtacaaagaaggaacatttcacaccatgtggcatgtcacacgcggcgctgtgcttatgcacaaggggaaaagaattgagccctcttgggccgacgtgaagaaagatctgatcagctacggaggcgggtggaagctcgagggagaatggaaggagggcgaagaggttcaggtcctggcgctcgaacccggcaaaaaccctcgggctgtgcaaaccaagccggggctgttcaaaacgaacaccggaacaattggcgccgtgtcccttgactttagccccgggacctctggatcccctatcgtcgataagaaaggcaaggtggttgggctgtatggaaatggcgtggtcacaagaagcggcacctacgtgtctgccatcgctcagacagagaagtccattgaggacaaccccgaaatcgaggatgacattttccgcaaaaagcggctgacgatcatggatctccatcctggggccggaaaaaccaagagatatctgcccgcgattgttcgcgaagctatcaaacggggccttagaacactgatcctcgcccctacccgcgtggtcgccgctgagatggaagaggccctgcgggggctcccgattagataccagacccccgctatccgcgccgagcacacaggacgggaaattgtggacctgatgtgtcatgcgacgttcaccatgagacttctgagccctatccgggttcccaattataacctgattatcatggatgaggcccactttacagaccctgcttccattgccgctcgcggctacatctctaccagagtggaaatgggggaggccgccggcatcttcatgacagctacacccccgggaagccgggacccttttccccagtccaatgcgcccattatggatgaggaacgcgagatccctgaaagaagctggaactctggccacgagtgggtcacggacttcaaggggaagacagtgtggtttgtgccctccattaaagccggaaatgatatcgctgcctgcctccggaagaacggcaaaaaggtcattcaactgagcagaaaaaccttcgactctgaatatatcaagacccgcacaaatgattgggactttgttgtgaccacagatatcagcgagatgggggccaacttcaaggctgagcgggtgattgaccctagacgctgtatgaaaccggtcatccttaccgatggagaggaacgggtgattctggccggccccatgcctgttacgcattcctctgcggctcagagacgcgggcgggtgggcagaaatcccaagaacgaaaatgaccagtacatctacatgggagagcctctcgaaaacgatgaggactgcgcccactggaaagaggccaagatgctgctggacaatattaacacacccgaaggcatcatcccgagcatgtttgagcctgaacgcgagaaagtcgatgctattgacggggaatatagactccggggagaggcccgcaagaccttcgtggatcttatgagacggggcgacctgcccgtttggctggcgtaccgcgtggccgctgaggggatcaactatgccgatagacggtggtgttttgacggagtcaaaaataaccaaattctcgaagagaatgtggaagtcgagatctggacaaaggagggcgaaagaaagaaactgaagcctcgctggcttgatgctcggatttactccgaccccctggccctcaaagagttcaaggagttcgctgccgggagaaaatctctgaccctgaacctcatcacggagatgggccgccttcctacctttatgacacagaaggcgaagaatgccctggataacctggctgtgctccataccgccgaagctggaggccgggcctataatcacgccctgagcgagcttcccgagacactggaaaccctcctgctgctcacacttctggctaccgttacagggggaattttcctgtttctcatgtccggcaaagggatcggaaagatgacactgggcatgtgctgcatcattaccgcgagcatccttctgtggtacgcccagattcagccgcactggatcgctgcctctattatcctcgagttctttctgatcgtgctgctcattcctgaacccgagaaacaaagaacaccccaggacaaccagcttacatatgtggtcatcgccattctgaccgttgtggctgccacaatggcgaatgaaatgggcttcctggagaagacgaaaaaggattttgggctcggatccatcaccacacagcaacctgagagcaacattctggacatcgatcttcggccggcctccgcttggaccctgtacgccgtggctacaaccttcatcacgcccatgctccgccattctattgaaaatagctccgtcaacgtgtctctgaccgccatcgcgaatcaggccacagttctgatgggcctcgggaagggatggcctcttagcaaaatggacattggcgtgcccctgctggctatcgggtgttactcccaggtcaaccctattaccctcacagccgctctgcttctgctcgtggcccactatgctatcattggacccggcctgcaggccaaggcgaccagagaggcccaaaaacgggctgccgctggcatcatgaagaatcctacggtcgacgggatgacagtgatcgatctggacccgattccctacgatcctaaatttgaaaagcagctcggacaggttatgcttctggtgctgtgcgtcacccaggtgctcatgatgcgcacaacctgggccctgtgtgaggcccttaccctggcgacaggccccatcagcacgctctgggaagggaaccctggaagattctggaataccacaattgctgtttctatggccaacatctttcggggctcctatctggctggggccggactcctgttcagcattatgaagaacaccgccaatacacgcagaggcaccggcaacacgggggagacacttggagagaaatggaagaatcggctgaacgctctgggcaaatctgaatttcaaatctacaagaaatccgggatccaggaggtggaccgcaccctcgccaaggaaggaattaaaagaggcgagaccgatcatcacgcggtcagccgggggtctgccaagctgagatggttcgtggagcgcaatcttgtgacacccgaaggaaaggttgtcgacctgggctgcggcagagggggatggagctattactgtggcgggctcaaaaacgtgaaggaggtgaaaggactgaccaagggcgggccgggacatgaagaacctatccccatgtccacatatggctggaatctggtcagactccagtctggcgttgatgtgttctttacgccccctgaaaaatgcgacacccttctgtgtgatattggggagagctcccccaaccctacagtggaggctggacgcaccctgcgggtcctcaatctggtggaaaactggcttaataacaatacacaattctgcatcaaggttctgaacccgtacatgcccagcgtgattgagaagatggaagccctccagagaaaatacggcggggctctggtccgcaatcctctgtcccggaactctacccacgagatgtattgggtgagcaacgcctccggaaatatcgtttctagcgtgaacatgatctccagaatgctcattaatcgctttacgatgcggcacaagaaagcgacctacgaacccgacgtcgatcttggctctgggacaagaaacatcggaattgagagcgagacccctaatctggacatcattggcaagcgcatcgagaagatcaagcaggagcatgaaacatcctggcactatgatcaggaccatccctacaagacctgggcctatcacggcagctacgagacaaaacaaaccgggtctgcttccagcatggtgaacggagtggtccggctgctcacgaagccgtgggacgttattcctatggtgacacagatggccatgaccgataccacacccttcggccagcagagagtgtttaaagaaaaggtcgacacgcgcacccaagagcctaaagaggggacaaagaagctgatgaaaatcaccgctgaatggctttggaaggagctgggcaaaaagaaaacacccagaatgtgtacccgggaagagttcacacgcaaggtgagatctaatgccgctctcggcgccatttttaccgatgagaacaaatggaagtccgcgcgggaagccgttgaggacagcgggttctgggaactggtggataaggagagaaatctgcacctcgaaggaaaatgcgagacgtgtgtctataacatgatgggcaagcgggagaaaaagctgggcgaatttgggaaagctaagggatctcgcgccatctggtacatgtggcttggcgctagattcctggagtttgaagccctcgggttcctgaatgaggaccattggttttcccgggaaaacagcctttccggagtggagggcgaggggctgcacaagctcggctacattctgcgcgatgttagcaaaaaggaaggaggcgccatgtatgcggacgataccgctgggtgggacacaagaatcaccctggaggatctcaaaaatgaagagatggtgacaaaccatatggaaggagagcacaagaaactggccgaggccattttcaaacttacctaccagaataaggtcgtgcgggttcagcgccctacgcccagaggcacagtgatggacatcatctctcggcgcgaccagagagggagcggacaagtcgtgacctatggcctgaacacattcaccaacatggaagctcagctcattcggcagatggagggggaaggcgtctttaaatccatccaacagctgacggtgaaggaggagattgccgttaaaaattggcttatccgcgtgggaagagaacggctgtctcgcatggctattagcggcgatgactgcgtcgtgaagccgctcgatgacagattcgcctccgcgctgaccgccctgaacgatatggggaaagtgcggaaggacatccagcagtgggagccttctagaggatggaatgattggacacaagttcccttttgcagccatcacttccacgaactcatcatgaaggacggccgcgtgctggtcgtgccctgtcggaaccaggatgagcttattgggagagctcgcatctcccagggagccggctggtctctgcgggaaaccgcttgcctcgggaaaagctacgcccagatgtggtccctgatgtattttcatagacgcgaccttcggctggcggccaatgctatttgtagcgccgttccttctcactggatcccgacatccagaaccacatggagcattcatgctacccacgagtggatgacgacagagaacatgctcaccgtgtggaatcgcgtctggatccaagaaaacccctggatggaggataagacccctgtggaatcttgggaggaaatcccctacctgggcaaacgggaggaccagtggtgcggatccctgattggcctcacaagcagagccacctgggctaagaatatccagacagccattaaccaggtccgctccctgatcgggaatgaggaatatacggattacatgccttctatgaaacggttcagacgggaggaagaggaagcgggagtgctttggtga

SEQ ID NO: 19614 - RNA, 9876 nt, synthetic construct
  misc_feature 1..9876: note = derived and/or modified CDS sequence (opt5) from DENV-2__KM279535__SS-prME
  source 1..9876: mol_type = other RNA
accgccggaatcattatcatgatgattcccaccgtgatggctttccacctgacgaccagaaacggggagcctcatatgatcgtcagccggcaggaaaagggaaaatccctcctgtttaagaccgagaatggagttaacatgtgcacccttatggccatggacctgggggaactctgtgaggataccattacctacaattgcccgctgcttcgccaaaacgaacccgaggacatcgattgttggtgcaattctacgagcacctgggtgacgtatggaacctgtacagcgaccggcgagcaccggcgggaaaaacgctccgtggctctggtccctcatgtggggatgggactcgagacaagaaccgaaacgtggatgtctagcgagggcgcctggaagcacgcccagcggatcgagacatggattctgcgccatcccggcttcaccatcatggctgccattctggcttacacaatcgggaccacctattttcagagagttctcattttcatcctgcttacagccgtgacgccttccatggcgatgcggtgcattggaatctctaaccgcgactttgtcgaaggcgtgagcgggggatcctgggttgatatcgtgctggagcacggcagctgtgtcaccacaatggccaaaaataagcccaccctcgacttcgaactgattaagacagaggctaaacaccttgccaccctgagaaagtactgcgtggaagctaaactcacgaacacaaccaccgcctctcggtgtcctacacagggggagccgtccctgaatgaggaacaagataagcgctttgtgtgcaaacatagcatggtcgacagaggatggggcaacggctgtgggctgttcggaaagggcgggatcgttacctgcgcgatgtttacatgcaagaaaaatatggagggaaaggtggtgcagcccgaaaacctcgagtatacgattgtcatcacccctcactctggcgaagagaatgccgtggggaacgatacaggaaaacatggcaaggagattaaagttacaccccagtccagcatcacagaagctgagctgaccggctacgggacggtgaccatggaatgttctcctcggacaggacttgacttcaatgagatggtcctgctccagatggaaaacaaggcctggctggtgcaccgccaatggtttcttgatctgcccctcccgtggctgcctggcgctgacacccaggggtccaactggatccagaaagagacactggttaccttcaagaatccccacgccaagaaacaggatgtggtcgtgctcggaagccaagagggcgccatgcatacggctctgacaggggcgaccgaaattcagatgtcctctggcaaccttctgtttacaggacacctcaagtgcagactgcggatggacaaacttcagctgaagggcatgagctattccatgtgtaccgggaaattcaaggtcgtgaaggagatcgccgaaacccaacatggaacaattgttatcagagtgcagtacgagggcgacgggagcccttgcaaaattcccttcgagatcatggatctcgaaaagcgccacgtcctgggacggctgatcacggtgaatcccattgttaccgagaaagactctcctgtgaacatcgaagctgagccgccctttggcgattcctacattatcattggggtcgaacctggccagctcaagctgagctggttcaaaaagggatctagcatcggccagatgtttgagacaaccatgagaggggccaagcgcatggccattcttggagacacagcttgggatttcggctccctcggcggggtgtttacctctatcgggaaagccctccatcaagtgttcggggcgatctatggcgctgcctttagcggagtttcctggacgatgaagattctgatcggcgtcgtgattacatggatcgggatgaatagccggtctacctccctgagcgtgtctcttgtcctcgtgggagttgtgaccctgtacctgggcgtcatggtgcaggccgactccgggtgtgttgtgagctggaaaaacaaggagctcaaatgcggatccggcattttcatcacagataatgtccacacctggacagaacagtataagtttcagcccgagtctcctagcaagctggcttccgccatccaaaaagctcacgaagaggggatttgtggcatcagatctgtgacgcgccttgaaaacctgatgtggaagcagattacccccgagctcaatcatatcctgacagagaacgaagttaaactgaccattatgacaggagacatcaagggcatcatgcaggccgggaaacggagccttagaccgcagcctaccgagctcaagtactcctggaaagcgtggggaaaggccaagatgctgagcacggaactgcacaatcataccttcctcattgatggccccgagacagctgaatgccctaacaccaatcgcgcctggaactctctggaggtggaggactatgggtttggagtcttcacaaccaatatctggcttaaactgaaggaacggcaagatgtgttttgtgactccaaactcatgagcgctgccattaaggacaacagagcggtgcacgccgatatgggctactggatcgagtctgctctgaacgacacatggaaaattgaaaaggcctccttcatcgaggtcaagagctgccactggcccaaatctcataccctgtggagcaatggcgttcttgagtccgaaatgatcattcctaagaacttcgctgggcccgtgagccagcacaattatcgcccgggataccatacgcagacagccggcccttggcacctcgggcggctggagatggattttgacttctgtgaaggaaccaccgtggtcgtgacagaggattgcggcaacagagggccctctctgcggaccacgacagcctccggaaaactcatcaccgaatggtgctgtcgcagctgcacactgccccctcttagataccggggcgaggacggctgttggtatgggatggagattagaccgctgaaggaaaaagaggaaaatctcgttaactccctggtgaccgctggacatggccagatcgataatttttctctgggggtccttggaatggcgctgttcctggaggaaatgctgcgcacacgggtgggcaccaagcacgccattctcctggttgctgtgagctttgtcacgcttatcaccgggaacatgtccttcagagacctgggacgcgtgatggttatggtgggcgccacaatgaccgatgacattggcatgggggtcacatacctcgccctgctggctgcctttaaggtgagacccaccttcgcggctggacttctgctccggaaactgacgtctaaggagctcatgatgacaaccatcggcatcgtgctgcttagccaatccacaattcctgagtctatcctggaactcaccgatgccctggccctggggatgatggtccttaaaattgttcgcaatatggagaagtatcagctggctgtgaccatcatggccattagctgcgtgcccaacgcggtcatcctccagaatgcttggaaagtgtcctgtacaacgctggccgttgtgagcgtctctcctctcctgcttacctccagccaacagaaggccgactggatccccctggctctcacaattaagggactgaaccctaccgccatctttctgacaaccctttctagaacgtccaaaaagcggagctggcccctgaatgaagctattatggccgtgggcatggtttctatcctcgcgtccagcctgctcaaaaacgatattccgatgacagggcctctggtggccggaggccttctgaccgtctgctacgtgctgaccggccgctccgctgacctcgagctggaaagagccgctgacgtccggtgggaggagcaggccgaaatcagcgggtctagccccatcctttccattacaatctctgaggatggaagcatgtccattaagaatgaagaggaggaacagaccctgacaatcctcattcgcacgggcctgctcgtgatctctgggctgttccctgttagcattcccatcaccgccgctgcgtggtatctttgggaggtgaaaaagcaaagagccggagtcctgtgggacgtgccgtcccctccccctgttggcaaagctgaactggaggatggggcctaccggatcaagcagaagggcattctcggctattctcagatcggcgccggggtgtacaaagaaggaacatttcacaccatgtggcatgtcacacgcggcgctgtgctgatgcacaaggggaaaagaattgagcccagctgggccgacgtgaagaaagatcttatctcctacggaggcgggtggaagctggagggagaatggaaggagggcgaagaggttcaggtcctcgcgctggaacccggcaaaaaccctcgggctgtgcaaaccaagccgggactcttcaaaacgaacaccggaacaattggcgccgtgagcctggacttttctcccgggacctccggaagccctatcgtcgataagaaaggcaaggtggttgggctttatggaaatggcgtggtcacaagatctggcacctacgtgtccgccatcgctcagacagaaaagagcattgaggacaaccccgaaatcgaggatgacattttccgcaaaaagcggctgacgatcatggatctgcatcctggggccggaaaaaccaagagatatctccccgcgattgttcgcgaagctatcaaacggggcctgagaacacttatcctggcccctacccgcgtggtcgccgctgagatggaagaggccctccgggggctgccgattagataccagacccccgctatccgcgccgagcacacaggacgggaaattgtggacctcatgtgtcatgcgacgttcaccatgagactgctttcccctatccgggttcccaattataacctgattatcatggatgaggcccactttacagaccctgcttctattgccgctcgcggctacatcagcaccagagtggaaatgggggaggccgccggcatcttcatgacagctacacccccgggatcccgggacccttttccccagagcaatgcgcccattatggatgaggaacgcgagatccctgaaagatcttggaactccggccacgagtgggtcacggacttcaaggggaagacagtgtggtttgtgcccagcattaaagccggaaatgatatcgctgcctgcctgcggaagaacggcaaaaaggtcattcaactctctagaaaaaccttcgacagcgaatatatcaagacccgcacaaatgattgggactttgttgtgaccacagatatctccgagatgggggccaacttcaaggctgagcgggtgattgaccctagacgctgtatgaaaccggtcatcctgaccgatggagaggaacgggtgattcttgccggccccatgcctgttacgcattctagcgcggctcagagacgcgggcgggtgggcagaaatcccaagaacgaaaatgaccagtacatctacatgggagagcctctggaaaacgatgaggactgcgcccactggaaagaggccaagatgctcctggacaatattaacacacccgaaggcatcatcccgtccatgtttgagcctgaacgcgagaaagtcgatgctattgacggggaatatagactgcggggagaggcccgcaagaccttcgtggatctcatgagacggggcgaccttcccgtttggctggcgtaccgcgtggccgctgaggggatcaactatgccgatagacggtggtgttttgacggagtcaaaaataaccaaattctggaagagaatgtggaagtcgagatctggacaaaggagggcgaaagaaagaaactcaagcctcgctggctggatgctcggatttactctgacccccttgccctgaaagagttcaaggagttcgctgccgggagaaaaagcctcaccctgaacctgatcacggagatgggccgcctccctacctttatgacacagaaggcgaagaatgcccttgataacctggctgtgctgcataccgccgaagctggaggccgggcctataatcacgccctctccgagctgcccgagacacttgaaaccctgctcctgctgacactccttgctaccgttacagggggaattttcctgtttctgatgagcggcaaagggatcggaaagatgacactcggcatgtgctgcatcattaccgcgtctatcctgctttggtacgcccagattcagccgcactggatcgctgcctccattatcctggagttctttctcatcgtgctgctgattcctgaacccgagaaacaaagaacaccccaggacaaccagctcacatatgtggtcatcgccattcttaccgttgtggctgccacaatggcgaatgaaatgggcttcctggagaagacgaaaaaggattttgggctgggaagcatcaccacacagcaacctgagtccaacattctcgacatcgatctgcggccggcctctgcttggaccctttacgccgtggctacaaccttcatcacgcccatgctgcgccatagcattgaaaattcctctgtcaacgtgagcctcaccgccatcgcgaatcaggccacagttctgatgggcctggggaagggatggcctctctccaaaatggacattggcgtgccccttctggctatcgggtgttacagccaggtcaaccctattaccctgacagccgctctcctgcttctggtggcccactatgctatcattggacccggcctccaggccaaggcgaccagagaggcccaaaaacgggctgccgctggcatcatgaagaatcctacggtcgacgggatgacagtgatcgatctggacccgattccctacgatcctaaatttgaaaagcagctgggacaggttatgctccttgtgctgtgcgtcacccaggtgctgatgatgcgcacaacctgggccctctgtgaggccctgacccttgcgacaggccccatctctacgctgtgggaagggaaccctggaagattctggaataccacaattgctgtttccatggccaacatctttcggggcagctatctcgctggggccggactgctgttctctattatgaagaacaccgccaatacacgcagaggcaccggcaacacgggggagacactcggagagaaatggaagaatcggcttaacgctctgggcaaatccgaatttcaaatctacaagaaaagcgggatccaggaggtggaccgcaccctggccaaggaaggaattaaaagaggcgagaccgatcatcacgcggtctctcgggggagcgccaagctcagatggttcgtggagcgcaatctggtgacacccgaaggaaaggttgtcgaccttggctgcggcagagggggatggtcctattactgtggcgggctgaaaaacgtgaaggaggtgaaaggactcaccaagggcgggccgggacatgaagaacctatccccatgtctacatatggctggaatctggtcagactgcagagcggcgttgatgtgttctttacgccccctgaaaaatgcgacaccctcctttgtgatattggggagtccagccccaaccctacagtggaggctggacgcaccctgcgggtcctgaatctcgtggaaaactggctgaataacaatacacaattctgcatcaaggttcttaacccgtacatgccctccgtgattgagaagatggaagccctgcagagaaaatacggcggggctctcgtccgcaatcctctgtctcggaacagcacccacgagatgtattgggtgtccaacgcctctggaaatatcgttagctccgtgaacatgatctctagaatgctgattaatcgctttacgatgcggcacaagaaagcgacctacgaacccgacgtcgatctcggcagcgggacaagaaacatcggaattgagtccgagacccctaatcttgacatcattggcaagcgcatcgagaagatcaagcaggagcatgaaacaagctggcactatgatcaggaccatccctacaagacctgggcctatcacggctcttacgagacaaaacaaaccgggtccgctagctctatggtgaacggagtggtccggctgctgacgaagccgtgggacgttattcctatggtgacacagatggccatgaccgataccacacccttcggccagcagagagtgtttaaagaaaaggtcgacacgcgcacccaagagcctaaagaggggacaaagaagctcatgaaaatcaccgctgaatggctgtggaaggagcttggcaaaaagaaaacacccagaatgtgtacccgggaagagttcacacgcaaggtgagatccaatgccgctctgggcgccatttttaccgatgagaacaaatggaaaagcgcgcgggaagccgttgaggactctgggttctgggaactcgtggataaggagagaaatctgcacctggaaggaaaatgcgagacgtgtgtctataacatgatgggcaagcgggagaaaaagctcggcgaatttgggaaagctaagggatcccgcgccatctggtacatgtggctgggcgctagattccttgagtttgaagccctggggttcctcaatgaggaccattggtttagccgggaaaactccctgagcggagtggagggcgaggggcttcacaagctgggctacattctccgcgatgtttctaaaaaggaaggaggcgccatgtatgcggacgataccgctgggtgggacacaagaatcaccctggaggatctgaaaaatgaagagatggtgacaaaccatatggaaggagagcacaagaaactcgccgaggccattttcaagctgacctaccagaataaggtcgtgcgggttcagcgccctacgcccagaggcacagtgatggacatcatcagccggcgcgaccagagagggtccggacaagtcgtgacctatggccttaacacattcaccaacatggaagctcagctgattcggcagatggagggggaaggcgtctttaaatctatccaacagctcacggtgaaggaggagattgccgttaaaaattggctgatccgcgtgggaagagaacggcttagccgcatggctatttccggcgatgactgcgtcgtgaagccgctggatgacagattcgcctctgcgctcaccgccctgaacgatatggggaaagtgcggaaggacatccagcagtgggagcctagcagaggatggaatgattggacacaagttcccttttgctcccatcacttccacgaactgatcatgaaggacggccgcgtgctcgtcgtgccctgtcggaaccaggatgagctgattgggagagctcgcatctctcagggagccggctggagccttcgggaaaccgcttgcctggggaaatcctacgcccagatgtggagcctcatgtattttcatagacgcgacctgcggcttgcggccaatgctatttgttctgccgttccttcccactggatcccgacaagcagaaccacatggtctattcatgctacccacgagtggatgacgacagaggatatgctgaccgtgtggaaccgcgtctggatccaagaaaatccctggatggaggacaagacccctgtggaatcctgggaggaaatcccctacctcggcaaacgggaggatcagtggtgcggaagcctgattggcctgacatccagagccacctgggctaagaacatccagacagccattaatcaggtccgctctctcatcgggaacgaggaatatacggactacatgcctagcatgaaacggttcagacgggaggaagaggaagcgggagtgctgtggtga

SEQ ID NO: 19615 - RNA, 9876 nt, synthetic construct
  misc_feature 1..9876: note = derived and/or modified CDS sequence (opt5) from DENV-2__KM279539__SS-prME
  source 1..9876: mol_type = other RNA
accgccggaatcattatcatgatgattcccaccgtgatggctttccacctgacgaccagaaacggggaacctcatatgatcgtcagccggcaggaaaagggaaaatccctcctgtttaagaccgagaatggcgttaacatgtgcacccttatggccatggacctgggggaactctgtgaggatacgattacctacaattgcccgctgcttcgccaaaacgaacccgaggacatcgattgttggtgcaattctacaagcacctgggtgacgtatggaacctgtacagcgaccggcgagcaccggcgggaaaaacgctccgtggctctggtccctcatgtggggatgggactcgagacaagaaccgaaacgtggatgtctagcgagggcgcctggaagcacgcccagcggatcgagacatggattctgcgccatcccggcttcaccatcatggctgccattctggcttacacaatcgggaccacctattttcagagagttctcattttcatcctgcttacagccgtgacgccttccatggcgatgcggtgcattggaatctctaaccgcgactttgtcgaaggcgtgagcgggggatcctgggttgatatcgtgctggagcacggcagctgtgtcaccacaatggccaaaaataagcccaccctcgacttcgaactgattaagacagaggctaaacaccttgccaccctgagaaagtactgcgtggaagctaaactcacgaacacaaccaccgcctctcggtgtcctacacagggggagccgtccctgaatgaggaacaagataagcgctttgtgtgcaaacatagcatggtcgacagaggatggggcaacggctgtgggctgttcggaaagggcgggatcgttacctgcgcgatgtttacatgcaagaaaaatatggagggaaaggtggtgcagcccgaaaacctcgagtatacgattgtcatcacccctcactctggcgaagagaatgccgtggggaacgatacaggaaaacatggcaaggagattaaagttacaccccagtccagcatcacagaagctgagctgaccggctacgggacggtgaccatggaatgttctcctcggacaggacttgacttcaatgagatggtcctgctccagatggaaaacaaggcctggctggtgcaccgccaatggtttcttgatctgcccctcccgtggctgcctggcgctgacacccaggggtccaactggatccagaaagagacactggttaccttcaagaatccccacgccaagaaacaggatgtggtcgtgctcggaagccaagagggcgccatgcatacggctctgacaggggcgaccgaaattcagatgtcctctggcaaccttctgtttacaggacacctcaagtgcagactgcggatggacaaacttcagctgaagggcatgagctattccatgtgtaccgggaaattcaaggtcgtgaaggagatcgccgaaacccaacatggaacaattgttatcagagtgcagtacgagggcgacgggagcccttgcaaaattcccttcgagatcatggatctcgaaaagcgccacgtcctgggacggctgatcacggtgaatcccattgttaccgagaaagactctcctgtgaacatcgaagctgagccgccctttggcgattcctacattatcattggggtcgaacctggccagctcaagctgagctggttcaaaaagggatctagcatcggccagatgtttgagacaaccatgagaggggccaagcgcatggccattcttggagacacagcttgggatttcggctccctcggcggggtgtttacctctatcgggaaagccctccatcaagtgttcggggcgatctatggcgctgcctttagcggagtttcctggacgatgaagattctgatcggcgtcgtgattacatggatcgggatgaatagccggtctacctccctgagcgtgtctcttgtcctcgtgggagttgtgaccctgtacctgggcgtcatggtgcaggccgactccgggtgtgttgtgagctggaaaaacaaggagctcaaatgcggatccggcattttcatcacagataatgtccacacctggacagaacagtataagtttcagcccgagtctcctagcaagctggcttccgccatccaaaaagctcacgaagaggggatttgtggcatcagatctgtgacgcgccttgaaaacctgatgtggaagcagattacccccgagctcaatcatatcctgacagagaacgaagttaaactgaccattatgacaggagacatcaagggcatcatgcaggccgggaaacggagccttagaccgcagcctaccgagctcaagtactcctggaaagcgtggggaaaggccaagatgctgagcacggaactgcacaatcataccttcctcattgatggccccgagacagctgaatgccctaacaccaatcgcgcctggaactctctggaggtggaggactatgggtttggagtcttcacaaccaatatctggcttaaactgaaggaacggcaagatgtgttttgtgactccaaactcatgagcgctgccattaaggacaacagagcggtgcacgccgatatgggctactggatcgagtctgctctgaacgacacatggaaaattgaaaaggcctccttcatcgaggtcaagagctgccactggcccaaatctcataccctgtggagcaatggcgttcttgagtccgaaatgatcattcctaagaacttcgctgggcccgtgagccagcacaattatcgcccgggataccatacgcagacagccggcccttggcacctcgggcggctggagatggattttgacttctgtgaaggaaccaccgtggtcgtgacagaggattgcggcaacagagggccctctctgcggaccacgacagcctccggaaaactcatcaccgaatggtgctgtcgcagctgcacactgccccctcttagataccggggcgaggacggctgttggtatgggatggagattagaccgctgaaggaaaaagaggaaaatctcgttaactccctggtgaccgctggacatggccagatcgataatttttctctgggggtccttggaatggcgctgttcctggaggaaatgctgcgcacacgggtgggcaccaagcacgccattctcctggttgctgtgagctttgtcacgcttatcaccgggaacatgtccttcagagacctgggacgcgtgatggttatggtgggcgccacaatgaccgatgacattggcatgggggtcacatacctcgccctgctggctgcctttaaggtgagacccaccttcgcggctggacttctgctccggaaactgacgtctaaggagctcatgatgacaaccatcggcatcgtgctgcttagccaatccacaattcctgagtctatcctggaactcaccgatgccctggccctggggatgatggtccttaaaattgttcgcaatatggagaagtatcagctggctgtgaccatcatggccattctctgcgtgcccaacgcggtcatcctgcagaatgcttggaaagtgagctgtacaacgctcgccgttgtgtccgtcagccctctgcttctgacctcttcccaacagaaggccgactggatccccctcgctctgacaattaagggactgaaccctaccgccatctttcttacaaccctgagcagaacgtctaaaaagcggtcctggcccctcaatgaagctattatggccgtgggcatggttagcatcctggcgtcttccctcctgaaaaacgatattccgatgacagggcctcttgtggccggaggcctgctgaccgtctgctacgtgctcaccggccgcagcgctgacctggagcttgaaagagccgctgacgtccggtgggaggagcaggccgaaatctccgggagctctcccatcctgagcattacaatctccgaggatggatctatgagcattaagaatgaagaggaggaacagaccctcacaatcctgattcgcacgggcctcctggtgatctccgggcttttccctgtttctattcccatcaccgccgctgcgtggtatctgtgggaggtgaaaaagcaaagagccggagtcctgtgggacgtgccgagccctccccctgttggcaaagctgaactcgaggatggggcctaccggatcaagcagaagggcattctgggctattcccagatcggcgccggggtgtacaaagaaggaacatttcacaccatgtggcatgtcacacgcggcgctgtgcttatgcacaaggggaaaagaattgagccctcttgggccgacgtgaagaaagatctgatcagctacggaggcgggtggaagctcgagggagaatggaaggagggcgaagaggttcaggtcctggcgctcgaacccggcaaaaaccctcgggctgtgcaaaccaagccggggctgttcaaaacgaacaccggaacaattggcgccgtgtcccttgactttagccccgggacctctggatcccctatcgtcgataagaaaggcaaggtggttgggctgtatggaaatggcgtggtcacaagaagcggcacctacgtgtctgccatcgctcagacagaggagtccattgaagacaaccccgagatcgaagatgacattttccgcaagaaacggctgacgatcatggatctccatcctggggccggaaagaccaaaagatatctgcccgcgattgttcgcgaggctatcaagcggggccttagaacactgatcctcgcccctacccgcgtggtcgccgctgaaatggaggaggccctgcgggggctcccgattagataccagacccccgctatccgcgccgaacacacaggacgggagattgtggacctgatgtgtcatgcgacgttcaccatgagacttctgagccctatccgggttcccaattataacctgattatcatggatgaagcccactttacagaccctgcttccattgccgctcgcggctacatctctaccagagtggagatgggggaggccgccggcatcttcatgacagctacacccccgggaagccgggacccttttccccagtccaatgcgcccattatggatgaagaacgcgaaatccctgagagaagctggaactctggccacgaatgggtcacggacttcaaagggaagacagtgtggtttgtgccctccattaaggccggaaatgatatcgctgcctgcctccggaaaaacggcaagaaagtcattcaactgagcagaaagaccttcgactctgagtatatcaaaacccgcacaaatgattgggactttgttgtgaccacagatatcagcgagatgggggccaacttcaaggctgaacgggtgattgaccctagacgctgtatgaagccggtcatccttaccgatggagaggaacgggtgattctggccggccccatgcctgttacgcattcctctgcggctcagagacgcgggcgggtgggcagaaatcccaaaaacgagaatgaccagtacatctacatgggagaacctctcgagaacgatgaggactgcgcccactggaaggaagccaaaatgctgctggacaatattaacacacccgagggcatcatcccgagcatgtttgaacctgagcgcgaaaaggtcgatgctattgacggggagtatagactccggggagaggcccgcaaaaccttcgtggatcttatgagacggggcgacctgcccgtttggctggcgtaccgcgtggccgctgaagggatcaactatgccgatagacggtggtgttttgacggagtcaagaataaccaaattctcgaggaaaatgtggaggtcgagatctggacaaaagaaggcgagagaaagaagctgaaacctcgctggcttgatgctcggatttactccgaccccctggccctcaaggagttcaaagagttcgctgccgggagaaagtctctgaccctgaacctcatcacggaaatgggccgccttcctacctttatgacacagaaagcgaagaatgccctggataacctggctgtgctccataccgccgaggctggaggccgggcctataatcacgccctgagcgagcttcccgaaacactggagaccctcctgctgctcacacttctggctaccgttacagggggaattttcctgtttctcatgtccggcaaggggatcggaaaaatgacactgggcatgtgctgcatcattaccgcgagcatccttctgtggtacgcccagattcagccgcactggatcgctgcctctattatcctcgagttctttctgatcgtgctgctcattcctgagcccgaaaagcaaagaacaccccaggacaaccagcttacatatgtggtcatcgccattctgaccgttgtggctgccacaatggcgaatgagatgggcttcctggagaaaacgaagaaagattttgggctcggatccatcaccacacagcaacctgaaagcaacattctggacatcgatcttcggccggcctccgcttggaccctgtacgccgtggctacaaccttcatcacgcccatgctccgccattctattgagaatagctccgtcaacgtgtctctgaccgccatcgcgaatcaggccacagttctgatgggcctcgggaagggatggcctcttagcaagatggacattggcgtgcccctgctggctatcgggtgttactcccaggtcaaccctattaccctcacagccgctctgcttctgctcgtggcccactatgctatcattggacccggcctgcaggccaaagcgaccagagaagcccaaaagcgggctgccgctggcatcatgaaaaatcctacggtcgacgggatgacagtgatcgatctggacccgattccctacgatcctaagtttgagaaacagctcggacaggttatgcttctggtgctgtgcgtcacccaggtgctcatgatgcgcacaacctgggccctgtgtgaagcccttaccctggcgacaggccccatcagcacgctctgggaggggaaccctggaagattctggaataccacaattgctgtttctatggccaacatctttcggggctcctatctggctggggccggactcctgttcagcattatgaagaacaccgccaatacacgcagaggcaccggcaacacgggggagacacttggagaaaagtggaaaaatcggctgaacgctctgggcaagtctgagtttcaaatctacaaaaagtccgggatccaggaagtggaccgcaccctcgccaaagagggaattaagagaggcgagaccgatcatcacgcggtcagccgggggtctgccaaactgagatggttcgtggaacgcaatcttgtgacacccgagggaaaggttgtcgacctgggctgcggcagagggggatggagctattactgtggcgggctcaagaacgtgaaagaagtgaagggactgaccaaaggcgggccgggacatgaggaacctatccccatgtccacatatggctggaatctggtcagactccagtctggcgttgatgtgttctttacgccccctgagaagtgcgacacccttctgtgtgatattggggagagctcccccaaccctacagtggaagctggacgcaccctgcgggtcctcaatctggtggagaactggcttaataacaatacacaattctgcatcaaagttctgaacccgtacatgcccagcgtgattgaaaagatggaggccctccagagaaagtacggcggggctctggtccgcaatcctctgtcccggaactctacccacgaaatgtattgggtgagcaacgcctccggaaatatcgtttctagcgtgaacatgatctccagaatgctcattaatcgctttacgatgcggcacaaaaaggcgacctacgagcccgacgtcgatcttggctctgggacaagaaacatcggaattgagagcgaaacccctaatctggacatcattggcaaacgcatcgagaagatcaaacaggaacatgagacatcctggcactatgatcaggaccatccctacaagacctgggcctatcacggcagctacgaaacaaagcaaaccgggtctgcttccagcatggtgaacggagtggtccggctgctcacgaaaccgtgggacgttattcctatggtgacacagatggccatgaccgataccacacccttcggccagcagagagtgtttaaggagaaagtcgacacgcgcacccaagagcctaaggaagggaccaaaaagctgatgaagatcaccgctgagtggctttggaaagaactgggaaagaaaaagacacccagaatgtgtacccgggaggagttcacacgcaaagtgagatctaatgccgctctcggcgccatttttaccgatgaaaacaagtggaaatccgcgcgggaggccgttgaagacagcgggttctgggagctggtggataaggaaagaaatctgcacctcgagggaaagtgcgagacgtgtgtctataacatgatgggcaaacgggaaaagaaactgggcgagtttgggaaggctaaaggatctcgcgccatctggtacatgtggcttggcgctagattcctggaatttgaggccctcgggttcctgaatgaagaccattggttttcccgggagaacagcctttccggagtggagggcgaagggctgcacaagctcggctacattctgcgcgatgttagcaagaaagagggaggcgccatgtatgcggacgataccgctgggtgggacacaagaatcaccctggaagatctcaagaatgaggaaatggtgacaaaccatatggagggagagcacaaaaagctggccgaagccattttcaaacttacctaccagaataaggtcgtgcgggttcagcgccctacgcccagaggcacagtgatggacatcatctctcggcgcgaccagagagggagcggacaagtcgtgacctatggcctgaacacattcaccaacatggaggctcagctcattcggcagatggaaggggagggcgtctttaagtccatccaacagctgacggtgaaagaggaaattgccgttaagaattggcttatccgcgtgggaagagagcggctgtctcgcatggctattagcggcgatgactgcgtcgtgaaaccgctcgatgacagattcgcctccgcgctgaccgccctgaacgatatggggaaggtgcggaaagacatccagcagtgggaaccttctagaggatggaatgattggacacaagttcccttttgcagccatcacttccacgagctcatcatgaaggacggccgcgtgctggtcgtgccctgtcggaaccaggatgaacttattgggagagctcgcatctcccagggagccggctggtctctgcgggagaccgcttgcctcggaaagagctacgcccagatgtggtccctgatgtattttcatagacgcgaccttcggctggcggccaatgctatttgtagcgccgttccttctcactggatcccgacatccagaaccacatggagcattcatgctacccacgagtggatgacgacagaagatatgctcaccgtgtggaaccgcgtctggatccaagagaatccctggatggaagacaaaacccctgtggagtcttgggaagagatcccctacctgggcaagcgggaggatcagtggtgcggatccctgattggcctcacaagcagagccacctgggctaaaaacatccagacagccattaatcaggtccgctccctgatcgggaacgaagagtatacggactacatgccttctatgaagcggttcagacgggaagaggaagaggcgggagtgctttggtga

SEQ ID NO: 19616 - RNA, 9876 nt, synthetic construct
  misc_feature 1..9876: note = derived and/or modified CDS sequence (opt5) from DENV-2__KM279543__SS-prME
  source 1..9876: mol_type = other RNA
accgccggaatcattatcatgatgattcccaccgtgatggctttccacctgacgaccagaaacggggaacctcatatgatcgtgagccggcaggaaaagggaaaatccctcctgtttaagaccgagaatggagttaacatgtgcacccttatggccatggacctgggggaactctgtgaggataccattacctacaattgcccgctgcttcgccaaaacgaacccgaggacatcgattgttggtgcaattctacgagcacctgggtgacgtatggaacctgtacagcgaccggcgagcaccggcgggaaaaacgctccgtggctctggtccctcatgtggggatgggactcgagacaagaaccgaaacgtggatgtctagcgagggcgcctggaagcacgcccagcggatcgagacatggattctgcgccatcccggcttcaccatcatggctgccattctggcttacacaatcgggaccacctattttcagagagttctcattttcatcctgcttacagccgtgacgccttccatggcgatgcggtgcattggaatctctaaccgcgactttgtcgaaggcgtgagcgggggatcctgggttgatatcgtgctggagcacggcagctgtgtcaccacaatggccaaaaataagcccaccctcgacttcgaactgattaagacagaggctaaacaccttgccaccctgagaaagtactgcgtggaagctaaactcacgaacacaaccaccgcctctcggtgtcctacacagggggagccgtccctgaatgaggaacaagataagcgctttgtgtgcaaacatagcatggtcgacagaggatggggcaacggctgtgggctgttcggaaagggcgggatcgttacctgcgcgatgtttacatgcaagaaaaatatggagggaaaggtggtgcagcccgaaaacctcgagtatacgattgtcatcacccctcactctggcgaagagaatgccgtggggaacgatacaggaaaacatggcaaggagattaaagttacaccccagtccagcatcacagaagctgagctgaccggctacgggacggtgaccatggaatgttctcctcggacaggacttgacttcaatgagatggtcctgctccagatggaaaacaaggcctggctggtgcaccgccaatggtttcttgatctgcccctcccgtggctgcctggcgctgacacccaggggtccaactggatccagaaagagacactggttaccttcaagaatccccacgccaagaaacaggatgtggtcgtgctcggaagccaagagggcgccatgcatacggctctgacaggggcgaccgaaattcagatgtcctctggcaaccttctgtttacaggacacctcaagtgcagactgcggatggacaaacttcagctgaagggcatgagctattccatgtgtaccgggaaattcaaggtcgtgaaggagatcgccgaaacccaacatggaacaattgttatcagagtgcagtacgagggcgacgggagcccttgcaaaattcccttcgagatcatggatctcgaaaagcgccacgtcctgggacggctgatcacggtgaatcccattgttaccgagaaagactctcctgtgaacatcgaagctgagccgccctttggcgattcctacattatcattggggtcgaacctggccagctcaagctgagctggttcaaaaagggatctagcatcggccagatgtttgagacaaccatgagaggggccaagcgcatggccattcttggagacacagcttgggatttcggctccctcgggggaatgtttacctctatcggcaaagccctccatcaagtgttcggggcgatctatggcgctgcctttagcggagtgtcctggacgatgaagattctgatcggcgttgtcattacatggatcgggatgaatagccggtctacctccctgagcgtgtctcttgtgctcgtcggagtggttaccctgtacctgggcgtgatggtccaggccgactccgggtgtgtggttagctggaaaaacaaggagctcaaatgcggatccggcattttcatcacagataatgtgcacacctggacagaacagtataagtttcagcccgagtctcctagcaagctggcttccgccatccaaaaagctcacgaagaggggatttgtggcatcagatctgtcacgcgccttgaaaacctgatgtggaagcagattacccccgagctcaatcatatcctgacagagaacgaagtgaaactgaccattatgacaggagacatcaagggcatcatgcaggccgggaaacggagccttagaccgcagcctaccgagctcaagtactcctggaaagcgtggggaaaggccaagatgctgagcacggaactgcacaatcataccttcctcattgatggccccgagacagctgaatgccctaacaccaatcgcgcctggaactctctggaggttgaggactatgggtttggagtgttcacaaccaatatctggcttaaactgaaggaacggcaagatgtcttttgtgactccaaactcatgagcgctgccattaaggacaacagagcggtgcacgccgatatgggctactggatcgagtctgctctgaacgacacatggaaaattgaaaaggcctccttcatcgaggtcaagagctgccactggcccaaatctcataccctgtggagcaatggcgtccttgagtccgaaatgatcattcctaagaacttcgctgggcccgttagccagcacaattatcgcccgggataccatacgcagacagccggcccttggcacctcgggcggctggagatggattttgacttctgtgaaggaaccaccgtggtggtcacagaggattgcggcaacagagggccctctctgcggaccacgacagcctccggaaaactcatcaccgaatggtgctgtcgcagctgcacactgccccctcttagataccggggcgaggacggctgttggtatgggatggagattagaccgctgaaggaaaaagaggaaaatctcgtgaactccctggttaccgctggacatggccagatcgataatttttctctgggggtgcttggaatggcgctgttcctggaggaaatgctgcgcacacgggtcggcaccaagcacgccattctcctggtggctgttagctttgtgacgcttatcaccgggaacatgtccttcagagacctgggacgcgtcatggtgatggttggcgccacaatgaccgatgacattggcatgggggtgacatacctcgccctgctggctgcctttaaggtcagacccaccttcgcggctggacttctgctccggaaactgacgtctaaggagctcatgatgacaaccatcggcatcgtgctgcttagccaatccacaattcctgagtctatcctggaactcaccgatgccctggccctggggatgatggtgcttaaaattgtccgcaatatggagaagtatcagctggctgttaccatcatggccattctctgcgtgcccaacgcggtgatcctgcagaatgcttggaaagtcagctgtacaacgctcgccgtggtttccgtgagccctctgcttctgacctcttcccaacagaaggccgactggatccccctcgctctgacaattaagggactgaaccctaccgccatctttcttacaaccctgagcagaacgtctaaaaagcggtcctggcccctcaatgaagctattatggccgtcggcatggtgagcatcctggcgtcttccctcctgaaaaacgatattccgatgacagggcctcttgttgccggaggcctgctgaccgtgtgctacgtcctcaccggccgcagcgctgacctggagcttgaaagagccgctgacgtgcggtgggaggagcaggccgaaatctccgggagctctcccatcctgagcattacaatctccgaggatggatctatgagcattaagaatgaagaggaggaacagaccctcacaatcctgattcgcacgggcctcctggtcatctccgggcttttccctgtgtctattcccatcaccgccgctgcgtggtatctgtgggaggttaaaaagcaaagagccggagtgctgtgggacgtcccgagccctccccctgtgggcaaagctgaactcgaggatggggcctaccggatcaagcagaagggcattctgggctattcccagatcggcgccggggtttacaaagaaggaacatttcacaccatgtggcatgtgacacgcggcgctgtccttatgcacaaggggaaaagaattgagccctcttgggccgacgtgaagaaagatctgatcagctacggaggcgggtggaagctcgagggagaatggaaggagggcgaagaggtgcaggttctggcgctcgaacccggcaaaaaccctcgggctgtccaaaccaagccggggctgttcaaaacgaacaccggaacaattggcgccgtgtcccttgactttagccccgggacctctggatcccctatcgtggataagaaaggcaaggtcgtggggctgtatggaaatggcgttgtgacaagaagcggcacctacgtctctgccatcgctcagacagagaagtccattgaggacaaccccgaaatcgaggatgacattttccgcaaaaagcggctgacgatcatggatctccatcctggggccggaaaaaccaagagatatctgcccgcgattgtgcgcgaagctatcaaacggggccttagaacactgatcctcgcccctacccgcgttgtggccgctgagatggaagaggccctgcgggggctcccgattagataccagacccccgctatccgcgccgagcacacaggacgggaaattgtcgacctgatgtgtcatgcgacgttcaccatgagacttctgagccctatccgggtgcccaattataacctgattatcatggatgaggcccactttacagaccctgcttccattgccgctcgcggctacatctctaccagagttgaaatgggggaggccgccggcatcttcatgacagctacacccccgggaagccgggacccttttccccagtccaatgcgcccattatggatgaggaacgcgagatccctgaaagaagctggaactctggccacgagtgggtgacggacttcaaggggaagacagtctggtttgtgccctccattaaagccggaaatgatatcgctgcctgcctccggaagaacggcaaaaaggtgattcaactgagcagaaaaaccttcgactctgaatatatcaagacccgcacaaatgattgggactttgtcgttaccacagatatcagcgagatgggggccaacttcaaggctgagcgggtgattgaccctagacgctgtatgaaaccggtgatccttaccgatggagaggaacgggtcattctggccggccccatgcctgtgacgcattcctctgcggctcagagacgcgggcgggttggcagaaatcccaagaacgaaaatgaccagtacatctacatgggagagcctctcgaaaacgatgaggactgcgcccactggaaagaggccaagatgctgctggacaatattaacacacccgaaggcatcatcccgagcatgtttgagcctgaacgcgagaaagtggatgctattgacggggaatatagactccggggagaggcccgcaagaccttcgtcgatcttatgagacggggcgacctgcccgtgtggctggcgtaccgcgttgccgctgaggggatcaactatgccgatagacggtggtgttttgacggagtgaaaaataaccaaattctcgaagagaatgtcgaagtggagatctggacaaaggagggcgaaagaaagaaactgaagcctcgctggcttgatgctcggatttactccgaccccctggccctcaaagagttcaaggagttcgctgccgggagaaaatctctgaccctgaacctcatcacggagatgggccgccttcctacctttatgacacagaaggcgaagaatgccctggataacctggctgtcctccataccgccgaagctggaggccgggcctataatcacgccctgagcgagcttcccgagacactggaaaccctcctgctgctcacacttctggctaccgtgacagggggaattttcctgtttctcatgtccggcaaagggatcggaaagatgacactgggcatgtgctgcatcattaccgcgagcatccttctgtggtacgcccagattcagccgcactggatcgctgcctctattatcctcgagttctttctgatcgttctgctcattcctgaacccgagaaacaaagaacaccccaggacaaccagcttacatatgtggtgatcgccattctgaccgtcgttgctgccacaatggcgaatgaaatgggcttcctggagaagacgaaaaaggattttgggctcggatccatcaccacacagcaacctgagagcaacattctggacatcgatcttcggccggcctccgcttggaccctgtacgccgtggctacaaccttcatcacgcccatgctccgccattctattgaaaatagctccgtgaacgtctctctgaccgccatcgcgaatcaggccacagtgctgatgggcctcgggaagggatggcctcttagcaaaatggacattggcgttcccctgctggctatcgggtgttactcccaggtgaaccctattaccctcacagccgctctgcttctgctcgtcgcccactatgctatcattggacccggcctgcaggccaaggcgaccagagaggcccaaaaacgggctgccgctggcatcatgaagaatcctacggtggacgggatgacagtcatcgatctggacccgattccctacgatcctaaatttgaaaagcagctcggacaggtgatgcttctggttctgtgcgtgacccaggtcctcatgatgcgcacaacctgggccctgtgtgaggcccttaccctggcgacaggccccatcagcacgctctgggaagggaaccctggaagattctggaataccacaattgctgtgtctatggccaacatctttcggggctcctatctggctggggccggactcctgttcagcattatgaagaacaccgccaatacacgcagaggcaccggcaacacgggggagacacttggagagaaatggaagaatcggctgaacgctctgggcaaatctgaatttcaaatctacaagaaatccgggatccaggaggttgaccgcaccctcgccaaggaaggaattaaaagaggcgagaccgatcatcacgcggtgagccgggggtctgccaagctgagatggttcgtcgagcgcaatcttgtgacacccgaaggaaaggtggttgacctgggctgcggcagagggggatggagctattactgtggcgggctcaaaaacgtcaaggaggtgaaaggactgaccaagggcgggccgggacatgaagaacctatccccatgtccacatatggctggaatctggtgagactccagtctggcgtcgatgttttctttacgccccctgaaaaatgcgacacccttctgtgtgatattggggagagctcccccaaccctacagtggaggctggacgcaccctgcgggtgctcaatctggtcgaaaactggcttaataacaatacacaattctgcatcaaggtgctgaacccgtacatgcccagcgttattgagaagatggaagccctccagagaaaatacggcggggctctggtgcgcaatcctctgtcccggaactctacccacgagatgtattgggtcagcaacgcctccggaaatatcgtgtctagcgttaacatgatctccagaatgctcattaatcgctttacgatgcggcacaagaaagcgacctacgaacccgacgtggatcttggctctgggacaagaaacatcggaattgagagcgagacccctaatctggacatcattggcaagcgcatcgagaagatcaagcaggagcatgaaacatcctggcactatgatcaggaccatccctacaagacctgggcctatcacggcagctacgagacaaaacaaaccgggtctgcttccagcatggtcaacggagtggtgcggctgctcacgaagccgtgggacgtcattcctatggttacacagatggccatgaccgataccacacccttcggccagcagagagtgtttaaagaaaaggtggacacgcgcacccaagagcctaaagaggggacaaagaagctgatgaaaatcaccgctgaatggctttggaaggagctgggcaaaaagaaaacacccagaatgtgtacccgggaagagttcacacgcaaggtcagatctaatgccgctctcggcgccatttttaccgatgagaacaaatggaagtccgcgcgggaagccgtggaggacagcgggttctgggaactggttgataaggagagaaatctgcacctcgaaggaaaatgcgagacgtgtgtgtataacatgatgggcaagcgggagaaaaagctgggcgaatttgggaaagctaagggatctcgcgccatctggtacatgtggcttggcgctagattcctggagtttgaagccctcgggttcctgaatgaggaccattggttttcccgggaaaacagcctttccggagtcgagggcgaggggctgcacaagctcggctacattctgcgcgatgtgagcaaaaaggaaggaggcgccatgtatgcggacgataccgctgggtgggacacaagaatcaccctggaggatctcaaaaatgaagagatggttacaaaccatatggaaggagagcacaagaaactggccgaggccattttcaaacttacctaccagaataaggtggtccgggtgcagcgccctacgcccagaggcacagttatggacatcatctctcggcgcgaccagagagggagcggacaagtggtcacctatggcctgaacacattcaccaacatggaagctcagctcattcggcagatggagggggaaggcgtgtttaaatccatccaacagctgacggtcaaggaggagattgccgtgaaaaattggcttatccgcgttggaagagaacggctgtctcgcatggctattagcggcgatgactgcgtggtcaagccgctcgatgacagattcgcctccgcgctgaccgccctgaacgatatggggaaagtgcggaaggacatccagcagtgggagccttctagaggatggaatgattggacacaagtgcccttttgcagccatcacttccacgaactcatcatgaaggacggccgcgttctggtggtcccctgtcggaaccaggatgagcttattgggagagctcgcatctcccagggagccggctggtctctgcgggaaaccgcttgcctcgggaaaagctacgcccagatgtggtccctgatgtattttcatagacgcgaccttcggctggcggccaatgctatttgtagcgccgtgccttctcactggatcccgacatccagaaccacatggagcattcatgctacccacgagtggatgacgacagaggatatgctcaccgtttggaaccgcgtgtggatccaagaaaatccctggatggaggacaagacccctgtcgaatcttgggaggaaatcccctacctgggcaaacgggaggatcagtggtgcggatccctgattggcctcacaagcagagccacctgggctaagaacatccagacagccattaatcaggtgcgctccctgatcgggaacgaggaatatacggactacatgccttctatgaaacggttcagacgggaggaagaggaagcgggagtcctttggtga

SEQ ID NO: 19617 - RNA, 9876 nt, synthetic construct
  misc_feature 1..9876: note = derived and/or modified CDS sequence (opt5) from DENV-2__KM279571__SS-prME
  source 1..9876: mol_type = other RNA
accgccggcatcattatcatgatgattcccaccgtgatggctttccacctgacgaccagaaacggggagcctcatatgatcgtcagccggcaggaaaagggaaaatccctcctgtttaagacagagaatggcgttaacatgtgcacccttatggccatggacctgggggaactctgtgaggataccattacctacaattgcccgctgcttcgccaaaacgaacccgaggacatcgattgttggtgcaattctacaagcacctgggtgacgtatggaacctgtacagcgaccggcgagcacagacgggaaaaacgctccgtggctctggtccctcatgtggggatgggactcgagacaagaaccgaaacgtggatgtctagcgagggcgcctggaagcacgcccagcggatcgagacatggattctgcgccatcccggcttcaccatcatggctgccattctggcttacacaatcgggaccacctattttcagagagttctcattttcatcctgcttacagccgtgacgccttccatggcgatgcggtgcattggaatctctaaccgcgactttgtcgaaggcgtgagcgggggatcctgggttgatatcgtgctggagcacggcagctgtgtcaccacaatggccaaaaataagcccaccctcgacttcgaactgattaagacagaggctaaacaccttgccaccctgagaaagtactgcgtggaagctaaactcacgaacacaaccaccgcctctcggtgtcctacacagggggagccgtccctgaatgaggaacaagataagcgctttgtgtgcaaacatagcatggtcgacagaggatggggcaacggctgtgggctgttcggaaagggcgggatcgttacctgcgcgatgtttacatgcaagaaaaatatggagggaaaggtggtgcagcccgaaaacctcgagtatacgattgtcatcacccctcactctggcgaagagaatgccgtggggaacgatacaggaaaacatggcaaggagattaaagttacaccccagtccagcatcacagaagctgagctgaccggctacgggacggtgaccatggaatgttctcctcggacaggacttgacttcaatgagatggtcctgctccagatggaaaacaaggcctggctggtgcaccgccaatggtttcttgatctgcccctcccgtggctgcctggcgctgacacccaggggtccaactggatccagaaagagacactggttaccttcaagaatccccacgccaagaaacaggatgtggtcgtgctcggaagccaagagggcgccatgcatacggctctgacaggggcgaccgaaattcagatgtcctctggcaaccttctgtttacaggacacctcaagtgcagactgcggatggacaaacttcagctgaagggcatgagctattccatgtgtaccgggaaattcaaggtcgtgaaggagatcgccgaaacccaacatggaacaattgttatcagagtgcagtacgagggcgacgggagcccttgcaaaattcccttcgagatcatggatctcgaaaagcgccacgtcctgggacggctgatcacggtgaatcccattgttaccgagaaagactctcctgtgaacatcgaagctgagccgccctttggcgattcctacattatcattggggtcgaacctggccagctcaagctgagctggttcaaaaagggatctagcatcggccagatgtttgagacaaccatgagaggggccaagcgcatggccattcttggagacacagcttgggatttcggctccctcgggggagtgtttacctctatcggcaaagccctccatcaagtgttcggggcgatctatggcgctgcctttagcggagtttcctggacgatgaagattctgatcggcgtcgtgattacatggatcgggatgaatagccggtctacctccctgagcgtgtctcttgtcctcgtgggagttgtgaccctgtacctgggcgtcatggtgcaggccgactccgggtgtgttgtgagctggaaaaacaaggagctcaaatgcggatccggcattttcatcacagataatgtccacacctggacagaacagtataagtttcagcccgagtctcctagcaagctggcttccgccatccaaaaagctcacgaagaggggatttgtggcatcagatctgtgacgcgccttgaaaacctgatgtggaagcagattacccccgagctcaatcatatcctgacagagaacgaagttaaactgaccattatgacaggagacatcaagggcatcatgcaggccgggaaacggacccttagaccgcagcctacggagctcaagtacagctggaaagcgtggggaaaggccaagatgctgtccaccgaactgcacaatcatacattcctcattgatggccccgagaccgctgaatgccctaacacaaatcgcgcctggaacagcctggaggtggaggactatgggtttggagtcttcaccacaaatatctggcttaaactgaaggaacggcaagatgtgttttgtgactctaaactcatgtccgctgccattaaggacaacagagcggtgcacgccgatatgggctactggatcgagagcgctctgaacgacacctggaaaattgaaaaggcctctttcatcgaggtcaagtcctgccactggcccaaaagccatacgctgtggtctaatggcgttcttgagagcgaaatgatcattcctaagaacttcgctgggcccgtgtcccagcacaattatcgcccgggataccatacacagaccgccggcccttggcacctcgggcggctggagatggattttgacttctgtgaaggaaccacagtggtcgtgaccgaggattgcggcaacagagggcccagcctgcggacgacaaccgcctctggaaaactcatcacagaatggtgctgtcgctcctgcaccctgccccctcttagataccggggcgaggacggctgttggtatgggatggagattagaccgctgaaggaaaaagaggaaaatctcgttaacagcctggtgacagctggacatggccagatcgataatttttccctgggggtccttggaatggcgctgttcctggaggaaatgctgcgcacccgggtgggcacgaagcacgccattctcctggttgctgtgtcttttgtcacccttatcacagggaacatgagcttcagagacctgggacgcgtgatggttatggtgggcgccaccatgacagatgacattggcatgggggtcacctacctcgccctgctggctgcctttaagatcagacccacgttcgcggctggacttctgctccggaaactgacatccaaggagctcatgatgaccacaatcggcattgtgctgctttctcaaagcaccatccctgagtccattctggaactcaccgatgccctggccctggggatgatggtgcttaaaatcgtccgcaatatggagaagtatcagctggctgttacaattatggccatcctctgcgtgcccaacgcggtgatcctgcagaatgcttggaaagtctcttgtacgaccctcgccgtggttagcgtgtcccctctgcttctgacaagctctcaacagaaggccgactggattcccctcgctctgaccatcaagggactgaaccctacagccatttttcttaccacgctgtccagaacaagcaaaaagcggtcttggcccctcaatgaagctatcatggccgtcggcatggtgtccattctggcgagctctctcctgaaaaacgatatcccgatgaccgggcctcttgttgccggaggcctgctgaccgtgtgctacgtcctcacaggccgctccgctgacctggagcttgaaagagccgctgacgtgcggtgggaggagcaggccgaaatcagcgggtccagccccattctgtctatcaccattagcgaggatggatccatgtctatcaagaatgaagaggaggaacagacactcacgattctgatccgcaccggcctcctggtcattagcgggcttttccctgtgtccatccccatcacagccgctgcgtggtatctgtgggaggttaaaaagcaaagagccggagtgctgtgggacgtcccgtctcctccccctgtgggcaaagctgaactcgaggatggggcctaccggattaagcagaagggaatcctgggctatagccagattggcgccggggtttacaaagaaggaacctttcacacaatgtggcatgtgacccgcggcgctgtccttatgcacaaggggaaaagaatcgagccctcctgggccgacgtgaagaaagatctgatttcttacggaggcgggtggaagctcgagggagaatggaaggagggcgaagaggtgcaggttctggcgctcgaacccggcaaaaaccctcgggctgtccaaacgaagccggggctgttcaaaaccaacacaggaaccatcggcgccgtgagccttgacttttcccccgggacaagcggatctcctatcgtggataagaaaggcaaggtcgtggggctgtatggaaatggcgttgtgaccagatccggcacatacgtcagcgccattgctcagacggagaagtctatcgaggacaaccccgaaattgaggatgacatcttccgcaaaaagcggctgaccattatggatctccatcctggggccggaaaaacaaagagatatctgcccgcgatcgtgcgcgaagctatcaaacggggccttagaaccctgattctcgcccctacccgcgttgtggccgctgagatggaagaggccctgcgggggctcccgatcagataccagacacccgctattcgcgccgagcacacgggacgggaaatcgtcgacctgatgtgtcatgcgaccttcacaatgagacttctgtcccctattcgggtgcccaattataacctgatcattatggatgaggcccactttaccgaccctgctagcatcgccgctcgcggctacatctccacaagagttgaaatgggggaggccgccggcattttcatgaccgctacgcccccgggatctcgggacccttttccccagagcaatgcgcccatcatggatgaggaaaaggagattcctgaacgctcctggaacagcggccacgagtgggtgacagacttcaaggggaaaaccgtctggtttgtgccctctatcaaggccggaaatgatattgctgcctgcctccgcaagaacggcaagaaagtgatccaactgtcccggaagaccttcgacagcgaatatatcaagacaagaaccaatgattgggactttgtcgttacaaccgatatttctgagatgggggccaacttcaaagctgagcgcgtgatcgaccctcggagatgtatgaagccggtgattcttacggatggagaggaacgcgtcatcctggccggccccatgcctgtgacacatagctccgcggctcagcggagagggcgcgttggccggaatcccaaaaacgaaaatgaccagtacatttacatgggagagcctctcgaaaacgatgaggactgcgcccactggaaggaggccaaaatgctgctggacaatatcaacacccccgaaggcatcattccgtctatgtttgagcctgaaagagagaaggtggatgctatcgacggggaatatcgcctcagaggagaggcccggaaaacattcgtcgatcttatgcgcagaggcgacctgcccgtgtggctggcgtaccgggttgccgctgaggggattaactatgccgatcgcagatggtgttttgacggagtgaagaataaccaaatcctcgaagagaatgtcgaagtggagatttggaccaaggagggcgaacggaaaaagctgaaacctagatggcttgatgctcgcatctacagcgaccccctggccctcaaggagttcaaagagttcgctgccgggcggaagtccctgacgctgaacctcattaccgagatgggcagacttcctacatttatgacccagaaggcgaaaaatgccctggataacctggctgtcctccatacagccgaagctggaggccgcgcctataatcacgccctgtctgagcttcccgagaccctggaaacactcctgctgctcacccttctggctacggtgacagggggaatcttcctgtttctcatgagcggcaaggggatcggaaaaatgaccctgggcatgtgctgcattatcaccgcgtccattcttctgtggtacgcccagatccagccgcactggattgctgccagcatcatcctcgagttctttctgattgttctgctcatccctgaacccgagaagcaacggacaccccaggacaaccagcttacctatgtggtgattgccatcctgacagtcgttgctgccacgatggcgaatgaaatgggcttcctggagaaaaccaagaaggattttgggctcggatctattacaacccagcaacctgagtccaacatcctggacatcgatcttagaccggccagcgcttggacactgtacgccgtggctaccacgttcattacccccatgctccggcattccatcgaaaattctagcgtgaacgtctccctgacagccattgcgaatcaggccaccgtgctgatgggcctcgggaaaggatggcctctttctaagatggacatcggcgttcccctgctggctattgggtgttacagccaggtgaaccctatcacactcaccgccgctctgcttctgctcgtcgcccactatgctattatcggacccggcctgcaggccaaagcgacgcgcgaggcccaaaagagagctgccgctggcatcatgaaaaatcctacagtggacgggatgaccgtcattgatctggacccgatcccctacgatcctaagtttgaaaagcagctcggacaggtgatgcttctggttctgtgcgtgacacaggtcctcatgatgcggaccacctgggccctgtgtgaggcccttacactggcgacgggccccatttccaccctctgggaagggaaccctggacgcttctggaatacaaccatcgctgtgagcatggccaacatttttagaggctcttatctggctggggccggactcctgttctccatcatgaaaaacacagccaatacccggcgcggcacgggcaacacaggggagacccttggagagaagtggaaaaatagactgaacgctctgggcaagagcgaatttcaaatctacaaaaagtctgggattcaggaggttgaccggaccctcgccaaagaaggaatcaagcgcggcgagacagatcatcacgcggtgtccagagggagcgccaagctgcggtggttcgtcgagagaaatcttgtgacccccgaaggaaaagtggttgacctgggctgcggccgcgggggatggtcttattactgtggcgggctcaagaacgtcaaagaggtgaagggactgacaaaaggcgggccgggacatgaagaacctattcccatgagcacgtatggctggaatctggtgcggctccagtccggcgtcgatgttttctttacaccccctgaaaagtgcgacacacttctgtgtgatatcggggagtctagccccaaccctaccgtggaggctggaagaacactgcgcgtgctcaatctggtcgaaaactggcttaataacaatacccaattctgcattaaggtgctgaacccgtacatgccctccgttatcgagaaaatggaagccctccagcggaagtacggcggggctctggtgagaaatcctctgagccgcaactccacgcacgagatgtattgggtctctaacgccagcggaaatatcgtgtcctctgttaacatgattagccggatgctcatcaatagatttaccatgcgccacaaaaaggcgacatacgaacccgacgtggatcttggctccgggacccggaacattggaatcgagtctgagacacctaatctggacattatcggcaaaagaatcgaaaagattaagcaggagcatgaaaccagctggcactatgatcaggaccatccctacaaaacatgggcctatcacggctcctacgagaccaagcaaacggggagcgcttcttccatggtcaacggagtggtgcgcctgctcacaaaaccgtgggacgtcatccctatggttacccagatggccatgaccgatacaacgcccttcggccagcagcgggtgtttaaggaaaaagtggacaccagaacacaagagcctaaggaggggaccaagaaactgatgaagattacagctgaatggctttggaaagagctgggaaagaaaaagacccccagaatgtgtacaagagaagagttcacccggaaagtccgcagcaatgccgctctcggcgccatctttacggatgagaacaagtggaagtctgcgagagaagccgtggaggactccgggttctgggaactggttgataaagagcggaatctgcacctcgaaggaaagtgcgagacctgtgtgtataacatgatgggcaaaagagagaagaaactgggcgaatttgggaaggctaagggaagccgggccatttggtacatgtggcttggcgctcgcttcctggagtttgaagccctcgggttcctgaatgaggaccattggttttctagagaaaactcccttagcggagtcgagggcgaggggctgcacaaactcggctacatcctgcgggatgtgtccaagaaagaaggaggcgccatgtatgcggacgatacagctgggtgggacacccgcattacactggaggatctcaagaatgaagagatggttaccaaccatatggaaggagagcacaaaaagctggccgaggccatcttcaaacttacgtaccagaataaagtggtcagagtgcagcggcctacaccccgcggcaccgttatggacatcattagcagacgggaccagcgcgggtctggacaagtggtcacatatggcctgaacaccttcacgaacatggaagctcagctcatcagacagatggagggggaaggcgtgtttaagagcattcaacagctgaccgtcaaagaggagatcgccgtgaagaattggcttattcgggttggacgcgaaagactgtcccggatggctatctctggcgatgactgcgtggtcaaaccgctcgatgaccgcttcgccagcgcgctgacagccctgaacgatatggggaaggtgagaaaggacatccagcagtgggagccttcccggggatggaatgattggacccaagtgcccttttgctctcatcacttccacgaactcattatgaaagacggcagagttctggtggtcccctgtcgcaaccaggatgagcttatcgggcgggctagaattagccagggagccggctggtccctgcgcgaaacagcttgcctcgggaagtcttacgcccagatgtggagcctgatgtattttcatcggagagaccttcgcctggcggccaatgctatctgttccgccgtgcctagccactggattccgacctctcggacaacctggtccatccatgctacgcacgagtggatgacaaccgaggatatgctcaccgtttggaacagagtgtggatccaagaaaatccctggatggaggacaaaacacctgtcgaaagctgggaggaaattccctacctgggcaagcgcgaggatcagtggtgcggatctctgatcggcctcacctcccgggccacatgggctaaaaacattcagacggccatcaatcaggtgagaagcctgattgggaacgaggaatataccgactacatgccttccatgaagcgcttccggagagaggaagaggaagcgggagtcctttggtga

SEQ ID NO: 19618 - RNA, 9876 nt, synthetic construct
  misc_feature 1..9876: note = derived and/or modified CDS sequence (opt5) from DENV-2__KM279544__SS-prME
  source 1..9876: mol_type = other RNA
accgccggaatcattatcatgatgattcccacagtgatggctttccacctgacgaccagaaacggggaacctcatatgatcgtgagccggcaggaaaagggaaaatccctcctgtttaagaccgagaatggcgttaacatgtgcacccttatggccatggacctgggggaactctgtgaggatacaattacctacaattgcccgctgcttcgccaaaacgaacccgaggacatcgattgttggtgcaattctacaagcacctgggtgacgtatggaacctgtacagcgaccggcgagcaccggcgggaaaaacgctccgtggctctggtccctcatgtggggatgggactcgagacaagaaccgaaacgtggatgtctagcgagggcgcctggaagcacgcccagcggatcgagacatggattctgcgccatcccggcttcaccatcatggctgccattctggcttacacaatcgggaccacctattttcagagagttctcattttcatcctgcttacagccgtgacgccttccatggcgatgcggtgcattggaacctctaaccgcgactttgtcgaaggcgtgagcgggggatcctgggttgatatcgtgctggagcacggcagctgtgtcacaaccatggccaaaaataagcccacactcgacttcgaactgatcaagaccgaggctaaacaccttgccacgctgagaaagtactgcgtggaagctaaactcacaaacaccaccacagcctctcggtgtcctacccagggggagccgtccctgaatgaggaacaagataagcgctttgtgtgcaaacatagcatggtcgacagaggatggggcaacggctgtgggctgttcggaaagggcgggattgttacatgcgcgatgtttacgtgcaagaaaaatatggagggaaaggtggtgcagcccgaaaacctcgagtataccatcgtcattacacctcactctggcgaagagaatgccgtggggaacgataccggaaaacatggcaaggagatcaaagttacaccccagtccagcattaccgaagctgagctgacgggctacgggaccgtgacaatggaatgttctcctcggaccggacttgacttcaatgagatggtcctgctccagatggaaaacaaggcctggctggtgcaccgccaatggtttcttgatctgcccctcccgtggctgcctggcgctgacacacaggggtccaactggatccagaaagagaccctggttacgttcaagaatccccacgccaagaaacaggatgtggtcgtgctcggaagccaagagggcgccatgcatacagctctgaccggggcgacagaaatccagatgtcctctggcaaccttctgtttaccggacacctcaagtgcagactgcggatggacaaacttcagctgaagggcatgagctattccatgtgtaccgggaaattcaaggtcgtgaaggagattgccgaaacacaacatggaacgatcgttattagagtgcagtacgagggcgacgggagcccttgcaaaatccccttcgagattatggatctcgaaaagcgccacgtcctgggacggctgatcaccgtgaatcccatcgttacagagaaagactctcctgtgaacattgaagctgagccgccctttggcgattcctacatcattatcggggtcgaacctggccagctcaagctgagctggttcaaaaagggatctagcattggccagatgtttgagaccacaatgagaggggccaagcgcatggccatccttggagacaccgcttgggatttcggctccctcgggggaatgtttacgtctattggcaaagccctccatcaagtgttcggggcgatctatggcgctgcctttagcggagtgtcctggacaatgaagatcctgattggcgttgtcatcacctggattgggatgaatagccggtctacctccctgagcgtgtctcttgtgctcgtcggagtggttacactgtacctgggcgtgatggtccaggccgactccgggtgtgtggttagctggaaaaacaaggagctcaaatgcggatccggcatcttcattaccgataatgtgcacacatggacggaacagtataagtttcagcccgagtctcctagcaagctggcttccgccatccaaaaagctcacgaagaggggatctgtggcattagatctgtcacccgccttgaaaacctgatgtggaagcagatcacacccgagctcaatcatattctgaccgagaacgaagtgaaactgacaatcatgaccggagacattaagggcatcatgcaggccgggaaacggagccttagaccgcagcctacggagctcaagtactcctggaaagcgtggggaaaggccaagatgctgagcaccgaactgcacaatcatacattcctcatcgatggccccgagaccgctgaatgccctaacacaaatcgcgcctggaactctctggaggttgaggactatgggtttggagtgttcaccacaaatatttggcttaaactgaaggaacggcaagatgtcttttgtgactccaaactcatgagcgctgccatcaaggacaacagagcggtgcacgccgatatgggctactggattgagtctgctctgaacgacacctggaaaatcgaaaaggcctccttcattgaggtcaagagctgccactggcccaaatctcatacgctgtggagcaatggcgtccttgagtccgaaatgatcatccctaagaacttcgctgggcccgttagccagcacaattatcgcccgggataccatacacagaccgccggcccttggcacctcgggcggctggagatggattttgacttctgtgaaggaaccacagtggtggtcaccgaggattgcggcaacagagggccctctctgcggacgacaaccgcctccggaaaactcattacagaatggtgctgtcgcagctgcaccctgccccctcttagataccggggcgaggacggctgttggtatgggatggagatcagaccgctgaaggaaaaagaggaaaatctcgtgaactccctggttacagctggacatggccagattgataatttttctctgggggtgcttggaatggcgctgttcctggaggaaatgctgcgcacccgggtcggcacgaagcacgccatcctcctggtggctgttagctttgtgacccttattacagggaacatgtccttcagagacctgggacgcgtcatggtgatggttggcgccaccatgacagatgacatcggcatgggggtgacctacctcgccctgctggctgcctttaaggtcagacccacgttcgcggctggacttctgctccggaaactgacatctaaggagctcatgatgaccacaattggcatcgtgctgcttagccaatccaccatccctgagtctattctggaactcaccgatgccctggccctggggatgatggtgcttaaaatcgtccgcaatatggagaagtatcagctggctgttacaattatggccatcctctgcgtgcccaacgcggtgattctgcagaatgcttggaaagtcagctgtacgaccctcgccgtggtttccgtgagccctctgcttctgacatcttcccaacagaaggccgactggatccccctcgctctgaccatcaagggactgaaccctacagccatttttcttaccacgctgagcagaacatctaaaaagcggtcctggcccctcaatgaagctatcatggccgtcggcatggtgagcattctggcgtcttccctcctgaaaaacgatatcccgatgaccgggcctcttgttgccggaggcctgctgaccgtgtgctacgtcctcacaggccgcagcgctgacctggagcttgaaagagccgctgacgtgcggtgggaggagcaggccgaaatttccgggagctctcccatcctgagcatcaccatttccgaggatggatctatgagcatcaagaatgaagaggaggaacagacactcacgattctgatccgcaccggcctcctggtcatttccgggcttttccctgtgtctatccccattacagccgctgcgtggtatctgtgggaggttaaaaagcaaagagccggagtgctgtgggacgtcccgagccctccccctgtgggcaaagctgaactcgaggatggggcctaccggatcaagcagaagggaatcctgggctattcccagattggcgccggggtttacaaagaaggaacctttcacacaatgtggcatgtgacccgcggcgctgtccttatgcacaaggggaaaagaatcgagccctcttgggccgacgtgaagaaagatctgattagctacggaggcgggtggaagctcgagggagaatggaaggagggcgaagaggtgcaggttctggcgctcgaacccggcaaaaaccctcgggctgtccaaacgaagccggggctgttcaaaaccaacacaggaaccatcggcgccgtgtcccttgactttagccccgggacatctggatcccctattgtggataagaaaggcaaggtcgtggggctgtatggaaatggcgttgtgaccagaagcggcacatacgtctctgccatcgctcagacggagaagtccatcgaggacaaccccgaaattgaggatgacatcttccgcaaaaagcggctgaccattatggatctccatcctggggccggaaaaacaaagagatatctgcccgcgatcgtgcgcgaagctattaaacggggccttagaaccctgatcctcgcccctacccgcgttgtggccgctgagatggaagaggccctgcgggggctcccgatcagataccagacacccgctattcgcgccgagcacacgggacgggaaatcgtcgacctgatgtgtcatgcgaccttcacaatgagacttctgagccctattcgggtgcccaattataacctgatcattatggatgaggcccactttaccgaccctgcttccatcgccgctcgcggctacatttctacaagagttgaaatgggggaggccgccggcatcttcatgaccgctacgcccccgggaagccgggacccttttccccagtccaatgcgcccatcatggatgaggaacgcgagattcctgaaagaagctggaactctggccacgagtgggtgacagacttcaaggggaagaccgtctggtttgtgccctccatcaaagccggaaatgatattgctgcctgcctccggaagaacggcaaaaaggtgatccaactgagcagaaaaaccttcgactctgaatatattaagacacgcaccaatgattgggactttgtcgttacaaccgatatcagcgagatgggggccaacttcaaggctgagcgggtgatcgaccctagacgctgtatgaaaccggtgattcttacggatggagaggaacgggtcatcctggccggccccatgcctgtgacacattcctctgcggctcagagacgcgggcgggttggcagaaatcccaagaacgaaaatgaccagtacatttacatgggagagcctctcgaaaacgatgaggactgcgcccactggaaagaggccaagatgctgctggacaatatcaacacccccgaaggcattatcccgagcatgtttgagcctgaacgcgagaaagtggatgctatcgacggggaatatagactccggggagaggcccgcaagacattcgtcgatcttatgagacggggcgacctgcccgtgtggctggcgtaccgcgttgccgctgaggggattaactatgccgatagacggtggtgttttgacggagtgaaaaataaccaaatcctcgaagagaatgtcgaagtggagatttggaccaaggagggcgaaagaaagaaactgaagcctcgctggcttgatgctcggatctactccgaccccctggccctcaaagagttcaaggagttcgctgccgggagaaaatctctgacgctgaacctcattaccgagatgggccgccttcctacatttatgacccagaaggcgaagaatgccctggataacctggctgtcctccatacagccgaagctggaggccgggcctataatcacgccctgagcgagcttcccgagaccctggaaacactcctgctgctcacccttctggctacggtgacagggggaatcttcctgtttctcatgtccggcaaagggattggaaagatgaccctgggcatgtgctgcatcatcaccgcgagcattcttctgtggtacgcccagatccagccgcactggattgctgcctctatcattctcgagttctttctgatcgttctgctcatccctgaacccgagaaacaaagaacaccccaggacaaccagcttacctatgtggtgattgccatcctgacagtcgttgctgccacgatggcgaatgaaatgggcttcctggagaagaccaaaaaggattttgggctcggatccattacaacccagcaacctgagagcaacatcctggacattgatcttcggccggcctccgcttggacactgtacgccgtggctaccacgttcatcacccccatgctccgccattctatcgaaaatagctccgtgaacgtctctctgacagccattgcgaatcaggccaccgtgctgatgggcctcgggaagggatggcctcttagcaaaatggacatcggcgttcccctgctggctattgggtgttactcccaggtgaaccctatcacactcaccgccgctctgcttctgctcgtcgcccactatgctattatcggacccggcctgcaggccaaggcgacgagagaggcccaaaaacgggctgccgctggcattatgaagaatcctacagtggacgggatgaccgtcatcgatctggacccgatcccctacgatcctaaatttgaaaagcagctcggacaggtgatgcttctggttctgtgcgtgacacaggtcctcatgatgcgcaccacctgggccctgtgtgaggcccttacactggcgacgggccccattagcaccctctgggaagggaaccctggaagattctggaatacaaccatcgctgtgtctatggccaacatttttcggggctcctatctggctggggccggactcctgttcagcatcatgaagaacacagccaatacccgcagaggcacgggcaacacaggggagacccttggagagaaatggaagaatcggctgaacgctctgggcaaatctgaatttcaaatttacaagaaatccgggatccaggaggttgaccgcaccctcgccaaggaaggaatcaaaagaggcgagacagatcatcacgcggtgagccgggggtctgccaagctgagatggttcgtcgagcgcaatcttgtgacccccgaaggaaaggtggttgacctgggctgcggcagagggggatggagctattactgtggcgggctcaaaaacgtcaaggaggtgaaaggactgacaaagggcgggccgggacatgaagaacctattcccatgtccacgtatggctggaatctggtgagactccagtctggcgtcgatgttttctttacaccccctgaaaaatgcgacacacttctgtgtgatatcggggagagctcccccaaccctaccgtggaggctggacgcacactgcgggtgctcaatctggtcgaaaactggcttaataacaatacccaattctgcattaaggtgctgaacccgtacatgcccagcgttatcgagaagatggaagccctccagagaaaatacggcggggctctggtgcgcaatcctctgtcccggaactctacgcacgagatgtattgggtcagcaacgcctccggaaatattgtgtctagcgttaacatgatctccagaatgctcatcaatcgctttaccatgcggcacaagaaagcgacatacgaacccgacgtggatcttggctctgggaccagaaacattggaatcgagagcgagacacctaatctggacattatcggcaagcgcattgagaagatcaagcaggagcatgaaacctcctggcactatgatcaggaccatccctacaagacatgggcctatcacggcagctacgagaccaaacaaacggggtctgcttccagcatggtcaacggagtggtgcggctgctcacaaagccgtgggacgtcatccctatggttacccagatggccatgaccgatacaacgcccttcggccagcagagagtgtttaaagaaaaggtggacacccgcacacaagagcctaaagaggggaccaagaagctgatgaaaattacagctgaatggctttggaaggagctgggcaaaaagaaaacccccagaatgtgtacacgggaagagttcacccgcaaggtcagatctaatgccgctctcggcgccatctttacggatgagaacaaatggaagtccgcgcgggaagccgtggaggacagcgggttctgggaactggttgataaggagagaaatctgcacctcgaaggaaaatgcgagacctgtgtgtataacatgatgggcaagcgggagaaaaagctgggcgaatttgggaaagctaagggatctcgcgccatttggtacatgtggcttggcgctagattcctggagtttgaagccctcgggttcctgaatgaggaccattggttttcccgggaaaacagcctttccggagtcgagggcgaggggctgcacaagctcggctacatcctgcgcgatgtgagcaaaaaggaaggaggcgccatgtatgcggacgatacagctgggtgggacaccagaattacactggaggatctcaaaaatgaagagatggttaccaaccatatggaaggagagcacaagaaactggccgaggccatcttcaaacttacgtaccagaataaggtggtccgggtgcagcgccctacacccagaggcaccgttatggacattatctctcggcgcgaccagagagggagcggacaagtggtcacatatggcctgaacaccttcacgaacatggaagctcagctcatccggcagatggagggggaaggcgtgtttaaatccattcaacagctgaccgtcaaggaggagatcgccgtgaaaaattggcttattcgcgttggaagagaacggctgtctcgcatggctatcagcggcgatgactgcgtggtcaagccgctcgatgacagattcgcctccgcgctgacagccctgaacgatatggggaaagtgcggaaggacattcagcagtgggagccttctagaggatggaatgattggacccaagtgcccttttgcagccatcacttccacgaactcatcatgaaggacggccgcgttctggtggtcccctgtcggaaccaggatgagcttatcgggagagctcgcatttcccagggagccggctggtctctgcgggaaacagcttgcctcgggaaaagctacgcccagatgtggtccctgatgtattttcatagacgcgaccttcggctggcggccaatgctatctgtagcgccgtgccttctcactggattccgacctccagaacaacctggagcatccatgctacgcacgagtggatgacaaccgaggatatgctcaccgtttggaaccgcgtgtggattcaagaaaatccctggatggaggacaagacactggtcgaatcttgggaggaaatcccttacctgggcaaacgggaggatcagtggtgcggatccctcatcggcctgaccagcagagccacatgggctaagaacattcagacggccatcaatcaggtgcgctcccttattgggaacgaggaatataccgactacatgccctctatgaaacggttcagacgggaggaagaggaagcgggagtcctgtggtga

SEQ ID NO: 19619 - RNA, 9876 nt, synthetic construct
  misc_feature 1..9876: note = derived and/or modified CDS sequence (opt5) from DENV-2__KM279549__SS-prME
  source 1..9876: mol_type = other RNA
accgccggaatcattatcatgatgattcccaccgtgatggctttccacctgacgaccagaaacggggaacctcatatgatcgtcagccggcaggaaaagggaaaatccctcctgtttaagaccgagaatggagttaacatgtgcacccttatggccatggacctgggggaactctgtgaggataccattacctacaattgcccgctgcttcgccaaaacgaacccgaggacatcgattgttggtgcaattctacgagcacctgggtgacgtatggaacctgtacagcgaccggcgagcaccggcgggaaaaacgctccgtggctctggtccctcatgtggggatgggactcgagacaagaaccgaaacgtggatgtctagcgagggcgcctggaagcacgcccagcggatcgagacatggattctgcgccatcccggcttcaccatcatggctgccattctggcttacacaatcgggaccacctattttcagagagttctcattttcatcctgcttacagccgtgacgccttccatggcgatgcggtgcattggaatctctaaccgcgactttgtcgaaggcgtgagcgggggatcctgggttgatatcgtgctggagcacggcagctgtgtcaccacaatggccaaaaataagcccaccctcgacttcgaactgattaagacagaggctaaacaccttgccaccctgagaaagtactgcgtggaagctaaactcacgaacacaaccaccgcctctcggtgtcctacacagggggagccgtccctgaatgaggaacaagataagcgctttgtgtgcaaacatagcatggtcgacagaggatggggcaacggctgtgggctgttcggaaagggcgggatcgttacctgcgcgatgtttacatgcaagaaaaatatggagggaaaggtggtgcagcccgaaaacctcgagtatacgattgtcatcacccctcactctggcgaagagaatgccgtggggaacgatacaggaaaacatggcaaggagattaaagttacaccccagtccagcatcacagaagctgagctgaccggctacgggacggtgaccatggaatgttctcctcggacaggacttgacttcaatgagatggtcctgctccagatggaaaacaaggcctggctggtgcaccgccaatggtttcttgatctgcccctcccgtggctgcctggcgctgacacccaggggtccaactggatccagaaagagacactggttaccttcaagaatccccacgccaagaaacaggatgtggtcgtgctcggaagccaagagggcgccatgcatacggctctgacaggggcgaccgaaattcagatgtcctctggcaaccttctgtttacaggacacctcaagtgcagactgcggatggacaaacttcagctgaagggcatgagctattccatgtgtaccgggaaattcaaggtcgtgaaggagatcgccgaaacccaacatggaacaattgttatcagagtgcagtacgagggcgacgggagcccttgcaaaattcccttcgagatcatggatctcgaaaagcgccacgtcctgggacggctgatcacggtgaatcccattgttaccgagaaagactctcctgtgaacatcgaagctgagccgccctttggcgattcctacattatcattggggtcgaacctggccagctcaagctgagctggttcaaaaagggatctagcatcggccagatgtttgagacaaccatgagaggggccaagcgcatggccattcttggagacacagcttgggatttcggctccctcgggggagtgtttacctctatcggcaaagccctccatcaagtgttcggggcgatctatggcgctgcctttagcggagtttcctggacgatgaagattctgatcggcgtcgtgattacatggatcgggatgaatagccggtctacctccctgagcgtgtctcttgtcctcgtgggagttgtgaccctgtacctgggcgtcatggtgcaggccgactccgggtgtgttgtgagctggaaaaacaaggagctcaaatgcggatccggcattttcatcacagataatgtccacacctggacagaacagtataagtttcagcccgagtctcctagcaagctggcttccgccatccaaaaagctcacgaagaggggatttgtggcatcagatctgtgacgcgccttgaaaacctgatgtggaagcagattacccccgagctcaatcatatcctgacagagaacgaagttaaactgaccattatgacaggagacatcaagggcatcatgcaggccgggaaacggagccttagaccgcagcctaccgagctcaagtactcctggaaagcgtggggaaaggccaagatgctgagcacggaactgcacaatcataccttcctcattgatggccccgagacagctgaatgccctaacaccaatcgcgcctggaactctctggaggtggaggactatgggtttggagtcttcacaaccaatatctggcttaaactgaaggaacggcaagatgtgttttgtgactccaaactcatgagcgctgccattaaggacaacagagcggtgcacgccgatatgggctactggatcgagtctgctctgaacgacacatggaaaattgaaaaggcctccttcatcgaggtcaagagctgccactggcccaaatctcataccctgtggagcaatggcgttcttgagtccgaaatgatcattcctaagaacttcgctgggcccgtgagccagcacaattatcgcccgggataccatacgcagacagccggcccttggcacctcgggcggctggagatggattttgacttctgtgaaggaaccaccgtggtcgtgacagaggattgcggcaacagagggccctctctgcggaccacgacagcctccggaaaactcatcaccgaatggtgctgtcgcagctgcacactgccccctcttagataccggggcgaggacggctgttggtatgggatggagattagaccgctgaaggaaaaagaggaaaatctcgttaactccctggtgaccgctggacatggccagatcgataatttttctctgggggtccttggaatggcgctgttcctggaggaaatgctgcgcacacgggtgggcaccaagcacgccattctcctggttgctgtgagctttgtcacgcttatcaccgggaacatgtccttcagagacctgggacgcgtgatggttatggtgggcgccacaatgaccgatgacattggcatgggggtcacatacctcgccctgctggctgcctttaaggtgagacccaccttcgcggctggacttctgctccggaaactgacgtctaaggagctcatgatgacaaccatcggcatcgtgctgcttagccaatccacaattcctgagtctatcctggaactcaccgatgccctggccctggggatgatggtccttaaaattgttcgcaatatggagaagtatcagctggctgtgaccatcatggccattctctgcgtgcccaacgcggtcatcctgcagaatgcttggaaagtgagctgtacaacgctcgccgttgtgtccgtcagccctctgcttctgacctcttcccaacagaaggccgactggatccccctcgctctgacaattaagggactgaaccctaccgccatctttcttacaaccctgagcagaacgtctaaaaagcggtcctggcccctcaatgaagctattatggccgtgggcatggttagcatcctggcgtcttccctcctgaaaaacgatattccgatgacagggcctcttgtggccggaggcctgctgaccgtctgctacgtgctcaccggccgcagcgctgacctggagcttgaaagagccgctgacgtccggtgggaggagcaggccgaaatctccgggagctctcccatcctgagcattacaatctccgaggatggatctatgagcattaagaatgaagaggaggaacagaccctcacaatcctgattcgcacgggcctcctggtgatctccgggcttttccctgtttctattcccatcaccgccgctgcgtggtatctgtgggaggtgaaaaagcaaagagccggagtcctgtgggacgtgccgagccctccccctgttggcaaagctgaactcgaggatggggcctaccggatcaagcagaagggcattctgggctattcccagatcggcgccggggtgtacaaagaaggaacatttcacaccatgtggcatgtcacacgcggcgctgtgcttatgcacaaggggaaaagaattgagccctcttgggccgacgtgaagaaagatctgatcagctacggaggcgggtggaagctcgagggagaatggaaggagggcgaagaggttcaggtcctggcgctcgaacccggcaaaaaccctcgggctgtgcaaaccaagccggggctgttcaaaacgaacaccggaacaattggcgccgtgtcccttgactttagccccgggacctctggatcccctatcgtcgataagaaaggcaaggtggttgggctgtatggaaatggcgtggtcacaagaagcggcacctacgtgtctgccatcgctcagacagagaagtccattgaggacaaccccgaaatcgaggatgacattttccgcaaaaagcggctgacgatcatggatctccatcctggggccggaaaaaccaagagatatctgcccgcgattgttcgcgaagctatcaaacggggccttagaacactgatcctcgcccctacccgcgtggtcgccgctgagatggaagaggccctgcgggggctcccgattagataccagacccccgctatccgcgccgagcacacaggacgggaaattgtggacctgatgtgtcatgcgacgttcaccatgagacttctgagccctatccgggttcccaattataacctgattatcatggatgaggcccactttacagaccctgcttccattgccgctcgcggctacatctctaccagagtggaaatgggggaggccgccggcatcttcatgacagctacacccccgggaagccgggacccttttccccagtccaatgcgcccattatggatgaggaacgcgagatccctgaaagaagctggaactctggccacgagtgggtcacggacttcaaggggaagacagtgtggtttgtgccctccattaaagccggaaatgatatcgctgcctgcctccggaagaacggcaaaaaggtcattcaactgagcagaaaaaccttcgactctgaatatatcaagacccgcacaaatgattgggactttgttgtgaccacagatatcagcgagatgggggccaacttcaaggctgagcgggtgattgaccctagacgctgtatgaaaccggtcatccttaccgatggagaggaacgggtgattctggccggccccatgcctgttacgcattcctctgcggctcagagacgcgggcgggtgggcagaaatcccaagaacgaaaatgaccagtacatctacatgggagagcctctcgaaaacgatgaggactgcgcccactggaaagaggccaagatgctgctggacaatattaacacacccgaaggcatcatcccgagcatgtttgagcctgaacgcgagaaagtcgatgctattgacggggaatatagactccggggagaggcccgcaagaccttcgtggatcttatgagacggggcgacctgcccgtttggctggcgtaccgcgtggccgctgaggggatcaactatgtcgatagacggtggtgttttgacggagtgaaaaataaccaaattctcgaagagaatgtcgaagtggagatctggacaaaggagggcgaaagaaagaaactgaagcctcgctggcttgatgcccggatttactccgaccccctggctctcaaagagttcaaggagttcgccgctgggagaaaatctctgaccctgaacctcatcacggagatgggccgccttcctacctttatgacacagaaggccaagaatgcgctggataacctggccgttctccataccgctgaagccggaggccgggcttataatcacgccctgagcgagcttcccgagacactggaaaccctcctgctgctcacacttctggccaccgtgacagggggaattttcctgtttctcatgtccggcaaagggatcggaaagatgacactgggcatgtgctgcatcattaccgctagcatccttctgtggtacgcgcagattcagccgcactggatcgccgcttctattatcctcgagttctttctgatcgtgctgctcattcctgaacccgagaaacaaagaacaccccaggacaaccagcttacatatgtcgttatcgccattctgaccgtggtggccgctacaatggccaatgaaatgggcttcctggagaagacgaaaaaggattttgggctcggatccatcaccacacagcaacctgagagcaacattctggacatcgatcttcggccggcgtccgcctggaccctgtacgctgtcgccacaaccttcatcacgcccatgctccgccattctattgaaaatagctccgtgaacgtttctctgaccgctatcgccaatcaggcgacagtgctgatgggcctcgggaagggatggcctcttagcaaaatggacattggcgtccccctgctggccatcgggtgttactcccaggtgaaccctattaccctcacagctgccctgcttctgctcgtcgctcactatgccatcattggacccggcctgcaggctaaggccaccagagaggcgcaaaaacgggccgctgccggcatcatgaagaatcctacggtggacgggatgacagttatcgatctggacccgattccctacgatcctaaatttgaaaagcagctcggacaggtgatgcttctggtcctgtgcgtgacccaggttctcatgatgcgcacaacctgggctctgtgtgaggcccttaccctggccacaggccccatcagcacgctctgggaagggaaccctggaagattctggaataccacaattgcggtgtctatggctaacatctttcggggctcctatctggccggggctggactcctgttcagcattatgaagaacaccgccaatacacgcagaggcaccggcaacacgggggagacacttggagagaaatggaagaatcggctgaacgccctgggcaaatctgaatttcaaatctacaagaaatccgggatccaggaggtcgaccgcaccctcgctaaggaaggaattaaaagaggcgagaccgatcatcacgccgtgagccgggggtctgcgaagctgagatggttcgtggagcgcaatcttgttacacccgaaggaaaggtcgtggacctgggctgcggcagagggggatggagctattactgtggcgggctcaaaaacgtgaaggaggtcaaaggactgaccaagggcgggccgggacatgaagaacctatccccatgtccacatatggctggaatctggttagactccagtctggcgtggatgtgttctttacgccccctgaaaaatgcgacacccttctgtgtgatattggggagagctcccccaaccctacagtcgaggccggacgcaccctgcgggtgctcaatctggttgaaaactggcttaataacaatacacaattctgcatcaaggtgctgaacccgtacatgcccagcgtcattgagaagatggaagctctccagagaaaatacggcggggccctggtgcgcaatcctctgtcccggaactctacccacgagatgtattgggttagcaacgcttccggaaatatcgtgtctagcgtcaacatgatctccagaatgctcattaatcgctttacgatgcggcacaagaaagccacctacgaacccgacgtggatcttggctctgggacaagaaacatcggaattgagagcgagacccctaatctggacatcattggcaagcgcatcgagaagatcaagcaggagcatgaaacatcctggcactatgatcaggaccatccctacaagacctgggcgtatcacggcagctacgagacaaaacaaaccgggtctgcctccagcatggtgaacggagtcgttcggctgctcacgaagccgtgggacgtgattcctatggtgacacagatggctatgaccgataccacacccttcggccagcagagagtctttaaagaaaaggtggacacgcgcacccaagagcctaaagaggggacaaagaagctgatgaaaatcaccgccgaatggctttggaaggagctgggcaaaaagaaaacacccagaatgtgtacccgggaagagttcacacgcaaggttagatctaatgctgccctcggcgctatttttaccgatgagaacaaatggaagtccgcccgggaagcggtggaggacagcgggttctgggaactggtcgataaggagagaaatctgcacctcgaaggaaaatgcgagacgtgtgtgtataacatgatgggcaagcgggagaaaaagctgggcgaatttgggaaagccaagggatctcgcgctatctggtacatgtggcttggcgccagattcctggagtttgaagctctcgggttcctgaatgaggaccattggttttcccgggaaaacagcctttccggagttgagggcgaggggctgcacaagctcggctacattctgcgcgatgtgagcaaaaaggaaggaggcgccatgtatgccgacgataccgcggggtgggacacaagaatcaccctggaggatctcaaaaatgaagagatggtcacaaaccatatggaaggagagcacaagaaactggctgaggccattttcaaacttacctaccagaataaggtggttcgggtgcagcgccctacgcccagaggcacagtcatggacatcatctctcggcgcgaccagagagggagcggacaagtggtcacctatggcctgaacacattcaccaacatggaagcccagctcattcggcagatggagggggaaggcgtgtttaaatccatccaacagctgacggttaaggaggagattgctgtgaaaaattggcttatccgcgtcggaagagaacggctgtctcgcatggccattagcggcgatgactgcgtggtgaagccgctcgatgacagattcgcttccgccctgaccgcgctgaacgatatggggaaagttcggaaggacatccagcagtgggagccttctagaggatggaatgattggacacaagtgcccttttgcagccatcacttccacgaactcatcatgaaggacggccgcgtcctggtggttccctgtcggaaccaggatgagcttattgggagagcccgcatctcccagggagctggctggtctctgcgggaaaccgcctgcctcgggaaaagctacgctcagatgtggtccctgatgtattttcatagacgcgaccttcggctggccgcgaatgccatttgtagcgctgtgccttctcactggatcccgacatccagaaccacatggagcattcatgccacccacgagtggatgacgacagaggatatgctcaccgtctggaaccgcgtgtggatccaagaaaatccctggatggaggacaagacccctgtcgaatcttgggaggaaatcccctacctgggcaaacgggaggatcagtggtgcggatccctgattggcctcacaagcagagctacctgggccaagaacatccagacagctattaatcaggtgcgctccctgatcgggaacgaggaatatacggactacatgccttctatgaaacggttcagacgggaggaagaggaagccggagttctttggtga

SEQ ID NO: 19620 - RNA, 9876 nt, synthetic construct
  misc_feature 1..9876: note = derived and/or modified CDS sequence (opt5) from DENV-2__KM279552__SS-prME
  source 1..9876: mol_type = other RNA
accgccggaatcattatcatgatgattcccaccgtgatggctttccacctgacgaccagaaacggggaacctcatatgatcgtcagccggcaggaaaagggaaaatccctcctgtttaagaccgagaatggagttaacatgtgcacccttatggccatggacctgggggaactctgtgaggataccattacctacaattgcccgctgcttcgccaaaacgaacccgaggacatcgattgttggtgcaattctacgagcacctgggtgacgtatggaacctgtacagcgaccggcgagcaccggcgggaaaaacgctccgtggctctggtccctcatgtggggatgggactcgagacaagaaccgaaacgtggatgtctagcgagggcgcctggaagcacgcccagcggatcgagacatggattctgcgccatcccggcttcaccatcatggctgccattctggcttacacaatcgggaccacctattttcagagagttctcattttcatcctgcttacagccgtgacgccttccatggcgatgcggtgcattggaatctctaaccgcgactttgtcgaaggcgtgagcgggggatcctgggttgatatcgtgctggagcacggcagctgtgtcaccacaatggccaaaaataagcccaccctcgacttcgaactgattaagacagaggctaaacaccttgccaccctgagaaagtactgcgtggaagctaaactcacgaacacaaccaccgcctctcggtgtcctacacagggggagccgtccctgaatgaggaacaagataagcgctttgtgtgcaaacatagcatggtcgacagaggatggggcaacggctgtgggctgttcggaaagggcgggatcgttacctgcgcgatgtttacatgcaagaaaaatatggagggaaaggtggtgcagcccgaaaacctcgagtatacgattgtcatcacccctcactctggcgaagagaatgccgtggggaacgatacaggaaaacatggcaaggagattaaagttacaccccagtccagcatcacagaagctgagctgaccggctacgggacggtgaccatggaatgttctcctcggacaggacttgacttcaatgagatggtcctgctccagatggaaaacaaggcctggctggtgcaccgccaatggtttcttgatctgcccctcccgtggctgcctggcgctgacacccaggggtccaactggatccagaaagagacactggttaccttcaagaatccccacgccaagaaacaggatgtggtcgtgctcggaagccaagagggcgccatgcatacggctctgacaggggcgaccgaaattcagatgtcctctggcaaccttctgtttacaggacacctcaagtgcagactgcggatggacaaacttcagctgaagggcatgagctattccatgtgtaccgggaaattcaaggtcgtgaaggagatcgccgaaacccaacatggaacaattgttatcagagtgcagtacgagggcgacgggagcccttgcaaaattcccttcgagatcatggatctcgaaaagcgccacgtcctgggacggctgatcacggtgaatcccattgttaccgagaaagactctcctgtgaacatcgaagctgagccgccctttggcgattcctacattatcattggggtcgaacctggccagctcaagctgagctggttcaaaaagggatctagcatcggccagatgtttgagacaaccatgagaggggccaagcgcatggccattcttggagacacagcttgggatttcggctccctcgggggagtgtttacctctatcggcaaagccctccatcaagtgttcggggcgatctatggcgctgcctttagcggagtttcctggacgatgaagattctgatcggcgtcgtgattacatggatcgggatgaatagccggtctacctccctgagcgtgtctcttgtcctcgtgggagttgtgaccctgtacctgggcgtcatggtgcaggccgactccgggtgtgttgtgagctggaaaaacaaggagctcaaatgcggatccggcattttcatcacagataatgtccacacctggacagaacagtataagtttcagcccgagtctcctagcaagctggcttccgccatccaaaaagctcacgaagaggggatttgtggcatcagatctgtgacgcgccttgaaaacctgatgtggaagcagattacccccgagctcaatcatatcctgacagagaacgaagttaaactgaccattatgacaggagacatcaagggcatcatgcaggccgggaaacggagccttagaccgcagcctaccgagctcaagtactcctggaaagcgtggggaaaggccaagatgctgagcacggaactgcacaatcataccttcctcattgatggccccgagacagctgaatgccctaacaccaatcgcgcctggaactctctggaggtggaggactatgggtttggagtcttcacaaccaatatctggcttaaactgaaggaacggcaagatgtgttttgtgactccaaactcatgagcgctgccattaaggacaacagagcggtgcacgccgatatgggctactggatcgagtctgctctgaacgacacatggaaaattgaaaaggcctccttcatcgaggtcaagagctgccactggcccaaatctcataccctgtggagcaatggcgttcttgagtccgaaatgatcattcctaagaacttcgctgggcccgtgagccagcacaattatcgcccgggataccatacgcagacagccggcccttggcacctcgggcggctggagatggattttgacttctgtgaaggaaccaccgtggtcgtgacagaggattgcggcaacagagggccctctctgcggaccacgacagcctccggaaaactcatcaccgaatggtgctgtcgcagctgcacactgccccctcttagataccggggcgaggacggctgttggtatgggatggagattagaccgctgaaggaaaaagaggaaaatctcgttaactccctggtgaccgctggacatggccagatcgataatttttctctgggggtccttggaatggcgctgttcctggaggaaatgctgcgcacacgggtgggcaccaagcacgccattctcctggttgctgtgagctttgtcacgcttatcaccgggaacatgtccttcagagacctgggacgcgtgatggttatggtgggcgccacaatgaccgatgacattggcatgggggtcacatacctcgccctgctggctgcctttaaggtgagacccaccttcgcggctggacttctgctccggaaactgacgtctaaggagctcatgatgacaaccatcggcatcgtgctgcttagccactccacaattcctgagtctatcctggaactcaccgatgccctggccctggggatgatggtccttaaaattgttcgcaatatggagaagtatcaactggctgtgaccatcatggccattctctgcgtgcccaacgcggtcatcctgcagaatgcttggaaagtgagctgtacaacgctcgccgttgtgtccgtcagccctctgcttctgacctcttcccagcaaaaggccgactggatccccctcgctctgacaattaagggactgaaccctaccgccatctttcttacaaccctgagcagaacgtctaaaaagcggtcctggcccctcaatgaagctattatggccgtgggcatggttagcatcctggcgtcttccctcctgaaaaacgatattccgatgacagggcctcttgtggccggaggcctgctgaccgtctgctacgtgctcaccggccgcagcgctgacctggagcttgaaagagccgctgacgtccggtgggaggagcaggccgaaatctccgggagctctcccatcctgagcattacaatctccgaggatggatctatgagcattaagaatgaagaggaggaacagaccctcacaatcctgattcgcacgggcctcctggtgatctccgggcttttccctgtttctattcccatcaccgccgctgcgtggtatctgtgggaggtgaaaaagcagagagccggagtcctgtgggacgtgccgagccctccccctgttggcaaagctgaactcgaggatggggcctaccggatcaagcaaaagggcattctgggctattcccagatcggcgccggggtgtacaaagaaggaacatttcataccatgtggcacgtcacacgcggcgctgtgcttatgcataaggggaaaagaattgagccctcttgggccgacgtgaagaaagatctgatcagctacggaggcgggtggaagctcgagggagaatggaaggagggcgaagaggttcaggtcctggcgctcgaacccggcaaaaaccctcgggctgtgcagaccaagccggggctgttcaaaacgaacaccggaacaattggcgccgtgtcccttgactttagccccgggacctctggatcccctatcgtcgataagaaaggcaaggtggttgggctgtatggaaatggcgtggtcacaagaagcggcacctacgtgtctgccatcgctcaaacagagaagtccattgaggacaaccccgaaatcgaggatgacattttccgcaaaaagcggctgacgatcatggatctccaccctggggccggaaaaaccaagagatatctgcccgcgattgttcgcgaagctatcaaacggggccttagaacactgatcctcgcccctacccgcgtggtcgccgctgagatggaagaggccctgcgggggctcccgattagataccagacccccgctatccgcgccgagcatacaggacgggaaattgtggacctgatgtgtcacgcgacgttcaccatgagacttctgagccctatccgggttcccaattataacctgattatcatggatgaggcccactttacagaccctgcttccattgccgctcgcggctacatctctaccagagtggaaatgggggaggccgccggcatcttcatgacagctacacccccgggaagccgggacccttttccccagtccaatgcgcccattatggatgaggaacgcgagatccctgaaagaagctggaactctggccatgagtgggtcacggacttcaaggggaagacagtgtggtttgtgccctccattaaagccggaaatgatatcgctgcctgcctccggaagaacggcaaaaaggtcattcagctgagcagaaaaaccttcgactctgaatatatcaagacccgcacaaatgattgggactttgttgtgaccacagatatcagcgagatgggggccaacttcaaggctgagcgggtgattgaccctagacgctgtatgaaaccggtcatccttaccgatggagaggaacgggtgattctggccggccccatgcctgttacgcactcctctgcggctcaaagacgcgggcgggtgggcagaaatcccaagaacgaaaatgaccagtacatctacatgggagagcctctcgaaaacgatgaggactgcgcccattggaaagaggccaagatgctgctggacaatattaacacacccgaaggcatcatcccgagcatgtttgagcctgaacgcgagaaagtcgatgctattgacggggaatatagactccggggagaggcccgcaagaccttcgtggatcttatgagacggggcgacctgcccgtttggctggcgtaccgcgtggccgctgaggggatcaactatgccgatagacggtggtgttttgacggagtcaaaaataaccagattctcgaagagaatgtggaagtcgagatctggacaaaggagggcgaaagaaagaaactgaagcctcgctggcttgatgctcggatttactccgaccccctggccctcaaagagttcaaggagttcgctgccgggagaaaatctctgaccctgaacctcatcacggagatgggccgccttcctacctttatgacacaaaaggcgaagaatgccctggataacctggctgtgctccacaccgccgaagctggaggccgggcctataatcacgccctgagcgagcttcccgagacactggaaaccctcctgctgctcacacttctggctaccgttacagggggaattttcctgtttctcatgtccggcaaagggatcggaaagatgacactgggcatgtgctgcatcattaccgcgagcatccttctgtggtacgcccagattcagccgcattggatcgctgcctctattatcctcgagttctttctgatcgtgctgctcattcctgaacccgagaaacagagaacaccccaagacaaccagcttacatatgtggtcatcgccattctgaccgttgtggctgccacaatggcgaatgaaatgggcttcctggagaagacgaaaaaggattttgggctcggatccatcaccacacagcagcctgagagcaacattctggacatcgatcttcggccggcctccgcttggaccctgtacgccgtggctacaaccttcatcacgcccatgctccgccactctattgaaaatagctccgtcaacgtgtctctgaccgccatcgcgaatcaagccacagttctgatgggcctcgggaagggatggcctcttagcaaaatggacattggcgtgcccctgctggctatcgggtgttactcccaggtcaaccctattaccctcacagccgctctgcttctgctcgtggcccattatgctatcattggacccggcctgcaggccaaggcgaccagagaggcccagaaacgggctgccgctggcatcatgaagaatcctacggtcgacgggatgacagtgatcgatctggacccgattccctacgatcctaaatttgaaaagcaactcggacaggttatgcttctggtgctgtgcgtcacccaggtgctcatgatgcgcacaacctgggccctgtgtgaggcccttaccctggcgacaggccccatcagcacgctctgggaagggaaccctggaagattctggaataccacaattgctgtttctatggccaacatctttcggggctcctatctggctggggccggactcctgttcagcattatgaagaacaccgccaatacacgcagaggcaccggcaacacgggggagacacttggagagaaatggaagaatcggctgaacgctctgggcaaatctgaatttcagatctacaagaaatccgggatccaagaggtggaccgcaccctcgccaaggaaggaattaaaagaggcgagaccgatcaccatgcggtcagccgggggtctgccaagctgagatggttcgtggagcgcaatcttgtgacacccgaaggaaaggttgtcgacctgggctgcggcagagggggatggagctattactgtggcgggctcaaaaacgtgaaggaggtgaaaggactgaccaagggcgggccgggacacgaagaacctatccccatgtccacatatggctggaatctggtcagactccagtctggcgttgatgtgttctttacgccccctgaaaaatgcgacacccttctgtgtgatattggggagagctcccccaaccctacagtggaggctggacgcaccctgcgggtcctcaatctggtggaaaactggcttaataacaatacacagttctgcatcaaggttctgaacccgtacatgcccagcgtgattgagaagatggaagccctccaaagaaaatacggcggggctctggtccgcaatcctctgtcccggaactctacccacgagatgtattgggtgagcaacgcctccggaaatatcgtttctagcgtgaacatgatctccagaatgctcattaatcgctttacgatgcggcataagaaagcgacctacgaacccgacgtcgatcttggctctgggacaagaaacatcggaattgagagcgagacccctaatctggacatcattggcaagcgcatcgagaagatcaagcaggagcacgaaacatcctggcattatgatcaggaccacccctacaagacctgggcctatcacggcagctacgagacaaaacagaccgggtctgcttccagcatggtgaacggagtggtccggctgctcacgaagccgtgggacgttattcctatggtgacacaaatggccatgaccgataccacacccttcggccagcagagagtgtttaaagaaaaggtcgacacgcgcacccaggagcctaaagaggggacaaagaagctgatgaaaatcaccgctgaatggctttggaaggagctgggcaaaaagaaaacacccagaatgtgtacccgggaagagttcacacgcaaggtgagatctaatgccgctctcggcgccatttttaccgatgagaacaaatggaagtccgcgcgggaagccgttgaggacagcgggttctgggaactggtggataaggagagaaatctgcatctcgaaggaaaatgcgagacgtgtgtctataacatgatgggcaagcgggagaaaaagctgggcgaatttgggaaagctaagggatctcgcgccatctggtacatgtggcttggcgctagattcctggagtttgaagccctcgggttcctgaatgaggaccactggttttcccgggaaaacagcctttccggagtggagggcgaggggctgcataagctcggctacattctgcgcgatgttagcaaaaaggaaggaggcgccatgtatgcggacgataccgctgggtgggacacaagaatcaccctggaggatctcaaaaatgaagagatggtgacaaaccacatggaaggagagcataagaaactggccgaggccattttcaaacttacctaccaaaataaggtcgtgcgggttcagcgccctacgcccagaggcacagtgatggacatcatctctcggcgcgaccagagagggagcggacaggtcgtgacctatggcctgaacacattcaccaacatggaagctcaactcattcggcagatggagggggaaggcgtctttaaatccatccagcaactgacggtgaaggaggagattgccgttaaaaattggcttatccgcgtgggaagagaacggctgtctcgcatggctattagcggcgatgactgcgtcgtgaagccgctcgatgacagattcgcctccgcgctgaccgccctgaacgatatggggaaagtgcggaaggacatccagcagtgggagccttctagaggatggaatgattggacacaggttcccttttgcagccaccacttccatgaactcatcatgaaggacggccgcgtgctggtcgtgccctgtcggaaccaagatgagcttattgggagagctcgcatctcccagggagccggctggtctctgcgggaaaccgcttgcctcgggaaaagctacgcccagatgtggtccctgatgtattttcacagacgcgaccttcggctggcggccaatgctatttgtagcgccgttccttctcattggatcccgacatccagaaccacatggagcattcacgctacccacgagtggatgacgacagaggatatgctcaccgtgtggaaccgcgtctggatccaggaaaatccctggatggaggacaagacccctgtggaatcttgggaggaaatcccctacctgggcaaacgggaggatcaatggtgcggatccctgattggcctcacaagcagagccacctgggctaagaacatccagacagccattaatcaggtccgctccctgatcgggaacgaggaatatacggactacatgccttctatgaaacggttcagacgggaggaagaggaagcgggagtgctttggtga

SEQ ID NO: 19621 - RNA, 9876 nt, synthetic construct
  misc_feature 1..9876: note = derived and/or modified CDS sequence (opt5) from DENV-2__KM279557__SS-prME
  source 1..9876: mol_type = other RNA
accgccggaatcattatcatgatgattcccaccgtgatggctttccacctgacgaccagaaacggggaacctcatatgatcgtcagccggcaggaaaagggaaaatccctcctgtttaagaccgagaatggagttaacatgtgcacccttatggccatggacctgggggaactctgtgaggataccattacctacaattgcccgctgcttcgccaaaacgaacccgaggacatcgattgttggtgcaattctacgagcacctgggtgacgtatggaacctgtacagcgaccggcgagcaccggcgggaaaaacgctccgtggctctggtccctcatgtggggatgggactcgagacaagaaccgaaacgtggatgtctagcgagggcgcctggaagcacgcccagcggatcgagacatggattctgcgccatcccggcttcaccatcatggctgccattctggcttacacaatcgggaccacctattttcagagagttctcattttcatcctgcttacagccgtgacgccttccatggcgatgcggtgcattggaatctctaaccgcgactttgtcgaaggcgtgagcgggggatcctgggttgatatcgtgctggagcacggcagctgtgtcaccacaatggccaaaaataagcccaccctcgacttcgaactgattaagacagaggctaaacaccttgccaccctgagaaagtactgcgtggaagctaaactcacgaacacaaccaccgcctctcggtgtcctacacagggggagccgtccctgaatgaggaacaagataagcgctttgtgtgcaaacatagcatggtcgacagaggatggggcaacggctgtgggctgttcggaaagggcgggatcgttacctgcgcgatgtttacatgcaagaaaaatatggagggaaaggtggtgcagcccgaaaacctcgagtatacgattgtcatcacccctcactctggcgaagagaatgccgtggggaacgatacaggaaaacatggcaaggagattaaagttacaccccagtccagcatcacagaagctgagctgaccggctacgggacggtgaccatggaatgttctcctcggacaggacttgacttcaatgagatggtcctgctccagatggaaaacaaggcctggctggtgcaccgccaatggtttcttgatctgcccctcccgtggctgcctggcgctgacacccaggggtccaactggatccagaaagagacactggttaccttcaagaatccccacgccaagaaacaggatgtggtcgtgctcggaagccaagagggcgccatgcatacggctctgacaggggcgaccgaaattcagatgtcctctggcaaccttctgtttacaggacacctcaagtgcagactgcggatggacaaacttcagctgaagggcatgagctattccatgtgtaccgggaaattcaaggtcgtgaaggagatcgccgaaacccaacatggaacaattgttatcagagtgcagtacgagggcgacgggagcccttgcaaaattcccttcgagatcatggatctcgaaaagcgccacgtcctgggacggctgatcacggtgaatcccattgttaccgagaaagactctcctgtgaacatcgaagctgagccgccctttggcgattcctacattatcattggggtcgaacctggccagctcaagctgagctggttcaaaaagggatctagcatcggccagatgtttgagacaaccatgagaggggccaagcgcatggccattcttggagacacagcttgggatttcggctccctcgggggagtgtttacctctatcggcaaagccctccatcaagtgttcggggcgatctatggcgctgcctttagcggagtttcctggacgatgaagattctgatcggcgtcgtgattacatggatcgggatgaatagccggtctacctccctgagcgtgtctcttgtcctcgtgggagttgtgaccctgtacctgggcgtcatggtgcaggccgactccgggtgtgttgtgagctggaaaaacaaggagctcaaatgcggatccggcattttcatcacagataatgtccacacctggacagaacagtataagtttcagcccgagtctcctagcaagctggcttccgccatccaaaaagctcacgaagaggggatttgtggcatcagatctgtgacgcgccttgaaaacctgatgtggaagcagattacccccgagctcaatcatatcctgacagagaacgaagttaaactgaccattatgacaggagacatcaagggcatcatgcaggccgggaaacggagccttagaccgcagcctaccgagctcaagtactcctggaaagcgtggggaaaggccaagatgctgagcacggaactgcacaatcataccttcctcattgatggccccgagacagctgaatgccctaacaccaatcgcgcctggaactctctggaggtggaggactatgggtttggagtcttcacaaccaatatctggcttaaactgaaggaacggcaagatgtgttttgtgactccaaactcatgagcgctgccattaaggacaacagagcggtgcacgccgatatgggctactggatcgagtctgctctgaacgacacatggaaaattgaaaaggcctccttcatcgaggtcaagagctgccactggcccaaatctcataccctgtggagcaatggcgttcttgagtccgaaatgatcattcctaagaacttcgctgggcccgtgagccagcacaattatcgcccgggataccatacgcagacagccggcccttggcacctcgggcggctggagatggattttgacttctgtgaaggaaccaccgtggtcgtgacagaggattgcggcaacagagggccctctctgcggaccacgacagcctccggaaaactcatcaccgaatggtgctgtcgcagctgcacactgccccctcttagataccggggcgaggacggctgttggtatgggatggagattagaccgctgaaggaaaaagaggaaaatctcgttaactccctggtgaccgctggacatggccagatcgataatttttctctgggggtccttggaatggcgctgttcctggaggaaatgctgcgcacacgggtgggcaccaagcacgccattctcctggttgctgtgagctttgtcacgcttatcaccgggaacatgtccttcagagacctgggacgcgtgatggttatggtgggcgccacaatgaccgatgacattggcatgggggtcacatacctcgccctgctggctgcctttaaggtgagacccaccttcgcggctggacttctgctccggaaactgacgtctaaggagctcatgatgacaaccatcggcatcgtgctgcttagccaatccacaattcctgagtctatcctggaactcaccgatgccctggccctggggatgatggtccttaaaattgttcgcaatatggagaagtatcagctggctgtgaccatcatggccattctctgcgtgcccaacgcggtcatcctgcagaatgcttggaaagtgagctgtacaacgctcgccgttgtgtccgtcagccctctgcttctgacctcttcccaacagaaggccgactggatccccctcgctctgacaattaagggactgaaccctaccgccatctttcttacaaccctgagcagaacgtctaaaaagcggtcctggcccctcaatgaagctattatggccgtgggcatggttagcatcctggcgtcttccctcctgaaaaacgatattccgatgacagggcctcttgtggccggaggcctgctgaccgtctgctacgtgctcaccggccgcagcgctgacctggagcttgaaagagccgctgacgtccggtgggaggagcaggccgaaatctccgggagctctcccatcctgagcattacaatctccgaggatggatctatgagcattaagaatgaagaggaggaacagaccctcacaatcctgattcgcacgggcctcctggtgatctccgggcttttccctgtttctattcccatcaccgccgctgcgtggtatctgtgggaggtgaaaaagcaaagagccggagtcctgtgggacgtgccgagccctccccctgttggcaaagctgaactcgaggatggggcctaccggatcaagcagaagggcattctgggctattcccagatcggcgccggggtgtacaaagaaggaacatttcacaccatgtggcatgtcacacgcggcgctgtgcttatgcacaaggggaaaagaattgagccctcttgggccgacgtgaagaaagatctgatcagctacggaggcgggtggaagctcgagggagaatggaaggagggcgaagaggttcaggtcctggcgctcgaacccggcaaaaaccctcgggctgtgcaaaccaagccggggctgttcaaaacgaacaccggaacaattggcgccgtgtcccttgactttagccccgggacctctggatcccctatcgtcgataagaaaggcaaggtggttgggctgtatggaaatggcgtggtcacaagaagcggcacctacgtgtctgccatcgctcagacagagaagtccattgaggacaaccccgaaatcgaggatgacattttccgcaaaaagcggctgacgatcatggatctccatcctggggccggaaaaaccaagagatatctgcccgcgattgttcgcgaagctatcaaacggggccttagaacactgatcctcgcccctacccgcgtggtcgccgctgagatggaagaggccctgcgggggctcccgattagataccagacccccgctatccgcgccgagcacacaggacgggaaattgtggacctgatgtgtcatgcgacgttcaccatgagacttctgagccctatccgggttcccaattataacctgattatcatggatgaggcccactttacagaccctgcttccattgccgctcgcggctacatctctaccagagtggaaatgggggaggccgccggcatcttcatgacagctacacccccgggaagccgggacccttttccccagtccaatgcgcccattatggatgaggaacgcgagatccctgaaagaagctggaactctggccacgagtgggtcacggacttcaaggggaagacagtgtggtttgtgccctccattaaagccggaaatgatatcgctgcctgcctccggaagaacggcaaaaaggtcattcaactgagcagaaaaaccttcgactctgaatatatcaagacccgcacaaatgattgggactttgttgtgaccacagatatcagcgagatgggggccaacttcaaggctgagcgggtgattgaccctagacgctgtatgaaaccggtcatccttaccgatggagaggaacgggtgattctggccggccccatgcctgttacgcattcctctgcggctcagagacgcgggcgggtgggcagaaatcccaagaacgaaaatgaccagtacatctacatgggagagcctctcgaaaacgatgaggactgcgcccactggaaagaggccaagatgctgctggacaatattaacacacccgaaggcatcatcccgagcatgtttgagcctgaacgcgagaaagtcgatgctattgacggggaatatagactccggggagaggcccgcaagaccttcgtggatcttatgagacggggcgacctgcccgtttggctggcgtaccgcgtggccgctgaggggatcaactatgccgatagacggtggtgttttgacggagtcaaaaataaccaaattctcgaagagaatgtggaagtcgagatctggacaaaggagggcgaaagaaagaaactgaagcctcgctggcttgatgctcggatttactccgaccccctggccctcaaagagttcaaggagttcgctgccgggagaaaatctctgaccctgaacctcatcacggagatgggccgccttcctacctttatgacacagaaggcgaagaatgccctggataacctggctgtgctccataccgccgaagctggaggccgggcctataatcacgccctgagcgagcttcccgagacactggaaaccctcctgctgctcacacttctggctaccgttacagggggaattttcctgtttctcatgtccggcaaagggatcggaaagatgacactgggcatgtgctgcatcattaccgcgagcatccttctgtggtacgcccagattcagccgcactggatcgctgcctctattatcctcgagttctttctgatcgtgctgctcattcctgaacccgagaaacaaagaacaccccaggacaaccagcttacatatgtggtcatcgccattctgaccgttgtggctgccacaatggcgaatgaaatgggcttcctggagaagacgaaaaaggattttgggctcggatccatcaccacacagcaacctgagagcaacattctggacatcgatcttcggccggcctccgcttggaccctgtacgccgtggctacaaccttcatcacgcccatgctccgccattctattgaaaatagctccgtcaacgtgtctctgaccgccatcgcgaatcaggccacagttctgatgggcctcgggaagggatggcctcttagcaaaatggacattggcgtgcccctgctggctatcgggtgttactcccaggtcaaccctattaccctcacagccgctctgcttctgctcgtggcccactatgctatcattggacccggcctgcaggccaaggcgaccagagaggcccaaaaacgggctgccgctggcatcatgaagaatcctacggtcgacgggatgacagtgatcgatctggacccgattccctacgatcctaaatttgaaaagcagctcggacaggttatgcttctggtgctgtgcgtcacccaggtgctcatgatgcgcacaacctgggccctgtgtgaggcccttaccctggcgacaggccccatcagcacgctctgggaagggaaccctggaagattctggaataccacaattgctgtttctatggccaacatctttcggggctcctatctggctggggccggactcctgttcagcattatgaagaacaccgccaatacacgcagaggcaccggcaacacgggggagacacttggagagaaatggaagaatcggctgaacgctctgggcaaatctgaatttcaaatctacaagaaatccgggatccaggaggtggaccgcaccctcgccaaggaaggaattaaaagaggcgagaccgatcatcacgcggtcagccgggggtctgccaagctgagatggttcgtggagcgcaatcttgtgacacccgaaggaaaggttgtcgacctgggctgcggcagagggggatggagctattactgtggcgggctcaaaaacgtgaaggaggtgaaaggactgaccaagggcgggccgggacatgaagaacctatccccatgtccacatatggctggaatctggtcagactccagtctggcgttgatgtgttctttacgccccctgaaaaatgcgacacccttctgtgtgatattggggagagctcccccaaccctacagtggaggctggacgcaccctgcgggtcctcaatctggtggaaaactggcttaataacaatacacaattctgcatcaaggttctgaacccgtacatgcccagcgtgattgagaagatggaagccctccagagaaaatacggcggggctctggtccgcaatcctctgtcccggaactctacccacgagatgtattgggtgagcaacgcctccggaaatatcgtttctagcgtgaacatgatctccagaatgctcattaatcgctttacgatgcggcacaagaaagcgacctacgaacccgacgtcgatcttggctctgggacaagaaacatcggaattgagagcgagacccctaatctggacatcattggcaagcgcatcgagaagatcaagcaggagcatgaaacatcctggcactatgatcaggaccatccctacaagacctgggcctatcacggcagctacgagacaaaacaaaccgggtctgcttccagcatggtgaacggagtggtccggctgctcacgaagccgtgggacgttattcctatggtgacacagatggccatgaccgataccacacccttcggccagcagagagtgtttaaagaaaaggtcgacacgcgcacccaagagcctaaagaggggacaaagaagctgatgaaaatcaccgctgaatggctttggaaggagctgggcaaaaagaaaacacccagaatgtgtacccgggaagagttcacacgcaaggtgagatctaatgccgctctcggcgccatttttaccgatgagaacaaatggaagtccgcgcgggaagccgttgaggacagcgggttctgggaactggtggataaggagagaaatctgcacctcgaaggaaaatgcgagacgtgtgtctataacatgatgggcaagcgggagaaaaagctgggcgaatttgggaaagctaagggatctcgcgccatctggtacatgtggcttggcgctagattcctggagtttgaagccctcgggttcctgaatgaggaccattggttttcccgggaaaacagcctttccggagtggagggcgaggggctgcacaagctcggctacattctgcgcgatgttagcaaaaaggaaggaggcgccatgtatgcggacgataccgctgggtgggacacaagaatcaccctggaggatctcaaaaatgaagagatggtgacaaaccatatggaaggagagcacaagaaactggccgaggccattttcaaacttacctaccagaataaggtcgtgcgggttcagcgccctacgcccagaggcacagtgatggacatcatctctcggcgcgaccagagagggagcggacaagtcgtgacctatggcctgaacacattcaccaacatggaagctcagctcattcggcagatggagggggaaggcgtctttaaatccatccaacagctgacggtgaaggaggagattgccgttaaaaattggcttatccgcgtgggaagagaacggctgtctcgcatggctattagcggcgatgactgcgtcgtgaagccgctcgatgacagattcgcctccgcgctgaccgccctgaacgatatggggaaagtgcggaaggacatccagcagtgggagccttctagaggatggaatgattggacacaagttcccttttgcagccatcacttccacgaactcatcatgaaggacggccgcgtgctggtcgtgccctgtcggaaccaggatgagcttattgggagagctcgcatctcccagggagccggctggtctctgcgggaaaccgcttgcctcgggaaaagctacgcccagatgtggtccctgatgtattttcatagacgcgaccttcggctggcggccaatagcatttgttctgctgttccttcccactggatcccgacaagcagaaccacatggtctattcatgccacccacgagtggatgacgacagaggatatgctcaccgtgtggaaccgcgtctggatccaagaaaatccctggatggaggacaagacccctgtggaatcctgggaggaaatcccctacctgggcaaacgggaggatcagtggtgcggaagcctgattggcctcacatccagagctacctgggccaagaacatccagacagctattaatcaggtccgctctctgatcgggaacgaggaatatacggactacatgcctagcatgaaacggttcagacgggaggaagaggaagccggagtgctttggtga

SEQ ID NO: 19622 - RNA, 9876 nt, synthetic construct
  misc_feature 1..9876: note = derived and/or modified CDS sequence (opt5) from DENV-2__KM279591__SS-prME
  source 1..9876: mol_type = other RNA
accgccggaatcattatcatgatgattcccaccgtgatggctttccacctgacgaccagaaacggggaacctcatatgatcgtcagccggcaggaaaagggaaaatccctcctgtttaagacagagaatggagttaacatgtgcacccttatggccatggacctgggggaactctgtgaggataccattacctacaattgcccgctgcttcgccaaaacgaacccgaggacatcgattgttggtgcaattctacaagcacctgggtgacgtatggaacctgtacagcgaccggcgagcaccggcgggaaaaacgctccgtggctctggtccctcatgtggggatgggactcgagacaagaaccgaaacgtggatgtctagcgagggcgcctggaagcacgcccagcggatcgagacatggattctgcgccatcccggcttcaccatcatggctgccattctggcttacacaatcgggaccacctattttcagagagttctcattttcatcctgcttacagccgtgacgccttccatggcgatgcggtgcattggaatctctaaccgcgactttgtcgaaggcgtgagcgggggatcctgggttgatatcgtgctggagcacggcagctgtgtcaccacaatggccaaaaataagcccaccctcgacttcgaactgattaagacagaggctaaacaccttgccaccctgagaaagtactgcgtggaagctaaactcacgaacacaaccaccgcctctcggtgtcctacacagggggagccgtccctgaatgaggaacaagataagcgctttgtgtgcaaacatagcatggtcgacagaggatggggcaacggctgtgggctgttcggaaagggcgggatcgttacctgcgcgatgtttacatgcaagaaaaatatggagggaaaggtggtgcagcccgaaaacctcgagtatacgattgtcatcacccctcactctggcgaagagaatgccgtggggaacgatacaggaaaacatggcaaggagattaaagttacaccccagtccagcatcacagaagctgagctgaccggctacgggacggtgaccatggaatgttctcctcggacaggacttgacttcaatgagatggtcctgctccagatggaaaacaaggcctggctggtgcaccgccaatggtttcttgatctgcccctcccgtggctgcctggcgctgacacccaggggtccaactggatccagaaagagacactggttaccttcaagaatccccacgccaagaaacaggatgtggtcgtgctcggaagccaagagggcgccatgcatacggctctgacaggggcgaccgaaattcagatgtcctctggcaaccttctgtttacaggacacctcaagtgcagactgcggatggacaaacttcagctgaagggcatgagctattccatgtgtaccgggaaattcaaggtcgtgaaggagatcgccgaaacccaacatggaacaattgttatcagagtgcagtacgagggcgacgggagcccttgcaaaattcccttcgagatcatggatctcgaaaagcgccacgtcctgggacggctgatcacggtgaatcccattgttaccgagaaagactctcctgtgaacatcgaagctgagccgccctttggcgattcctacattatcattggggtcgaacctggccagctcaagctgagctggttcaaaaagggatctagcatcggccagatgtttgagacaaccatgagaggggccaagcgcatggccattcttggagacacagcttgggatttcggctccctcgggggagtgtttacctctatcggcaaagccctccatcaagtgttcggggcgatctatggcgctgcctttagcggagtttcctggacgatgaagattctgatcggcgtcgtgattacatggatcgggatgaatagccggtctacctccctgagcgtgtctcttgtcctcgtgggagttgtgaccctgtacctgggcgtcatggtgcaggccgactccgggtgtgttgtgagctggaaaaacaaggagctcaaatgcggatccggcattttcatcacagataatgtccacacctggacagaacagtataagtttcagcccgagtctcctagcaagctggcttccgccatccaaaaagctcacgaagaggggatttgtggcatcagatctgtgacgcgccttgaaaacctgatgtggaagcagattacccccgagctcaatcatatcctgacagagaacgaagttaaactgaccattatgacaggagacatcaagggcatcatgcaggccgggaaacggacccttagaccgcagcctacggagctcaagtacagctggaaagcgtggggaaaggccaagatgctgtccaccgaactgcacaatcatacattcctcattgatggccccgagaccgctgaatgccctaacacaaatcgcgcctggaacagcctggaggtggaggactatgggtttggagtcttcaccacaaatatctggcttaaactgaaggaacggcaagatgtgttttgtgactctaaactcatgtccgctgccattaaggacaacagagcggtgcacgccgatatgggctactggatcgagagcgctctgaacgacacctggaaaattgaaaaggcctctttcatcgaggtcaagtcctgccactggcccaaaagccatacgctgtggtctaatggcgttcttgagagcgaaatgatcattcctaagaacttcgctgggcccgtgtcccagcacaattatcgcccgggataccatacacagaccgccggcccttggcacctcgggcggctggagatggattttgacttctgtgaaggaaccacagtggtcgtgaccgaggattgcggcaacagagggcccagcctgcggacgacaaccgcctctggaaaactcatcacagaatggtgctgtcgctcctgcaccctgccccctcttagataccggggcgaggacggctgttggtatgggatggagattagaccgctgaaggaaaaagaggaaaatctcgttaacagcctggtgacagctggacatggccagatcgataatttttccctgggggtccttggaatggcgctgttcctggaggaaatgctgcgcacccgggtgggcacgaagcacgccattctcctggttgctgtgtcttttgtcacccttatcacagggaacatgagcttcagagacctgggacgcgtgatggttatggtgggcgccaccatgacagatgacattggcatgggggtcacctacctcgccctgctggctgcctttaaggtgagacccacgttcgcggctggacttctgctccggaaactgacatccaaggagctcatgatgaccacaatcggcatcgtgctgctttctcaaagcaccattcctgagtccatcctggaactcaccgatgccctggccctggggatgatggtccttaaaattgttcgcaatatggagaagtatcagctggctgtgacaatcatggccattctctgcgtgcccaacgcggtcatcctgcagaatgcttggaaagtgtcttgtacgaccctcgccgttgtgagcgtctcccctctgcttctgacaagctctcaacagaaggccgactggatccccctcgctctgaccattaagggactgaaccctacagccatctttcttaccacgctgtccagaacaagcaaaaagcggtcttggcccctcaatgaagctattatggccgtgggcatggtttccatcctggcgagctctctcctgaaaaacgatattccgatgaccgggcctcttgtggccggaggcctgctgaccgtctgctacgtgctcacaggccgctccgctgacctggagcttgaaagagccgctgacgtccggtgggaggagcaggccgaaatcagcgggtccagccccatcctgtctattaccatcagcgaggatggatccatgtctattaagaatgaagaggaggaacagacactcacgatcctgattcgcaccggcctcctggtgatcagcgggcttttccctgtttccattcccatcacagccgctgcgtggtatctgtgggaggtgaaaaagcaaagagccggagtcctgtgggacgtgccgtctcctccccctgttggcaaagctgaactcgaggatggggcctaccggatcaagcagaagggcattctgggctatagccagatcggcgccggggtgtacaaagaaggaacctttcacacaatgtggcatgtcacccgcggcgctgtgcttatgcacaaggggaaaagaattgagccctcctgggccgacgtgaagaaagatctgatctcttacggaggcgggtggaagctcgagggagaatggaaggagggcgaagaggttcaggtcctggcgctcgaacccggcaaaaaccctcgggctgtgcaaacgaagccggggctgttcaaaaccaacacaggaaccattggcgccgtgagccttgacttttcccccgggacaagcggatctcctatcgtcgataagaaaggcaaggtggttgggctgtatggaaatggcgtggtcaccagatccggcacatacgtgagcgccatcgctcagacggagaagtctattgaggacaaccccgaaatcgaggatgacattttccgcaaaaagcggctgaccatcatggatctccatcctggggccggaaaaacaaagagatatctgcccgcgattgttcgcgaagctatcaaacggggccttagaaccctgatcctcgcccctacccgcgtggtcgccgctgagatggaagaggccctgcgggggctcccgattagataccagacacccgctatccgcgccgagcacacgggacgggaaattgtggacctgatgtgtcatgcgaccttcacaatgagacttctgtcccctatccgggttcccaattataacctgattatcatggatgaggcccactttaccgaccctgctagcattgccgctcgcggctacatctccacaagagtggaaatgggggaggccgccggcatcttcatgaccgctacgcccccgggatctcgggacccttttccccagagcaatgcgcccattatggatgaggaacgcgagatccctgaaagatcctggaacagcggccacgagtgggtcacagacttcaaggggaagaccgtgtggtttgtgccctctattaaagccggaaatgatatcgctgcctgcctccggaagaacggcaaaaaggtcattcaactgtccagaaaaaccttcgacagcgaatatatcaagacacgcaccaatgattgggactttgttgtgacaaccgatatctctgagatgggggccaacttcaaggctgagcgggtgattgaccctagacgctgtatgaaaccggtcatccttacggatggagaggaacgggtgattctggccggccccatgcctgttacacatagctccgcggctcagagacgcgggcgggtgggcagaaatcccaagaacgaaaatgaccagtacatctacatgggagagcctctcgaaaacgatgaggactgcgcccactggaaagaggccaagatgctgctggacaatattaacacccccgaaggcatcatcccgtctatgtttgagcctgaacgcgagaaagtcgatgctattgacggggaatatagactccggggagaggcccgcaagacattcgtggatcttatgagacggggcgacctgcccgtttggctggcgtaccgcgtggccgctgaggggatcaactatgtcgatagacggtggtgttttgacggagtgaaaaataaccaaattctcgaagagaatgtcgaagtggagatctggaccaaggagggcgaaagaaagaaactgaagcctcgctggcttgatgcccggatttacagcgaccccctggctctcaaagagttcaaggagttcgccgctgggagaaaatccctgacgctgaacctcatcaccgagatgggccgccttcctacatttatgacccagaaggccaagaatgcgctggataacctggccgttctccatacagctgaagccggaggccgggcttataatcacgccctgtctgagcttcccgagaccctggaaacactcctgctgctcacccttctggccacggtgacagggggaattttcctgtttctcatgagcggcaaagggatcggaaagatgaccctgggcatgtgctgcatcattaccgcttccatccttctgtggtacgcgcagattcagccgcactggatcgccgctagcattatcctcgagttctttctgatcgtgctgctcattcctgaacccgagaaacaaagaacaccccaggacaaccagcttacctatgtcgttatcgccattctgacagtggtggccgctacgatggccaatgaaatgggcttcctggagaagaccaaaaaggattttgggctcggatctatcacaacccagcaacctgagtccaacattctggacatcgatcttcggccggcgagcgcctggacactgtacgctgtcgccaccacgttcatcacccccatgctccgccattccattgaaaattctagcgtgaacgtttccctgacagctatcgccaatcaggcgaccgtgctgatgggcctcgggaagggatggcctctttctaaaatggacattggcgtccccctgctggccatcgggtgttacagccaggtgaaccctattacactcaccgctgccctgcttctgctcgtcgctcactatgccatcattggacccggcctgcaggctaaggccacgagagaggcgcaaaaacgggccgctgccggcatcatgaagaatcctacagtggacgggatgaccgttatcgatctggacccgattccctacgatcctaaatttgaaaagcagctcggacaggtgatgcttctggtcctgtgcgtgacacaggttctcatgatgcgcaccacctgggctctgtgtgaggcccttacactggccacgggccccatctccaccctctgggaagggaaccctggaagattctggaatacaaccattgcggtgagcatggctaacatctttcggggctcttatctggccggggctggactcctgttctccattatgaagaacacagccaatacccgcagaggcacgggcaacacaggggagacccttggagagaaatggaagaatcggctgaacgccctgggcaaaagcgaatttcaaatctacaagaaatctgggatccaggaggtcgaccgcaccctcgctaaggaaggaattaaaagaggcgagacagatcatcacgccgtgtcccgggggagcgcgaagctgagatggttcgtggagcgcaatcttgttacccccgaaggaaaggtcgtggacctgggctgcggcagagggggatggtcttattactgtggcgggctcaaaaacgtgaaggaggtcaaaggactgacaaagggcgggccgggacatgaagaacctatccccatgagcacgtatggctggaatctggttagactccagtccggcgtggatgtgttctttacaccccctgaaaaatgcgacacacttctgtgtgatattggggagtctagccccaaccctaccgtcgaggccggacgcacactgcgggtgctcaatctggttgaaaactggcttaataacaatacccaattctgcatcaaggtgctgaacccgtacatgccctccgtcattgagaagatggaagctctccagagaaaatacggcggggccctggtgcgcaatcctctgagccggaactccacgcacgagatgtattgggtttctaacgctagcggaaatatcgtgtcctctgtcaacatgatcagcagaatgctcattaatcgctttaccatgcggcacaagaaagccacatacgaacccgacgtggatcttggctccgggaccagaaacatcggaattgagtctgagacacctaatctggacatcattggcaagcgcatcgagaagatcaagcaggagcatgaaaccagctggcactatgatcaggaccatccctacaagacatgggcgtatcacggctcctacgagaccaaacaaacggggagcgcctcttccatggtgaacggagtcgttcggctgctcacaaagccgtgggacgtgattcctatggtgacccagatggctatgaccgatacaacgcccttcggccagcagagagtctttaaagaaaaggtggacacccgcacacaagagcctaaagaggggaccaagaagctgatgaaaatcacagccgaatggctttggaaggagctgggcaaaaagaaaacccccagaatgtgtacacgggaagagttcacccgcaaggttagaagcaatgctgccctcggcgctatttttacggatgagaacaaatggaagtctgcccgggaagcggtggaggactccgggttctgggaactggtcgataaggagagaaatctgcacctcgaaggaaaatgcgagacctgtgtgtataacatgatgggcaagcgggagaaaaagctgggcgaatttgggaaagccaagggaagccgcgctatctggtacatgtggcttggcgccagattcctggagtttgaagctctcgggttcctgaatgaggaccattggttttctcgggaaaactcccttagcggagttgagggcgaggggctgcacaagctcggctacattctgcgcgatgtgtccaaaaaggaaggaggcgccatgtatgccgacgatacagcggggtgggacaccagaatcacactggaggatctcaaaaatgaagagatggtcaccaaccatatggaaggagagcacaagaaactggctgaggccattttcaaacttacgtaccagaataaggtggttcgggtgcagcgccctacacccagaggcaccgtcatggacatcatcagccggcgcgaccagagagggtctggacaagtggtcacatatggcctgaacaccttcacgaacatggaagcccagctcattcggcagatggagggggaaggcgtgtttaaaagcatccaacagctgaccgttaaggaggagattgctgtgaaaaattggcttatccgcgtcggaagagaacggctgtcccgcatggccatttctggcgatgactgcgtggtgaagccgctcgatgacagattcgctagcgccctgacagcgctgaacgatatggggaaagttcggaaggacatccagcagtgggagccttccagaggatggaatgattggacccaagtgcccttttgctctcatcacttccacgaactcatcatgaaggacggccgcgtcctggtggttccctgtcggaaccaggatgagcttattgggagagcccgcatcagccagggagctggctggtccctgcgggaaacagcctgcctcgggaaatcttacgctcagatgtggagcctgatgtattttcatagacgcgaccttcggctggccgcgaatgccatttgttccgctgtgcctagccactggatcccgacctctagaacaacctggtccattcatgccacgcacgagtggatgacaaccgaggatatgctcaccgtctggaaccgcgtgtggatccaagaaaatccctggatggaggacaagacacctgtcgaaagctgggaggaaatcccctacctgggcaaacgggaggatcagtggtgcggatctctgattggcctcacctccagagctacatgggccaagaacatccagacggctattaatcaggtgcgcagcctgatcgggaacgaggaatataccgactacatgccttccatgaaacggttcagacgggaggaagaggaagccggagttctttggtga

SEQ ID NO: 19623 - RNA, 9876 nt, synthetic construct
  misc_feature 1..9876: note = derived and/or modified CDS sequence (opt5) from DENV-2__KM279558__SS-prME
  source 1..9876: mol_type = other RNA
accgccggaatcattatcatgatgattcccaccgtgatggctttccacctgacgaccagaaacggggagcctcatatgatcgtgagccggcaggaaaagggaaaatccctcctgtttaagaccgagaatggcgttaacatgtgcacccttatggccatggacctgggggaactctgtgaggataccattacctacaattgcccgctgcttcgccaaaacgaacccgaggacatcgattgttggtgcaattctacgagcacctgggtgacgtatggaacctgtacagcgaccggcgagcaccggcgggaaaaacgctccgtggctctggtccctcatgtggggatgggactcgagacaagaaccgaaacgtggatgtctagcgagggcgcctggaagcacgcccagcggatcgagacatggattctgcgccatcccggcttcaccatcatggctgccattctggcttacacaatcgggaccacctattttcagagagttctcattttcatcctgcttacagccgtgacgccttccatggcgatgcggtgcattggaatctctaaccgcgactttgtcgaaggcgtgagcgggggatcctgggttgatatcgtgctggagcacggcagctgtgtcaccacaatggccaaaaataagcccaccctcgacttcgaactgattaagacagaggctaaacaccttgccaccctgagaaagtactgcgtggaagctaaactcacgaacacaaccaccgcctctcggtgtcctacacagggggagccgtccctgaatgaggaacaagataagcgctttgtgtgcaaacatagcatggtcgacagaggatggggcaacggctgtgggctgttcggaaagggcgggatcgttacctgcgcgatgtttacatgcaagaaaaatatggagggaaaggtggtgcagcccgaaaacctcgagtatacgattgtcatcacccctcactctggcgaagagaatgccgtggggaacgatacaggaaaacatggcaaggagattaaaatcacaccccagtccagcatcacagaagctgagctgaccggctacgggacggttaccatggaatgttctcctcggacaggacttgacttcaatgagatggtgctgctccagatggaaaacaaggcctggctggtccaccgccaatggtttcttgatctgcccctcccgtggctgcctggcgctgacacccaggggtccaactggattcagaaagagacactggtgaccttcaagaatccccacgccaagaaacaggatgttgtggtcctcggaagccaagagggcgccatgcatacggctctgacaggggcgaccgaaatccagatgtcctctggcaaccttctgtttacaggacacctcaagtgcagactgcggatggacaaacttcagctgaagggcatgagctattccatgtgtaccgggaaattcaaggtggtcaaggagattgccgaaacccaacatggaacaatcgtgattagagttcagtacgagggcgacgggagcccttgcaaaatccccttcgagatcatggatctcgaaaagcgccacgtgctgggacggctgattacggtcaatcccatcgtgaccgagaaagactctcctgttaacattgaagctgagccgccctttggcgattcctacatcattatcggggtggaacctggccagctcaagctgagctggttcaaaaagggatctagcattggccagatgtttgagacaaccatgagaggggccaagcgcatggccatccttggagacacagcttgggatttcggctccctcggcggggtctttacctctatcgggaaagccctccatcaagtgttcggggcgatttatggcgctgcctttagcggagtgtcctggacgatgaagatcctgattggcgttgtcatcacatggattgggatgaatagccggtctacctccctgagcgtgtctcttgtgctcgtcggagtggttaccctgtacctgggcgtgatggtccaggccgactccgggtgtgtggttagctggaaaaacaaggagctcaaatgcggatccggcatcttcatcacagataatgtgcacacctggacagaacagtataagtttcagcccgagtctcctagcaagctggcttccgccattcaaaaagctcacgaagaggggatctgtggcattagatctgtcacgcgccttgaaaacctgatgtggaagcagatcacccccgagctcaatcatattctgacagagaacgaagtgaaactgaccatcatgacaggagacatcaagggcattatgcaggccgggaaacggagccttagaccgcagcctaccgagctcaagtactcctggaaagcgtggggaaaggccaagatgctgagcacggaactgcacaatcataccttcctcatcgatggccccgagacagctgaatgccctaacaccaatcgcgcctggaactctctggaggttgaggactatgggtttggagtgttcacaaccaatatttggcttaaactgaaggaacggcaagatgtcttttgtgactccaaactcatgagcgctgccatcaaggacaacagagcggtgcacgccgatatgggctactggattgagtctgctctgaacgacacatggaaaatcgaaaaggcctccttcatcgaggtcaagagctgccactggcccaaatctcataccctgtggagcaatggcgtccttgagtccgaaatgattatccctaagaacttcgctgggcccgttagccagcacaattatcgcccgggataccatacgcagacagccggcccttggcacctcgggcggctggagatggattttgacttctgtgaaggaaccaccgtggtggtcacagaggattgcggcaacagagggccctctctgcggaccacgacagcctccggaaaactcattaccgaatggtgctgtcgcagctgcacactgccccctcttagataccggggcgaggacggctgttggtatgggatggagatcagaccgctgaaggaaaaagaggaaaatctcgtgaactccctggttaccgctggacatggccagattgataatttttctctgggggtgcttggaatggcgctgttcctggaggaaatgctgcgcacacgggtcggcaccaagcacgccatcctcctggtggctgttagctttgtgacgcttattaccgggaacatgtccttcagagacctgggacgcgtcatggtgatggttggcgccacaatgaccgatgacatcggcatgggggtgacatacctcgccctgctggctgcctttaaggtcagacccaccttcgcggctggacttctgctccggaaactgacgtctaaggagctcatgatgacaaccatcggcattgtgctgcttagccaatccacaatccctgagtctattctggaactcaccgatgccctggccctggggatgatggtgcttaaaatcgtccgcaatatggagaagtatcagctggctgttaccattatggccatcagctgcgtgcccaacgcggtgatcctccagaatgcttggaaagtctcctgtacaacgctggccgtggttagcgtgtctcctctcctgcttacctccagccaacagaaggccgactggattcccctggctctcacaatcaagggactgaaccctaccgccatttttctgacaaccctttctagaacgtccaaaaagcggagctggcccctgaatgaagctatcatggccgtcggcatggtgtctattctcgcgtccagcctgctcaaaaacgatatcccgatgacagggcctctggttgccggaggccttctgaccgtgtgctacgtcctgaccggccgctccgctgacctcgagctggaaagagccgctgacgtgcggtgggaggagcaggccgaaatcagcgggtctagccccattctttccatcacaatttctgaggatggaagcatgtccatcaagaatgaagaggaggaacagaccctgacaattctcatccgcacgggcctgctcgtcatttctgggctgttccctgtgagcatccccatcaccgccgctgcgtggtatctttgggaggttaaaaagcaaagagccggagtgctgtgggacgtcccgtcccctccccctgtgggcaaagctgaactggaggatggggcctaccggattaagcagaagggaatcctcggctattctcagattggcgccggggtttacaaagaaggaacatttcacaccatgtggcatgtgacacgcggcgctgtcctgatgcacaaggggaaaagaatcgagcccagctgggccgacgtgaagaaagatcttatttcctacggaggcgggtggaagctggagggagaatggaaggagggcgaagaggtgcaggttctcgcgctggaacccggcaaaaaccctcgggctgtccaaaccaagccgggactcttcaaaacgaacaccggaacaatcggcgccgtgagcctggacttttctcccgggacctccggaagccctatcgtggataagaaaggcaaggtcgtggggctttatggaaatggcgttgtgacaagatctggcacctacgtctccgccattgctcagacagaaaagagcatcgaggacaaccccgaaattgaggatgacatcttccgcaaaaagcggctgacgattatggatctgcatcctggggccggaaaaaccaagagatatctccccgcgatcgtgcgcgaagctatcaaacggggcctgagaacacttattctggcccctacccgcgttgtggccgctgagatggaagaggccctccgggggctgccgatcagataccagacccccgctattcgcgccgagcacacaggacgggaaatcgtcgacctcatgtgtcatgcgacgttcaccatgagactgctttcccctattcgggtgcccaattataacctgatcattatggatgaggcccactttacagaccctgcttctatcgccgctcgcggctacatcagcaccagagttgaaatgggggaggccgccggcattttcatgacagctacacccccgggatcccgggacccttttccccagagcaatgcgcccatcatggatgaggaacgcgagattcctgaaagatcttggaactccggccacgagtgggtgacggacttcaaggggaagacagtctggtttgtgcccagcatcaaagccggaaatgatattgctgcctgcctgcggaagaacggcaaaaaggtgatccaactctctagaaaaaccttcgacagcgaatatatcaagacccgcacaaatgattgggactttgtcgttaccacagatatttccgagatgggggccaacttcaaggctgagcgggtgatcgaccctagacgctgtatgaaaccggtgattctgaccgatggagaggaacgggtcatccttgccggccccatgcctgtgacgcattctagcgcggctcagagacgcgggcgggttggcagaaatcccaagaacgaaaatgaccagtacatttacatgggagagcctctggaaaacgatgaggactgcgcccactggaaagaggccaagatgctcctggacaatatcaacacacccgaaggcatcattccgtccatgtttgagcctgaacgcgagaaagtggatgctatcgacggggaatatagactgcggggagaggcccgcaagaccttcgtcgatctcatgagacggggcgaccttcccgtgtggctggcgtaccgcgttgccgctgaggggattaactatgccgatagacggtggtgttttgacggagtgaaaaataaccaaatcctggaagagaatgtcgaagtggagatttggacaaaggagggcgaaagaaagaaactcaagcctcgctggctggatgctcggatctactctgacccccttgccctgaaagagttcaaggagttcgctgccgggagaaaaagcctcaccctgaacctgattacggagatgggccgcctccctacctttatgacacagaaggcgaagaatgcccttgataacctggctgtcctgcataccgccgaagctggaggccgggcctataatcacgccctctccgagctgcccgagacacttgaaaccctgctcctgctgacactccttgctaccgtgacagggggaatcttcctgtttctgatgagcggcaaagggatcggaaagatgacactcggcatgtgctgcattatcaccgcgtctattctgctttggtacgcccagatccagccgcactggattgctgcctccatcatcctggagttctttctcattgttctgctgatccctgaacccgagaaacaaagaacaccccaggacaaccagctcacatatgtggtgattgccatccttaccgtcgttgctgccacaatggcgaatgaaatgggcttcctggagaagacgaaaaaggattttgggctgggaagcattaccacacagcaacctgagtccaacatcctcgacatcgatctgcggccggcctctgcttggaccctttacgccgtggctacaaccttcattacgcccatgctgcgccatagcatcgaaaattcctctgtgaacgtcagcctcaccgccattgcgaatcaggccacagtgctgatgggcctggggaagggatggcctctctccaaaatggacatcggcgttccccttctggctattgggtgttacagccaggtgaaccctatcaccctgacagccgctctcctgcttctggtcgcccactatgctattatcggacccggcctccaggccaaggcgaccagagaggcccaaaaacgggctgccgctggcatcatgaagaatcctacggtggacgggatgacagtcattgatctggacccgatcccctacgatcctaaatttgaaaagcagctgggacaggtgatgctccttgttctgtgcgtgacccaggtcctgatgatgcgcacaacctgggccctctgtgaggccctgacccttgcgacaggccccatttctacgctgtgggaagggaaccctggaagattctggaataccacaatcgctgtgtccatggccaacatttttcggggcagctatctcgctggggccggactgctgttctctatcatgaagaacaccgccaatacacgcagaggcaccggcaacacgggggagacactcggagagaaatggaagaatcggcttaacgctctgggcaaatccgaatttcaaatctacaagaaaagcgggattcaggaggttgaccgcaccctggccaaggaaggaatcaaaagaggcgagaccgatcatcacgcggtgtctcgggggagcgccaagctcagatggttcgtcgagcgcaatctggtgacacccgaaggaaaggtggttgaccttggctgcggcagagggggatggtcctattactgtggcgggctgaaaaacgtcaaggaggtgaaaggactcaccaagggcgggccgggacatgaagaacctattcccatgtctacatatggctggaatctggtgagactgcagagcggcgtcgatgttttctttacgccccctgaaaaatgcgacaccctcctttgtgatatcggggagtccagccccaaccctacagtggaggctggacgcaccctgcgggtgctgaatctcgtcgaaaactggctgaataacaatacacaattctgcattaaggtgcttaacccgtacatgccctccgttatcgagaagatggaagccctgcagagaaaatacggcggggctctcgtgcgcaatcctctgtctcggaacagcacccacgagatgtattgggtctccaacgcctctggaaatatcgtgagctccgttaacatgatttctagaatgctgatcaatcgctttacgatgcggcacaagaaagcgacctacgaacccgacgtggatctcggcagcgggacaagaaacattggaatcgagtccgagacccctaatcttgacattatcggcaagcgcatcgagaagattaagcaggagcatgaaacaagctggcactatgatcaggaccatccctacaagacctgggcctatcacggctcttacgagacaaaacaaaccgggtccgctagctctatggtcaacggagtggtgcggctgctgacgaagccgtgggacgtcatccctatggttacacagatggccatgaccgataccacacccttcggccagcagagagtgtttaaagaaaaggtggacacgcgcacccaagagcctaaagaggggacaaagaagctcatgaaaattaccgctgaatggctgtggaaggagcttggcaaaaagaaaacacccagaatgtgtacccgggaagagttcacacgcaaggtcagatccaatgccgctctgggcgccatctttaccgatgagaacaaatggaaaagcgcgcgggaagccgtggaggactctgggttctgggaactcgttgataaggagagaaatctgcacctggaaggaaaatgcgagacgtgtgtgtataacatgatgggcaagcgggagaaaaagctcggcgaatttgggaaagctaagggatcccgcgccatttggtacatgtggctgggcgctagattccttgagtttgaagccctggggttcctcaatgaggaccattggtttagccgggaaaactccctgagcggagtcgagggcgaggggcttcacaagctgggctacatcctccgcgatgtgtctaaaaaggaaggaggcgccatgtatgcggacgataccgctgggtgggacacaagaattaccctggaggatctgaaaaatgaagagatggttacaaaccatatggaaggagagcacaagaaactcgccgaggccatcttcaagctgacctaccagaataaggtggtccgggtgcagcgccctacgcccagaggcacagttatggacatcattagccggcgcgaccagagagggtccggacaagtggtcacctatggccttaacacattcaccaacatggaagctcagctgatccggcagatggagggggaaggcgtgtttaaatctattcaacagctcacggtcaaggaggagatcgccgtgaaaaattggctgattcgcgttggaagagaacggcttagccgcatggctatctccggcgatgactgcgtggtcaagccgctggatgacagattcgcctctgcgctcaccgccctgaacgatatggggaaagtgcggaaggacatccagcagtgggagcctagcagaggatggaatgattggacacaagtgcccttttgctcccatcacttccacgaactgattatgaaggacggccgcgttctcgtggtcccctgtcggaaccaggatgagctgatcgggagagctcgcatttctcagggagccggctggagccttcgggaaaccgcttgcctggggaaatcctacgcccagatgtggagcctcatgtattttcatagacgcgacctgcggcttgcggccaatgctatctgttctgccgtgccttcccactggattccgacaagcagaaccacatggtctatccatgctacccacgagtggatgacgacagaggatatgctgaccgtttggaaccgcgtgtggatccaagaaaatccctggatggaggacaagacccctgtcgaatcctgggaggaaattccctacctcggcaaacgggaggatcagtggtgcggaagcctgatcggcctgacatccagagccacctgggctaagaacattcagacagccatcaatcaggtgcgctctctcattgggaacgaggaatatacggactacatgcctagcatgaaacggttcagacgggaggaagaggaagcgggagtcctgtggtga

SEQ ID NO: 19624 - RNA, 9876 nt, synthetic construct
  misc_feature 1..9876: note = derived and/or modified CDS sequence (opt5) from DENV-2__KM279564__SS-prME
  source 1..9876: mol_type = other RNA
accgccggaatcattatcatgatgattcccaccgtgatggctttccacctgacgaccagaaacggggagcctcatatgatcgtgagccggcaggaaaagggaaaatccctcctgtttaagaccgagaatggcgttaacatgtgcacccttatggccatggacctgggggaactctgtgaggataccattacctacaattgcccgctgcttcgccaaaacgaacccgaggacatcgattgttggtgcaattctacgagcacctgggtgacgtatggaacctgtacagcgaccggcgagcaccggcgggaaaaacgctccgtggctctggtccctcatgtggggatgggactcgagacaagaaccgaaacgtggatgtctagcgagggcgcctggaagcacgcccagcggatcgagacatggattctgcgccatcccggcttcaccatcatggctgccattctggcttacacaatcgggaccacctattttcagagagttctcattttcatcctgcttacagccgtgacgccttccatggcgatgcggtgcattggaatctctaaccgcgactttgtcgaaggcgtgagcgggggatcctgggttgatatcgtgctggagcacggcagctgtgtcaccacaatggccaaaaataagcccaccctcgacttcgaactgattaagacagaggctaaacaccttgccaccctgagaaagtactgcgtggaagctaaactcacgaacacaaccaccgcctctcggtgtcctacacagggggagccgtccctgaatgaggaacaagataagcgctttgtgtgcaaacatagcatggtcgacagaggatggggcaacggctgtgggctgttcggaaagggcgggatcgttacctgcgcgatgtttacatgcaagaaaaatatggagggaaaggtggtgcagcccgaaaacctcgagtatacgattgtcatcacccctcactctggcgaagagaatgccgtggggaacgatacaggaaaacatggcaaggagattaaaatcacaccccagtccagcatcacagaagctgagctgaccggctacgggacggttaccatggaatgttctcctcggacaggacttgacttcaatgagatggtgctgctccagatggaaaacaaggcctggctggtccaccgccaatggtttcttgatctgcccctcccgtggctgcctggcgctgacacccaggggtccaactggattcagaaagagacactggtgaccttcaagaatccccacgccaagaaacaggatgttgtggtcctcggaagccaagagggcgccatgcatacggctctgacaggggcgaccgaaatccagatgtcctctggcaaccttctgtttacaggacacctcaagtgcagactgcggatggacaaacttcagctgaagggcatgagctattccatgtgtaccgggaaattcaaggtggtcaaggagattgccgaaacccaacatggaacaatcgtgattagagttcagtacgagggcgacgggagcccttgcaaaatccccttcgagatcatggatctcgaaaagcgccacgtgctgggacggctgattacggtcaatcccatcgtgaccgagaaagactctcctgttaacattgaagctgagccgccctttggcgattcctacatcattatcggggtggaacctggccagctcaagctgagctggttcaaaaagggatctagcattggccagatgtttgagacaaccatgagaggggccaagcgcatggccatccttggagacacagcttgggatttcggctccctcggcggggtctttacctctatcgggaaagccctccatcaagtgttcggggcgatttatggcgctgcctttagcggagtgtcctggacgatgaagatcctgattggcgttgtcatcacatggattgggatgaatagccggtctacctccctgagcgtgtctcttgtgctcgtcggagtggttaccctgtacctgggcgtgatggtccaggccgactccgggtgtgtggttagctggaaaaacaaggagctcaaatgcggatccggcatcttcatcacagataatgtgcacacctggacagaacagtataagtttcagcccgagtctcctagcaagctggcttccgccattcaaaaagctcacgaagaggggatctgtggcattagatctgtcacgcgccttgaaaacctgatgtggaagcagatcacccccgagctcaatcatattctgacagagaacgaagtgaaactgaccatcatgacaggagacatcaagggcattatgcaggccgggaaacggagccttagaccgcagcctaccgagctcaagtactcctggaaagcgtggggaaaggccaagatgctgagcacggaactgcacaatcataccttcctcatcgatggccccgagacagctgaatgccctaacaccaatcgcgcctggaactctctggaggttgaggactatgggtttggagtgttcacaaccaatatttggcttaaactgaaggaacggcaagatgtcttttgtgactccaaactcatgagcgctgccatcaaggacaacagagcggtgcacgccgatatgggctactggattgagtctgctctgaacgacacatggaaaatcgaaaaggcctccttcatcgaggtcaagagctgccactggcccaaatctcataccctgtggagcaatggcgtccttgagtccgaaatgattatccctaagaacttcgctgggcccgttagccagcacaattatcgcccgggataccatacgcagacagccggcccttggcacctcgggcggctggagatggattttgacttctgtgaaggaaccaccgtggtggtcacagaggattgcggcaacagagggccctctctgcggaccacgacagcctccggaaaactcattaccgaatggtgctgtcgcagctgcacactgccccctcttagataccggggcgaggacggctgttggtatgggatggagatcagaccgctgaaggaaaaagaggaaaatctcgtgaactccctggttaccgctggacatggccagattgataatttttctctgggggtgcttggaatggcgctgttcctggaggaaatgctgcgcacacgggtcggcaccaagcacgccatcctcctggtggctgttagctttgtgacgcttattaccgggaacatgtccttcagagacctgggacgcgtcatggtgatggttggcgccacaatgaccgatgacatcggcatgggggtgacatacctcgccctgctggctgcctttaaggtcagacccaccttcgcggctggacttctgctccggaaactgacgtctaaggagctcatgatgacaaccatcggcattgtgctgcttagccaatccacaatccctgagtctattctggaactcaccgatgccctggccctggggatgatggtgcttaaaatcgtccgcaatatggagaagtatcagctggctgttaccattatggccatcagctgcgtgcccaacgcggtgatcctccagaatgcttggaaagtctcctgtacaacgctggccgtggttagcgtgtctcctctcctgcttacctccagccaacagaaggccgactggattcccctggctctcacaatcaagggactgaaccctaccgccatttttctgacaaccctttctagaacgtccaaaaagcggagctggcccctgaatgaagctatcatggccgtcggcatggtgtctattctcgcgtccagcctgctcaaaaacgatatcccgatgacagggcctctggttgccggaggccttctgaccgtgtgctacgtcctgaccggccgctccgctgacctcgagctggaaagagccgctgacgtgcggtgggaggagcaggccgaaatcagcgggtctagccccattctttccatcacaatttctgaggatggaagcatgtccatcaagaatgaagaggaggaacagaccctgacaattctcatccgcacgggcctgctcgtcatttctgggctgttccctgtgagcatccccatcaccgccgctgcgtggtatctttgggaggttaaaaagcaaagagccggagtgctgtgggacgtcccgtcccctccccctgtgggcaaagctgaactggaggatggggcctaccggattaagcagaagggaatcctcggctattctcagattggcgccggggtttacaaagaaggaacatttcacaccatgtggcatgtgacacgcggcgctgtcctgatgcacaaggggaaaagaatcgagcccagctgggccgacgtgaagaaagatcttatttcctacggaggcgggtggaagctggagggagaatggaaggagggcgaagaggtgcaggttctcgcgctggaacccggcaaaaaccctcgggctgtccaaaccaagccgggactcttcaaaacgaacaccggaacaatcggcgccgtgagcctggacttttctcccgggacctccggaagccctatcgtggataagaaaggcaaggtcgtggggctttatggaaatggcgttgtgacaagatctggcacctacgtctccgccattgctcagacagaaaagagcatcgaggacaaccccgaaattgaggatgacatcttccgcaaaaagcggctgacgattatggatctgcatcctggggccggaaaaaccaagagatatctccccgcgatcgtgcgcgaagctatcaaacggggcctgagaacacttattctggcccctacccgcgttgtggccgctgagatggaagaggccctccgggggctgccgatcagataccagacccccgctattcgcgccgagcacacaggacgggaaatcgtcgacctcatgtgtcatgcgacgttcaccatgagactgctttcccctattcgggtgcccaattataacctgatcattatggatgaggcccactttacagaccctgcttctatcgccgctcgcggctacatcagcaccagagttgaaatgggggaggccgccggcattttcatgacagctacacccccgggatcccgggacccttttccccagagcaatgcgcccatcatggatgaggaacgcgagattcctgaaagatcttggaactccggccacgagtgggtgacggacttcaaggggaagacagtctggtttgtgcccagcatcaaagccggaaatgatattgctgcctgcctgcggaagaacggcaaaaaggtgatccaactctctagaaaaaccttcgacagcgaatatatcaagacccgcacaaatgattgggactttgtcgttaccacagatatttccgagatgggggccaacttcaaggctgagcgggtgatcgaccctagacgctgtatgaaaccggtgattctgaccgatggagaggaacgggtcatccttgccggccccatgcctgtgacgcattctagcgcggctcagagacgcgggcgggttggcagaaatcccaagaacgaaaatgaccagtacatttacatgggagagcctctggaaaacgatgaggactgcgcccactggaaagaggccaagatgctcctggacaatatcaacacacccgaaggcatcattccgtccatgtttgagcctgaacgcgagaaagtggatgctatcgacggggaatatagactgcggggagaggcccgcaagaccttcgtcgatctcatgagacggggcgaccttcccgtgtggctggcgtaccgcgttgccgctgaggggattaactatgccgatagacggtggtgttttgacggagtgaaaaataaccaaatcctggaagagaatgtcgaagtggagatttggacaaaggagggcgaaagaaagaaactcaagcctcgctggctggatgctcggatctactctgacccccttgccctgaaagagttcaaggagttcgctgccgggagaaaaagcctcaccctgaacctgattacggagatgggccgcctccctacctttatgacacagaaggcgaagaatgcccttgataacctggctgtcctgcataccgccgaagctggaggccgggcctataatcacgccctctccgagctgcccgagacacttgaaaccctgctcctgctgacactccttgctaccgtgacagggggaatcttcctgtttctgatgagcggcaaagggatcggaaagatgacactcggcatgtgctgcattatcaccgcgtctattctgctttggtacgcccagatccagccgcactggattgctgcctccatcatcctggagttctttctcattgttctgctgatccctgaacccgagaaacaaagaacaccccaggacaaccagctcacatatgtggtgattgccatccttaccgtcgttgctgccacaatggcgaatgaaatgggcttcctggagaagacgaaaaaggattttgggctgggaagcattaccacacagcaacctgagtccaacatcctcgacatcgatctgcggccggcctctgcttggaccctttacgccgtggctacaaccttcattacgcccatgctgcgccatagcatcgaaaattcctctgtgaacgtcagcctcaccgccattgcgaatcaggccacagtgctgatgggcctggggaagggatggcctctctccaaaatggacatcggcgttccccttctggctattgggtgttacagccaggtgaaccctatcaccctgacagccgctctcctgcttctggtcgcccactatgctattatcggacccggcctccaggccaaggcgaccagagaggcccaaaaacgggctgccgctggcatcatgaagaatcctacggtggacgggatgacagtcattgatctggacccgatcccctacgatcctaaatttgaaaagcagctgggacaggtgatgctccttgttctgtgcgtgacccaggtcctgatgatgcgcacaacctgggccctctgtgaggccctgacccttgcgacaggccccatttctacgctgtgggaagggaaccctggaagattctggaataccacaatcgctgtgtccatggccaacatttttcggggcagctatctcgctggggccggactgctgttctctatcatgaagaacaccgccaatacacgcagaggcaccggcaacacgggggagacactcggagagaaatggaagaatcggcttaacgctctgggcaaatccgaatttcaaatctacaagaaaagcgggattcaggaggttgaccgcaccctggccaaggaaggaatcaaaagaggcgagaccgatcatcacgcggtgtctcgggggagcgccaagctcagatggttcgtcgagcgcaatctggtgacacccgaaggaaaggtggttgaccttggctgcggcagagggggatggtcctattactgtggcgggctgaaaaacgtcaaggaggtgaaaggactcaccaagggcgggccgggacatgaagaacctattcccatgtctacatatggctggaatctggtgagactgcagagcggcgtcgatgttttctttacgccccctgaaaaatgcgacaccctcctttgtgatatcggggagtccagccccaaccctacagtggaggctggacgcaccctgcgggtgctgaatctcgtcgaaaactggctgaataacaatacacaattctgcattaaggtgcttaacccgtacatgccctccgttatcgagaagatggaagccctgcagagaaaatacggcggggctctcgtgcgcaatcctctgtctcggaacagcacccacgagatgtattgggtctccaacgcctctggaaatatcgtgagctccgttaacatgatttctagaatgctgatcaatcgctttacgatgcggcacaagaaagcgacctacgaacccgacgtggatctcggcagcgggacaagaaacattggaatcgagtccgagacccctaatcttgacattatcggcaagcgcatcgagaagattaagcaggagcatgaaacaagctggcactatgatcaggaccatccctacaagacctgggcctatcacggctcttacgagacaaaacaaaccgggtccgctagctctatggtcaacggagtggtgcggctgctgacgaagccgtgggacgtcatccctatggttacacagatggccatgaccgataccacacccttcggccagcagagagtgtttaaagaaaaggtggacacgcgcacccaagagcctaaagaggggacaaagaagctcatgaaaattaccgctgaatggctgtggaaggagcttggcaaaaagaaaacacccagaatgtgtacccgggaagagttcacacgcaaggtcagatccaatgccgctctgggcgccatctttaccgatgagaacaaatggaaaagcgcgcgggaagccgtggaggactctgggttctgggaactcgttgataaggagagaaatctgcacctggaaggaaaatgcgagacgtgtgtgtataacatgatgggcaagcgggagaaaaagctcggcgaatttgggaaagctaagggatcccgcgccatttggtacatgtggctgggcgctagattccttgagtttgaagccctggggttcctcaatgaggaccattggtttagccgggaaaactccctgagcggagtcgagggcgaggggcttcacaagctgggctacatcctccgcgatgtgtctaaaaaggaaggaggcgccatgtatgcggacgataccgctgggtgggacacaagaattaccctggaggatctgaaaaatgaagagatggttacaaaccatatggaaggagagcacaagaaactcgccgaggccatcttcaagctgacctaccagaataaggtggtccgggtgcagcgccctacgcccagaggcacagttatggacatcattagccggcgcgaccagagagggtccggacaagtggtcacctatggccttaacacattcaccaacatggaagctcagctgatccggcagatggagggggaaggcgtgtttaaatctattcaacagctcacggtcaaggaggagatcgccgtgaaaaattggctgattcgcgttggaagagaacggcttagccgcatggctatctccggcgatgactgcgtggtcaagccgctggatgacagattcgcctctgcgctcaccgccctgaacgatatggggaaagtgcggaaggacatccagcagtgggagcctagcagaggatggaatgattggacacaagtgcccttttgctcccatcacttccacgaactgattatgaaggacggccgcgttctcgtggtcccctgtcggaaccaggatgagctgatcgggagagctcgcatttctcagggagccggctggagccttcgggaaaccgcttgcctggggaaatcctacgcccagatgtggagcctcatgtattttcatagacgcgacctgcggcttgcggccaatgctatctgttctgccgtgccttcccactggattccgacaagcagaaccacatggtctatccatgctacccacgagtggatgacgacagaggatatgctgaccgtttggaaccgcgtgtggatccaagaaaatccctggatggaggacaagacccctgtcgaatcctgggaggaaattccctacctcggcaaacgggaggatcagtggtgcggaagcctgatcggcctgacatccagagccacctgggctaagaacattcagacagccatcaatcaggtgcgctctctcattgggaacgaggaatatacggactacatgcctagcatgaaacggttcagaatcgaggaagaggaagcgggagtcctgtggtga

SEQ ID NO: 19625 - RNA, 9876 nt, synthetic construct
  misc_feature 1..9876: note = derived and/or modified CDS sequence (opt5) from DENV-2__KM279595__SS-prME
  source 1..9876: mol_type = other RNA
accgccggaatcattatcatgatgattcccaccgtgatggctttccacctgacgacccggaatggggagcctcatatgatcgtcagccggcaggaaaagggaaagtccctcctgtttaagacagagaatggcgttaacatgtgcacccttatggccatggacctgggggaactctgtgaggataccattacctacaattgcccgctgcttcgccaaaacgaacccgaggacatcgattgttggtgcaattctacaagcacctgggtgacgtatggaacctgtacagcgaccggcgagcacagacgggaaaaacgctccgtggctctggtccctcatgtggggatgggactcgagacaagaaccgaaacgtggatgtctagcgagggcgcctggaagcacgcccagcggatcgagacatggattctgcgccatcccggcttcaccatcatggctgccattctggcttacacaatcgggaccacctattttcagagagttctcattttcatcctgcttacagccgtgacgccttccatggcgatgcggtgcattggaatctctaaccgcgactttgtcgaaggcgtgagcgggggatcctgggttgatatcgtgctggagcacggcagctgtgtcaccacaatggccaaaaataagcccaccctcgacttcgaactgattaagacagaggctaaacaccttgccaccctgagaaagtactgcgtggaagctaaactcacgaacacaaccaccgcctctcggtgtcctacacagggggagccgtccctgaatgaggaacaagataagcgctttgtgtgcaaacatagcatggtcgacagaggatggggcaacggctgtgggctgttcggaaagggcgggatcgttacctgcgcgatgtttacatgcaagaaaaatatggagggaaaggtggtgcagcccgaaaacctcgagtatacgattgtcatcacccctcactctggcgaagagaatgccgtggggaacgatacaggaaaacatggcaaggagattaaagttacaccccagtccagcatcacagaagctgagctgaccggctacgggacggtgaccatggaatgttctcctcggacaggacttgacttcaatgagatggtcctgctccagatggaaaacaaggcctggctggtgcaccgccaatggtttcttgatctgcccctcccgtggctgcctggcgctgacacccaggggtccaactggatccagaaagagacactggttaccttcaagaatccccacgccaagaaacaggatgtggtcgtgctcggaagccaagagggcgccatgcatacggctctgacaggggcgaccgaaattcagatgtcctctggcaaccttctgtttacaggacacctcaagtgcagactgcggatggacaaacttcagctgaagggcatgagctattccatgtgtaccgggaaattcaaggtcgtgaaggagatcgccgaaacccaacatggaacaattgttatcagagtgcagtacgagggcgacgggagcccttgcaaaattcccttcgagatcatggatctcgaaaagcgccacgtcctgggacggctgatcacggtgaatcccattgttaccgagaaagactctcctgtgaacatcgaagctgagccgccctttggcgattcctacattatcattggggtcgaacctggccagctcaagctgagctggttcaaaaagggatctagcatcggccagatgtttgagacaaccatgagaggggccaagcgcatggccattcttggagacacagcttgggatttcggctccctcgggggagtgtttacctctatcggcaaagccctccatcaagtgttcggggcgatctatggcgctgcctttagcggagtttcctggacgatgaagattctgatcggcgtcgtgattacatggatcgggatgaatagccggtctacctccctgagcgtgtctcttgtcctcgtgggagttgtgaccctgtacctgggcgtcatggtgcaggccgactccgggtgtgttgtgagctggaaaaacaaggagctcaaatgcggatccggcattttcatcacagataatgtccacacctggacagaacagtataagtttcagcccgagtctcctagcaagctggcttccgccatccaaaaagctcacgaagaggggatttgtggcatcagatctgtgacgcgccttgaaaacctgatgtggaagcagattacccccgagctcaatcatatcctgacagagaacgaagttaaactgaccattatgacaggagacatcaagggcatcatgcaggccgggaaacggacccttagaccgcagcctacggagctcaagtacagctggaaagcgtggggaaaggccaagatgctgtccaccgaactgcacaatcatacattcctcattgatggccccgagaccgctgaatgccctaacacaaatcgcgcctggaacagcctggaggtggaggactatgggtttggagtcttcaccacaaatatctggcttaaactgaaggaacggcaagatgtgttttgtgactctaaactcatgtccgctgccattaaggacaacagagcggtgcacgccgatatgggctactggatcgagagcgctctgaacgacacctggaaaattgaaaaggcctctttcatcgaggtcaagtcctgccactggcccaaaagccatacgctgtggtctaatggcgttcttgagagcgaaatgatcattcctaagaacttcgctgggcccgtgtcccagcacaattatcgcccgggataccatacacagaccgccggcccttggcacctcgggcggctggagatggattttgacttctgtgaaggaaccacagtggtcgtgaccgaggattgcggcaacagagggcccagcctgcggacgacaaccgcctctggaaaactcatcacagaatggtgctgtcgctcctgcaccctgccccctcttagataccggggcgaggacggctgttggtatgggatggagattagaccgctgaaggaaaaagaggaaaatctcgttaacagcctggtgacagctggacatggccagatcgataatttttccctgggggtccttggaatggcgctgttcctggaggaaatgctgcgcacccgggtgggcacgaagcacgccattctcctggttgctgtgtcttttgtcacccttatcacagggaacatgagcttcagagacctgggacgcgtgatggttatggtgggcgccaccatgacagatgacattggcatgggggtcacctacctcgccctgctggctgcctttaaggtgagacccacgttcgcggctggacttctgctccggaaactgacatccaaggagctcatgatgaccacaatcggcatcgtgctgctttctcaaagcaccattcctgagtccatcctggaactcaccgatgccctggccctggggatgatggtccttaaaattgttcgcaatatggagaagtatcagctggctgtgacaatcatggccattctctgcgtgcccaacgcggtcatcctgcagaatgcttggaaagtgtcttgtacgaccctcgccgttgtgagcgtctcccctctgcttctgacaagctctcaacagaaggccgactggatccccctcgctctgaccattaagggactgaaccctacagccatctttcttaccacgctgtccagaacaagcaaaaagcggtcttggcccctcaatgaagctattatggccgtgggcatggtttccatcctggcgagctctctcctgaaaaacgatattccgatgaccgggcctcttgtggccggaggcctgctgaccgtctgctacgtgctcacaggccgctccgctgacctggagcttgaaagagccgctgacgtccggtgggaggagcaggccgaaatcagcgggtccagccccatcctgtctattaccatcagcgaggatggatccatgtctattaagaatgaagaggaggaacagacactcacgatcctgattcgcaccggcctcctggtgatcagcgggcttttccctgtttccattcccatcacagccgctgcgtggtatctgtgggaggtgaaaaagcaaagagccggagtcctgtgggacgtgccgtctcctccccctgttggcaaagctgaactcgaggatggggcctaccggatcaagcagaagggcattctgggctatagccagatcggcgccggggtgtacaaagaaggaacctttcacacaatgtggcatgtcacccgcggcgctgtgcttatgcacaaggggaaaagaattgagccctcctgggccgacgtgaagaaagatctgatctcttacggaggcgggtggaagctcgagggagaatggaaggagggcgaagaggttcaggtcctggcgctcgaacccggcaaaaaccctcgggctgtgcaaacgaagccggggctgttcaaaaccaacacaggaaccattggcgccgtgagccttgacttttcccccgggacaagcggatctcctatcgtcgataagaaaggcaaggtggttgggctgtatggaaatggcgtggtcaccagatccggcacatacgtgagcgccatcgctcagacggagaagaacattgaggacaatcccgaaatcgaggatgacattttccgcaaaaagcggctgaccatcatggatctccatcctggggccggaaaaacaaagagatatctgcccgcgattgttcgcgaagctatcaaacggggccttagaaccctgatcctcgcccctacccgcgtggtcgccgctgagatggaagaggccctgcgggggctcccgattagataccagacacccgctatccgcgccgagcacacgggacgggaaattgtggacctgatgtgtcatgcgaccttcacaatgagacttctgtctcctatccgggttcccaactataatctgattatcatggatgaggcccactttaccgaccctgcttccattgccgctcgcggctacatcagcacaagagtggaaatgggggaggccgccggcatcttcatgaccgctacgcccccgggatcccgggacccttttccccagtctaacgcgcccattatggatgaggaaaaggagatccctgaacgcagctggaactccggccacgagtgggtcacagacttcaaggggaaaaccgtgtggtttgtgcccagcattaaggccggaaacgatatcgctgcctgcctccgcaagaatggcaagaaagtcattcaactgtctcggaagaccttcgactccgaatatatcaagacaagaaccaacgattgggactttgttgtgacaaccgatatcagcgagatgggggccaatttcaaagctgagcgcgtgattgaccctcggagatgtatgaagccggtcatccttacggatggagaggaacgcgtgattctggccggccccatgcctgttacacattctagcgcggctcagcggagagggcgcgtgggccggaaccccaaaaatgaaaacgaccagtacatctacatgggagagcctctcgaaaatgatgaggactgcgcccactggaaggaggccaaaatgctgctggacaacattaacacccccgaaggcatcatcccgtccatgtttgagcctgaaagagagaaggtcgatgctattgacggggaatatcgcctcagaggagaggcccggaaaacattcgtggatcttatgcgcagaggcgacctgcccgtttggctggcgtaccgggtggccgctgaggggatcaattatgccgatcgcagatggtgttttgacggagtcaagaacaatcaaattctcgaagagaacgtggaagtcgagatctggaccaaggagggcgaacggaaaaagctgaaacctagatggcttgatgctcgcatttactctgaccccctggccctcaaggagttcaaagagttcgctgccgggagaaagagcctgacgctgaatctcatcaccgagatgggcagacttcctacatttatgacccagaaggcgaaaaacgccctggataatctggctgtgctccatacagccgaagctggaggccgcgcctataaccacgccctgtccgagcttcccgagaccctggaaacactcctgctgctcacccttctggctacggttacagggggaattttcctgtttctcatgtctggcaaggggatcggaaaaatgaccctgggcatgtgctgcatcattaccgcgagcatccttctgtggtacgcccagattcagccgcactggatcgctgcctccattatcctcgagttctttctgatcgtgctgctcattcctgaacccgagaagcaacggacaccccaggacaatcagcttacctatgtggtcatcgccattctgacagttgtggctgccacgatggcgaacgaaatgggcttcctggagaaaaccaagaaggattttgggctcggaagcatcacaacccagcaacctgagtctaatattctggacatcgatcttagaccggcctccgcttggacactgtacgccgtggctaccacgttcatcacccccatgctccggcatagcattgaaaactcctctgtcaatgtgagcctgacagccatcgcgaaccaggccaccgttctgatgggcctcgggaaaggatggcctctttccaagatggacattggcgtgcccctgctggctatcgggtgttactctcaggtcaatcctattacactcaccgccgctctgcttctgctcgtggcccactatgctatcattggacccggcctgcaggccaaagcgacgcgcgaggcccaaaagagagctgccgctggcatcatgaaaaaccctacagtcgacgggatgaccgtgatcgatctggacccgattccctacgatcctaagtttgaaaagcagctcggacaggttatgcttctggtgctgtgcgtcacacaggtgctcatgatgcggaccacctgggccctgtgtgaggcccttacactggcgacgggccccatcagcaccctctgggaagggaatcctggacgcttctggaacacaaccattgctgtttccatggccaacatctttagaggcagctatctggctggggccggactcctgttctctattatgaaaaatacagccaacacccggcgcggcacgggcaatacaggggagacccttggagagaagtggaaaaacagactgaatgctctgggcaagtccgaatttcaaatctacaaaaagagcgggatccaggaggtggaccggaccctcgccaaagaaggaattaagcgcggcgagacagatcatcacgcggtctctagagggtccgccaagctgcggtggttcgtggagagaaaccttgtgacccccgaaggaaaagttgtcgacctgggctgcggccgcgggggatggagctattactgtggcgggctcaagaatgtgaaagaggtgaagggactgacaaaaggcgggccgggacatgaagaacctatccccatgtctacgtatggctggaacctggtccggctccagagcggcgttgatgtgttctttacaccccctgaaaagtgcgacacacttctgtgtgatattggggagtcctctcccaatcctaccgtggaggctggaagaacactgcgcgtcctcaacctggtggaaaattggcttaacaataacacccaattctgcatcaaggttctgaatccgtacatgcccagcgtgattgagaaaatggaagccctccagcggaagtacggcggggctctggtcagaaaccctctgtcccgcaacagcacgcacgagatgtattgggtgtccaatgcctctggaaacatcgttagctccgtgaatatgatctctcggatgctcattaacagatttaccatgcgccacaaaaaggcgacatacgaacccgacgtcgatcttggcagcgggacccggaatatcggaattgagtccgagacacctaacctggacatcattggcaaaagaatcgaaaagatcaagcaggagcatgaaacctcttggcactatgatcaggaccatccctacaaaacatgggcctatcacggcagctacgagaccaagcaaacggggtccgctagctctatggtgaatggagtggtccgcctgctcacaaaaccgtgggacgttattcctatggtgacccagatggccatgaccgatacaacgcccttcggccagcagcgggtgtttaaggaaaaagtcgacaccagaacacaagagcctaaggaggggaccaagaaactgatgaagatcacagctgaatggctttggaaagagctgggaaagaaaaagacccccagaatgtgtacaagagaagagttcacccggaaagtgcgctccaacgccgctctcggcgccatttttacggatgagaataagtggaaaagcgcgagagaagccgttgaggactctgggttctgggaactggtggataaagagcggaacctgcacctcgaaggaaagtgcgagacctgtgtctataatatgatgggcaaaagagagaagaaactgggcgaatttgggaaggctaagggatcccgggccatctggtacatgtggcttggcgctcgcttcctggagtttgaagccctcgggttcctgaacgaggaccattggtttagcagagaaaattctctttccggagtggagggcgaggggctgcacaaactcggctacattctgcgggatgttagcaagaaagaaggaggcgccatgtatgcggacgatacagctgggtgggacacccgcatcacactggaggatctcaagaacgaagagatggtgaccaatcatatggaaggagagcacaaaaagctggccgaggccattttcaaacttacgtaccagaacaaagtcgtgagagttcagcggcctacaccccgcggcaccgtgatggacatcatctccagacgggaccagcgcgggagcggacaagtcgtgacatatggcctgaacaccttcacgaatatggaagctcagctcattagacagatggagggggaaggcgtctttaagtctatccaacagctgaccgtgaaagaggagattgccgttaaggattggcttatccgggtgggacgcgaaagactgagccggatggctatttccggcgacgattgcgtcgtgaaaccgctcgacgatcgcttcgcctctgcgctgacagccctgaacgacatggggaaggtgagaaaggatatccagcagtgggagcctagccggggatggaatgactggacccaagttcccttttgctcccatcacttccacgaactcatcatgaaagatggcagagtgctggtcgtgccctgtcgcaaccaggacgagcttattgggcgggctagaatctctcagggagccggctggagcctgcgcgaaacagcttgcctcgggaagtcctacgcccagatgtggtctctgatgtattttcatcggagagatcttcgcctggcggccaatgctatttgtagcgccgttccttcccactggatcccgaccagccggacaacctggtctattcatgctacgcacgagtggatgacaaccgaggacatgctcaccgtgtggaacagagtctggatccaagaaaatccctggatggaggataaaacacctgtggaatcctgggaggaaatcccctacctgggcaagcgcgaggaccagtggtgcggaagcctgattggcctcacctctcgggccacatgggctaaaaacatccagacggccattaatcaggtcagatccctgatcgggaacgaggaatataccgactacatgcctagcatgaagcgcttccggagagaggaagaggaagcgggagtgctttggtga

SEQ ID NO: 19626 - RNA, 9876 nt, synthetic construct
  misc_feature 1..9876: note = derived and/or modified CDS sequence (opt5) from DENV-2__KM279566__SS-prME
  source 1..9876: mol_type = other RNA
accgccggaatcattatcatgatgattcccaccgtgatggctttccacctgacgaccagaaacggggagcctcatatgatcgtcagccggcaggaaaagggaaaatccctcctgtttaagacagagaatggcgttaacatgtgcacccttatggccatggacctgggggaactctgtgaggataccattacctacaattgcccgctgcttcgccaaaacgaacccgaggacatcgattgttggtgcaattctacaagcacctgggtgacgtatggaacctgtacagcgaccggcgagcacagacgggaaaaacgctccgtggctctggtccctcatgtggggatgggactcgagacaagaaccgaaacgtggatgtctagcgagggcgcctggaagcacgcccagcggatcgagacatggattctgcgccatcccggcttcaccatcatggctgccattctggcttacacaatcgggaccacctattttcagagagttctcattttcatcctgcttacagccgtgacgccttccatggcgatgcggtgcattggaatctctaaccgcgactttgtcgaaggcgtgagcgggggatcctgggttgatatcgtgctggagcacggcagctgtgtcaccacaatggccaaaaataagcccaccctcgacttcgaactgattaagacagaggctaaacaccttgccaccctgagaaagtactgcgtggaagctaaactcacgaacacaaccaccgcctctcggtgtcctacacagggggagccgtccctgaatgaggaacaagataagcgctttgtgtgcaaacatagcatggtcgacagaggatggggcaacggctgtgggctgttcggaaagggcgggatcgttacctgcgcgatgtttacatgcaagaaaaatatggagggaaaggtggtgcagcccgaaaacctcgagtatacgattgtcatcacccctcactctggcgaagagaatgccgtggggaacgatacaggaaaacatggcaaggagattaaagttacaccccagtccagcatcacagaagctgagctgaccggctacgggacggtgaccatggaatgttctcctcggacaggacttgacttcaatgagatggtcctgctccagatggaaaacaaggcctggctggtgcaccgccaatggtttcttgatctgcccctcccgtggctgcctggcgctgacacccaggggtccaactggatccagaaagagacactggttaccttcaagaatccccacgccaagaaacaggatgtggtcgtgctcggaagccaagagggcgccatgcatacggctctgacaggggcgaccgaaattcagatgtcctctggcaaccttctgtttacaggacacctcaagtgcagactgcggatggacaaacttcagctgaagggcatgagctattccatgtgtaccgggaaattcaaggtcgtgaaggagatcgccgaaacccaacatggaacaattgttatcagagtgcagtacgagggcgacgggagcccttgcaaaattcccttcgagatcatggatctcgaaaagcgccacgtcctgggacggctgatcacggtgaatcccattgttaccgagaaagactctcctgtgaacatcgaagctgagccgccctttggcgattcctacattatcattggggtcgaacctggccagctcaagctgagctggttcaaaaagggatctagcatcggccagatgtttgagacaaccatgagaggggccaagcgcatggccattcttggagacacagcttgggatttcggctccctcgggggagtgtttacctctatcggcaaagccctccatcaagtgttcggggcgatctatggcgctgcctttagcggagtttcctggacgatgaagattctgatcggcgtcgtgattacatggatcgggatgaatagccggtctacctccctgagcgtgtctcttgtcctcgtgggagttgtgaccctgtacctgggcgtcatggtgcaggccgactccgggtgtgttgtgagctggaaaaacaaggagctcaaatgcggatccggcattttcatcacagataatgtccacacctggacagaacagtataagtttcagcccgagtctcctagcaagctggcttccgccatccaaaaagctcacgaagaggggatttgtggcatcagatctgtgacgcgccttgaaaacctgatgtggaagcagattacccccgagctcaatcatatcctgacagagaacgaagttaaactgaccattatgacaggagacatcaagggcatcatgcaggccgggaaacggacccttagaccgcagcctacggagctcaagtacagctggaaagcgtggggaaaggccaagatgctgtccaccgaactgcacaatcatacattcctcattgatggccccgagaccgctgaatgccctaacacaaatcgcgcctggaacagcctggaggtggaggactatgggtttggagtcttcaccacaaatatctggcttaaactgaaggaacggcaagatgtgttttgtgactctaaactcatgtccgctgccattaaggacaacagagcggtgcacgccgatatgggctactggatcgagagcgctctgaacgacacctggaaaattgaaaaggcctctttcatcgaggtcaagtcctgccactggcccaaaagccatacgctgtggtctaatggcgttcttgagagcgaaatgatcattcctaagaacttcgctgggcccgtgtcccagcacaattatcgcccgggataccatacacagaccgccggcccttggcacctcgggcggctggagatggattttgacttctgtgaaggaaccacagtggtcgtgaccgaggattgcggcaacagagggcccagcctgcggacgacaaccgcctctggaaaactcatcacagaatggtgctgtcgctcctgcaccctgccccctcttagataccggggcgaggacggctgttggtatgggatggagattagaccgctgaaggaaaaagaggaaaatctcgttaacagcctggtgacagctggacatggccagatcgataatttttccctgggggtccttggaatggcgctgttcctggaggaaatgctgcgcacccgggtgggcacgaagcacgccattctcctggttgctgtgtcttttgtcacccttatcacagggaacatgagcttcagagacctgggacgcgtgatggttatggtgggcgccaccatgacagatgacattggcatgggggtcacctacctcgccctgctggctgcctttaaggtgagacccacgttcgcggctggacttctgctccggaaactgacatccaaggagctcatgatgaccacaatcggcatcgtgctgctttctcaaagcaccattcctgagtccatcctggaactcaccgatgccctggccctggggatgatggtccttaaaattgttcgcaatatggagaagtatcagctggctgtgacaatcatggccattctctgcgtgcccaacgcggtcatcctgcagaatgcttggaaagtgtcttgtacgaccctcgccgttgtgagcgtctcccctctgcttctgacaagctctcaacagaaggccgactggatccccctcgctctgaccattaagggactgaaccctacagccatctttcttaccacgctgtccagaacaagcaaaaagcggtcttggcccctcaatgaagctattatggccgtgggcatggtttccatcctggcgagctctctcctgaaaaacgatattccgatgaccgggcctcttgtggccggaggcctgctgaccgtctgctacgtgctcacaggccgctccgctgacctggagcttgaaagagccgctgacgtccggtgggaggagcaggccgaaatcagcgggtccagccccatcctgtctattaccatcagcgaggatggatccatgtctattaagaatgaagaggaggaacagacactcacgatcctgattcgcaccggcctcctggtgatcagcgggcttttccctgtttccattcccatcacagccgctgcgtggtatctgtgggaggtgaaaaagcaaagagccggagtcctgtgggacgtgccgtctcctccccctgttggcaaagctgaactcgaggatggggcctaccggatcaagcagaagggcattctgggctatagccagatcggcgccggggtgtacaaagaaggaacctttcacacaatgtggcatgtcacccgcggcgctgtgcttatgcacaaggggaaaagaattgagccctcctgggccgacgtgaagaaagatctgatctcttacggaggcgggtggaagctcgagggagaatggaaggagggcgaagaggttcaggtcctggcgctcgaacccggcaaaaaccctcgggctgtgcaaacgaagccggggctgttcaaaaccaacacaggaaccattggcgccgtgagccttgacttttcccccgggacaagcggatctcctatcgtcgataagaaaggcaaggtggttgggctgtatggaaatggcgtggtcaccagatccggcacatacgtgagcgccatcgctcagacggagaagtctattgaggacaaccccgaaatcgaggatgacattttccgcaaaaagcggctgaccatcatggatctccatcctggggccggaaaaacaaagagatatctgcccgcgattgttcgcgaagctatcaaacggggccttagaaccctgatcctcgcccctacccgcgtggtcgccgctgagatggaagaggccctgcgggggctcccgattagataccagacacccgctatccgcgccgagcacacgggacgggaaattgtggacctgatgtgtcatgcgaccttcacaatgagacttctgtcccctatccgggttcccaattataacctgattatcatggatgaggcccactttaccgaccctgctagcattgccgctcgcggctacatctccacaagagtggaaatgggggaggccgccggcatcttcatgaccgctacgcccccgggatctcgggacccttttccccagagcaatgcgcccattatggatgaggaaaaggagatccctgaacgctcctggaacagcggccacgagtgggtcacagacttcaaggggaaaaccgtgtggtttgtgccctctattaaggccggaaatgatatcgctgcctgcctccgcaagaacggcaagaaagtcattcaactgtcccggaagaccttcgacagcgaatatatcaagacaagaaccaatgattgggactttgttgtgacaaccgatatctctgagatgggggccaacttcaaagctgagcgcgtgattgaccctcggagatgtatgaagccggtcatccttacggatggagaggaacgcgtgattctggccggccccatgcctgttacacatagctccgcggctcagcggagagggcgcgtgggccggaatcccaaaaacgaaaatgaccagtacatctacatgggagagcctctcgaaaacgatgaggactgcgcccactggaaggaggccaaaatgctgctggacaatattaacacccccgaaggcatcatcccgtctatgtttgagcctgaaagagagaaggtcgatgctattgacggggaatatcgcctcagaggagaggcccggaaaacattcgtggatcttatgcgcagaggcgacctgcccgtttggctggcgtaccgggtggccgctgaggggatcaactatgccgatcgcagatggtgttttgacggagtcaagaataaccaaattctcgaagagaatgtggaagtcgagatctggaccaaggagggcgaacggaaaaagctgaaacctagatggcttgatgctcgcatttacagcgaccccctggccctcaaggagttcaaagagttcgctgccgggcggaagtccctgacgctgaacctcatcaccgagatgggcagacttcctacatttatgacccagaaggcgaaaaatgccctggataacctggctgtgctccatacagccgaagctggaggccgcgcctataatcacgccctgtctgagcttcccgagaccctggaaacactcctgctgctcacccttctggctacggttacagggggaattttcctgtttctcatgagcggcaaggggatcggaaaaatgaccctgggcatgtgctgcatcattaccgcgtccatccttctgtggtacgcccagattcagccgcactggatcgctgccagcattatcctcgagttctttctgatcgtgctgctcattcctgaacccgagaagcaacggacaccccaggacaaccagcttacctatgtggtcatcgccattctgacagttgtggctgccacgatggcgaatgaaatgggcttcctggagaaaaccaagaaggattttgggctcggatctatcacaacccagcaacctgagtccaacattctggacatcgatcttagaccggccagcgcttggacactgtacgccgtggctaccacgttcatcacccccatgctccggcattccattgaaaattctagcgtcaacgtgtccctgacagccatcgcgaatcaggccaccgttctgatgggcctcgggaaaggatggcctctttctaagatggacattggcgtgcccctgctggctatcgggtgttacagccaggtcaaccctattacactcaccgccgctctgcttctgctcgtggcccactatgctatcattggacccggcctgcaggccaaagcgacgcgcgaggcccaaaagagagctgccgctggcatcatgaaaaatcctacagtcgacgggatgaccgtgatcgatctggacccgattccctacgatcctaagtttgaaaagcagctcggacaggttatgcttctggtgctgtgcgtcacacaggtgctcatgatgcggaccacctgggccctgtgtgaggcccttacactggcgacgggccccatctccaccctctgggaagggaaccctggacgcttctggaatacaaccattgctgttagcatggccaacatctttagaggctcttatctggctggggccggactcctgttctccattatgaaaaacacagccaatacccggcgcggcacgggcaacacaggggagacccttggagagaagtggaaaaatagactgaacgctctgggcaagagcgaatttcaaatctacaaaaagtctgggatccaggaggtggaccggaccctcgccaaagaaggaattaagcgcggcgagacagatcatcacgcggtctccagagggagcgccaagctgcggtggttcgtggagagaaatcttgtgacccccgaaggaaaagttgtcgacctgggctgcggccgcgggggatggtcttattactgtggcgggctcaagaacgtgaaagaggtgaagggactgacaaaaggcgggccgggacatgaagaacctatccccatgagcacgtatggctggaatctggtccggctccagtccggcgttgatgtgttctttacaccccctgaaaagtgcgacacacttctgtgtgatattggggagtctagccccaaccctaccgtggaggctggaagaacactgcgcgtcctcaatctggtggaaaactggcttaataacaatacccaattctgcatcaaggttctgaacccgtacatgccctccgtgattgagaaaatggaagccctccagcggaagtacggcggggctctggtcagaaatcctctgagccgcaactccacgcacgagatgtattgggtgtctaacgccagcggaaatatcgtttcctctgtgaacatgatcagccggatgctcattaatagatttaccatgcgccacaaaaaggcgacatacgaacccgacgtcgatcttggctccgggacccggaacatcggaattgagtctgagacacctaatctggacatcattggcaaaagaatcgaaaagatcaagcaggagcatgaaaccagctggcactatgatcaggaccatccctacaaaacatgggcctatcacggctcctacgagaccaagcaaacggggagcgcttcttccatggtgaacggagtggtccgcctgctcacaaaaccgtgggacgttattcctatggtgacccagatggccatgaccgatacaacgcccttcggccagcagcgggtgtttaaggaaaaagtcgacaccagaacacaagagcctaaggaggggaccaagaaactgatgaagatcacagctgaatggctttggaaagagctgggaaagaaaaagacccccagaatgtgtacaagagaagagttcacccggaaagtgcgcagcaatgccgctctcggcgccatttttacggatgagaacaagtggaagtctgcgagagaagccgttgaggactccgggttctgggaactggtggataaagagcggaatctgcacctcgaaggaaagtgcgagacctgtgtctataacatgatgggcaaaagagagaagaaactgggcgaatttgggaaggctaagggaagccgggccatctggtacatgtggcttggcgctcgcttcctggagtttgaagccctcgggttcctgaatgaggaccattggttttctagagaaaactcccttagcggagtggagggcgaggggctgcacaaactcggctacattctgcgggatgtttccaagaaagaaggaggcgccatgtatgcggacgatacagctgggtgggacacccgcatcacactggaggatctcaagaatgaagagatggtgaccaaccatatggaaggagagcacaaaaagctggccgaggccattttcaaacttacgtaccagaataaagtcgtgagagttcagcggcctacaccccgcggcaccgtgatggacatcatcagcagacgggaccagcgcgggtctggacaagtcgtgacatatggcctgaacaccttcacgaacatggaagctcagctcattagacagatggagggggaaggcgtctttaagagcatccaacagctgaccgtgaaagaggagattgccgttaagaattggcttatccgggtgggacgcgaaagactgtcccggatggctatttctggcgatgactgcgtcgtgaaaccgctcgatgaccgcttcgccagcgcgctgacagccctgaacgatatggggaaggtgagaaaggacatccagcagtgggagccttcccggggatggaatgattggacccaagttcccttttgctctcatcacttccacgaactcatcatgaaagacggcagagtgctggtcgtgccctgtcgcaaccaggatgagcttattgggcgggctagaatcagccagggagccggctggtccctgcgcgaaacagcttgcctcgggaagtcttacgcccagatgtggagcctgatgtattttcatcggagagaccttcgcctggcggccaatgctatttgttccgccgttcctagccactggatcccgacctctcggacaacctggtccattcatgctacgcacgagtggatgacaaccgaggatatgctcaccgtgtggaacagagtctggatccaagaaaatccctggatggaggacaaaacacctgtggaaagctgggaggaaatcccctacctgggcaagcgcgaggatcagtggtgcggatctctgattggcctcacctcccgggccacatgggctaaaaacatccagacggccattaatcaggtcagaagcctgatcgggaacgaggaatataccgactacatgccttccatgaagcgcttccggagagaggaagaggaagcgggagtgctttggtga

SEQ ID NO: 19627 - RNA, 9876 nt, synthetic construct
  misc_feature 1..9876: note = derived and/or modified CDS sequence (opt5) from DENV-2__KM279574__SS-prME
  source 1..9876: mol_type = other RNA
accgccggcatcattatcatgatgattcccaccgtgatggctttccacctgacgaccagaaacggggagcctcatatgatcgtcagccggcaggaaaagggaaaatccctcctgtttaagacagagaatggcgttaacatgtgcacccttatggccatggacctgggggaactctgtgaggatacaattacctacaattgcccgctgcttagacaaaacgaacccgaggacatcgattgttggtgcaattctacaagcacctgggtgacgtatggaacctgtacagcgaccggcgagcacagacgggaaaaacgctccgtggctctggtccctcatgtggggatgggactcgagacaagaaccgaaacgtggatgtctagcgagggcgcctggaagcacgcccagcggatcgagacatggattctgcgccatcccggcttcaccatcatggctgccattctggcttacacaatcgggaccacctattttcagagagttctcattttcatcctgcttacagccgtgacgccttccatggcgatgcggtgcattggaatctctaaccgcgactttgtcgaaggcgtgagcgggggatcctgggttgatatcgtgctggagcacggcagctgtgtcaccacaatggccaaaaataagcccaccctcgacttcgaactgattaagacagaggctaaacaccttgccaccctgagaaagtactgcgtggaagctaaactcacgaacacaaccaccgcctctcggtgtcctacacagggggagccgtccctgaatgaggaacaagataagcgctttgtgtgcaaacatagcatggtcgacagaggatggggcaacggctgtgggctgttcggaaagggcgggatcgttacctgcgcgatgtttacatgcaagaaaaatatggagggaaaggtggtgcagcccgaaaacctcgagtatacgattgtcatcacccctcactctggcgaagagaatgccgtggggaacgatacaggaaaacatggcaaggagattaaagttacaccccagtccagcatcacagaagctgagctgaccggctacgggacggtgaccatggaatgttctcctcggacaggacttgacttcaatgagatggtcctgctccagatggaaaacaaggcctggctggtgcaccgccaatggtttcttgatctgcccctcccgtggctgcctggcgctgacacccaggggtccaactggatccagaaagagacactggttaccttcaagaatccccacgccaagaaacaggatgtggtcgtgctcggaagccaagagggcgccatgcatacggctctgacaggggcgaccgaaattcagatgtcctctggcaaccttctgtttacaggacacctcaagtgcagactgcggatggacaaacttcagctgaagggcatgagctattccatgtgtaccgggaaattcaaggtcgtgaaggagatcgccgaaacccaacatggaacaattgttatcagagtgcagtacgagggcgacgggagcccttgcaaaattcccttcgagatcatggatctcgaaaagcgccacgtcctgggacggctgatcacggtgaatcccattgttaccgagaaagactctcctgtgaacatcgaagctgagccgccctttggcgattcctacattatcattggggtcgaacctggccagctcaagctgagctggttcaaaaagggatctagcatcggccagatgtttgagacaaccatgagaggggccaagcgcatggccattcttggagacacagcttgggatttcggctccctcgggggagtgtttacctctatcggcaaagccctccatcaagtgttcggggcgatctatggcgctgcctttagcggagtttcctggacgatgaagattctgatcggcgtcgtgattacatggatcgggatgaatagccggtctacctccctgagcgtgtctcttgtcctcgtgggagttgtgaccctgtacctgggcgtcatggtgcaggccgactccgggtgtgttgtgagctggaaaaacaaggagctcaaatgcggatccggcattttcatcacagataatgtccacacctggacagaacagtataagtttcagcccgagtctcctagcaagctggcttccgccatccaaaaagctcacgaagaggggatttgtggcatcagatctgtgacgcgccttgaaaacctgatgtggaagcagattacccccgagctcaatcatatcctgacagagaacgaagttaaactgaccattatgacaggagacatcaagggcatcatgcaggccgggaaacggacccttagaccgcagcctacggagctcaagtacagctggaaagcgtggggaaaggccaagatgctgtccaccgaactgcacaatcatacattcctcattgatggccccgagaccgctgaatgccctaacacaaatcgcgcctggaacagcctggaggtggaggactatgggtttggagtcttcaccacaaatatctggcttaaactgaaggaacggcaagatgtgttttgtgactctaaactcatgtccgctgccattaaggacaacagagcggtgcacgccgatatgggctactggatcgagagcgctctgaacgacacctggaaaattgaaaaggcctctttcatcgaggtcaagtcctgccactggcccaaaagccatacgctgtggtctaatggcgttcttgagagcgaaatgatcattcctaagaacttcgctgggcccgtgtcccagcacaattatcgcccgggataccatacacagaccgccggcccttggcacctcgggcggctggagatggattttgacttctgtgaaggaaccacagtggtcgtgaccgaggattgcggcaacagagggcccagcctgcggacgacaaccgcctctggaaaactcatcacagaatggtgctgtcgctcctgcaccctgccccctcttagataccggggcgaggacggctgttggtatgggatggagattagaccgctgaaggaaaaagaggaaaatctcgttaacagcctggtgacagctggacatggccagatcgataatttttccctgggggtccttggaatggcgctgttcctggaggaaatgctgcgcacccgggtgggcacgaagcacgccattctcctggttgctgtgtcttttgtcacccttatcacagggaacatgagcttcagagacctgggacgcgtgatggttatggtgggcgccaccatgacagatgacattggcatgggggtcacctacctcgccctgctggctgcctttaagatcagacccacgttcgcggctggacttctgctccggaaactgacatccaaggagctcatgatgaccacaatcggcattgtgctgctttctcaaagcaccatccctgagtccattctggaactcaccgatgccctggccctggggatgatggtgcttaaaatcgtccgcaatatggagaagtatcagctggctgttacaattatggccatcctctgcgtgcccaacgcggtgatcctgcagaatgcttggaaagtctcttgtacgaccctcgccgtggttagcgtgtcccctctgcttctgacaagctctcaacagaaggccgactggattcccctcgctctgaccatcaagggactgaaccctacagccatttttcttaccacgctgtccagaacaagcaaaaagcggtcttggcccctcaatgaagctatcatggccgtcggcatggtgtccattctggcgagctctctcctgaaaaacgatatcccgatgaccgggcctcttgttgccggaggcctgctgaccgtgtgctacgtcctcacaggccgctccgctgacctggagcttgaaagagccgctgacgtgcggtgggaggagcaggccgaaatcagcgggtccagccccattctgtctatcaccattagcgaggatggatccatgtctatcaagaatgaagaggaggaacagacactcacgattctgatccgcaccggcctcctggtcattagcgggcttttccctgtgtccatccccatcacagccgctgcgtggtatctgtgggaggttaaaaagcaaagagccggagtgctgtgggacgtcccgtctcctccccctgtgggcaaagctgaactcgaggatggggcctaccggattaagcagaagggaatcctgggctatagccagattggcgccggggtttacaaagaaggaacctttcacacaatgtggcatgtgacccgcggcgctgtccttatgcacaaggggaaaagaatcgagccctcctgggccgacgtgaagaaagatctgatttcttacggaggcgggtggaagctcgagggagaatggaaggagggcgaagaggtgcaggttctggcgctcgaacccggcaaaaaccctcgggctgtccaaacgaagccggggctgttcaaaaccaacacaggaaccatcggcgccgtgagccttgacttttcccccgggacaagcggatctcctatcgtggataagaaaggcaaggtcgtggggctgtatggaaatggcgttgtgaccagatccggcacatacgtcagcgccattgctcagacggagaagtctatcgaggacaaccccgaaattgaggatgacatcttccgcaaaaagcggctgaccattatggatctccatcctggggccggaaaaacaaagagatatctgcccgcgatcgtgcgcgaagctatcaaacggggccttagaaccctgattctcgcccctacccgcgttgtggccgctgagatggaagaggccctgcgggggctcccgatcagataccagacacccgctattcgcgccgagcacacgggacgggaaatcgtcgacctgatgtgtcatgcgaccttcacaatgagacttctgtcccctattcgggtgcccaattataacctgatcattatggatgaggcccactttaccgaccctgctagcatcgccgctcgcggctacatctccacaagagttgaaatgggggaggccgccggcattttcatgaccgctacgcccccgggatctcgggacccttttccccagagcaatgcgcccatcatggatgaggaaaaggagattcctgaacgctcctggaacagcggccacgagtgggtgacagacttcaaggggaaaaccgtctggtttgtgccctctatcaaggccggaaatgatattgctgcctgcctccgcaagaacggcaagaaagtgatccaactgtcccggaagaccttcgacagcgaatatatcaagacaagaaccaatgattgggactttgtcgttacaaccgatatttctgagatgggggccaacttcaaagctgagcgcgtgatcgaccctcggagatgtatgaagccggtgattcttacggatggagaggaacgcgtcatcctggccggccccatgcctgtgacacatagctccgcggctcagcggagagggcgcgttggccggaatcccaaaaacgaaaatgaccagtacatttacatgggagagcctctcgaaaacgatgaggactgcgcccactggaaggaggccaaaatgctgctggacaatatcaacacccccgaaggcatcattccgtctatgtttgagcctgaaagagagaaggtggatgctatcgacggggaatatcgcctcagaggagaggcccggaaaacattcgtcgatcttatgcgcagaggcgacctgcccgtgtggctggcgtaccgggttgccgctgaggggattaactatgccgatcgcagatggtgttttgacggagtgaagaataaccaaatcctcgaagagaatgtcgaagtggagatttggaccaaggagggcgaacggaaaaagctgaaacctagatggcttgatgctcgcatctacagcgaccccctggccctcaaggagttcaaagagttcgctgccgggcggaagtccctgacgctgaacctcattaccgagatgggcagacttcctacatttatgacccagaaggcgaaaaatgccctggataacctggctgtcctccatacagccgaagctggaggccgcgcctataatcacgccctgtctgagcttcccgagaccctggaaacactcctgctgctcacccttctggctacggtgacagggggaatcttcctgtttctcatgagcggcaaggggatcggaaaaatgaccctgggcatgtgctgcattatcaccgcgtccattcttctgtggtacgcccagatccagccgcactggattgctgccagcatcatcctcgagttctttctgattgttctgctcatccctgaacccgagaagcaacggacaccccaggacaaccagcttacctatgtggtgattgccatcctgacagtcgttgctgccacgatggcgaatgaaatgggcttcctggagaaaaccaagaaggattttgggctcggatctattacaacccagcaacctgagtccaacatcctggacatcgatcttagaccggccagcgcttggacactgtacgccgtggctaccacgttcattacccccatgctccggcattccatcgaaaattctagcgtgaacgtctccctgacagccattgcgaatcaggccaccgtgctgatgggcctcgggaaaggatggcctctttctaagatggacatcggcgttcccctgctggctattgggtgttacagccaggtgaaccctatcacactcaccgccgctctgcttctgctcgtcgcccactatgctattatcggacccggcctgcaggccaaagcgacgcgcgaggcccaaaagagagctgccgctggcatcatgaaaaatcctacagtggacgggatgaccgtcattgatctggacccgatcccctacgatcctaagtttgaaaagcagctcggacaggtgatgcttctggttctgtgcgtgacacaggtcctcatgatgcggaccacctgggccctgtgtgaggcccttacactggcgacgggccccatttccaccctctgggaagggaaccctggacgcttctggaatacaaccatcgctgtgagcatggccaacatttttagaggctcttatctggctggggccggactcctgttctccatcatgaaaaacacagccaatacccggcgcggcacgggcaacacaggggagacccttggagagaagtggaaaaatagactgaacgctctgggcaagagcgaatttcaaatctacaaaaagtctgggattcaggaggttgaccggaccctcgccaaagaaggaatcaagcgcggcgagacagatcatcacgcggtgtccagagggagcgccaagctgcggtggttcgtcgagagaaatcttgtgacccccgaaggaaaagtggttgacctgggctgcggccgcgggggatggtcttattactgtggcgggctcaagaacgtcaaagaggtgaagggactgacaaaaggcgggccgggacatgaagaacctattcccatgagcacgtatggctggaatctggtgcggctccagtccggcgtcgatgttttctttacctctcccgaaaagtgcgacacacttctgtgtgatatcggggagagctcccctaaccccaccgtggaggctggaagaacactgcgcgtgctcaatctggtcgaaaactggcttaataacaatacccaattctgcattaaggtgctgaacccttacatgccgagcgttatcgagaaaatggaagccctccagcggaagtacggcggggctctggtgagaaatcccctgtcccgcaactctacgcacgagatgtattgggtcagcaacgcctccggaaatatcgtgtctagcgttaacatgatttcccggatgctcatcaatagatttaccatgcgccacaaaaaggcgacatacgaacctgacgtggatcttggctctgggacccggaacattggaatcgagagcgagacacccaatctggacattatcggcaaaagaatcgaaaagattaagcaggagcatgaaacctcctggcactatgatcaggaccatccttacaaaacatgggcctatcacggcagctacgagaccaagcaaacggggtctgcttccagcatggtcaacggagtggtgcgcctgctcacaaaaccctgggacgtcatcccgatggttacccagatggccatgaccgatacaacgcctttcggccagcagcgggtgtttaaggaaaaagtggacaccagaacacaagagcccaaggaggggaccaagaaactgatgaagattacagctgaatggctttggaaagagctgggaaagaaaaagacccctcgcatgtgtacaagagaagagttcacccggaaagtccgctctaatgccgctctcggcgccatctttacggatgagaacaagtggaagtccgcgagagaagccgtggaggacagcgggttctgggaactggttgataaagagcggaatctgcacctcgaaggaaagtgcgagacctgtgtgtataacatgatgggcaaaagagagaagaaactgggcgaatttgggaaggctaagggatctcgggccatttggtacatgtggcttggcgctcgcttcctggagtttgaagccctcgggttcctgaatgaggaccattggttttccagagaaaacagcctttccggagtcgagggcgaggggctgcacaaactcggctacatcctgcgggatgtgagcaagaaagaaggaggcgccatgtatgcggacgatacagctgggtgggacacccgcattacactggaggatctcgaaaatgaggaaatggttaccaaccatatggagggagagcacaagaaactggccgaagccatcttcaaacttacgtaccagaataaggtggtcagagtgcagcggcccacacctcgcggcaccgttatggacatcatttctagacgggaccagcgcgggagcggacaagtggtcacatatggcctgaacaccttcacgaacatggaggctcagctcatcagacagatggaaggggagggcgtgtttaaatccattcaacagctgaccgtcaaggaggaaatcgccgtgaaaaattggcttacacgggttggacgcgagagactgtctcggatggctattagcggcgatgactgcgtggtcaagcccctcgatgaccgcttcgcctccgcgctgaccgccctgaacgatatggggaaagtgagaaaggacatccagcagtgggaaccgtctcggggatggaatgattggacacaagtgcctttttgcagccatcacttccacgagctcatcatgaaggacggcagagttctggtggtcccctgtcgcaaccaggatgaacttattgggcgggctagaatctcccagggagccggctggtctctgcgcgagaccgcttgcctcgggaaaagctacgcccagatgtggtccctgatgtattttcatcggagagaccttcgcctggcggccaatgctatttgtagcgccgtgccctctcactggatccctacatcccggaccacgtggagcattcatgctacacacgagtggatgaccaccgaagatatgctcacagtttggaacagagtgtggatccaagagaatccgtggatggaagacaagacccccgtcgagtcttgggaagagatcccttacctgggcaaacgcgaggatcagtggtgcggatccctgattggcctcacaagccgggccacgtgggctaagaacatccagaccgccattaatcaggtgagatccctgatcgggaacgaagagtatacagactacatgccctctatgaaacgcttccggagagaagaggaagaggcgggagtcctttggtga

SEQ ID NO: 19628 - RNA, 9876 nt, synthetic construct
  misc_feature 1..9876: note = derived and/or modified CDS sequence (opt5) from DENV-2__KM279568__SS-prME
  source 1..9876: mol_type = other RNA
accgccggaatcattatcatgatgattcccaccgtgatggctttccacctgacgaccagaaacggggagcctcatatgatcgtgagccggcaggaaaagggaaaatccctcctgtttaagaccgagaatggagttaacatgtgcacccttatggccatggacctgggggaactctgtgaggataccattacctacaattgcccgctgcttcgccaaaacgaacccgaggacatcgattgttggtgcaattctacgagcacctgggtgacgtatggaacctgtacagcgaccggcgagcaccggcgggaaaaacgctccgtggctctggtgcctcatgtggggatgggactcgagacaagaaccgaaacgtggatgtctagcgagggcgcctggaagcacgcccagcggatcgagacatggattctgcgccatcccggcttcaccatcatggctgccattctggcttacacaatcgggaccacctattttcagagagttctcattttcatcctgcttacagccgtgacgccttccatggcgatgcggtgcattggaatctctaaccgcgactttgtcgaaggcgtgagcgggggatcctgggttgatatcgtgctggagcacggcagctgtgtcaccacaatggccaaaaataagcccaccctcgacttcgaactgattaagacagaggctaaacaccttgccaccctgagaaagtactgcgtggaagctaaactcacgaacacaaccaccgcctctcggtgtcctacacagggggagccgtccctgaatgaggaacaagataagcgctttgtgtgcaaacatagcatggtcgacagaggatggggcaacggctgtgggctgttcggaaagggcgggatcgttacctgcgcgatgtttacatgcaagaaaaatatggagggaaaggtggtgcagcccgaaaacctcgagtatacgattgtcatcacccctcactctggcgaagagaatgccgtggggaacgatacaggaaaacatggcaaggagattaaaatcacaccccagtccagcatcacagaagctgagctgaccggctacgggacggttaccatggaatgttctcctcggacaggacttgacttcaatgagatggtgctgctccagatggaaaacaaggcctggctggtccaccgccaatggtttcttgatctgcccctcccgtggctgcctggcgctgacacccaggggtccaactggattcagaaagagacactggtgaccttcaagaatccccacgccaagaaacaggatatcgttgtgctcggaagccaagagggcgccatgcatacggctctgacaggggcgaccgaaattcagatgtcctctggcaaccttctgtttacaggacacctcaagtgcagactgcggatggacaaacttcagctgaagggcatgagctattccatgtgtaccgggaaattcaaggtcgtgaaggagatcgccgaaacccaacatggaacaattgtcatcagagtgcagtacgagggcgacgggagcccttgcaaaatccccttcgagattatggatctcgaaaagcgccacgttctgggacggctgatcacggtgaatcccattgtcaccgagaaagactctcctgtgaacatcgaagctgagccgccctttggcgattcctacattatcattggggttgaacctggccagctcaagctgagctggttcaaaaagggatctagcatcggccagatgtttgagacaaccatgagaggggccaagcgcatggccatccttggagacacagcttgggatttcggctccctcggcggggtgtttacctctattgggaaagccctccatcaagtcttcggggcgatctatggcgctgcctttagcggagtgtcctggacgatgaagattctgatcggcgtggttattacatggatcgggatgaatagccggtctacctccctgagcgtctctcttgtgctcgtgggagtcgtgaccctgtacctgggcgttatggtgcaggccgactccgggtgtgtcgtgagctggaaaaacaaggagctcaaatgcggatccggcatcttcattacagataatgttcacacctggacagaacagtataagtttcagcccgagtctcctagcaagctggcttccgccatccaaaaagctcacgaagaggggatttgtggcatcagatctgtgacgcgccttgaaaacctgatgtggaagcagattacccccgagctcaatcatatcctgacagagaacgaagtcaaactgaccatcatgacaggagacattaagggcatcatgcaggccgggaaacggagccttagaccgcagcctaccgagctcaagtactcctggaaagcgtggggaaaggccaagatgctgagcacggaactgcacaatcataccttcctcattgatggccccgagacagctgaatgccctaacaccaatcgcgcctggaactctctggaggtggaggactatgggtttggagttttcacaaccaatatctggcttaaactgaaggaacggcaagatgtgttttgtgactccaaactcatgagcgctgccattaaggacaacagagcggtccacgccgatatgggctactggatcgagtctgctctgaacgacacatggaaaatcgaaaaggcctccttcattgaggtcaagagctgccactggcccaaatctcataccctgtggagcaatggcgtgcttgagtccgaaatgatcattcctaagaacttcgctgggcccgtcagccagcacaattatcgcccgggataccatacgcagacagccggcccttggcacctcgggcggctggagatggattttgacttctgtgaaggaaccaccgttgtggtgacagaggattgcggcaacagagggccctctctgcggaccacgacagcctccggaaaactcatcaccgaatggtgctgtcgcagctgcacactgccccctcttagataccggggcgaggacggctgttggtatgggatggagattagaccgctgaaggaaaaagaggaaaatctcgtcaactccctggtgaccgctggacatggccagatcgataatttttctctgggggttcttggaatggcgctgttcctggaggaaatgctgcgcacacgggtgggcaccaagcacgccattctcctggtcgctgtgagctttgttacgcttatcaccgggaacatgtccttcagagacctgggacgcgtgatggtcatggtgggcgccacaatgaccgatgacatcggcatgggggttacatacctcgccctgctggctgcctttaaggtgagacccaccttcgcggctggacttctgctccggaaactgacgtctaaggagctcatgatgacaaccattggcatcgtcctgcttagccaatccacaattcctgagtctatcctggaactcaccgatgccctggccctggggatgatggtgcttaaaattgtgcgcaatatggagaagtatcagctggctgtcaccatcatggccatcagctgcgttcccaacgcggtgattctccagaatgcttggaaagtgtcctgtacaacgctggccgtcgtgagcgtttctcctctcctgcttacctccagccaacagaaggccgactggatccccctggctctcacaattaagggactgaaccctaccgccatctttctgacaaccctttctagaacgtccaaaaagcggagctggcccctgaatgaagctattatggccgtgggcatggtctctatcctcgcgtccagcctgctcaaaaacgatatcccgatgacagggcctctggtggccggaggccttctgaccgtttgctacgtgctgaccggccgctccgctgacctcgagctggaaagagccgctgacgtccggtgggaggagcaggccgaaattagcgggtctagccccatcctttccattacaatctctgaggatggaagcatgtccattaagaatgaagaggaggaacagaccctgacaatcctcattcgcacgggcctgctcgtgatctctgggctgttccctgtcagcatccccattaccgccgctgcgtggtatctttgggaggtgaaaaagcaaagagccggagttctgtgggacgtgccgtcccctccccctgtcggcaaagctgaactggaggatggggcctaccggatcaagcagaagggcattctcggctattctcagatcggcgccggggtgtacaaagaaggaacatttcacaccatgtggcatgttacacgcggcgctgtgctgatgcacaaggggaaaagaattgagcccagctgggccgacgtcaagaaagatcttatctcctacggaggcgggtggaagctggagggagaatggaaggagggcgaagaggtccaggtgctcgcgctggaacccggcaaaaaccctcgggctgttcaaaccaagccgggactcttcaaaacgaacaccggaacaatcggcgccgtcagcctggacttttctcccgggacctccggaagccctattgtggataagaaaggcaaggtggtcgggctttatggaaatggcgtggttacaagatctggcacctacgtgtccgccatcgctcagacagaaaagagcattgaggacaaccccgaaatcgaggatgacattttccgcaaaaagcggctgacgatcatggatctgcatcctggggccggaaaaaccaagagatatctccccgcgatcgtccgcgaagctattaaacggggcctgagaacacttatcctggcccctacccgcgtggttgccgctgagatggaagaggccctccgggggctgccgattagataccagacccccgctatccgcgccgagcacacaggacgggaaattgtggacctcatgtgtcatgcgacgttcaccatgagactgctttcccctatccgggtccccaattataacctgattatcatggatgaggcccactttacagaccctgcttctatcgccgctcgcggctacattagcaccagagtggaaatgggggaggccgccggcatcttcatgacagctacacccccgggatcccgggacccttttccccagagcaatgcgcccattatggatgaggaacgcgagatccctgaaagatcttggaactccggccacgagtgggttacggacttcaaggggaagacagtgtggtttgtccccagcattaaagccggaaatgatatcgctgcctgcctgcggaagaacggcaaaaaggtgatccaactctctagaaaaaccttcgacagcgaatatattaagacccgcacaaatgattgggactttgtggtcaccacagatatctccgagatgggggccaacttcaaggctgagcgggttattgaccctagacgctgtatgaaaccggtgatcctgaccgatggagaggaacgggtgattcttgccggccccatgcctgtcacgcattctagcgcggctcagagacgcgggcgggtgggcagaaatcccaagaacgaaaatgaccagtacatctacatgggagagcctctggaaaacgatgaggactgcgcccactggaaagaggccaagatgctcctggacaatatcaacacacccgaaggcattatcccgtccatgtttgagcctgaacgcgagaaagttgatgctattgacggggaatatagactgcggggagaggcccgcaagaccttcgtggatctcatgagacggggcgaccttcccgtctggctggcgtaccgcgtggccgctgaggggatcaactatgccgatagacggtggtgttttgacggagttaaaaataaccaaattctggaagagaatgtggaagtcgagatctggacaaaggagggcgaaagaaagaaactcaagcctcgctggctggatgctcggatttactctgacccccttgccctgaaagagttcaaggagttcgctgccgggagaaaaagcctcaccctgaacctgatcacggagatgggccgcctccctacctttatgacacagaaggcgaagaatgcccttgataacctggctgtgctgcataccgccgaagctggaggccgggcctataatcacgccctctccgagctgcccgagacacttgaaaccctgctcctgctgacactccttgctaccgtcacagggggaatcttcctgtttctgatgagcggcaaagggattggaaagatgacactcggcatgtgctgcatcattaccgcgtctatcctgctttggtacgcccagattcagccgcactggatcgctgcctccatcattctggagttctttctcatcgtgctgctgattcctgaacccgagaaacaaagaacaccccaggacaaccagctcacatatgttgtgatcgccattcttaccgtggtcgctgccacaatggcgaatgaaatgggcttcctggagaagacgaaaaaggattttgggctgggaagcatcaccacacagcaacctgagtccaacatcctcgacattgatctgcggccggcctctgcttggaccctttacgccgttgctacaaccttcatcacgcccatgctgcgccatagcattgaaaattcctctgtgaacgtgagcctcaccgccatcgcgaatcaggccacagtcctgatgggcctggggaagggatggcctctctccaaaatggacattggcgtgccccttctggctatcgggtgttacagccaggttaaccctattaccctgacagccgctctcctgcttctggtggcccactatgctatcatcggacccggcctccaggccaaggcgaccagagaggcccaaaaacgggctgccgctggcattatgaagaatcctacggtcgacgggatgacagtgatcgatctggacccgattccctacgatcctaaatttgaaaagcagctgggacaggtcatgctccttgtgctgtgcgttacccaggtgctgatgatgcgcacaacctgggccctctgtgaggccctgacccttgcgacaggccccatctctacgctgtgggaagggaaccctggaagattctggaataccacaattgctgtctccatggccaacatctttcggggcagctatctcgctggggccggactgctgttctctatcatgaagaacaccgccaatacacgcagaggcaccggcaacacgggggagacactcggagagaaatggaagaatcggcttaacgctctgggcaaatccgaatttcaaatttacaagaaaagcgggatccaggaggtggaccgcaccctggccaaggaaggaattaaaagaggcgagaccgatcatcacgcggtttctcgggggagcgccaagctcagatggttcgtggagcgcaatctggtcacacccgaaggaaaggtggtggaccttggctgcggcagagggggatggtcctattactgtggcgggctgaaaaacgttaaggaggtcaaaggactcaccaagggcgggccgggacatgaagaacctatccccatgtctacatatggctggaatctggtgagactgcagagcggcgtggatgtcttctttacgccccctgaaaaatgcgacaccctcctttgtgatattggggagtccagccccaaccctacagttgaggctggacgcaccctgcgggtgctgaatctcgtggaaaactggctgaataacaatacacaattctgcatcaaggtccttaacccgtacatgccctccgtgatcgagaagatggaagccctgcagagaaaatacggcggggctctcgttcgcaatcctctgtctcggaacagcacccacgagatgtattgggtgtccaacgcctctggaaatattgtcagctccgtgaacatgatctctagaatgctgattaatcgctttacgatgcggcacaagaaagcgacctacgaacccgacgttgatctcggcagcgggacaagaaacatcggaattgagtccgagacccctaatcttgacatcatcggcaagcgcattgagaagatcaagcaggagcatgaaacaagctggcactatgatcaggaccatccctacaagacctgggcctatcacggctcttacgagacaaaacaaaccgggtccgctagctctatggtgaacggagtcgtgcggctgctgacgaagccgtgggacgtgattcctatggtcacacagatggccatgaccgataccacacccttcggccagcagagagtttttaaagaaaaggtggacacgcgcacccaagagcctaaagaggggacaaagaagctcatgaaaatcaccgctgaatggctgtggaaggagcttggcaaaaagaaaacacccagaatgtgtacccgggaagagttcacacgcaaggtgagatccaatgccgctctgggcgccatttttaccgatgagaacaaatggaaaagcgcgcgggaagccgtcgaggactctgggttctgggaactcgtggataaggagagaaatctgcacctggaaggaaaatgcgagacgtgtgtttataacatgatgggcaagcgggagaaaaagctcggcgaatttgggaaagctaagggatcccgcgccatctggtacatgtggctgggcgctagattccttgagtttgaagccctggggttcctcaatgaggaccattggtttagccgggaaaactccctgagcggagtggagggcgaggggcttcacaagctgggctacattctccgcgatgtctctaaaaaggaaggaggcgccatgtatgcggacgataccgctgggtgggacacaagaatcaccctggaggatctgaaaaatgaagagatggtgacaaaccatatggaaggagagcacaagaaactcgccgaggccatcttcaagctgacctaccagaataaggttgtgcgggtccagcgccctacgcccagaggcacagtgatggacattatcagccggcgcgaccagagagggtccggacaagttgtgacctatggccttaacacattcaccaacatggaagctcagctgattcggcagatggagggggaaggcgtctttaaatctatccaacagctcacggtgaaggaggagattgccgtcaaaaattggctgatccgcgtgggaagagaacggcttagccgcatggctatctccggcgatgactgcgttgtgaagccgctggatgacagattcgcctctgcgctcaccgccctgaacgatatggggaaagtccggaaggacattcagcagtgggagcctagcagaggatggaatgattggacacaagtgcccttttgctcccatcacttccacgaactgatcatgaaggacggccgcgtgctcgttgtgccctgtcggaaccaggatgagctgattgggagagctcgcatctctcagggagccggctggagccttcgggaaaccgcttgcctggggaaatcctacgcccagatgtggagcctcatgtattttcatagacgcgacctgcggcttgcggccaatgctatttgttctgccgtcccttcccactggatcccgacaagcagaaccacatggtctatccatgctacccacgagtggatgacgacagaggatatgctgaccgtgtggaaccgcgtttggattcaagaaaatccctggatggaggacaagacccctgtggaatcctgggaggaaatcccctacctcggcaaacgggaggatcagtggtgcggaagcctgattggcctgacatccagagccacctgggctaagaacatccagacagccattaatcaggtccgctctctcatcgggaacgaggaatatacggactacatgcctagcatgaaacggttcagacgggaggaagaggaagcgggagtgctgtggtga

SEQ ID NO: 19629 - RNA, 9876 nt, synthetic construct
  misc_feature 1..9876: note = derived and/or modified CDS sequence (opt5) from DENV-2__KM279569__SS-prME
  source 1..9876: mol_type = other RNA
accgccggaatcattatcatgatgattcccaccgtgatggctttccacctgacgaccagaaacggggagcctcatatgatcgtcagccggcaggaaaagggaaaatccctcctgtttaagacagagaatggcgttaacatgtgcacccttatggccatggacctgggggaactctgtgaggataccattacctacaattgcccgctgcttcgccaaaacgaacccgaggacatcgattgttggtgcaattctacaagcacctgggtgacgtatggaacctgtacagcgaccggcgagcacagacgggaaaaacgctccgtggctctggtccctcatgtggggatgggactcgagacaagaaccgaaacgtggatgtctagcgagggcgcctggaagcacgcccagcggatcgagacatggattctgcgccatcccggcttcaccatcatggctgccattctggcttacacaatcgggaccacctattttcagagagttctcattttcatcctgcttacagccgtgacgccttccatggcgatgcggtgcattggaatctctaaccgcgactttgtcgaaggcgtgagcgggggatcctgggttgatatcgtgctggagcacggcagctgtgtcaccacaatggccaaaaataagcccaccctcgacttcgaactgattaagacagaggctaaacaccttgccaccctgagaaagtactgcgtggaagctaaactcacgaacacaaccaccgcctctcggtgtcctacacagggggagccgtccctgaatgaggaacaagataagcgctttgtgtgcaaacatagcatggtcgacagaggatggggcaacggctgtgggctgttcggaaagggcgggatcgttacctgcgcgatgtttacatgcaagaaaaatatggagggaaaggtggtgcagcccgaaaacctcgagtatacgattgtcatcacccctcactctggcgaagagaatgccgtggggaacgatacaggaaaacatggcaaggagattaaagttacaccccagtccagcatcacagaagctgagctgaccggctacgggacggtgaccatggaatgttctcctcggacaggacttgacttcaatgagatggtcctgctccagatggaaaacaaggcctggctggtgcaccgccaatggtttcttgatctgcccctcccgtggctgcctggcgctgacacccaggggtccaactggatccagaaagagacactggttaccttcaagaatccccacgccaagaaacaggatgtggtcgtgctcggaagccaagagggcgccatgcatacggctctgacaggggcgaccgaaattcagatgtcctctggcaaccttctgtttacaggacacctcaagtgcagactgcggatggacaaacttcagctgaagggcatgagctattccatgtgtaccgggaaattcaaggtcgtgaaggagatcgccgaaacccaacatggaacaattgttatcagagtgcagtacgagggcgacgggagcccttgcaaaattcccttcgagatcatggatctcgaaaagcgccacgtcctgggacggctgatcacggtgaatcccattgttaccgagaaagactctcctgtgaacatcgaagctgagccgccctttggcgattcctacattatcattggggtcgaacctggccagctcaagctgagctggttcaaaaagggatctagcatcggccagatgtttgagacaaccatgagaggggccaagcgcatggccattcttggagacacagcttgggatttcggctccctcgggggagtgtttacctctatcggcaaagccctccatcaagtgttcggggcgatctatggcgctgcctttagcggagtttcctggacgatgaagattctgatcggcgtcgtgattacatggatcgggatgaatagccggtctacctccctgagcgtgtctcttgtcctcgtgggagttgtgaccctgtacctgggcgtcatggtgcaggccgactccgggtgtgttgtgagctggaaaaacaaggagctcaaatgcggatccggcattttcatcacagataatgtccacacctggacagaacagtataagtttcagcccgagtctcctagcaagctggcttccgccatccaaaaagctcacgaagaggggatttgtggcatcagatctgtgacgcgccttgaaaacctgatgtggaagcagattacccccgagctcaatcatatcctgacagagaacgaagttaaactgaccattatgacaggagacatcaagggcatcatgcaggccgggaaacggacccttagaccgcagcctacggagctcaagtacagctggaaagcgtggggaaaggccaagatgctgtccaccgaactgcacaatcatacattcctcattgatggccccgagaccgctgaatgccctaacacaaatcgcgcctggaacagcctggaggtggaggactatgggtttggagtcttcaccacaaatatctggcttaaactgaaggaacggcaagatgtgttttgtgactctaaactcatgtccgctgccattaaggacaacagagcggtgcacgccgatatgggctactggatcgagagcgctctgaacgacacctggaaaattgaaaaggcctctttcatcgaggtcaagtcctgccactggcccaaaagccatacgctgtggtctaatggcgttcttgagagcgaaatgatcattcctaagaacttcgctgggcccgtgtcccagcacaattatcgcccgggataccatacacagaccgccggcccttggcacctcgggcggctggagatggattttgacttctgtgaaggaaccacagtggtcgtgaccgaggattgcggcaacagagggcccagcctgcggacgacaaccgcctctggaaaactcatcacagaatggtgctgtcgctcctgcaccctgccccctcttagataccggggcgaggacggctgttggtatgggatggagattagaccgctgaaggaaaaagaggaaaatctcgttaacagcctggtgacagctggacatggccagatcgataatttttccctgggggtccttggaatggcgctgttcctggaggaaatgctgcgcacccgggtgggcacgaagcacgccattctcctggttgctgtgtcttttgtcacccttatcacagggaacatgagcttcagagacctgggacgcgtgatggttatggtgggcgccaccatgacagatgacattggcatgggggtcacctacctcgccctgctggctgcctttaaggtgagacccacgttcgcggctggacttctgctccggaaactgacatccaaggagctcatgatgaccacaatcggcatcgtgctgctttctcaaagcaccattcctgagtccatcctggaactcaccgatgccctggccctggggatgatggtccttaaaattgttcgcaatatggagaagtatcagctggctgtgacaatcatggccattctctgcgtgcccaacgcggtcatcctgcagaatgcttggaaagtgtcttgtacgaccctcgccgttgtgagcgtctcccctctgcttctgacaagctctcaacagaaggccgactggatccccctcgctctgaccattaagggactgaaccctacagccatctttcttaccacgctgtccagaacaagcaaaaagcggtcttggcccctcaatgaagctattatggccgtgggcatggtttccatcctggcgagctctctcctgaaaaacgatattccgatgaccgggcctcttgtggccggaggcctgctgaccgtctgctacgtgctcacaggccgctccgctgacctggagcttgaaagagccgctgacgtccggtgggaggagcaggccgaaatcagcgggtccagccccatcctgtctattaccatcagcgaggatggatccatgtctattaagaatgaagaggaggaacagacactcacgatcctgattcgcaccggcctcctggtgatcagcgggcttttccctgtttccattcccatcacagccgctgcgtggtatctgtgggaggtgaaaaagcaaagagccggagtcctgtgggacgtgccgtctcctccccctgttggcaaagctgaactcgaggatggggcctaccggatcaagcagaagggcattctgggctatagccagatcggcgccggggtgtacaaagaaggaacctttcacacaatgtggcatgtcacccgcggcgctgtgcttatgcacaaggggaaaagaattgagccctcctgggccgacgtgaagaaagatctgatctcttacggaggcgggtggaagctcgagggagaatggaaggagggcgaagaggttcaggtcctggcgctcgaacccggcaaaaaccctcgggctgtgcaaacgaagccggggctgttcaaaaccaacacaggaaccattggcgccgtgagccttgacttttcccccgggacaagcggatctcctatcgtcgataagaaaggcaaggtggttgggctgtatggaaatggcgtggtcaccagatccggcacatacgtgagcgccatcgctcagacggagaagtctattgaggacaaccccgaaatcgaggatgacattttccgcaaaaagcggctgaccatcatggatctccatcctggggccggaaaaacaaagagatatctgcccgcgattgttcgcgaagctatcaaacggggccttagaaccctgatcctcgcccctacccgcgtggtcgccgctgagatggaagaggccctgcgggggctcccgattagataccagacacccgctatccgcgccgagcacacgggacgggaaattgtggacctgatgtgtcatgcgaccttcacaatgagacttctgtcccctatccgggttcccaattataacctgattatcatggatgaggcccactttaccgaccctgctagcattgccgctcgcggctacatctccacaagagtggaaatgggggaggccgccggcatcttcatgaccgctacgcccccgggatctcgggacccttttccccagagcaatgcgcccattatggatgaggaaaaggagatccctgaacgctcctggaacagcggccacgagtgggtcacagacttcaaggggaaaaccgtgtggtttgtgccctctattaaggccggaaatgatatcgctgcctgcctccgcaagaacggcaagaaagtcattcaactgtcccggaagaccttcgacagcgaatatatcaagacaagaaccaatgattgggactttgttgtgacaaccgatatctctgagatgggggccaacttcaaagctgagcgcgtgattgaccctcggagatgtatgaagccggtcatccttacggatggagaggaacgcgtgattctggccggccccatgcctgttacacatagctccgcggctcagcggagagggcgcgtgggccggaatcccaaaaacgaaaatgaccagtacatctacatgggagagcctctcgaaaacgatgaggactgcgcccactggaaggaggccaaaatgctgctggacaatattaacacccccgaaggcatcatcccgtctatgtttgagcctgaaagagagaaggtcgatgctattgacggggaatatcgcctcagaggagaggcccggaaaacattcgtggatcttatgcgcagaggcgacctgcccgtttggctggcgtaccgggtggccgctgaggggatcaactatgccgatcgcagatggtgttttgacggagtcaagaataaccaaattctcgaagagaatgtggaagtcgagatctggaccaaggagggcgaacggaaaaagctgaaacctagatggcttgatgctcgcatttacagcgaccccctggccctcaaggagttcaaagagttcgctgccgggcggaagtccctgacgctgaacctcatcaccgagatgggcagacttcctacatttatgacccagaaggcgaaaaatgccctggataacctggctgtgctccatacagccgaagctggaggccgcgcctataatcacgccctgtctgagcttcccgagaccctggaaacactcctgctgctcacccttctggctacggttacagggggaattttcctgtttctcatgagcggcaaggggatcggaaaaatgaccctgggcatgtgctgcatcattaccgcgtccatccttctgtggtacgcccagattcagccgcactggatcgctgccagcattatcctcgagttctttctgatcgtgctgctcattcctgaacccgagaagcaacggacaccccaggacaaccagcttacctatgtggtcatcgccattctgacagttgtggctgccacgatggcgaatgaaatgggcttcctggagaaaaccaagaaggattttgggctcggatctatcacaacccagcaacctgagtccaacattctggacatcgatcttagaccggccagcgcttggacactgtacgccgtggctaccacgttcatcacccccatgctccggcattccattgaaaattctagcgtcaacgtgtccctgacagccatcgcgaatcaggccaccgttctgatgggcctcgggaaaggatggcctctttctaagatggacattggcgtgcccctgctggctatcgggtgttacagccaggtcaaccctattacactcaccgccgctctgcttctgctcgtggcccactatgctatcattggacccggcctgcaggccaaagcgacgcgcgaggcccaaaagagagctgccgctggcatcatgaaaaatcctacagtcgacgggatgaccgtgatcgatctggacccgattccctacgatcctaagtttgaaaagcagctcggacaggttatgcttctggtgctgtgcgtcacacaggtgctcatgatgcggaccacctgggccctgtgtgaggcccttacactggcgacgggccccatctccaccctctgggaagggaaccctggacgcttctggaatacaaccattgctgttagcatggccaacatctttagaggctcttatctggctggggccggactcctgttctccattatgaaaaacacagccaatacccggcgcggcacgggcaacacaggggagacccttggagagaagtggaaaaatagactgaacgctctgggcaagagcgaatttcaaatctacaaaaagtctgggatccaggaggtggaccggaccctcgccaaagaaggaattaagcgcggcgagacagatcatcacgcggtctccagagggagcgccaagctgcggtggttcgtggagagaaatcttgtgacccccgaaggaaaagttgtcgacctgggctgcggccgcgggggatggtcttattactgtggcgggctcaagaacgtgaaagaggtgaagggactgacaaaaggcgggccgggacatgaagaacctatccccatgagcacgtatggctggaatctggtccggctccagtccggcgttgatgtgttctttacaccccctgaaaagtgcgacacacttctgtgtgatattggggagtctagccccaaccctaccgtggaggctggaagaacactgcgcgtcctcaatctggtggaaaactggcttaataacaatacccaattctgcatcaaggttctgaacccgtacatgccctccgtgattgagaaaatggaagccctccagcggaagtacggcggggctctggtcagaaatcctctgagccgcaactccacgcacgagatgtattgggtgtctaacgccagcggaaatatcgtttcctctgtgaacatgatcagccggatgctcattaatagatttaccatgcgccacaaaaaggcgacatacgaacccgacgtcgatcttggctccgggacccggaacatcggaattgagtctgagacacctaatctggacatcattggcaaaagaatcgaaaagatcaagcaggagcatgaaaccagctggcactatgatcaggaccatccctacaaaacatgggcctatcacggctcctacgagaccaagcaaacggggagcgcttcttccatggtgaacggagtggtccgcctgctcacaaaaccgtgggacgttattcctatggtgacccagatggccatgaccgatacaacgcccttcggccagcagcgggtgtttaaggaaaaagtcgacaccagaacacaagagcctaaggaggggaccaagaaactgatgaagatcacagctgaatggctttggaaagagctgggaaagaaaaagacccccagaatgtgtacaagagaagagttcacccggaaagtgcgcagcaatgccgctctcggcgccatttttacggatgagaacaagtggaagtctgcgagagaagccgttgaggactccgggttctgggaactggtggataaagagcggaatctgcacctcgaaggaaagtgcgagacctgtgtctataacatgatgggcaaaagagagaagaaactgggcgaatttgggaaggctaagggaagccgggccatctggtacatgtggcttggcgctcgcttcctggagtttgaagccctcgggttcctgaatgaggaccattggttttctagagaaaactcccttagcggagtggagggcgaggggctgcacaaactcggctacattctgcgggatgtttccaagaaagaaggaggcgccatgtatgcggacgatacagctgggtgggacacccgcatcacactggaggatctcaagaatgaagagatggtgaccaaccatatggaaggagagcacaaaaagctggccgaggccattttcaaacttacgtaccagaataaagtcgtgagagttcagcggcctacaccccgcggcaccgtgatggacatcatcagcagacgggaccagcgcgggtctggacaagtcgtgacatatggcctgaacaccttcacgaacatggaagctcagctcattagacagatggagggggaaggcgtctttaagagcatccaacagctgaccgtgaaagaggagattgccgttaaggattggcttatccgggtgggacgcgaaagactgtcccggatggctatttctggcgacgattgcgtcgtgaaaccgctcgacgatcgcttcgccagcgcgctgacagccctgaatgacatggggaaggtgagaaaggatatccagcagtgggagccttcccggggatggaacgactggacccaagttcccttttgctctcatcacttccacgaactcatcatgaaagatggcagagtgctggtcgtgccctgtcgcaatcaggacgagcttattgggcgggctagaatcagccagggagccggctggtccctgcgcgaaacagcttgcctcgggaagtcttacgcccagatgtggagcctgatgtattttcatcggagagatcttcgcctggcggccaacgctatttgttccgccgttcctagccactggatcccgacctctcggacaacctggtccattcatgctacgcacgagtggatgacaaccgaggacatgctcaccgtgtggaatagagtctggatccaagaaaacccctggatggaggataaaacacctgtggaaagctgggaggaaatcccctacctgggcaagcgcgaggaccagtggtgcggatctctgattggcctcacctcccgggccacatgggctaaaaatatccagacggccattaaccaggtcagaagcctgatcgggaatgaggaatataccgactacatgccttccatgaagcgcttccggagagaggaagaggaagcgggagtgctttggtga

SEQ ID NO: 19630 - RNA, 9876 nt, synthetic construct
  misc_feature 1..9876: note = derived and/or modified CDS sequence (opt5) from DENV-2__KM279570__SS-prME
  source 1..9876: mol_type = other RNA
accgccggaatcattatcatgatgattcccaccgtgatggctttccacctgacgaccagaaacggggaacctcatatgatcgtcagccggcaggaaaagggaaaatccctcctgtttaagaccgagaatggagttaacatgtgcacccttatggccatggacctgggggaactctgtgaggataccattacctacaattgcccgctgcttcgccaaaacgaacccgaggacatcgattgttggtgcaattctacgagcacctgggtgacgtatggaacctgtacagcgaccggcgagcaccggcgggaaaaacgctccgtggctctggtccctcatgtggggatgggactcgagacaagaaccgaaacgtggatgtctagcgagggcgcctggaagcacgcccagcggatcgagacatggattctgcgccatcccggcttcaccatcatggctgccattctggcttacacaatcgggaccacctattttcagagagttctcattttcatcctgcttacagccgtgacgccttccatggcgatgcggtgcattggaatctctaaccgcgactttgtcgaaggcgtgagcgggggatcctgggttgatatcgtgctggagcacggcagctgtgtcaccacaatggccaaaaataagcccaccctcgacttcgaactgattaagacagaggctaaacaccttgccaccctgagaaagtactgcgtggaagctaaactcacgaacacaaccaccgcctctcggtgtcctacacagggggagccgtccctgaatgaggaacaagataagcgctttgtgtgcaaacatagcatggtcgacagaggatggggcaacggctgtgggctgttcggaaagggcgggatcgttacctgcgcgatgtttacatgcaagaaaaatatggagggaaaggtggtgcagcccgaaaacctcgagtatacgattgtcatcacccctcactctggcgaagagaatgccgtggggaacgatacaggaaaacatggcaaggagattaaagttacaccccagtccagcatcacagaagctgagctgaccggctacgggacggtgaccatggaatgttctcctcggacaggacttgacttcaatgagatggtcctgctccagatggaaaacaaggcctggctggtgcaccgccaatggtttcttgatctgcccctcccgtggctgcctggcgctgacacccaggggtccaactggatccagaaagagacactggttaccttcaagaatccccacgccaagaaacaggatgtggtcgtgctcggaagccaagagggcgccatgcatacggctctgacaggggcgaccgaaattcagatgtcctctggcaaccttctgtttacaggacacctcaagtgcagactgcggatggacaaacttcagctgaagggcatgagctattccatgtgtaccgggaaattcaaggtcgtgaaggagatcgccgaaacccaacatggaacaattgttatcagagtgcagtacgagggcgacgggagcccttgcaaaattcccttcgagatcatggatctcgaaaagcgccacgtcctgggacggctgatcacggtgaatcccattgttaccgagaaagactctcctgtgaacatcgaagctgagccgccctttggcgattcctacattatcattggggtcgaacctggccagctcaagctgagctggttcaaaaagggatctagcatcggccagatgtttgagacaaccatgagaggggccaagcgcatggccattcttggagacacagcttgggatttcggctccctcgggggagtgtttacctctatcggcaaagccctccatcaagtgttcggggcgatctatggcgctgcctttagcggagtttcctggacgatgaagattctgatcggcgtcgtgattacatggatcgggatgaatagccggtctacctccctgagcgtgtctcttgtcctcgtgggagttgtgaccctgtacctgggcgtcatggtgcaggccgactccgggtgtgttgtgagctggaaaaacaaggagctcaaatgcggatccggcattttcatcacagataatgtccacacctggacagaacagtataagtttcagcccgagtctcctagcaagctggcttccgccatccaaaaagctcacgaagaggggatttgtggcatcagatctgtgacgcgccttgaaaacctgatgtggaagcagattacccccgagctcaatcatatcctgacagagaacgaagttaaactgaccattatgacaggagacatcaagggcatcatgcaggccgggaaacggagccttagaccgcagcctaccgagctcaagtactcctggaaagcgtggggaaaggccaagatgctgagcacggaactgcacaatcataccttcctcattgatggccccgagacagctgaatgccctaacaccaatcgcgcctggaactctctggaggtggaggactatgggtttggagtcttcacaaccaatatctggcttaaactgaaggaacggcaagatgtgttttgtgactccaaactcatgagcgctgccattaaggacaacagagcggtgcacgccgatatgggctactggatcgagtctgctctgaacgacacatggaaaattgaaaaggcctccttcatcgaggtcaagagctgccactggcccaaatctcataccctgtggagcaatggcgttcttgagtccgaaatgatcattcctaagaacttcgctgggcccgtgagccagcacaattatcgcccgggataccatacgcagacagccggcccttggcacctcgggcggctggagatggattttgacttctgtgaaggaaccaccgtggccgtcacagaggattgcggcaacagagggccctctctgcggaccacgacagcttccggaaaactcatcaccgaatggtgctgtcgcagctgcacactgccccctcttagataccggggcgaggacggctgttggtatgggatggagattagaccgctgaaggaaaaagaggaaaatctcgtgaactccctggttaccgcgggacatggccagatcgataatttttctctgggggtgcttggaatggccctcttcctggaggaaatgctgcgcacacgggtcggcaccaagcacgctattctcctggtggccgttagctttgtgacgcttatcaccgggaacatgtccttcagagacctgggacgcgtcatggtgatggttggcgccacaatgaccgatgacattggcatgggggtgacatacctcgctctgctggccgcgtttaaggtcagacccaccttcgctgccggacttctgctccggaaactgacgtctaaggagctcatgatgacaaccatcggcatcgtgctgcttagccaatccacaattcctgagtctatcctggaactcaccgatgccctggctctggggatgatggtgcttaaaattgtccgcaatatggagaagtatcagctggccgttaccatcatggcgattctctgcgtgcccaacgctgtgatcctgcagaatgcctggaaagtcagctgtacaacgctcgccgtggtttccgtgagccctctgcttctgacctcttcccaacagaaggctgactggatccccctcgccctgacaattaagggactgaaccctaccgctatctttcttacaaccctgagcagaacgtctaaaaagcggtcctggcccctcaatgaagccattatggcggtcggcatggtgagcatcctggcctcttccctcctgaaaaacgatattccgatgacagggcctcttgttgctggaggcctgctgaccgtgtgctacgtcctcaccggccgcagcgccgacctggagcttgaaagagctgccgacgtgcggtgggaggagcaggccgaaatctccgggagctctcccatcctgagcattacaatctccgaggatggatctatgagcattaagaatgaagaggaggaacagaccctcacaatcctgattcgcacgggcctcctggtcatctccgggcttttccctgtgtctattcccatcaccgctgcggcctggtatctgtgggaggttaaaaagcaaagagctggagtgctgtgggacgtcccgagccctccccctgtgggcaaagccgaactcgaggatggggcctaccggatcaagcagaagggcattctgggctattcccagatcggcgctggggtttacaaagaaggaacatttcacaccatgtggcatgtgacacgcggcgccgtccttatgcacaaggggaaaagaattgagccctcttgggcggacgtgaagaaagatctgatcagctacggaggcgggtggaagctcgagggagaatggaaggagggcgaagaggtgcaggttctggctctcgaacccggcaaaaaccctcgggccgtccaaaccaagccggggctgttcaaaacgaacaccggaacaattggcgccgtgtcccttgactttagccccgggacctctggatcccctatcgtggataagaaaggcaaggtcgtggggctgtatggaaatggcgttgtgacaagaagcggcacctacgtctctgctatcgcccagacagagaagtccattgaggacaaccccgaaatcgaggatgacattttccgcaaaaagcggctgacgatcatggatctccatcctggggcgggaaaaaccaagagatatctgcccgctattgtgcgcgaagccatcaaacggggccttagaacactgatcctcgcccctacccgcgttgtggctgccgagatggaagaggctctgcgggggctcccgattagataccagacccccgccatccgcgcggagcacacaggacgggaaattgtcgacctgatgtgtcatgccacgttcaccatgagacttctgagccctatccgggtgcccaattataacctgattatcatggatgaggctcactttacagaccctgcctccattgctgcccgcggctacatctctaccagagttgaaatgggggaggccgctggcatcttcatgacagcgacacccccgggaagccgggacccttttccccagtccaatgcccccattatggatgaggaacgcgagatccctgaaagaagctggaactctggccacgagtgggtgacggacttcaaggggaagacagtctggtttgtgccctccattaaagctggaaatgatatcgccgcctgcctccggaagaacggcaaaaaggtgattcaactgagcagaaaaaccttcgactctgaatatatcaagacccgcacaaatgattgggactttgtcgttaccacagatatcagcgagatgggggctaacttcaaggccgagcgggtgattgaccctagacgctgtatgaaaccggtgatccttaccgatggagaggaacgggtcattctggcgggccccatgcctgtgacgcattcctctgctgcccagagacgcgggcgggttggcagaaatcccaagaacgaaaatgaccagtacatctacatgggagagcctctcgaaaacgatgaggactgcgcccactggaaagaggctaagatgctgctggacaatattaacacacccgaaggcatcatcccgagcatgtttgagcctgaacgcgagaaagtggatgccattgacggggaatatagactccggggagaggcgcgcaagaccttcgtcgatcttatgagacggggcgacctgcccgtgtggctggcctaccgcgttgctgccgaggggatcaactatgctgatagacggtggtgttttgacggagtgaaaaataaccaaattctcgaagagaatgtcgaagtggagatctggacaaaggagggcgaaagaaagaaactgaagcctcgctggcttgatgcccggatttactccgaccccctggctctcaaagagttcaaggagttcgccgcggggagaaaatctctgaccctgaacctcatcacggagatgggccgccttcctacctttatgacacagaaggccaagaatgctctggataacctggccgtcctccataccgctgaagccggaggccgggcctataatcacgctctgagcgagcttcccgagacactggaaaccctcctgctgctcacacttctggcgaccgtgacagggggaattttcctgtttctcatgtccggcaaagggatcggaaagatgacactgggcatgtgctgcatcattaccgccagcatccttctgtggtacgctcagattcagccgcactggatcgccgcctctattatcctcgagttctttctgatcgttctgctcattcctgaacccgagaaacaaagaacaccccaggacaaccagcttacatatgtggtgatcgctattctgaccgtcgttgccgcgacaatggccaatgaaatgggcttcctggagaagacgaaaaaggattttgggctcggatccatcaccacacagcaacctgagagcaacattctggacatcgatcttcggccggcttccgcctggaccctgtacgctgtggccacaaccttcatcacgcccatgctccgccattctattgaaaatagctccgtgaacgtctctctgaccgcgatcgccaatcaggctacagtgctgatgggcctcgggaagggatggcctcttagcaaaatggacattggcgttcccctgctggccatcgggtgttactcccaggtgaaccctattaccctcacagctgccctgcttctgctcgtcgctcactatgccatcattggacccggcctgcaggcgaaggccaccagagaggctcaaaaacgggccgctgccggcatcatgaagaatcctacggtggacgggatgacagtcatcgatctggacccgattccctacgatcctaaatttgaaaagcagctcggacaggtgatgcttctggttctgtgcgtgacccaggtcctcatgatgcgcacaacctgggccctgtgtgaggcgcttaccctggctacaggccccatcagcacgctctgggaagggaaccctggaagattctggaataccacaattgccgtgtctatggctaacatctttcggggctcctatctggccggggccggactgctgttcagcattatgaagaacaccgctaatacacgcagaggcaccggcaacacgggggagacacttggagagaaatggaagaatcggctgaacgccctgggcaaatctgaatttcaaatctacaagaaatccgggatccaggaggttgaccgcaccctcgcgaaggaaggaattaaaagaggcgagaccgatcatcacgccgtgagccgggggtctgctaagctgagatggttcgtcgagcgcaatcttgtgacacccgaaggaaaggtggttgacctgggctgcggcagagggggatggagctattactgtggcgggctcaaaaacgtcaaggaggtgaaaggactgaccaagggcgggccgggacatgaagaacctatccccatgtccacatatggctggaatctggtgagactccagtctggcgtcgatgttttctttacgccccctgaaaaatgcgacacccttctgtgtgatattggggagagctcccccaaccctacagtggaggccggacgcaccctgcgggtgctcaatctggtcgaaaactggcttaataacaatacacaattctgcatcaaggtgctgaacccgtacatgcccagcgttattgagaagatggaagctctccagagaaaatacggcggggccctggtgcgcaatcctctgtcccggaactctacccacgagatgtattgggtcagcaacgcgtccggaaatatcgtgtctagcgttaacatgatctccagaatgctcattaatcgctttacgatgcggcacaagaaagccacctacgaacccgacgtggatcttggctctgggacaagaaacatcggaattgagagcgagacccctaatctggacatcattggcaagcgcatcgagaagatcaagcaggagcatgaaacatcctggcactatgatcaggaccatccctacaagacctgggcttatcacggcagctacgagacaaaacaaaccgggtctgcctccagcatggtcaacggagtggtgcggctgctcacgaagccgtgggacgtcattcctatggttacacagatggctatgaccgataccacacccttcggccagcagagagtgtttaaagaaaaggtggacacgcgcacccaagagcctaaagaggggacaaagaagctgatgaaaatcaccgccgaatggctttggaaggagctgggcaaaaagaaaacacccagaatgtgtacccgggaagagttcacacgcaaggtcagatctaatgctgccctcggcgcgatttttaccgatgagaacaaatggaagtccgcccgggaagctgtggaggacagcgggttctgggaactggttgataaggagagaaatctgcacctcgaaggaaaatgcgagacgtgtgtgtataacatgatgggcaagcgggagaaaaagctgggcgaatttgggaaagccaagggatctcgcgctatctggtacatgtggcttggcgccagattcctggagtttgaagccctcgggttcctgaatgaggaccattggttttcccgggaaaacagcctttccggagtcgagggcgaggggctgcacaagctcggctacattctgcgcgatgtgagcaaaaaggaaggaggcgcgatgtatgctgacgataccgccgggtgggacacaagaatcaccctggaggatctcaaaaatgaagagatggttacaaaccatatggaaggagagcacaagaaactggccgaggctattttcaaacttacctaccagaataaggtggtccgggtgcagcgccctacgcccagaggcacagttatggacatcatctctcggcgcgaccagagagggagcggacaagtggtcacctatggcctgaacacattcaccaacatggaagcccagctcattcggcagatggagggggaaggcgtgtttaaatccatccaacagctgacggtcaaggaggagattgctgtgaaaaattggcttatccgcgttggaagagaacggctgtctcgcatggccattagcggcgatgactgcgtggtcaagccgctcgatgacagattcgcgtccgccctgaccgctctgaacgatatggggaaagtgcggaaggacatccagcagtgggagccttctagaggatggaatgattggacacaagtgcccttttgcagccatcacttccacgaactcatcatgaaggacggccgcgttctggtggtcccctgtcggaaccaggatgagcttattgggagagcccgcatctcccagggagctggctggtctctgcgggaaaccgcctgcctcgggaaaagctacgcgcagatgtggtccctgatgtattttcatagacgcgaccttcggctggccgctaatgccatttgtagcgctgtgccttctcactggatcccgacatccagaaccacatggagcattcatgccacccacgagtggatgacgacagaggatatgctcaccgtttggaaccgcgtgtggatccaagaaaatccctggatggaggacaagacccctgtcgaatcttgggaggaaatcccctacctgggcaaacgggaggatcagtggtgcggatccctgattggcctcacaagcagagctacctgggccaagaacatccagacagcgattaatcaggtgcgctccctgatcgggaacgaggaatatacggactacatgccttctatgaaacggttcagacgggaggaagaggaagccggagtcctttggtga

SEQ ID NO: 19631 - RNA, 9876 nt, synthetic construct
  misc_feature 1..9876: note = derived and/or modified CDS sequence (opt5) from DENV-2__KM279596__SS-prME
  source 1..9876: mol_type = other RNA
accgccggaatcattatcatgatgattcccaccgtgatggctttccacctgacgaccagaaacggggaacctcatatgatcgtcagccggcaggaaaagggaaaatccctcctgtttaagaccgagaatggagttaacatgtgcacccttatggccatggacctgggggaactctgtgaggataccattacctacaattgcccgctgcttcgccaaaacgaacccgaggacatcgattgttggtgcaattctacgagcacctgggtgacgtatggaacctgtacagcgaccggcgagcaccggcgggaaaaacgctccgtggctctggtccctcatgtggggatgggactcgagacaagaaccgaaacgtggatgtctagcgagggcgcctggaagcacgcccagcggatcgagacatggattctgcgccatcccggcttcaccatcatggctgccattctggcttacacaatcgggaccacctattttcagagagttctcattttcatcctgcttacagccgtgacgccttccatggcgatgcggtgcattggaatctctaaccgcgactttgtcgaaggcgtgagcgggggatcctgggttgatatcgtgctggagcacggcagctgtgtcaccacaatggccaaaaataagcccaccctcgacttcgaactgattaagacagaggctaaacaccttgccaccctgagaaagtactgcgtggaagctaaactcacgaacacaaccaccgcctctcggtgtcctacacagggggagccgtccctgaatgaggaacaagataagcgctttgtgtgcaaacatagcatggtcgacagaggatggggcaacggctgtgggctgttcggaaagggcgggatcgttacctgcgcgatgtttacatgcaagaaaaatatggagggaaaggtggtgcagcccgaaaacctcgagtatacgattgtcatcacccctcactctggcgaagagaatgccgtggggaacgatacaggaaaacatggcaaggagattaaagttacaccccagtccagcatcacagaagctgagctgaccggctacgggacggtgaccatggaatgttctcctcggacaggacttgacttcaatgagatggtcctgctccagatggaaaacaaggcctggctggtgcaccgccaatggtttcttgatctgcccctcccgtggctgcctggcgctgacacccaggggtccaactggatccagaaagagacactggttaccttcaagaatccccacgccaagaaacaggatgtggtcgtgctcggaagccaagagggcgccatgcatacggctctgacaggggcgaccgaaattcagatgtcctctggcaaccttctgtttacaggacacctcaagtgcagactgcggatggacaaacttcagctgaagggcatgagctattccatgtgtaccgggaaattcaaggtcgtgaaggagatcgccgaaacccaacatggaacaattgttatcagagtgcagtacgagggcgacgggagcccttgcaaaattcccttcgagatcatggatctcgaaaagcgccacgtcctgggacggctgatcacggtgaatcccattgttaccgagaaagactctcctgtgaacatcgaagctgagccgccctttggcgattcctacattatcattggggtcgaacctggccagctcaagctgagctggttcaaaaagggatctagcatcggccagatgtttgagacaaccatgagaggggccaagcgcatggccattcttggagacacagcttgggatttcggctccctcgggggagtgtttacctctatcggcaaagccctccatcaagtgttcggggcgatctatggcgctgcctttagcggagtttcctggacgatgaagattctgatcggcgtcgtgattacatggatcgggatgaatagccggtctacctccctgagcgtgtctcttgtcctcgtgggagttgtgaccctgtacctgggcgtcatggtgcaggccgactccgggtgtgttgtgagctggaaaaacaaggagctcaaatgcggatccggcattttcatcacagataatgtccacacctggacagaacagtataagtttcagcccgagtctcctagcaagctggcttccgccatccaaaaagctcacgaagaggggatttgtggcatcagatctgtgacgcgccttgaaaacctgatgtggaagcagattacccccgagctcaatcatatcctgacagagaacgaagttaaactgaccattatgacaggagacatcaagggcatcatgcaggccgggaaacggagccttagaccgcagcctaccgagctcaagtactcctggaaagcgtggggaaaggccaagatgctgagcacggaactgcacaatcataccttcctcattgatggccccgagacagctgaatgccctaacaccaatcgcgcctggaactctctggaggtggaggactatgggtttggagtcttcacaaccaatatctggcttaaactgaaggaacggcaagatgtgttttgtgactccaaactcatgagcgctgccattaaggacaacagagcggtgcacgccgatatgggctactggatcgagtctgctctgaacgacacatggaaaattgaaaaggcctccttcatcgaggtcaagagctgccactggcccaaatctcataccctgtggagcaatggcgttcttgagtccgaaatgatcattcctaagaacttcgctgggcccgtgagccagcacaattatcgcccgggataccatacgcagacagccggcccttggcacctcgggcggctggagatggattttgacttctgtgaaggaaccaccgtggccgtcacagaggattgcggcaacagagggccctctctgcggaccacgacagcttccggaaaactcatcaccgaatggtgctgtcgcagctgcacactgccccctcttagataccggggcgaggacggctgttggtatgggatggagattagaccgctgaaggaaaaagaggaaaatctcgtgaactccctggttaccgcgggacatggccagatcgataatttttctctgggggtgcttggaatggccctcttcctggaggaaatgctgcgcacacgggtcggcaccaagcacgctattctcctggtggccgttagctttgtgacgcttatcaccgggaacatgtccttcagagacctgggacgcgtcatggtgatggttggcgccacaatgaccgatgacattggcatgggggtgacatacctcgctctgctggccgcgtttaaggtcagacccaccttcgctgccggacttctgctccggaaactgacgtctaaggagctcatgatgacaaccatcggcatcgtgctgcttagccaatccacaattcctgagtctatcctggaactcaccgatgccctggctctggggatgatggtgcttaaaattgtccgcaatatggagaagtatcagctggccgttaccatcatggcgattctctgcgtgcccaacgctgtgatcctgcagaatgcctggaaagtcagctgtacaacgctcgccgtggtttccgtgagccctctgcttctgacctcttcccaacagaaggctgactggatccccctcgccctgacaattaagggactgaaccctaccgctatctttcttacaaccctgagcagaacgtctaaaaagcggtcctggcccctcaatgaagccattatggcggtcggcatggtgagcatcctggcctcttccctcctgaaaaacgatattccgatgacagggcctcttgttgctggaggcctgctgaccgtgtgctacgtcctcaccggccgcagcgccgacctggagcttgaaagagctgccgacgtgcggtgggaggagcaggccgaaatctccgggagctctcccatcctgagcattacaatctccgaggatggatctatgagcattaagaatgaagaggaggaacagaccctcacaatcctgattcgcacgggcctcctggtcatctccgggcttttccctgtgtctattcccatcaccgctgcggcctggtatctgtgggaggttaaaaagcaaagagctggagtgctgtgggacgtcccgagccctccccctgtgggcaaagccgaactcgaggatggggcctaccggatcaagcagaagggcattctgggctattcccagatcggcgctggggtttacaaagaaggaacatttcacaccatgtggcatgtgacacgcggcgccgtccttatgcacaaggggaaaagaattgagccctcttgggcggacgtgaagaaagatctgatcagctacggaggcgggtggaagctcgagggagaatggaaggagggcgaagaggtgcaggttctggctctcgaacccggcaaaaaccctcgggccgtccaaaccaagccggggctgttcaaaacgaacaccggaacaattggcgccgtgtcccttgactttagccccgggacctctggatcccctatcgtggataagaaaggcaaggtcgtggggctgtatggaaatggcgttgtgacaagaagcggcacctacgtctctgctatcgcccagacagagaagtccattgaggacaaccccgaaatcgaggatgacattttccgcaaaaagcggctgacgatcatggatctccatcctggggcgggaaaaaccaagagatatctgcccgctattgtgcgcgaagccatcaaacggggccttagaacactgatcctcgcccctacccgcgttgtggctgccgagatggaagaggctctgcgggggctcccgattagataccagacccccgccatccgcgcggagcacacaggacgggaaattgtcgacctgatgtgtcatgccacgttcaccatgagacttctgagccctatccgggtgcccaattataacctgattatcatggatgaggctcactttacagaccctgcctccattgctgcccgcggctacatctctaccagagttgaaatgggggaggccgctggcatcttcatgacagcgacacccccgggaagccgggacccttttccccagtccaatgcccccattatggatgaggaacgcgagatccctgaaagaagctggaactctggccacgagtgggtgacggacttcaaggggaagacagtctggtttgtgccctccattaaagctggaaatgatatcgccgcctgcctccggaagaacggcaaaaaggtgattcaactgagcagaaaaaccttcgactctgaatatatcaagacccgcacaaatgattgggactttgtcgttaccacagatatcagcgagatgggggctaacttcaaggccgagcgggtgattgaccctagacgctgtatgaaaccggtgatccttaccgatggagaggaacgggtcattctggcgggccccatgcctgtgacgcattcctctgctgcccagagacgcgggcgggttggcagaaatcccaagaacgaaaatgaccagtacatctacatgggagagcctctcgaaaacgatgaggactgcgcccactggaaagaggctaagatgctgctggacaatattaacacacccgaaggcatcatcccgagcatgtttgagcctgaacgcgagaaagtggatgccattgacggggaatatagactccggggagaggcgcgcaagaccttcgtcgatcttatgagacggggcgacctgcccgtgtggctggcctaccgcgttgctgccgaggggatcaactatgctgatagacggtggtgttttgacggagtgaaaaataaccaaattctcgaagagaatgtcgaagtggagatctggacaaaggagggcgaaagaaagaaactgaagcctcgctggcttgatgcccggatttactccgaccccctggctctcaaagagttcaaggagttcgccgcggggagaaaatctctgaccctgaacctcatcacggagatgggccgccttcctacctttatgacacagaaggccaagaatgctctggataacctggccgtcctccataccgctgaagccggaggccgggcctataatcacgctctgagcgagcttcccgagacactggaaaccctcctgctgctcacacttctggcgaccgtgacagggggaattttcctgtttctcatgtccggcaaagggatcggaaagatgacactgggcatgtgctgcatcattaccgccagcatccttctgtggtacgctcagattcagccgcactggatcgccgcctctattatcctcgagttctttctgatcgttctgctcattcctgaacccgagaaacaaagaacaccccaggacaaccagcttacatatgtggtgatcgctattctgaccgtcgttgccgcgacaatggccaatgaaatgggcttcctggagaagacgaaaaaggattttgggctcggatccatcgctacccagcaacctgagagcaacattctggacatcgatcttcggccggcctccgcttggacactgtacgccgtggcgaccacattcatcacccccatgctccgccattctattgaaaatagctccgtgaacgtctctctgacggccatcgctaatcaggccaccgtgctgatgggcctcgggaagggatggcctcttagcaaaatggacattggcgttcccctgctggctatcgggtgttactcccaggtgaaccctattacactcaccgccgctctgcttctgctcgtcgcccactatgcgatcattggacccggcctgcaggccaaggctacaagagaggcccaaaaacgggctgccgccggcatcatgaagaatcctaccgtggacgggatgacggtcatcgatctggacccgattccctacgatcctaaatttgaaaagcagctcggacaggtgatgcttctggttctgtgcgtgacacaggtcctcatgatgcgcaccacatgggcgctgtgtgaggctcttaccctggccaccggccccatcagcacactctgggaagggaaccctggaagattctggaatacgaccattgctgtgtctatggccaacatctttcggggctcctatctggccggggctggactgctgttcagcattatgaagaacacagccaatacccgcagaggcacaggcaacaccggggagacgcttggagagaaatggaagaatcggctgaacgcgctgggcaaatctgaatttcaaatctacaagaaatccgggatccaggaggttgaccgcacactcgccaaggaaggaattaaaagaggcgagaccgatcatcacgctgtgagccgggggtctgccaagctgagatggttcgtcgagcgcaatcttgtgacccccgaaggaaaggtggttgacctgggctgcggcagagggggatggagctattactgtggcgggctcaaaaacgtcaaggaggtgaaaggactgacaaagggcgggccgggacatgaagaacctatccccatgtccacctatggctggaatctggtgagactccagtctggcgtcgatgttttctttacaccccctgaaaaatgcgacacgcttctgtgtgatattggggagagctcccccaaccctaccgtggaggctggacgcacactgcgggtgctcaatctggtcgaaaactggcttaataacaatacccaattctgcatcaaggtgctgaacccgtacatgcccagcgttattgagaagatggaagccctccagagaaaatacggcggggcgctggtgcgcaatcctctgtcccggaactctacacacgagatgtattgggtcagcaacgcctccggaaatatcgtgtctagcgttaacatgatctccagaatgctcattaatcgctttaccatgcggcacaagaaagctacgtacgaacccgacgtggatcttggctctgggaccagaaacatcggaattgagagcgagacacctaatctggacatcattggcaagcgcatcgagaagatcaagcaggagcatgaaacctcctggcactatgatcaggaccatccctacaagacatgggcctatcacggcagctacgagaccaaacaaacagggtctgcttccagcatggtcaacggagtggtgcggctgctcaccaagccgtgggacgtcattcctatggttacgcagatggccatgacagataccacccccttcggccagcagagagtgtttaaagaaaaggtggacacacgcacgcaagagcctaaagaggggaccaagaagctgatgaaaatcacagctgaatggctttggaaggagctgggcaaaaagaaaacccccagaatgtgtacacgggaagagttcacccgcaaggtcagatctaatgccgcgctcggcgccatttttacagatgagaacaaatggaagtccgctcgggaagccgtggaggacagcgggttctgggaactggttgataaggagagaaatctgcacctcgaaggaaaatgcgagacctgtgtgtataacatgatgggcaagcgggagaaaaagctgggcgaatttgggaaagctaagggatctcgcgccatctggtacatgtggcttggcgccagattcctggagtttgaagcgctcgggttcctgaatgaggaccattggttttcccgggaaaacagcctttccggagtcgagggcgaggggctgcacaagctcggctacattctgcgcgatgtgagcaaaaaggaaggaggcgctatgtatgccgacgatacggccgggtgggacaccagaatcacactggaggatctcaaaaatgaagagatggttaccaaccatatggaaggagagcacaagaaactggctgaggccattttcaaacttacataccagaataaggtggtccgggtgcagcgccctacccccagaggcacggttatggacatcatctctcggcgcgaccagagagggagcggacaagtggtcacatatggcctgaacaccttcacaaacatggaagctcagctcattcggcagatggagggggaaggcgtgtttaaatccatccaacagctgaccgtcaaggaggagattgccgtgaaaaattggcttatccgcgttggaagagaacggctgtctcgcatggcgattagcggcgatgactgcgtggtcaagccgctcgatgacagattcgcctccgctctgacggccctgaacgatatggggaaagtgcggaaggacatccagcagtgggagccttctagaggatggaatgattggacccaagtgcccttttgcagccatcacttccacgaactcatcatgaaggacggccgcgttctggtggtcccctgtcggaaccaggatgagcttattgggagagctcgcatctcccagggagccggctggtctctgcgggaaacagcgtgcctcgggaaaagctacgcccagatgtggtccctgatgtattttcatagacgcgaccttcggctggctgccaatgctatttgtagcgccgtgccttctcactggatcccgacctccagaacaacctggagcattcatgctacacacgagtggatgaccacggaggatatgctcacagtttggaaccgcgtgtggatccaagaaaatccctggatggaggacaagacccctgtcgaatcttgggaggaaatcccctacctgggcaaacgggaggatcagtggtgcggatccctgattggcctcaccagcagagccacatgggcgaagaacatccagaccgccattaatcaggtgcgctccctgatcgggaacgaggaatatacagactacatgccttctatgaaacggttcagacgggaggaagaggaagctggagtcctttggtga

SEQ ID NO: 19632 - RNA, 9876 nt, synthetic construct
  misc_feature 1..9876: note = derived and/or modified CDS sequence (opt5) from DENV-2__FJ850072__SS-prME
  source 1..9876: mol_type = other RNA
accgccggagtgatcattatgctgatccccacggctatggccttccacctcacgaccagaaatggggaacctcatatgattgttggacggcaggaaaagggcaagagcctgctttttaagacagaggacggggttaatatgtgcaccctgatggcgatggatctcggagaactgtgtgaggacacaatcacctacaagtgcccgcttctgagacaaaatgaacccgaggatattgactgttggtgcaattccacatctacctgggtgacgtatggcacctgtacaaccacaggggagcacagacgggaaaagcgcagcgtggctctcgtccctcatgtgggaatgggcctggagaccagaacggaaacatggatgtcctctgagggcgcctggaaacacgttcagcggatcgagacctggatcctgcgccatcccgggttcgccattatggctgccatcctcgcttacacaattggaaccacccactttcagagagccctgatcttcattcttctgacagcggtggcccctagcatgacgatgcggtgcatcggcatttccaaccgcgattttgtcgaaggggtgtctggaggcagctgggttgacatcgtgctcgagcacgggtcctgtgtcaccacaatggctaagaataagcccaccctggatttcgaacttatcaaaacagaggccaagcagcctgctaccctgagaaaatattgcattgaagccaagctcacgaacacaaccaccgagagccggtgtccgacacaaggagagccctctctgaatgaagaacaggacaaacgctttatctgcaagcattccatggtggatagaggctggggcaacgggtgtggactgttcggcaaaggcgggattgtgacctgcgcgatgtttacatgcaaaaagaatatggaagggaaagtcgttctccctgagaacctggaatacacgatcgtgattacaccccacagcggggaggagcatgccgtgggaaatgacacaggcaagcacggcgaagagatcaaaatcacccctcagtcttccattacagaagctgagcttaccgggtatggaacggtcaccatggaatgtagcccccggacaggcctggatttcaacgagatggtgctcctgcagatggaggaaaaggcctggcttgttcaccgccaatggtttctggacctcccgctgccttggctgcccggggctgatacccagggatctaattggatccagaaagagacactcgtgaccttcaagaaccctcatgccaagaaacaggacgtcgtggttctgggctcccaagaaggggccatgcacacggctcttacaggcgcgaccgagattcagatgagctccggaaatctgctctttacaggccatctgaagtgcagacttcggatggacaaactgcagctcaaggggatgtcttacagcatgtgtaccggaaaattcaagatcgtgaaggagattgccgaaacccaacacggcacaatcgtcatcagagtgcagtatgagggggatggatccccctgcaaaattcccttcgaaatcatggacctggagaagcgccatgctctgggccggctcattacggtcaaccctatcgtgaccgaaaaagatagcccggttaacattgaggccgagcccccttttggggactcttacatcattatcggcgtggaacccggacagctgaaacttaattggttcaaaaagggctccagcatcgggcagatgtttgagacaaccatgagaggagccaagcgcatggctattctgggcgatacagcctgggacttcgggtctctcggaggcgtctttaccagcatcgggaaagcgctgcaccaagtgttcggcgctatttacggagccgccttttccggcgtttcttggacgatgaagatcctgattggggtgatcatcacatggattggaatgaacagccggtccaccagcctttctgtctccctcgtgctggtgggcgttgtcaccctgtatctcggggctatggtgcaggccgatagcggatgtgtggtctcttggaaaaataaggaactgaaatgcggctccgggatcttcattacagacaacgtgcacacctggacagagcagtacaagtttcagcctgaaagcccctccaaacttgcttctgccatccaaaaagcgcatgaggagggcatttgtggaatcagaagcgttacgcgcctggaaaatctcatgtggaagcagatcaccccggagctgaaccacattctgtccgaaaatgaggtgaaacttacaatcatgaccggcgatattaaggggatcatgcaggccggaaaacggtctctcagacctcagcccacagaactgaagtatagctggaaaacctggggcaaggctaagatgctgtccacggagagccataaccaaaccttcctcattgacgggcctgagacagccgaatgccccaataccaaccgcgcttggaactctctggaggtcgaagattacggatttggcgtgttcacaaccaacatctggcttaaactgcgggagaagcaggacgtcttttgtgactccaaactcatgagcgccgcgatcaaggataatagagccgtgcacgctgacatgggctattggattgagtctgccctgaacgatacatggaaaatggaaaaggcttccttcatcgaggtcaagagctgccactggcctaaatctcataccctgtggagcaatggggtgcttgaatccgagatgattatccccaagaacttcgccggaccggttagccagcacaactaccgccctggctatcatacgcagacagccgggccctggcacctcggaaaactggaaatggactttgatttctgtgagggcaccaccgtggtcgtgacagaggactgcgggaatcggggaccctctctgagaaccacgacagcttccggcaagctcattaccgaatggtgctgtcggagctgcacactgcctccgcttcgctacagaggcgaggatgggtgttggtacggaatggaaatccggcccctgaaagagaaggaagagaacctcgtgaatagcctggtcaccgcgggccatgggcaaattgacaacttttctctgggagttcttggcatggccctcttcctggaggaaatgctgagaacacgcgtggggaccaagcacgctatcctcctggtggccgtcagctttgtgacgcttatcaccggaaatatgtccttccgggatctgggcagagttatggtgatggtcggcgtggccatgacagacgatattgggatgggagttacctatctcgctctgctggccgcgtttaaagtgcgccctacattcgctgccggccttctgctcagaaagctgacctctaaagagctcatgatggccacgatcgggattacactgcttagccagtccaccatccccgaaacaattctggagctcaccgacgctctggccctgggaatgatggtccttaagatcgtgcggaacatggaaaaataccagctggcggttaccatcatgacaatttcttgcgtgcctaatgctatgatcctcctgaacgcctggaaggtcagctgtacgattctcgccgtggtgtccgtcagccccctgcttctgacctcttcccaacagaagacagattggatccctctcgctctgaccattaaaggcctgaatcccacagccatctttcttaccacgctgagccgcacatctaagaaaagatcctggccgctcaacgaggctgttatggccgtggggatggtgagcatcctggcgtcttccctcctgaagaatgacattcctatgaccggaccccttgtcgccggcggcctgctgaccgtgtgctatgttctcacagggcggagcgctgacctggagcttgaacgcgccaccgatgtgaaatgggaggaccaggctgaaatctccggaagctctcctattctgagcatcacaatttccgaggatggctctatgagcatcaagaacgaggaagaggaacagacgctcaccattctgatcagaacagggctcctggtcatctccggagtgttccccgtttctattccgatcaccgccgccgcttggtacctttgggaggtgaaaaagcaacgggcgggcgtcctgtgggacgtgccttctccccctcccgtcgaaaaggccgagctggaggatggggcttatcgcattaaacagagaggaatcctcggctactcccagattggcgccggggtgtataaggaaggaacatttcacaccatgtggcatgttacgcggggcgccgtgctgatgcaccgcgggaaaagaatcgagccctcctgggctgacgtcaagaaagatcttatcagctacggaggcgggtggaagctggaaggagagtggaaggaaggcgaggaggtgcaggttctcgccctggaacctggcaaaaatccgcgggcggtgcaaaccaagcccggactcttcaaaacaaacaccggaacaattggcgctgtctccctggactttagccctgggacctctggatcccccatcgtggatagaaagggcaaagtggttgggctttacggaaatggcgtcgtgacacgcagcggcgcctatgtgtctgccattgctcagacggagaagtccatcgaagacaaccctgagattgaagatgacatcttccggaagaaaagactgaccatcatggatctgcatcccggggccggaaagacaaaacgctacctccctgcgattgtccgggaggctatcaagagaggcctgcgcacccttattctggccccgacccgggtggttgccgctgagatggaagaggccctcagagggctgcccatccgctatcagacccctgctattcgggccgaacacacgggaagagagatcgtggacctcatgtgtcatgcgaccttcacaatgcggctgcttagccccgtccgcgtgcctaactacaatctgattatcatggacgaggcccactttaccgatcccgcttccatcgccgctagaggctatatttctacacgggttgaaatgggggaggccgccggcatcttcatgaccgctacgccgcctggaagccgcgacccctttccccagtccaacgcgcctattatggatgaagagagagaaatccccgagcggagctggaactctggccacgagtgggtgacagacttcaaagggaagaccgtctggtttgtgccttccattaaggccggaaacgatatcgctgcctgcctgcgcaagaatggcaagaaagttatccaactcagccgcaagaccttcgactctgaatacgtgaaaacacgggccaacgattgggactttgtcgtgaccacagatattagcgagatgggggctaatttcagagccgaacgcgtgatcgacccgcggagatgtatgaagcccgtcattctgaccgatggagaggaacgcgttatccttgcgggccctatgcccgtgacgcattcctctgctgcccagcggagagggcgcgtgggcagaaaccctaagaatgagaacgaccagtatatttacatgggagagcccctggaaaatgacgaggattgcgcccactggaaagaagctaagatgctcctggacaacatcaatacaccggagggcatcattcctagcatgtttgaacccgagcgggagaaagtcgatgccatcgacggggaataccgcctgagaggagaggcgcggaagaccttcgtggatctcatgcgcagaggcgaccttcctgtttggctggcctatcgggtggctgccgaagggattaactacgctgatagacgctggtgttttgacggaatcaaaaataaccaaattctggaggagaacgtcgaagtggagatctggacaaaggaaggcgagcggaaaaagctcaagcccagatggctggatgcccgcatttattccgaccctcttgctctgaaagagttcaaggagttcgccgcggggcggaaatctctcaccctgaatctgatcacggagatgggcagactccccacctttatgacacagaaggcccggaacgctcttgataatctggccgttctgcataccgctgaagccggaggccgcgcctacaaccacgctctcagcgagctgccggaaacacttgagaccctgctcctgctgacactccttgcgaccgtgacagggggaatcttcctgtttctgatgtccggcaaagggattggaaagatgacactcggcatgtgctgcatcattaccgccagcatcctgctttggtatgctcagattcagcctcactggatcgccgcctctatcattctggagttctttctcatcgtcctgctgattcccgagcccgagaagcaaagaacccctcaggacaatcagctcacatacgtggtcatcgctattcttaccgtggttgccgcgacaatggccaacgaaatgggcttcctggagaaaacgaagaaagatctggggctcggatccatcaccacacaggaaagcgagtccaatatcctggacattgaccttcggccggcttctgcctggaccctgtatgctgtggccacaacctttatcacgcccatgctccgccatagcattgaaaactcctctgtgaatgtcagcctgaccgcgatcgccaaccaagctacagttctgatgggcctcgggaagggatggcctctttccaaaatggatattggcgtgcccctgctggccatcgggtgttacagccaggtgaatcctattaccctcacagctgccctgctttctctggtcgctcactacgccatcatcggacccggcctccaggcgaaggccaccagagaggctcagaagcgggccgctgccggcattatgaaaaaccctacggtggacgggatcacagttattgatctggagccgatcccctatgaccctaagttcgaaaaacaactgggacaggtgatgctccttattctgtgcgtcacccaggtgctgatgatgcgcacaacctgggccctctgtgaggcgctgacccttgctacaggccccatctccacgctgtgggaagggaatcctggaagattttggaacaccacaatcgccgtcagcatggctaatattttccggggctcttacctcgccggggccggactgctgttttccatcatgaagaacaccacaaatacccgcagaggcacgggcaacattggggagacactcggagagaaatggaaaagccggcttaacgctctgggcaagtctgagttccagatctataaaagaagcgggattcaagaggtggatcgcaccctggccaaggaaggaatcaaacggggcgagaccgaccatcacgcggtttccagagggtctgccaagctccgctggtttgtggaacggaatatggtcacacccgagggaaaagtggttgatctgggctgcggcagagggggatggagctactattgtggcgggcttaagaacgtgcgcgaggtcaaaggactgaccaagggcgggccgggacatgaagaacctatccccatgtccacatacggctggaatctcgtgcggctgcagagcggcgtggacgttttcttcacgccccctgaaaagtgcgataccctgctctgtgacattggggagtcctctcccaaccctacaatcgaagctggaagaacccttcgcgtcctgaatctggtggagaactggctcaataacaatacacagttttgcattaaagtgctgaacccgtatatgcccagcgtcatcgagaagatggaaacccttcaacggaaatacggcggggccctggttagaaatcctctctcccgcaactctacgcacgagatgtactgggtgagcaatgctaccggaaacattgtgtcctctgtcaatatgatcagccggatgctgatcaacagattcacaatgaagcacaaaaaggccacctatgaacccgatgtggacctgggctccgggacacgcaacattggaatcgagagcgaaattcctaatctcgatatcattggcaagagaatcgagaaaattaagcaggagcatgaaacctcttggcactacgaccaggaccatccctataaaacatgggcgtaccacggctcctatgagaccaagcagacggggagcgcctcttccatggttaacggagtggtccggcttctgacaaaaccgtgggatgtggttcctatggtgacccaaatggctatgaccgacacaacgccctttggccagcagcgcgtcttcaaggaaaaggtggataccagaacacaggagcctaaagaggggaccaagaaactgatgcggatcacagccgaatggctctggaaggagctgggcaagaagaagacccccagaatgtgtacacgggaagagtttacccgcaaagtgagaagcaatgctgcccttggcgctatcttcacggacgaaaacaagtggaaatctgcccgggaggcggtcgaggattcccgcttttgggaactggttgacagagagcggaatctccacctggaagggaagtgcgagacctgtgtgtacaacatgatgggaaaacgcgaaaagaaactgggcgagttcggcaaggccaaggggagcagagctatttggtatatgtggctcggagcccggtttctggagttcgaagctcttggctttctgaatgaggatcattggttctcccgcgggaacagcctctctggagtggaaggcgaggggctgcacagacttggctacatcctgcgggacgtcagcaaaaaggaaggaggcgccatgtacgccgatgacacagcggggtgggatacccgcattacactcgaggacctgaaaaatgaggaaatggtgaccaaccatatgaagggagagcacaaaaagctggctgaagccgtttttaagctcacgtatcaaaataaagtggtcagagtgcagcggcctacaccccgcggcaccgttatggacatcatttccagacgggatcagagagggtctggacaggtgggcacatacgggctgaacaccttcacgaatatggaggcccaacttatccgccagatggagggcgaaggaatcttcaagagcattcagcatctgaccgtcacagaggaaatcgctgtgcaaaactggctcgcccgggttggcagagagcgcctgtcccggatggctatttctggggacgattgcgtggtcaaaccgcttgacgatagatttgccagcgcgctgaccgccctcaatgacatgggaaaggtgcgcaaagatatccagcagtgggaaccttcccggggctggaacgactggacacaggtccccttctgctctcaccactttcatgagctggtgatgaaggatgggagaatgctggttgtgccctgtcgcaaccaagacgagctcattggacgggctagaatcagccagggcgccgggtggtccctgaaggaaaccgcttgccttggcaaaagctatgcccagatgtggacactgatgtacttccaccgccgggatctcagactggcggccaatgctatctgttctgccgtcccttcccattgggtgccgaccagccggacgacatggtctattcacgctaagcacgagtggatgaccaccgaagacatgcttgccgtgtggaacagagtttggatccaggagaatccctggatggaagataaaacacctgtggagtcctgggaggaagtcccctatctgggaaagcgcgaggaccaatggtgcggcagcctcattgggctgacctcccgggctacatgggccaaaaacatccagacggcgattaatcaggtgagatctctgatcggaaacgaagagtacaccgactatatgcctagcatgaagcgctttagacgggaagaggaggaagccggcgttctctggtga

SEQ ID NO: 19633 - RNA, 9876 nt, synthetic construct
  misc_feature 1..9876: note = derived and/or modified CDS sequence (opt5) from DENV-2__JN819419__SS-prME
  source 1..9876: mol_type = other RNA
accgccggcgtgatcgtcatgctgattcccacagctatggccttccacctcacgacccggaatggggagcctcatatgatcgttggacggcaggaaaagggcaagagcctgctttttaagacagaggacggggtgaatatgtgcaccctgatggccattgatctcggagaactgtgtgaggacacaatcacctacaagtgcccgcttctgcgccaaaacgaacccgaggatattgactgttggtgcaattccacatctacctgggtgacgtatggcacctgtacaaccacaggggagcaccggcgggaaaagcgcagcgtcgctctcgtgcctcatgttggaatgggcctggagaccagaacggaaacatggatgtcctctgagggcgcctggaagcacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcgtggaagctaagctcacaaacaccaccacagagagccggtgtccgacccaaggagagccctctctgaatgaggaacaggacaaacgctttatttgcaagcattccatggtcgatagaggctggggcaacgggtgtggactgttcggcaaaggcgggatcgttacatgcgccatgtttacgtgcaaaaagaatatggaagggaaagtggtgcagcctgagaacctcgaatacaccattgtcatcacaccccacagcggggaggagcatgcggtgggaaatgacaccggcaagcacggcaaagaaattaagatcacacctcagtcttccatcaccgaggccgaactgacggggtatggaaccgttacaatggagtgtagcccccggaccggccttgatttcaacgaaatggtgctgctccaaatggaggacaaggcttggctggtccaccgccagtggtttcttgatctgccgctcccttggctgcccggggccgacacacagggatctaattggattcagaaggagaccctggtgacgttcaagaaccctcatgctaaaaagcaagacgttgtggtcctcggctcccaggaaggggccatgcacacagccctgaccggcgctacagagatccagatgagctccggaaatcttctgtttaccggccatctcaaatgcagactgcggatggataaacttcaactgaaagggatgtcttacagcatgtgtaccggaaagttcaagattgtgaaagaaatcgcggagacacagcacggcacgattgtcatcagagtgcagtatgagggggacggatccccctgcaagatccccttcgaaattatggatctcgagaaacgccatgttctgggccggctgatcaccgtgaaccctattgtcacagaaaaggacagcccggtgaacatcgaggccgaacccccttttggggattcttacattatcattggcgttgagcccggacagctcaaactgaattggttcaagaagggctccagcatcgggcaaatgtttgagaccacaatgagaggagctaaacgcatggccatccttggcgacaccgcctgggatttcgggtctctgggaggcgtgtttacgagcattgggaaggctctccaccaggtcttcggcgccatctacggagcggctttttccggcgtgtcttggacaatgaaaattctgatcggggtgattatcacctggatcggaatgaacagccggtccaccagcctgtctgtttcccttgtcctcgtgggcgtggtcacactgtatctgggggccatggtgcaggccgacagcggatgtgttgtgtcttggaagaataaagaactcaagtgcggctccgggattttcatcaccgataacgtccacacatggacggagcagtacaagtttcaacctgaaagcccctccaaactggcttctgccattcagaaggctcatgaggaaggcatctgtggaattagaagcgtgacccgccttgagaatctgatgtggaaacagatcacaccggagctcaaccacatcctgtccgaaaatgaggttaagctgaccattatgacaggcgacatcaaagggattatgcaggccggaaagcggtctcttagacctcaacccaccgaactcaaatatagctggaagacgtggggcaaggcgaaaatgctgtccaccgagagccataaccagacattcctgatcgatgggcctgaaaccgccgagtgccccaatacaaaccgcgcttggaactctctcgaggtggaagactacggatttggcgtcttcaccacaaacatttggctgaaacttcgggagaaacaggacgtgttttgtgattccaagctgatgagcgccgctatcaaagacaatagagccgttcacgcggatatgggctattggatcgaatctgccctcaacgacacctggaagatggagaaggcttccttcattgaggtgaaaagctgccactggcctaagtctcatacgctgtggagcaatggggtcctggaatccgagatgatcattcccaaaaacttcgccggaccggtgagccagcacaactaccgccctggctatcatacacaaaccgctgggccctggcaccttggaaagctcgaaatggattttgacttctgtgagggcaccacagtggtcgttaccgaagattgcgggaatcggggaccctctctgagaacgacaaccgcctccggcaaactgatcacagagtggtgctgtcggagctgcaccctccctccgctgcgctacagaggcgaggacgggtgttggtacggaatggaaattcggccccttaaggagaaggaagagaacctggtgaatagcctcgtgacagccggccatgggcagatcgataacttttctctgggagtcctgggcatggctcttttcctcgaagagatgctgagaacccgcgtggggacgaaacacgcgattctgctcgttgccgtgagctttgtcaccctgatcacaggaaatatgtccttccgggaccttggcagagtgatggttatggtgggcgctaccatgacagatgacatcgggatgggagtcacctatctggccctcctggccgcttttaaggtgcgccctacgttcgccgcgggcctgcttctgagaaaactcacatctaaggagctgatgatggctaccattggggttgccctcctgagccagtccacaatccccgaaaccattcttgagctgaccgatgccctcgctctgggaatgatggccctgaaaatcgtgaagaacatggaaaagtaccaacttgcggtcacaattatggctatctcttgcgtgcctaatgccgtgatcctgcagaacgcctggaaagtcagctgtacgattctcgctgccgtttccgtgagccccctgctcctgacctcttcccagcagaaggctgactggatccctcttgccctgacaattaaaggcctcaatcccaccgcgatctttctgacaaccctgagccggacgtctaagaaacgctcctggccgcttaacgaggccattatggctgtggggatggtcagcatcctggcctcttccctcctgaagaatgacatccctatgacaggacccctcgtggctggcggcctgcttaccgtttgctatgtgctgaccgggagaagcgccgatctggaactcgagcgggccgctgacgtcaaatgggaggatcaagcggaaatttccggaagctctcctatcctgagcattacaatctccgaggacggctctatgagcattaagaacgaagaggaggaacagacccttacaatcctgattcgcacggggctcctggtgatctccggagttttccccgtgtctatcccgattaccgccgctgcctggtacctctgggaggtcaagaaacagagagccggcgtgctgtgggatgtcccttctccccctcccgtggggaaggctgaacttgaggacggagcctatcggatcaaacagcgcggcattctgggctactcccaaatcggggcgggagtttataaggaaggcacatttcacaccatgtggcatgtgacaagaggggctgtcctgatgcaccggggaaaacgcattgagccctcctgggccgatgtgaagaaggacctcgttagctacggcgggggatggaaactggagggcgaatggaaggagggcgaagaggtgcaggtccttgccctggaacctgggaaaaatccgagagctgtgcagaccaagcccggaatcttcaaaacgaacaccggcaatatcggggccgtgtccctcgattttagccctggaacatctggctcccccattgttgaccggaaggggaaggtcgtgggactgtacggcaacggcgtggtcaccagaagcggggcgtatgtgtctgctatcgcccagacagagaaatccattgaggataaccctgaaatcgaggacgatattttccgcaagaaacggctcaccatcatggacctgcatcccggagccggcaagacaaaaagataccttcctgctatcgttcgcgaagccattaagcgggggctgagaacgctgatcctcgctccgacccgcgtggtcgccgcggagatggaagaggccctgcggggacttcccattagatatcaaacccctgctatccgcgccgagcacaccggccgggaaattgtggacctgatgtgtcatgctaccttcacaatgagactcctgagccccgttcgggtgcctaattacaacctcatcattatggatgaggcccactttacggaccccgcctccatcgctgcgcgcgggtatatctctaccagagtcgaaatgggcgaggccgctggaattttcatgacagccaccccgcctggcagccgggatccctttccccagtccaatgcccctatcatggacgaggaacgcgagattcccgaaagaagctggaactctgggcacgagtgggtgacagatttcaagggaaaaaccgtttggtttgtgccttccatcaaggctggcaatgacattgccgcgtgcctgcggaaaaacgggaagaaagtcatccagcttagcagaaagacgttcgattctgaatacgtgaagacacgcgctaatgactgggattttgtggtcaccaccgacatcagcgagatgggagccaacttcaaagccgagcgggttattgatccgagacgctgtatgaagcccgtgatcctgacagacggcgaggaacgggtgattctggctgggcctatgcccgtcacccattcctctgccgcgcaaagacgcggccggatcggaagaaatcctaaaaacgaaaatgaccagtatatttacatgggcgagcccctcgaaaacgatgaggactgcgcccactggaaggaggctaaaatgctgcttgataatatcaacacaccggaagggatcattcctagcatgtttgagcccgaacgcgagaaggtggacgccatcgatggagaatacagactgcggggcgaggctcgcaaaaccttcgttgacctcatgagaagaggggatctgcctgtgtggctggcctataaggtcgctgccgagggaattaattacgcggaccgcagatggtgttttgatggcatcaagaacaaccagattctcgaagagaatgtggaagttgagatctggacgaaagagggggaacggaagaaacttaagcccagatggctggacgcccgcatttattccgatcctctggctctcaaagagttcaaggagttcgccgctggccggaagtctctgacacttaacctgatcaccgagatgggaagactccccacatttatgacccagaaagcccgcaatgccctggacaacctggctgtgctccatacggcggaagccggcgggaaggcttacaatcacgcccttagcgagctgccggagaccctggaaacactcctgcttctgaccctcctggccacagtcaccggaggcatcttcctgtttctcatgtccgggaaaggaattggcaagatgacacttggcatgtgctgcatcattaccgctagcatcctgctgtggtatgcccaaattcagcctcactggatcgcggcctctatcattctcgagttctttctgatcgtgcttctgattcccgaacccgagaaacagcggacgcctcaggataaccaactcacatacgtcgtgatcgctattctgaccgttgtggccgctaccatggccaatgaaatggggttcctggagaagacaaagaaagacctcggacttggctccatcaccacacaggagagcgaatccaacatcctggacattgatctgagaccggcgtctgcctggacgctctatgctgtggccaccacatttgtcacccccatgctgcggcatagcatcgaaaattcctctgttaacgtgagccttacagctattgccaatcaggctaccgtgctgatggggctcggaaagggctggcctctgtccaaaatggacatcggggcgcccctgctcgcgattggatgttacagccaggtcaaccctatcacgcttaccgccgctctgctgctcctggtggcccactacgctattatcggccccggccttcaagccaaggccacacgcgaagcgcagaaaagagctgccgctgggatcatgaagaatcctaccgttgatggaattacagtgatcgacctggagccgattccctatgatcctaagttcgaaaaacagctcggccaggtcatgctgctgatcctctgcgtgacccaagtccttatgatgcggacgacatgggccctgtgtgaggccctgaccctcgctacagggcccatttctaccctgtgggagggaaaccctggccgcttttggaataccacaatcgccgtgtccatggcgaacatcttcagagggagctaccttgccggagctggcctgctcttttctattatgaagaatacgaccaacacacggcgcggcaccgggaacatcggagaaacactgggcgagaaatggaagtccagactgaatgccctcgggaaaagcgagttccagatttataagaaatctggaatccaggaggttgaccggacccttgctaaggagggcattaagcgcggggaaacggatcatcacgccgtgagcagaggatccgcgaaactgcggtggtttgtcgagagaaacatggtgacacccgaaggcaaggttgtggacctgggctgcgggcgcggaggctggtcttactattgtgggggactcaaaaatgtccgggaggtgaagggcctgaccaaagggggaccgggccatgaagaacctatccccatgagcacctacggctggaaccttgtgagactgcaatccggggttgatgtcttcttcacaccccctgagaagtgcgacaccctcctgtgtgatatcggagaaagctcccccaatcctacaattgaggccggccgcacgctgcgggtgctcaaccttgtggaaaattggctgaacaataacacccagttttgcatcaaggtcctgaatccgtatatgccctctgttattgagaaaatggaaacactccagagaaagtacgggggagctctggtgcgcaaccctcttagcagaaattccacccacgagatgtactgggtgtctaacgccacaggcaatatcgtcagctccgtgaacatgatttctagaatgctgatcaaccgcttcaccatgaaacacaagaaagctacgtatgagcccgacgttgatctcgggagcggaacccggaatatcggcattgaatccgagatccctaacctggacattatcggcaagagaattgaaaagatcaaacaggagcatgaaacaagctggcactacgaccaagatcatccctataagacctgggcctaccacgggtcttatgagacaaaacagaccggatccgctagctctatggtgaatggcgtcgtgcgcctgctcacaaagccgtgggacgttgtgcctatggtcacccagatggccatgacggatacaaccccctttgggcagcaacgggtgttcaaagagaaggtggacaccagaacacaggaacctaaggagggaacgaagaaacttatgaaaattaccgcggaatggctgtggaaagagctgggcaaaaagaaaatcccccgcatgtgtacaagagaggaatttacccggaaggtccgctccaacgccgctctcggggccatcttcacagatgagaataagtggaaaagcgctagagaagccgttgaggacggacggttttgggaactggtggatagagagcggaaccttcacctggagggcaagtgcgaaacctgtgtgtacaatatgatgggcaaacgcgagaagaaactcggggagttcggaaaggccaagggctctagagcgatttggtatatgtggctgggggctcggtttctggagttcgaagccctcggatttctgaacgaggaccattggttctcccgcggcaatagcctttccggggtcgagggcgaaggactgcacagactcggctacatcctgcgggatgtgagcaaaaaggaagggggagccatgtacgctgacgatacagccggctgggacacccgcattacgcttgaagacctgaaaaacgaggaaatggttaccaatcatatgaagggggagcacaaaaagctcgctgaggccatctttaagctgacatatcagaacaaagtggtcagagtgcagcggcctacaccccgcggaacagttatggatattatctctagacgggaccaacgcggcagcggacaggtgggcacctacggactgaatacgttcacaaacatggaagcgcagctcatcagacaaatggagggcgaagggattttcaagtccatccagcatctgaccgtcacagaggagattgccgtgcagaattggcttgctcgggttggacgcgaaagactgacccggatggccatctctggcgatgactgcgtggtcaaaccgattgatgacagatttgctaacgccctcacggcgctgaacgatatggggaaggtgcgcaaagacatccagcaatgggagcctagccggggatggaatgattggacccaggtccccttctgctcccaccactttcatgaacttgtgatgaaggacggcagagttctggtggtcccctgtcgcaaccaggatgagctcatcgggcgggccagaatttctcagggcgctggatggagcctgaaggaaacagcctgcctgggcaaatcctatgctcaaatgtggaccctcatgtacttccaccgccgggacctgagacttgccgctaatgccatctgttctgcggtgcctagccattgggtgccgacatcccgcaccacatggagcattcacgccaagcacgagtggatgaccacggaggatatgctggctgtttggaaccgggtgtggatccaggaaaatccctggatggaggacaaaacacctgtcgaatcttgggaggaagtgccctatctcgggaagagagaggaccagtggtgcggatccctgattggccttaccagccgcgccacctgggccaaaaacatccagacagctattaatcaagttcggtctctgatcgggaacgaggaatacaccgattatatgccttccatgaagagatttcggagagaggaagaggaagccggagtgctctggtga

SEQ ID NO: 19634 - RNA, 9876 nt, synthetic construct
  misc_feature 1..9876: note = derived and/or modified CDS sequence (opt5) from DENV-2__FJ850074__SS-prME
  source 1..9876: mol_type = other RNA
accgccggagtgatcgttatgctgattcccacagttatggctttccacctcacgacccggaacggggagcctcatatgatcgtgggacggcaggaaaagggcaagagcctgctttttaagacagaggacggggtgaatatgtgcaccctgatggccattgatctcggagaactgtgtgaggacacaatcacctacaagtgcccccttctgcgccaaaacgaacccgaggatattgactgttggtgcaattccacatctacctgggtcacgtatggcacctgtacaaccacaggggagcacagacgggaaaagcgcagcgtggcgctcgttcctcatgtgggaatgggcctggagaccagaacggaaacatggatgtcctctgagggcgcttggaagcacgtccagcggatcgagacctggatcctgcgccatcccgggttcacaatgatggccgccattctcgcttacaccatcggaaccacacactttcagagagccctgattttcatccttctgacggctgtggcccctagcatgaccatgcggtgcattggcatctccaaccgcgattttgttgaaggggtgtctggaggcagctgggtcgacattgtgctcgagcacgggtcctgtgtgacaaccatggcgaagaataagcccacactggatttcgaacttatcaagaccgaggccaagcagcctgctacgctgagaaaatattgcgtcgaagccaagctcacaaacaccaccacagagagccggtgtccgacccaaggagagccctctctgaatgaggaacaggacaaacgctttatctgcaagcattccatggttgatagaggctggggcaacgggtgtggactgttcggcaaaggcgggattgtgacatgcgctatgtttacgtgcaaaaagaatatggaagggaaagtggtccagcctgagaacctcgaatacaccatcgtgattacaccccacagcggggaggagcatgccgttggaaatgacaccggcaagcacggcaaagaaatcaagattacacctcagtcttccatcaccgaggcggaactgacggggtatggaaccgtgacaatggagtgtagcccccggaccggccttgatttcaacgaaatggtcctgctccaaatggaggacaaagcctggctggtgcaccgccagtggtttcttgatctgccgctcccttggctgcccggggctgacacacagggatctaattggatccagaaggagaccctggttacgttcaagaaccctcatgccaaaaagcaagacgtggtcgtgctcggctcccaggaaggggctatgcacacagccctgaccggcgccacagagattcagatgagctccggaaatcttctgtttaccggccatctcaaatgcagactgcggatggataaacttcaactgaaagggatgtcttacagcatgtgtaccggaaagttcaagatcgtcaaagaaattgctgagacacagcacggcacgatcgtgattagagttcagtatgagggggacggatccccctgcaagatccccttcgaaatcatggatctcgagaaacgccatgtgctgggccggctgattaccgtcaaccctatcgtgacagaaaaggacagcccggttaacattgaggcggaacccccttttggggattcttacatcattatcggcgtggagcccggacagctcaaactgaattggttcaagaagggctccagcattgggcaaatgtttgagaccacaatgagaggagccaaacgcatggctatccttggcgacaccgcctgggatttcgggtctctgggaggcgtctttacgagcatcgggaaggccctccaccaggtgttcggcgctatttacggagccgcgttttccggcgtgtcttggacaatgaaaatcctgattggggttatcattacctggatcggaatgaacagccggtccaccagcctgtctgtctcccttgtgctcgtgggcgtcgtgacactgtatctgggggctatggttcaggccgacagcggatgtgtggtctcttggaagaataaagaactcaagtgcggctccgggatcttcattaccgataacgtgcacacatggacggagcagtacaagtttcaacctgaaagcccctccaaactggcctctgctatccagaaggcccatgaggaaggcatttgtggaatcagaagcgttacccgccttgagaatctgatgtggaaacagattacaccggagctcaaccacatcctgtccgaaaatgaggtgaagctgaccatcatgacaggcgacattaaagggatcatgcaggctggaaagcggtctcttagacctcaacccaccgaactcaaatatagctggaagacgtggggcaaggccaaaatgctgcctaccgagtcccataaccagacattcctgattgatgggcccgaaaccgcggagtgccctaatacaaaccgcgcctggaatagcctcgaggtcgaagactacggatttggcgtgttcaccacaaacatctggctgaaacttcgggagaaacaggacgtcttttgtgattctaagctgatgtccgctgccattaaagacaatagagctgtgcacgccgatatgggctattggatcgaaagcgcgctcaacgacacctggaagatggagaaggcctctttcatcgaggtcaaatcctgccactggcccaagagccatacgctgtggtctaatggggtgctggaaagcgagatgattatcccgaaaaacttcgctggacctgtgtcccagcacaactaccgccccggctatcatacacaaaccgccgggccctggcaccttggaaagctcgaaatggattttgacttctgtgagggcaccacagtcgttgtgaccgaagattgcgggaatcggggacctagcctgagaacgacaaccgcttctggcaaactgattacagagtggtgctgtcggtcctgcaccctcccgcccctgcgctacagaggcgaggacgggtgttggtacggaatggaaatccggcctcttaaggagaaggaagagaacctggtgaatagcctcgtcacagccggccatgggcagattgataacttttccctgggagtgctgggcatggcccttttcctcgaagagatgctgagaacccgcgttgggacgaaacacgctatcctgctcgtggcggtctcttttgtgaccctgattacaggaaatatgagcttccgggaccttggcagagttatggtgatggtcggcgccaccatgacagatgacatcgggatgggagtgacctatctggctctcctggccgcctttaaggttcgccccacgttcgctgccggcctgcttctgagaaaactcacatccaaggagctgatgatggcgaccatcggggtggctctcctgtctcagagcacaattcctgaaaccatccttgagctgaccgatgccctcgccctgggaatgatggctctgaaaattgtcaagaacatggaaaagtaccaacttgccgtgacaatcatggcgatttcctgcgtgcccaatgctgtcatcctgcagaacgcctggaaagtttcttgtacgatcctcgccgctgtgagcgtgtcccctctgctcctgaccagctctcagcagaaggccgactggattccccttgctctgacaatcaaaggcctcaatccgaccgccatttttctgacaaccctgtcccggacgagcaagaaacgctcttggcctcttaacgaggcgatcatggccgtcgggatggtgtccattctggctagctctctcctgaagaatgacatccccatgacaggacctctcgttgccggcggcctgcttaccgtgtgctatgtcctgaccgggagatccgctgatctggaactcgagcgggccgccgacgtgaaatgggaggatcaagctgaaatcagcggatccagccccattctgtctatcacaattagcgaggacggctccatgtctatcaagaacgaagaggaggaacagacccttacaattctgatccgcacggggctcctggttattagcggagtgttcccggtctccatccctatcaccgcggccgcttggtacctctgggaggtgaagaaacagagagccggcgtcctgtgggatgtgccctctcctccgcccgttgggaaggccgaacttgaggacggagcttatcggattaaacagcgcggcatcctgggctacagccaaattggggccggagtgtataaggaaggcacatttcacaccatgtggcatgtcacaagaggggcggtgctgatgcaccggggaaaacgcatcgagccttcctgggctgatgttaagaaggacctcgtgtcttacggcgggggatggaaactggagggcgaatggaaggagggcgaagaggtccaggtgcttgccctggaaccggggaaaaatcccagagccgtgcagaccaagcctggaattttcaaaacgaacaccggcacaatcggggctgttagcctcgatttttcccccggaaccagcggctctcctatcgtcgaccggaaggggaaggtggtgggactgtacggcaatggcgtcgtgacaagatccggggcctatgttagcgcgattgctcagaccgagaaatctatcgaggataaccccgaaattgaggacgatatcttccgcaagaaacggctcacaattatggacctgcatcctggagccggcaagacgaaaagataccttccggccatcgtgcgcgaagctatcaagcgggggctgagaaccctgattctcgcccccacacgcgtcgtggctgccgagatggaagaggcgctgcggggacttcctatcagatatcaaacccccgccattcgcgctgagcacaccggccgggaaatcgttgacctgatgtgtcatgccacattcacgatgagactcctgtcccctgtgcgggtccccaactacaatctcattatcatggatgaggctcactttaccgacccggccagcattgccgctcgcgggtatatctccacaagagtggaaatgggcgaggcggccggaatcttcatgaccgctacacctcccggctctcgggatccctttcctcagagcaacgcccccattatggacgaggaacgcgagatccctgaaagatcctggaatagcgggcacgagtgggttaccgatttcaagggaaaaacggtgtggtttgtcccgtctattaaggccggcaacgacatcgctgcctgcctgcggaaaaatgggaagaaagtgattcagctttccagaaagacattcgatagcgaatacgtgaagacccgctctaacgactgggattttgtcgttaccacagacatcagcgagatgggagcgaatttcaaagctgagcgggtgatcgatcccagacgctgtatgaagcctgtgattctgaccgacggcgaagaacgggtcatcctggccgggcccatgcctgtgacacattcctctgccgctcaaagacgcggccggattggaagaaaccccaaaaatgaaaacgaccagtatatctacatgggcgagccgctcgaaaatgatgaggactgcgcccactggaaggaggcgaaaatgctgcttgataacattaatacccctgaagggatcatccccagcatgtttgagcctgaacgcgagaaggttgacgccattgatggagaatacagactgcggggcgaggctcgcaaaacgttcgtggacctcatgagaagaggggatctgcccgtctggctggcctataaggtggctgccgagggaatcaactacgctgaccgcagatggtgttttgatggcattaagaataaccagatcctcgaagagaacgttgaagtggagatttggacaaaagagggggaacggaagaaacttaagcctagatggctggacgcccgcatctattccgatcccctggcgctcaaagagttcaaggagttcgccgctggccggaagtctctgacccttaatctgattacagagatgggaagactcccgacctttatgacgcagaaagcccgcaacgctctggacaatctggccgtcctccataccgccgaagctggcgggaaggcgtacaaccacgcccttagcgagctgcctgagacactggaaaccctcctgcttctgacactcctggctaccgtgacaggaggcatcttcctgtttctcatgtccgggaaaggaatcggcaagatgacccttggcatgtgctgcattatcacggccagcattctgctgtggtatgcccaaatccagccccactggattgctgcctctatcatcctcgagttctttctgattgtccttctgatccccgaacctgagaaacagcggacaccgcaggataatcaactcacctacgtggttattgcgatcctgaccgtggtggccgctacaatggccaacgaaatggggttcctggagaagaccaagaaagacctcggacttggctccattacaacgcaggagagcgaatccaatatcctggacatcgatctgagacccgcttctgcctggaccctctatgcggtcgccacaacctttgttacacctatgctgcggcatagcattgagaactcctctgtgaatgtgagccttaccgctatcgccaaccaggctacggtcctgatggggctcggaaagggctggcccctgtccaaaatggacattggggtgcctctgctcgccatcggatgttacagccaggttaatcccattacccttacagctgccctgctgctcctggtggcgcactacgccatcattggccctggccttcaagctaaggccacccgcgaagctcagaaaagagccgccgcggggatcatgaagaacccgacagtcgatggaatcaccgtgattgacctggagcccatcccttatgatcccaagttcgaaaaacagctcggccaggtcatgctgctgattctctgcgtgacgcaagttcttatgatgcggacaacctgggctctgtgtgaggccctgacactcgctaccgggcctatctctaccctgtgggagggaaatcccggccgcttttggaacacaacgattgccgtgtccatggccaatatcttcagagggagctaccttgctggagccggcctgctcttttctatcatgaagaacaccacaaatacccggcgcggcacagggaacattggagaaaccctgggcgagaaatggaagtccagactgaacgcgctcgggaaaagcgagttccagatctataagaaatctggcattcaggaggtcgaccggacgcttgccaaggagggcatcaagcgcggggaaacagatcatcacgctgtgagcagaggatccgccaaactgcggtggtttgttgagagaaatatggtgaccccggaaggcaaggtcgtggacctgggctgcgggcgcggaggctggtcttactattgtgggggactcaaaaacgtgcgggaggttaagggcctgaccaaagggggacctggccatgaagaacccattcccatgagcacatacggctggaatcttgtcagactgcaatccggggtggatgtgttcttcacccctcccgagaagtgcgacacactcctgtgtgatatcggagaaagctcccctaacccgacgatcgaggctggccgcaccctgcgggtcctcaatcttgttgaaaactggctgaataacaatacacagttttgcattaaggtgctgaacccctatatgccttctgtgatcgagaaaatggaaaccctccagagaaagtacgggggagccctggtccgcaatccccttagccggaactccacacacgagatgtactgggtgtctaatgcgaccggcaacattgttagctccgtgaatatgatctctagaatgctgattaaccgcttcacgatgaaacacaagaaagccacctatgagcctgacgtcgatctcgggagcggaacacggaacatcggcatcgaatccgagattcccaatctggacatcattggcaagagaatcgaaaagattaaacaggagcatgaaaccagctggcactacgaccaagatcatccgtataagacatgggcttaccacgggtcttatgagaccaaacagacaggatccgccagctctatggtgaacggcgttgtgcgcctgctcaccaagccttgggacgtcgtgcccatggtgacgcagatggctatgacagataccaccccttttgggcagcaacgggtcttcaaagagaaggttgacacaagaacgcaggaacccaaggagggaaccaagaaacttatgaaaatcacagccgaatggctgtggaaagagctgggcaaaaagaaaacccctcgcatgtgtacaagagaggaatttacccggaaggtgcgctccaatgctgccctcggggcgattttcacagatgagaacaagtggaaaagcgccagagaagctgtggaggacggacggttttgggaactggtcgatagagagcggaatcttcacctggagggcaagtgcgaaacctgtgtgtacaacatgatgggcaaacgcgagaagaaactcggggagttcggaaaggccaagggctctagagctatctggtatatgtggctgggggcccggtttctggagttcgaagccctcggatttctgaatgaggaccattggttctcccgcggcaacagcctttccggggttgagggcgaaggactgcacagactcggctacatcctgcgggatgtgagcaaaaaggaagggggagcgatgtacgctgacgatacggccggctgggacacccgcattacacttgaagacctgaaaaatgaggaaatggtcaccaaccatatgaagggggagcacaaaaagctcgccgaggctatctttaagctgacatatcagaataaagtggttagagtgcagcggcccaccccgcgcggaacggtcatggatattatctctagacgggaccaacgcggcagcggacaggtgggcacatacggactgaacaccttcacaaatatggaagcccagctcattagacaaatggagggcgaagggatcttcaagtccatccagcatctgaccgttacggaggagattgctgtgcagaactggcttgcccgggtcggacgcgaaagactgacccggatggcgatctctggcgatgactgcgtggtcaaacctattgatgacagatttgccaatgctctcacagccctgaacgatatggggaaggtgcgcaaagacatccagcaatgggagcccagccggggatggaacgattggacccaggttcccttctgctcccaccactttcatgaacttgtgatgaaggacggcagagtcctggtggtgccttgtcgcaatcaggatgagctcattgggcgggctagaatctctcagggcgccggatggagcctgaaggaaacagcgtgcctgggcaaatcctatgcccaaatgtggaccctcatgtacttccaccgccgggacctgagacttgctgccaacgctatctgttctgccgttccgagccattgggtgcccacatcccgcaccacgtggagcattcacgctaagcacgagtggatgacaaccgaggatatgctggccgtctggaatcgggtgtggatccaggaaaacccttggatggaggacaaaacccccgttgaatcttgggaggaagtgccttatctcgggaagagagaggaccagtggtgcggatccctgattggccttacaagccgcgcgacctgggccaaaaatatccagacagctattaaccaagtccggtctctgatcgggaatgaggaatacacggattatatgccctccatgaagagatttcggagagaggaagaggaagccggagtgctctggtga

SEQ ID NO: 19635 - RNA, 9876 nt, synthetic construct
  misc_feature 1..9876: note = derived and/or modified CDS sequence (opt5) from DENV-2__FJ850076__SS-prME
  source 1..9876: mol_type = other RNA
accgccggcgctatcgtgatgctgattcccacagtcatggccttccacctcacgacccggaacggggagcctcatatgatcgttggacggcaggaaaagggcaagagcctgctttttaagacagaggacggggtgaatatgtgcaccctgatggcgattgatctcggagaactgtgtgaggacacaatcacctacaagtgcccccttctgcgccaaaacgaacccgaggatattgactgttggtgcaattccacatctacctgggtgacgtatggcacctgtacaaccacaggggagcacagacgggaaaagcgcagcgtcgctctcgtgcctcatgttggaatgggcctggagaccagaacggaaacatggatgtcctctgagggcgcctggaagcacgtgcagcggatcgagacctggatcctgcgccatcccgggttcacaatgatggccgctattctcgcctacaccatcggaaccacacactttcagagagctctgattttcatccttctgacggccgtcgcgcctagcatgaccatgcggtgcattggcatctccaaccgcgattttgtggaaggggtttctggaggcagctgggtggacattgtcctcgagcacgggtcctgtgtgacaaccatggccaagaataagcccacactggatttcgaacttatcaaaaccgaggctaagcagcctgccacgctgagaaaatattgcgtggaagctaagctcacaaacaccaccacagagagccggtgtccgacccaaggagagccctctctgaatgaggaacaggacaaacgctttatctgcaagcattccatggtcgatagaggctggggcaacgggtgtggactgttcggcaaaggcgggattgttacatgcgccatgtttacgtgcaaaaagaatatggaagggaaagtggtgcagcctgagaacctcgaatacaccatcgtcattacaccccacagcggggaggagcatgcggtgggaaatgacaccggcaagcacggcaaagaaatcaagattacacctcagtcttccatcaccgaggccgaactgacggggtatggaaccgttacaatggagtgtagcccccggaccggccttgatttcaacgaaatggtgctgctccaaatggaggacaaggcttggctggtccaccgccagtggtttcttgatctgccgctcccttggctgcccggggccgacacacagggatctaattggatccagaaggagaccctggtgacgttcaagaaccctcatgctaaaaagcaagacgttgtggtcctcggctcccaggaaggggccatgcacacagccctgaccggcgctacagagattcagatgagctccggaaatcttctgtttaccggccatctcaaatgcagactgcggatggataaacttcaactgaaagggatgtcttacagcatgtgtaccggaaagttcaagatcgtgaaagaaattgcggagacacagcacggcacgatcgtcattagagtgcagtatgagggggacggatccccctgcaagatccccttcgaaatcatggatctcgagaaacgccatgttctgggccggctgattaccgtgaaccctatcgtcacagaaaaggacagcccggtgaacattgaggccgaacccccttttggggattcttacatcattatcggcgttgagcccggacagctcaaactgaattggttcaagaagggctccagcattgggcaaatgtttgagaccacaatgagaggagctaaacgcatggccatccttggcgacaccgcctgggatttcgggtctctgggaggcgtgtttacgagcatcgggaaggctctccaccaggtcttcggcgccatttacggagcggctttttccggcgtgtcttggacaatgaaaatcctgattggggtgatcattacctggatcggaatgaacagccggtccaccagcctgtctgtttcccttgtcctcgtgggcgtggtcacactgtatctgggggccatggtgcaggccgacagcggatgtgttgtgtcttggaagaataaagaactcaagtgcggctccgggatcttcattaccgataacgtccacacatggacggagcagtacaagtttcaacctgaaagcccctccaaactggcttctgccatccagaaggctcatgaggaaggcatttgtggaatcagaagcgtgacccgccttgagaatctgatgtggaaacagattacaccggagctcaaccacatcctgtccgaaaatgaggttaagctgaccatcatgacaggcgacattaaagggatcatgcaggccggaaagcggtctcttagacctcaacccaccgaactcaaatatagctggaagacgtggggcaaggcgaaaatgctgcctaccgagtcccataaccagacattcctgattgatgggcccgaaaccgccgagtgccctaatacaaaccgcgcttggaatagcctcgaggtggaagactacggatttggcgtcttcaccacaaacatctggctgaaacttcgggagaaacaggacgtgttttgtgattctaagctgatgtccgccgctattaaagacaatagagccgttcacgcggatatgggctattggatcgaaagcgccctcaacgacacctggaagatggagaaggcttctttcatcgaggtgaaatcctgccactggcccaagagccatacgctgtggtctaatggggtcctggaaagcgagatgattatcccgaaaaacttcgccggacctgtgtcccagcacaactaccgccccggctatcatacacaaaccgctgggccctggcaccttggaaagctcgaaatggattttgacttctgtgagggcaccacagtggtcgttaccgaagattgcgggaatcggggacctagcctgagaacgacaaccgcctctggcaaactgattacagagtggtgctgtcggtcctgcaccctcccgcccctgcgctacagaggcgaggacgggtgttggtacggaatggaaatccggcctcttaaggagaaggaagagaacctggtgaatagcctcgtgacagccggccatgggcagattgataacttttccctgggagtcctgggcatggctcttttcctcgaagagatgctgagaacccgcgtggggacgaaacacgcgatcctgctcgttgccgtgtcttttgtcaccctgattacaggaaatatgagcttccgggaccttggcagagtgatggttatggtgggcgctaccatgacagatgacatcgggatgggagtcacctatctggccctcctggccgcttttaaggtgcgccccacgttcgccgcgggcctgcttctgagaaaactcacatccaaggagctgatgatggctaccatcggggttgccctcctgtctcagagcacaattcctgaaaccatccttgagctgaccgatgccctcgctctgggaatgatggccctgaaaattgtgaagaacatggaaaagtaccaacttgcggtcacaatcatggctatttcctgcgtgcccaatgccgtgatcctgcagaacgcctggaaagtctcttgtacgatcctcgctgccgttagcgtgtcccctctgctcctgaccagctctcagcagaaggctgactggattccccttgccctgacaatcaaaggcctcaatccgaccgcgatttttctgacaaccctgtcccggacgagcaagaaacgctcttggcctcttaacgaggccatcatggctgtggggatggtctccattctggccagctctctcctgaagaatgacgtgcccatgacaggacctctcgttgctggcggcctgcttaccgtgtgctatgtcctgaccgggagatccgccgatctggaactcgagcgggccgctgacgtgaaatgggaggatcaagcggaaatcagcggatccagccccatcctgtctattacaatcagcgaggacggctccatgtctattaagaacgaagaggaggaacagacccttacaatcctgattcgcacggggctcctggttatcagcggagtgttcccggtctccattcctatcaccgccgctgcctggtacctctgggaggtgaagaaacagagagccggcgtcctgtgggatgtgccctctcctccgcccgttgggaaggctgaacttgaggacggagcctatcggatcaaacagcgcggcattctgggctacagccaaatcggggcgggagtgtataaggaaggcacatttcacaccatgtggcatgtcacaagaggggctgtgctgatgcaccggggaaaacgcattgagccttcctgggccgatgttaagaaggacctcgtgtcttacggcgggggatggaaactggagggcgaatggaaggagggcgaagaggtccaggtgcttgccctggaaccggggaaaaatcccagagctgtgcagaccaagcctggaatcttcaaaacgaacaccggcacaattggggccgttagcctcgatttttcccccggaaccagcggctctcctatcgtcgaccggaaggggaaggtggtgggactgtacggcaatggcgtcgtgacaagatccggggcgtatgttagcgctatcgcccagaccgagaaatctattgaggataaccccgaaatcgaggacgatattttccgcaagaaacggctcacaatcatggacctgcatcctggagccggcaagacgaaaagataccttccggctattgtgcgcgaagccatcaagcgggggctgagaaccctgatcctcgctcccacacgcgtcgtggccgcggagatggaagaggccctgcggggacttcctattagatatcaaacccccgctatccgcgccgagcacaccggccgggaaattgttgacctgatgtgtcatgctacattcacgatgagactcctgtcccctgtgcgggtccccaactacaatctcatcattatggatgaggcccactttaccgacccggccagcatcgctgcgcgcgggtatatttccacaagagtggaaatgggcgaggccgctggaatcttcatgaccgccacacctcccggctctcgggatccctttcctcagagcaacgcccccatcatggacgaggaacgcgagattcctgaaagatcctggaatagcgggcacgagtgggttaccgatttcaagggaaaaacggtgtggtttgtcccgtctatcaaggctggcaacgacattgccgcgtgcctgcggaaaaatgggaagaaagtgatccagctttccagaaagacattcgatagcgaatacgtgaagacccgctctaacgactgggattttgtcgttaccacagacattagcgagatgggagctaatttcaaagccgagcgggtgatcgatcccagacgctgtatgaagcctgtgatcctgaccgacggcgaagaacgggtcattctggccgggcccatgcctgtgacacattcctctgctgcccaaagacgcggccggatcggaagaaaccccaaaaatgaaaacgaccagtatatttacatgggcgagccgctcgaaaatgatgaggactgcgcgcactggaaggaggccaaaatgctgcttgataacatcaatacccctgaagggattatccccagcatgtttgagcctgaacgcgagaaggttgacgctatcgatggagaatacagactgcggggcgaggcccgcaaaacgttcgtggacctcatgagaagaggggatctgcccgtctggctggcttataaggtggccgctgagggaattaactacgccgaccgcagatggtgttttgatggcatcaagaataaccagattctcgaagagaacgttgaagtggagatctggacaaaagagggggaacggaagaaacttaagcctagatggctggacgcgcgcatttattccgatcccctggccctcaaagagttcaaggagttcgctgccggccggaagtctctgacccttaatctgatcacagagatgggaagactcccgacctttatgacgcagaaagctcgcaacgccctggacaatctggccgtcctccataccgctgaagcgggcgggaaggcctacaaccacgctcttagcgagctgcctgagacactggaaaccctcctgcttctgacactcctggccaccgtgacaggaggcattttcctgtttctcatgtccgggaaaggaatcggcaagatgacccttggcatgtgctgcatcattacggccagcatcctgctgtggtatgctcaaattcagccccactggatcgccgcgtctattatcctcgagttctttctgatcgtccttctgattcccgaacctgagaaacagcggacaccgcaggataatcaactcacctacgtggttatcgccattctgaccgtggtggctgccacaatggctaacgaaatggggttcctggagaagaccaagaaagacctcggacttggctccatcacaacgcaggagagcgaatccaatattctggacatcgatctgagacccgcctctgcgtggaccctctatgccgtcgctacaacctttgttacacctatgctgcggcatagcatcgagaactcctctgtgaatgtgagccttaccgccattgctaaccaggccacggtcctgatggggctcggaaagggctggcccctgtccaaaatggacatcggggtgcctctgctcgctattggatgttacagccaggttaatcccatcacccttacagccgcgctgctgctcctggtggcccactacgctattatcggccctggccttcaagccaaggctacccgcgaagcccagaaaagagccgcggctgggattatgaagaacccgacagtcgatggaatcaccgtgatcgacctggagcccattccttatgatcccaagttcgaaaaacagctcggccaggtcatgctgctgatcctctgcgtgacgcaagttcttatgatgcggacaacctgggccctgtgtgaggctctgacactcgccaccgggcctatttctaccctgtgggagggaaatcccggccgcttttggaacacaacgatcgccgtgtccatggctaatattttcagagggagctaccttgccggagcgggcctgctcttttctatcatgaagaacaccacaaatacccggcgcggcacagggaacatcggagaaaccctgggcgagaaatggaagtccagactgaacgccctcgggaaaagcgagttccagatttataagaaatctggaatccaggaggtcgaccggacgcttgctaaggagggcattaagcgcggggaaacagatcatcacgccgtgagcagaggatccgctaaactgcggtggtttgttgagagaaatatggtgaccccggaaggcaaggtcgtggacctgggctgcgggcgcggaggctggtcttactattgtgggggactcaaaaacgtgcgggaggttaagggcctgaccaaagggggacctggccatgaagaacccatccccatgagcacatacggctggaatcttgtcagactgcaatccggggtggatgtgttcttcacccctcccgagaagtgcgacacactcctgtgtgatattggagaaagctcccctaacccgacgatcgaggccggccgcaccctgcgggtcctcaatcttgttgaaaactggctgaataacaatacacagttttgcatcaaggtgctgaacccctatatgccttctgtgattgagaaaatggaaaccctccagagaaagtacgggggagcgctggtccgcaatccccttagccggaactccacacacgagatgtactgggtgtctaatgccaccggcaacatcgttagctccgtgaatatgatttctagaatgctgatcaaccgcttcacgatgaaacacaagaaagctacctatgagcctgacgtcgatctcgggagcggaacacggaacattggcatcgaatccgagatccccaatctggacattatcggcaagagaattgaaaagatcaaacaggagcatgaaaccagctggcactacgaccaagatcatccgtataagacatgggcctaccacgggtcttatgagaccaaacagacaggatccgctagctctatggtgaacggcgttgtgcgcctgctcaccaagccttgggacgtcgtgcccatggtgacgcagatggccatgacagataccaccccttttgggcagcaacgggtcttcaaagagaaggttgacacaagaacgcaggaacccaaggagggaaccaagaaacttatgaaaattacagctgaatggctgtggaaagagctgggcaaaaagaaaacccctcgcatgtgtacaagagaggaatttacccggaaggtgcgctccaatgccgcgctcggggccatcttcacagatgagaacaagtggaaaagcgctagagaagccgtggaggacggacggttttgggaactggtcgatagagagcggaatcttcacctggagggcaagtgcgaaacctgtgtgtacaacatgatgggcaaacgcgagaagaaactcggggagttcggaaaggctaagggctctagagccatttggtatatgtggctgggggcccggtttctggagttcgaagcgctcggatttctgaatgaggaccattggttctcccgcggcaacagcctttccggggttgagggcgaaggactgcacagactcggctacatcctgcgggatgtgagcaaaaaggaagggggagctatgtacgccgacgatacggccggctgggacacccgcatcacacttgaagacctgaaaaatgaggaaatggtcaccaaccatatgaagggggagcacaaaaagctcgctgaggccatttttaagctgacatatcagaataaagtggttagagtgcagcggcccaccccgcgcggaacggtcatggatatcatttctagacgggaccaacgcggcagcggacaggtgggcacatacggactgaacaccttcacaaatatggaagctcagctcatcagacaaatggagggcgaagggattttcaagtccatccagcatctgaccgttacggaggagatcgccgtgcagaactggcttgcgcgggtcggacgcgaaagactgacccggatggccatttctggcgatgactgcgtggtcaaacctatcgatgacagatttgctaatgccctcacagctctgaacgatatggggaaggtgcgcaaagacattcagcaatgggagcccagccggggatggaacgattggacccaggttcccttctgctcccaccactttcatgaacttgtgatgaaggacggcagagtcctggtggtgccttgtcgcaatcaggatgagctcatcgggcgggccagaatttctcagggcgcgggatggagcctgaaggaaacagcctgcctgggcaaatcctatgctcaaatgtggaccctcatgtacttccaccgccgggacctgagacttgccgctaacgccatctgttctgctgttccgagccattgggtgcccacatcccgcaccacgtggagcatccacgccaagcacgagtggatgacaaccgaggatatgctggcggtctggaatcgggtgtggattcaggaaaacccttggatggaggacaaaacccccgttgaatcttgggaggaagtgccttatctcgggaagagagaggaccagtggtgcggatccctgatcggccttacaagccgcgccacctgggctaaaaatattcagacagccatcaaccaagtccggtctctgattgggaatgaggaatacacggattatatgccctccatgaagagatttcggagagaggaagaggaagccggagtgctctggtga

SEQ ID NO: 19636 - RNA, 9876 nt, synthetic construct
  misc_feature 1..9876: note = derived and/or modified CDS sequence (opt5) from DENV-2__GQ868640__SS-prME
  source 1..9876: mol_type = other RNA
accgccggagctatcgtgatgctgattcccacagtcatggccttccacctcacgacccggaacggggagcctcatatgatcgttggacggcaggaaaagggcaagagcctgctttttaagacagaggacggggtgaatatgtgcaccctgatggcgattgatctcggagaactgtgtgaggacacaatcacctacaagtgcccccttctgcgccaaaacgaacccgaggatattgactgttggtgcaattccacatctacctgggtgacgtatggcacctgtacaaccacaggggagcacagacgggaaaagcgcagcgtcgctctcgtgcctcatgttggaatgggcctggagaccagaacggaaacatggatgtcctctgagggcgcctggaagcacgtgcagcggatcgagacctggatcctgcgccatcccgggttcacaatgatggccgctattctcgcctacaccatcggaaccacacactttcagagagctctgattttcatccttctgacggccgtcgcgcctagcatgaccatgcggtgcattggcatctccaaccgcgattttgtggaaggggtttctggaggcagctgggtggacattgtcctcgagcacgggtcctgtgtgacaaccatggccaagaataagcccacactggatttcgaacttatcaaaaccgaggctaagcagcctgccacgctgagaaaatattgcgtggaagctaagctcacaaacaccaccacagagagccggtgtccgacccaaggagagccctctctgaatgaggaacaggacaaacgctttatctgcaagcattccatggtcgatagaggctggggcaacgggtgtggactgttcggcaaaggcgggattgttacatgcgccatgtttacgtgcaaaaagaatatggaagggaaagtggtgcagcctgagaacctcgaatacaccatcgtcattacaccccacagcggggaggagcatgcggtgggaaatgacaccggcaagcacggcaaagaaatcaagattacacctcagtcttccatcaccgaggccgaactgacggggtatggaaccgttacaatggagtgtagcccccggaccggccttgatttcaacgaaatggtgctgctccaaatggaggacaaggcttggctggtccaccgccagtggtttcttgatctgccgctcccttggctgcccggggccgacacacagggatctaattggatccagaaggagaccctggtgacgttcaagaaccctcatgctaaaaagcaagacgttgtggtcctcggctcccaggaaggggccatgcacacagccctgaccggcgctacagagattcagatgagctccggaaatcttctgtttaccggccatctcaaatgcagactgcggatggataaacttcaactgaaagggatgtcttacagcatgtgtaccggaaagttcaagatcgtgaaagaaattgcggagacacagcacggcacgatcgtcattagagtgcagtatgagggggacggatccccctgcaagatccccttcgaaatcatggatctcgagaaacgccatgttctgggccggctgattaccgtgaaccctatcgtcacagaaaaggacagcccggtgaacattgaggccgaacccccttttggggattcttacatcattatcggcgttgagcccggacagctcaaactgaattggttcaagaagggctccagcattgggcaaatgtttgagaccacaatgagaggagctaaacgcatggccatccttggcgacaccgcctgggatttcgggtctctgggaggcgtgtttacgagcatcgggaaggctctccaccaggtcttcggcgccatttacggagcggctttttccggcgtgtcttggacaatgaaaatcctgattggggtgatcattacctggatcggaatgaacagccggtccaccagcctgtctgtttcccttgtcctcgtgggcgtggtcacactgtatctgggggccatggtgcaggccgacagcggatgtgttgtgtcttggaagaataaagaactcaagtgcggctccgggatcttcattaccgataacgtccacacatggacggagcagtacaagtttcaacctgaaagcccctccaaactggcttctgccatccagaaggctcatgaggaaggcatttgtggaatcagaagcgtgacccgccttgagaatctgatgtggaaacagattacaccggagctcaaccacatcctgtccgaaaatgaggttaagctgaccatcatgacaggcgacattaaagggatcatgcaggccggaaagcggtctcttagacctcaacccaccgaactcaaatatagctggaagacgtggggcaaggcgaaaatgctgcctaccgagtcccataaccagacattcctgattgatgggcccgaaaccgccgagtgccctaatacaaaccgcgcttggaatagcctcgaggtggaagactacggatttggcgtcttcaccacaaacatctggctgaaacttcgggagaaacaggacgtgttttgtgattctaagctgatgtccgccgctattaaagacaatagagccgttcacgcggatatgggctattggatcgaaagcgccctcaacgacacctggaagatggagaaggcttctttcatcgaggtgaaatcctgccactggcccaagagccatacgctgtggtctaatggggtcctggaaagcgagatgattatcccgaaaaacttcgccggacctgtgtcccagcacaactaccgccccggctatcatacacaaaccgctgggccctggcaccttggaaagctcgaaatggattttgacttctgtgagggcaccacagtggtcgttaccgaagattgcgggaatcggggacctagcctgagaacgacaaccgcctctggcaaactgattacagagtggtgctgtcggtcctgcaccctcccgcccctgcgctacagaggcgaggacgggtgttggtacggaatggaaatccggcctcttaaggagaaggaagagaacctggtgaatagcctcgtgacagccggccatgggcagattgataacttttccctgggagtcctgggcatggctcttttcctcgaagagatgctgagaacccgcgtggggacgaaacacgcgatcctgctcgttgccgtgtcttttgtcaccctgattacaggaaatatgagcttccgggaccttggcagagtgatggttatggtgggcgctaccatcacagatgacatcgggatgggagtcacctatctggccctcctggccgcttttaaggtgcgccccacgttcgccgcgggcctgcttctgagaaaactcacatccaaggagctgatgatggctaccattggggttgccctcctgtctcagagcacaatccctgaaaccattcttgagctgaccgatgccctcgctctgggaatgatggccctgaaaatcgtgaagaacatggaaaagtaccaacttgcggtcacaattatggctatctcctgcgtgcccaatgccgtgatcctgcagaacgcctggaaagtctcttgtacgattctcgctgccgttagcgtgtcccctctgctcctgaccagctctcagcagaaggctgactggatcccccttgccctgacaattaaaggcctcaatccgaccgcgatctttctgacaaccctgtcccggacgagcaagaaacgctcttggcctcttaacgaggccattatggctgtggggatggtctccatcctggccagctctctcctgaagaatgacgtgcccatgacaggacctctcgttgctggcggcctgcttaccgtgtgctatgtcctgaccgggagatccgccgatctggaactcgagcgggccgctgacgtgaaatgggaggatcaagcggaaatcagcggatccagccccattctgtctatcacaattagcgaggacggctccatgtctatcaagaacgaagaggaggaacagacccttacaattctgatccgcacggggctcctggttattagcggagtgttcccggtctccatccctatcaccgccgctgcctggtacctctgggaggtgaagaaacagagagccggcgtcctgtgggatgtgccctctcctccgcccgttgggaaggctgaacttgaggacggagcctatcggattaaacagcgcggcatcctgggctacagccaaattggggcgggagtgtataaggaaggcacatttcacaccatgtggcatgtcacaagaggggctgtgctgatgcaccggggaaaacgcatcgagccttcctgggccgatgttaagaaggacctcgtgtcttacggcgggggatggaaactggagggcgaatggaaggagggcgaagaggtccaggtgcttgccctggaaccggggaaaaatcccagagctgtgcagaccaagcctggaattttcaaaacgaacaccggcacaatcggggccgttagcctcgatttttcccccggaaccagcggctctcctatcgtcgaccggaaggggaaggtggtgggactgtacggcaatggcgtcgtgacaagatccggggcgtatgttagcgctattgcccagaccgagaaatctatcgaggataaccccgaaattgaggacgatatcttccgcaagaaacggctcacaattatggacctgcatcctggagccggcaagacgaaaagataccttccggctatcgtgcgcgaagccatcaagcgggggctgagaaccctgattctcgctcccacacgcgtcgtggccgcggagatggaagaggccctgcggggacttcctatcagatatcaaacccccgctattcgcgccgagcacaccggccgggaaatcgttgacctgatgtgtcatgctacattcacgatgagactcctgtcccctgtgcgggtccccaactacaatctcattatcatggatgaggcccactttaccgacccggccagcattgctgcgcgcgggtatatctccacaagagtggaaatgggcgaggccgctggaatcttcatgaccgccacacctcccggctctcgggatccctttcctcagagcaacgcccccattatggacgaggaacgcgagatccctgaaagatcctggaatagcgggcacgagtgggttaccgatttcaagggaaaaacggtgtggtttgtcccgtctattaaggctggcaacgacatcgccgcgtgcctgcggaaaaatgggaagaaagtgattcagctttccagaaagacattcgatagcgaatacgtgaagacccgctctaacgactgggattttgtcgttaccacagacatcagcgagatgggagctaatttcaaagccgagcgggtgatcgatcccagacgctgtatgaagcctgtgattctgaccgacggcgaagaacgggtcatcctggccgggcccatgcctgtgacacattcctctgctgcccaaagacgcggccggattggaagaaaccccaaaaatgaaaacgaccagtatatctacatgggcgagccgctcgaaaatgatgaggactgcgcgcactggaaggaggccaaaatgctgcttgataacattaatacccctgaagggatcatccccagcatgtttgagcctgaacgcgagaaggttgacgctattgatggagaatacagactgcggggcgaggcccgcaaaacgttcgtggacctcatgagaagaggggatctgcccgtctggctggcttataaggtggccgctgagggaatcaactacgccgaccgcagatggtgttttgatggcattaagaataaccagatcctcgaagagaacgttgaagtggagatttggacaaaagagggggaacggaagaaacttaagcctagatggctggacgcgcgcatctattccgatcccctggccctcaaagagttcaaggagttcgctgccggccggaagtctctgacccttaatctgattacagagatgggaagactcccgacctttatgacgcagaaagctcgcaacgccctggacaatctggccgtcctccataccgctgaagcgggcgggaaggcctacaaccacgctcttagcgagctgcctgagacactggaaaccctcctgcttctgacactcctggccaccgtgacaggaggcatcttcctgtttctcatgtccgggaaaggaatcggcaagatgacccttggcatgtgctgcattatcacggccagcattctgctgtggtatgctcaaatccagccccactggattgccgcgtctatcatcctcgagttctttctgattgtccttctgatccccgaacctgagaaacagcggacaccgcaggataatcaactcacctacgtggttattgccatcctgaccgtggtggctgccacaatggctaacgaaatggggttcctggagaagaccaagaaagacctcggacttggctccattacaacgcaggagagcgaatccaatatcctggacatcgatctgagacccgcctctgcgtggaccctctatgccgtcgctacaacctttgttacacctatgctgcggcatagcattgagaactcctctgtgaatgtgagccttaccgccatcgctaaccaggccacggtcctgatggggctcggaaagggctggcccctgtccaaaatggacattggggtgcctctgctcgctatcggatgttacagccaggttaatcccattacccttacagccgcgctgctgctcctggtggcccactacgctatcattggccctggccttcaagccaaggctacccgcgaagcccagaaaagagccgcggctgggatcatgaagaacccgacagtcgatggaatcaccgtgattgacctggagcccatcccttatgatcccaagttcgaaaaacagctcggccaggtcatgctgctgattctctgcgtgacgcaagttcttatgatgcggacaacctgggccctgtgtgaggctctgacactcgccaccgggcctatctctaccctgtgggagggaaatcccggccgcttttggaacacaacgattgccgtgtccatggctaatatcttcagagggagctaccttgccggagcgggcctgctcttttctatcatgaagaacaccacaaatacccggcgcggcacagggaacattggagaaaccctgggcgagaaatggaagtccagactgaacgccctcgggaaaagcgagttccagatctataagaaatctggcattcaggaggtcgaccggacgcttgctaaggagggcatcaagcgcggggaaacagatcatcacgccgtgagcagaggatccgctaaactgcggtggtttgttgagagaaatatggtgaccccggaaggcaaggtcgtggacctgggctgcgggcgcggaggctggtcttactattgtgggggactcaaaaacgtgcgggaggttaagggcctgaccaaagggggacctggccatgaagaacccattcccatgagcacatacggctggaatcttgtcagactgcaatccggggtggatgtgttcttcacccctcccgagaagtgcgacacactcctgtgtgatatcggagaaagctcccctaacccgacgatcgaggccggccgcaccctgcgggtcctcaatcttgttgaaaactggctgaataacaatacacagttttgcattaaggtgctgaacccctatatgccttctgtgatcgagaaaatggaaaccctccagagaaagtacgggggagcgctggtccgcaatccccttagccggaactccacacacgagatgtactgggtgtctaatgccaccggcaacattgttagctccgtgaatatgatctctagaatgctgattaaccgcttcacgatgaaacacaagaaagctacctatgagcctgacgtcgatctcgggagcggaacacggaacatcggcatcgaatccgagattcccaatctggacatcattggcaagagaatcgaaaagattaaacaggagcatgaaaccagctggcactacgaccaagatcatccgtataagacatgggcctaccacgggtcttatgagaccaaacagacaggatccgctagctctatggtgaacggcgttgtgcgcctgctcaccaagccttgggacgtcgtgcccatggtgacgcagatggccatgacagataccaccccttttgggcagcaacgggtcttcaaagagaaggttgacacaagaacgcaggaacccaaggagggaaccaagaaacttatgaaaatcacagctgaatggctgtggaaagagctgggcaaaaagaaaacccctcgcatgtgtacaagagaggaatttacccggaaggtgcgctccaatgccgcgctcggggccattttcacagatgagaacaagtggaaaagcgctagagaagccgtggaggacggacggttttgggaactggtcgatagagagcggaatcttcacctggagggcaagtgcgaaacctgtgtgtacaacatgatgggcaaacgcgagaagaaactcggggagttcggaaaggctaagggctctagagccatctggtatatgtggctgggggcccggtttctggagttcgaagcgctcggatttctgaatgaggaccattggttctcccgcggcaacagcctttccggggttgagggcgaaggactgcacagactcggctacatcctgcgggatgtgagcaaaaaggaagggggagctatgtacgccgacgatacggccggctgggacacccgcattacacttgaagacctgaaaaatgaggaaatggtcaccaaccatatgaagggggagcacaaaaagctcgctgaggccatctttaagctgacatatcagaataaagtggttagagtgcagcggcccaccccgcgcggaacggtcatggatattatctctagacgggaccaacgcggcagcggacaggtgggcacatacggactgaacaccttcacaaatatggaagctcagctcattagacaaatggagggcgaagggatcttcaagtccatccagcatctgaccgttacggaggagattgccgtgcagaactggcttgcgcgggtcggacgcgaaagactgacccggatggccatctctggcgatgactgcgtggtcaaacctattgatgacagatttgctaatgccctcacagctctgaacgatatggggaaggtgcgcaaagacatccagcaatgggagcccagccggggatggaacgattggacccaggttcccttctgctcccaccactttcatgaacttgtgatgaaggacggcagagtcctggtggtgccttgtcgcaatcaggatgagctcattgggcgggccagaatctctcagggcgcgggatggagcctgaaggaaacagcctgcctgggcaaatcctatgctcaaatgtggaccctcatgtacttccaccgccgggacctgagacttgccgctaacgccatctgttctgctgttccgagccattgggtgcccacatcccgcaccacgtggagcattcacgccaagcacgagtggatgacaaccgaggatatgctggcggtctggaatcgggtgtggatccaggaaaacccttggatggaggacaaaacccccgttgaatcttgggaggaagtgccttatctcgggaagagagaggaccagtggtgcggatccctgattggccttacaagccgcgccacctgggctaaaaatatccagacagccattaaccaagtccggtctctgatcgggaatgaggaatacacggattatatgccctccatgaagagatttcggagagaggaagaggaagccggagtgctctggtga

SEQ ID NO: 19637 - RNA, 9876 nt, synthetic construct
  misc_feature 1..9876: note = derived and/or modified CDS sequence (opt5) from DENV-2__FJ850078__SS-prME
  source 1..9876: mol_type = other RNA
accgccggcgtgatcgtcatgctgattcccacagttatggctttccacctcacgaccagaaacggggagcctcatatgatcgtgggacggcaggaaaagggcaaaagcctgctttttaagacagaggacggggtgaatatgtgcaccctgatggccattgatctcggagaactgtgtgaggacacaatcacctacaaatgcccgcttctgcgccaaaacgaacccgaggatattgactgttggtgcaattccacatctacctgggtcacgtatggcacctgtacaaccacaggggagcacagacgggaaaagcgcagcgtggcgctcgttcctcatgtgggaatgggcctggagaccagaacggaaacatggatgtcctctgagggcgcttggaaacacgtccagcggatcgagacctggatcctgcgccatcccgggttcacaatgatggccgccattctcgcttacaccatcggaaccacacactttcagagagccctgattttcatccttctgacggctgtggcccctagcatgaccatgcggtgcattggcatctccaaccgcgattttgttgaaggggtgtctggaggcagctgggtcgacattgtgctcgagcacgggtcctgtgtgacaaccatggcgaagaataagcccacactggatttcgaacttatcaaaaccgaggccaagcagcctgctacgctgagaaaatattgcgtcgaagccaagctcacaaacaccaccacagagagccggtgtccgacccaaggagagccctctctgaatgaagagcaggacaaacgctttatctgcaagcattccatggttgatagaggctggggcaacgggtgtggactgttcggcaaggggggaattgtgacatgcgctatgtttacgtgcaaaaagaatatggaaggcaaagtggtccagcctgagaacctcgaatacaccatcgtgattacaccccacagcggggaggagcatgccgttggaaatgacaccggcaagcacggcaaagaaatcaagattacacctcagtcttccatcaccgaggcggaactgacggggtatggaaccgtgacaatggagtgtagcccccggaccggccttgatttcaacgaaatggtcctgctccaaatggaggacaaagcctggctggtgcaccgccagtggtttcttgatctgccgctcccttggctgcccggggctgacacacagggatctaattggatccagaaggagaccctggttacgttcaagaaccctcatgccaaaaagcaagacgtggtcgtgctcggctcccaggaaggggctatgcacacagccctgaccggcgccacagagattcagatgagctccggaaatcttctgtttaccggccatctcaaatgcagactgcggatggataagcttcaactgaaagggatgtcttacagcatgtgtaccggaaagttcaagatcgtcaaagaaattgctgagacacagcacggcacgatcgtgattagagttcagtatgagggggacggatccccctgcaagatccccttcgaaatcatggatctcgagaaacgccatgtgctgggccggctgattaccgtcaaccctatcgtgacagaaaaggacagcccggttaacattgaggcggaacccccttttggggattcttacatcattgtgggcgtcgagcccggacagctcaaactgaattggttcaagaagggctccagcatcgggcaaatgtttgagaccacaatgagaggagccaaacgcatggctattcttggcgacaccgcctgggatttcgggtctctgggaggcgtgtttacgagcatcgggaaggccctccaccaggtgttcggcgctatctacggagccgcgtttaacggcgtttcctggacaatgaaaattctgatcggggtcattatcacctggattggaatgaattctcggagcacctccctgagcgtgtctcttgtgctcgtcggcgtggttacactgtatctgggggctatggtgcaggccgactccggatgtgtcgtgagctggaagaacaaagaactcaagtgcggctctgggatcttcatcaccgataatgttcacacatggacggagcagtacaagtttcaacctgaatcccccagcaaactggcctccgctattcagaaggcccatgaggaaggcatctgtggaattagatctgtgacccgccttgagaacctgatgtggaaacagatcacaccggagctcaatcacattctgagcgaaaacgaggtcaagctgaccatcatgacaggcgacatcaaagggattatgcaggctggaaagcggtcccttagacctcaacccaccgaactcaaatattcttggaagacgtggggcaaggccaaaatgctgcctaccgagagccataatcagacattcctgatcgatgggcccgaaaccgcggagtgccctaacgccaatcgcgcttggaactccctcgaggtggaagactacggatttggcgttttcacaaccaatatttggctgaagcttcgggagaaacaggacgtgttttgtgatagcaagctgatgtctgccgctatcaaagacaacagagccgtccacgcggatatgggctattggattgaatccgccctcaatgacacatggaagatggagaaggctagcttcatcgaggtgaaatcttgccactggcccaagtcccataccctgtggagcaacggggtgctggaatctgagatgatcattccgaaaaacttcgccggacctgtcagccagcacaattaccgccccggctatcatacgcaaacagctgggccctggcaccttggaaagctcgaaatggattttgacttctgtgagggcaccaccgttgtggtgacagaagattgcgggaaccggggaccttccctgagaaccacgacagccagcggcaaactgatcaccgagtggtgctgtcggtcttgcacactcccgcccctgcgctacagaggcgaggacgggtgttggtacggaatggaaattcggcctcttaaggagaaggaagagaatctggtcaactccctcgtgaccgccggccatgggcagatcgataattttagcctgggagttctgggcatggctcttttcctcgaagagatgctgagaacacgcgtggggaccaaacacgcgattctgctcgtcgccgtgtcctttgttacgctgatcaccggaaacatgtctttccgggaccttggcagagtgatggtcatggtgggcgctacaatgaccgatgacattgggatgggagttacatatctggccctcctggccgcttttaaggtgcgccccaccttcgccgcgggcctgcttctgagaaaactcacgagcaaggagctgatgatggctacaatcggggtcgccctcctgtcccagtctaccatccctgaaacaattcttgagctgaccgatgccctcgctctgggaatgatggccctgaaaatcgtgaagaatatggaaaagtaccaacttgcggtgaccattatggctatcagctgcgtccccaacgccgttattctgcagaatgcctggaaagtgtcctgtacaatcctcgctgccgtgtctgtcagccctctgctcctgacgtccagccagcagaaggctgactggatcccccttgccctgaccattaaaggcctcaacccgacagcgatctttctgaccacactgtctcggacctccaagaaacgcagctggcctcttaatgaggccgtgatggctgttgggatggtgtctattctggcctccagcctcctgaagaacgacatccccatgacgggacctctcgtcgctggcggcctgcttacagtgtgctatgttctgaccgggagatctgccgatctggaactcgagcgggccgctgacgtgaaatgggaggatcaagcggaaatttccggaagctcccccatcctgagcatcaccatttctgaggacggcagcatgtccatcaagaatgaagaggaggaacagacacttaccattctgatccgcacagggctcctggtcatttctggagtgttcccggtcagcatccctattacggccgctgcctggtacctctgggaggtgaagaaacagagagccggcgttctgtgggatgtgccctcccctccccccgtcgaaaaggctgagcttgaagacggggcctatcggatcaaacagcgcggaatcctgggctactctcaaattggcgcgggggtgtataaggagggaacctttcacacaatgtggcatgttaccagaggcgctgtgctgatgcaccgggggaaacgcatcgagcctagctgggccgatgtcaagaaggacctcgtgtcctacggaggcgggtggaaactggaaggagagtggaaggaaggcgaggaagtgcaggttcttgccctggagccgggcaaaaaccccagagctgtccagacaaagcctgggattttcaaaaccaatacgggaaccatcggcgccgtgtctctcgattttagccccgggacatccggaagccctattgtggaccggaagggcaaggtcgtggggctgtacggaaacggcgttgtgaccagatctggcgcgtatgtctccgctatcgcccagacagagaaaagcatcgaagataaccccgagattgaagacgatatcttccgcaagaaacggctcaccattatggacctgcatcctggggccggaaagacaaaaagataccttccggctatcgtgcgcgaggccattaagcggggcctgagaacgctgatcctcgctcccacccgcgttgtggccgcggaaatggaggaggccctgcgggggcttcctatcagatatcaaacacccgctattcgcgccgaacacaccggacgggagatcgtcgacctgatgtgtcatgctaccttcacaatgagactcctgtctcctgtgcgggttcccaattacaacctcattatcatggatgaagcccactttacggacccggcctccattgctgcgcgcggctatatcagcaccagagtggagatgggggaggccgctggcattttcatgacagccacccctcccggatcccgggatccctttcctcagtctaatgcccccatcatggacgaagagcgcgaaatccctgagagaagctggaactccggccacgaatgggtcacagatttcaaggggaaaaccgtgtggtttgtgccgagcattaaggctggaaatgacatcgccgcgtgcctgcggaaaaacggcaagaaagtcattcagctttctagaaagacgttcgattccgagtacgttaagacacgcagcaatgactgggattttgtggtgaccaccgacatctctgagatgggggctaacttcaaagccgaacgggtcattgatcccagacgctgtatgaagcctgtgatcctgacagacggagaggaacgggttatcctggccggccccatgcctgtgacccatagctccgctgcccaaagacgcgggcggattggcagaaatcccaaaaacgagaatgaccagtatatctacatgggagaaccgctcgagaacgatgaggactgcgcgcactggaaggaagccaaaatgctgcttgataatattaacacacctgagggcatcattccctctatgtttgaacctgagcgcgaaaaggtcgacgctatcgatggggagtacagactgcggggagaggcccgcaaaaccttcgtggacctcatgagacggggcgatctgcccgtttggctggcttataaggtggccgctgaagggatcaattacgccgaccgcagatggtgttttgatggaattaagaacaaccagatcctcgaggaaaatgtcgaggtggagatttggacgaaagaaggcgagcggaagaaacttaagcctagatggctggacgcgcgcatctatagcgatcccctggccctcaaagaattcaaggagttcgctgccgggcggaagtccctgacacttaacctgattaccgaaatgggcagactcccgacatttatgacccagaaagctcgcaatgccctggacaacctggccgtcctccatacggctgaggcgggaggcaaggcctacaatcacgctctttctgagctgcctgaaaccctggagacactcctgcttctgaccctcctggccacagtgaccgggggaatcttcctgtttctcatgagcggcaaagggattggaaagatgacacttggcatgtgctgcatcatcaccgcctccattctgctgtggtatgctcaaatccagccccactggattgccgcgagcatcattctcgaattctttctgatcgttcttctgatccccgagcctgaaaaacagcggacgccgcaggataaccaactcacatacgtggtgattgccatcctgaccgtcgttgctgccaccatggctaatgagatgggcttcctggagaagacaaagaaagacctcgggcttggatctattaccacacaggaatccgagagcaacatcctggacattgatctgagacccgcctccgcgtggacgctctatgccgtggctaccacatttgtgacccctatgctgcggcattctatcgaaaatagctccgtcaacgtgtctcttacagccatcgctaatcaggccaccgttctgatgggcctcgggaagggatggcccctgagcaaaatggacattggcgtgcctctgctcgctatcgggtgttactcccaggtcaaccccattacgcttaccgccgcgctgctgctcctggtggcccactacgctatcattggacctggccttcaagccaaggctacacgcgaggcccagaaaagagccgcggctggcatcatgaagaatccgaccgtcgatgggattacagtgatcgacctggaacccatcccttatgatcccaagttcgagaaacagctcggacaggttatgctgctgattctctgcgtgacccaagtccttatgatgcggacgacatgggccctgtgtgaggctctgaccctcgccacaggccctatcagcaccctgtgggaagggaaccccggacgcttttggaataccacaattgccgtgtctatggctaacatcttcagaggctcctaccttgccggggcgggactgctctttagcattatgaagaatacgaccaacacacggcgcggcaccggcaacatcggggagacactgggagaaaaatggaagtctagactgaatgccctcggcaaatccgagttccagatctataagaaaagcgggattcaggaggttgaccggacccttgctaaggaaggaatcaagcgcggcgagacggatcatcacgccgtgtctagagggagcgctaaactgcggtggtttgtcgaaagaaacatggtgacaccggagggaaaggtggttgacctgggctgcggccgcgggggatggtcctactattgtggcgggctcaaaaatgtccgggaagtgaagggactgaccagaggcgggcctggacatgaggagcccattcccatgtctacctacggctggaaccttgtgcgcctgcaaagcggcgtcgatgttttcttcacacctcccgaaaaatgcgacaccctcctgtgtgatatcggggagtccagccctaatccgacaattgaagccggacggacgctgagagtgctcaaccttgtggagaattggctgaacaataacacccagttttgcatcaaggtcctgaatccctatatgccttccgtgatcgaaaagatggagacactccagcgcaaatacggcggggcgctggttcggaaccccctttctagaaatagcacccacgagatgtactgggtgtccaacgccacaggaaatattgtctctagcgtgaacatgatctcccgcatgctgattaaccggttcaccatgaagcacaaaaaggctacgtatgaacctgacgttgatctcggctctgggaccagaaatatcggaattgagagcgaaatccccaacctggacatcattggcaaacgcatcgagaagattaagcaggaacatgagacatcctggcactacgaccaagatcatccgtataaaacctgggcctaccacggcagctatgagacaaagcagaccgggtctgcttccagcatggtgaatggagtcgtgcggctgctcacaaaaccttgggacgtggtccccatggttacccagatggccatgacggatacaaccccttttggccagcaaagagtgttcaaggaaaaagtggacacccgcacacaggagcccaaggaagggacgaagaaacttatgaagatcaccgctgagtggctgtggaaagagctgggaaagaaaaagacacctagaatgtgtacccgggaagagtttacacgcaaagtcagatctaacgccgcgctcggcgccattttcaccgatgaaaataagtggaagtccgctcgggaggccgtggaagacgggagattttgggagctggttgatcgggagcgcaaccttcacctggaaggaaaatgcgagacatgtgtgtacaatatgatgggcaagagagaaaaaaagctcggcgagttcgggaaagctaagggaagccgggccatctggtatatgtggctgggcgcccgctttctggaattcgaggcgctcgggtttctgaacgaggaccattggttctctagaggaaattcccttagcggcgtcgaaggggagggcctgcaccggctcggatacattctgcgcgatgtgtccaagaaagaaggcggggctatgtacgccgacgataccgccggatgggacacgagaatcacccttgaggacctgaagaacgaagagatggttacaaatcatatgaaaggcgagcacaagaaactcgctgaagccatctttaagctgacctatcagaacaaggtggtccgggtgcagcgccccacaccgagagggaccgttatggatattatcagccggcgcgaccaaagaggatctggccaggtggggacgtacggcctgaatacattcaccaacatggaggctcagctcattcggcaaatggaaggagagggcatcttcaaaagcattcagcatctgacagtcaccgaggaaatcgccgtgcagaattggcttgcgcgcgtcgggagagagcggctgacgagaatggccatctccggagatgactgcgtggttaagcctattgatgaccgctttgctaacgccctcaccgctctgaacgatatgggcaaagtgcggaaggacatccagcaatgggaaccctctagagggtggaatgattggacacaggtccccttctgcagccaccactttcatgagcttgtgatgaaagacggacgcgtgctggttgtgccttgtcggaaccaggatgaactcattggcagagcccgcatctcccagggggcgggctggtctctgaaggagaccgcctgcctgggaaagagctatgctcaaatgtggacactcatgtacttccaccggagagacctgcgccttgccgctaatgccatttgttccgctgtcccgtctcattgggtgcccaccagccggacaacctggtccatccacgccaaacacgagtggatgacgacagaagatatgctggcggtttggaacagagtgtggatccaggagaatccttggatggaagacaagacccccgtcgagagctgggaagaggtgccttatctcggcaaacgcgaggaccagtggtgcgggtctctgattggacttacctcccgggccacatgggctaagaacatccagaccgccattaatcaagtcagaagcctgatcggcaacgaagagtacacagattatatgccctctatgaaacggtttagacgcgaagaggaagaggccggggtgctctggtga

SEQ ID NO: 19638 - RNA, 9876 nt, synthetic construct
  misc_feature 1..9876: note = derived and/or modified CDS sequence (opt5) from DENV-2__FJ850082__SS-prME
  source 1..9876: mol_type = other RNA
accgtgggagttatcgttatgctgattcccacagccatggctttccacctcacgacccggaacggggagcctcatatgatcgtgggacggcaggaaaagggcaagagcctgctttttaagacagagaatggggtgaacatgtgcaccctgatggccattgacctcggagaactgtgtgaggatacaatcacctacaagtgcccgcttctgcgccaaaatgaacccgaggacattgattgttggtgcaactccacatctacctgggtgacgtatggcacctgtacaaccacaggggagcaccggcgggaaaagcgcagcgtggcgctcgttcctcatgtgggaatgggcctggagaccagaacggaaacatggatgtcctctgagggcgcttggaagcacgtccagcggatcgagacctggatcctgcgccatcccgggttcacaattatggccgccatcctcgcttacaccattggaaccacacactttcagagagccctgatcttcattcttctgacggctgtggcccctagcatgaccatgcggtgcatcggcatttccaatcgcgactttgttgaaggggtgtctggaggcagctgggtcgatatcgtgctcgagcacgggtcctgtgtgacaaccatggcgaagaacaagcccacactggacttcgaacttatcaagaccgaggccaagcagcctgctacgctgagaaaatattgcgtcgaagccaagctcacaaataccaccacagagagccggtgtccgacccaaggagagccctctctgaacgaggaacaggataaacgctttatttgcaagcattccatggttgacagaggctggggcaatgggtgtggactgttcggcaaagggggaatcgtgacatgcgctatgtttacgtgcaaaaagaacatggaaggcaaagtggtccagcctgagaatctcgaatacaccattgtgatcacaccccacagcggggaggagcatgccgttggaaacgataccggcaagcacggcaaagaaattaagatcacacctcagtcttccatcaccgaggcggaactgacggggtatggaaccgtgacaatggagtgtagcccccggaccggccttgacttcaatgaaatggtcctgctccaaatggaggataaagcctggctggtgcaccgccagtggtttcttgacctgccgctcccttggctgcccggggctgatacacagggatctaactggattcagaaggagaccctggttacgttcaagaatcctcatgccaaaaagcaagacgtggtcgtgctcggctcccaggaaggggctatgcacacagccctgaccggcgccacagagatccagatgagctccggaaaccttctgtttaccggccatctcaaatgcagactgcggatggacaaacttcaactgaaagggatgtcttacagcatgtgtaccggaaagttcaagattgtcaaagaaatcgctgagacacagcacggcacgattgtgatcagagttcagtatgagggggatggatccccctgcaagatccccttcgaaattatggacctcgagaaacgccatgtgctgggccggctgatcaccgtcaaccctattgtgacagaaaaggatagcccggttaatatcgaggcggaacccccttttggggactcttacattatcattggcgtggagcccggacagctcaaactgaactggttcaagaagggctccagcatcgggcaaatgtttgagaccacaatgagaggagccaaacgcatggctatccttggcgataccgcctgggacttcgggtctctgggaggcgtctttacgagcattgggaaggccctccaccaggtgttcggcgctatctacggagccgcgttttccggcgtgtcttggacaatgaaaattctgatcggggttattatcacctggatcggaatgaatagccggtccaccagcctgtctgtctcccttgtgctcgtgggcgtcgtgacactgtatctgggggctatggttcaggccgatagcggatgtgtggtctcttggaagaacaaagaactcaagtgcggctccgggattttcatcaccgacaatgtgcacacatggacggagcagtacaagtttcaacctgaaagcccctccaaactggcctctgctattcagaaggcccatgaggaaggcatctgtggaattagaagcgttacccgccttgagaacctgatgtggaaacagatcacaccggagctcaatcacatcctgtccgaaaacgaggtgaagctgaccattatgacaggcgatatcaaagggattatgcaggctggaaagcggtctcttagacctcaacccaccgaactcaaatatagctggaagacgtggggcaaggccaaaatgctgtccaccgagagccataatcagacattcctgatcgacgggcctgaaaccgcggagtgccccaacacaaatcgcgcctggaactctctcgaggtcgaagattacggatttggcgtgttcaccacaaatatttggctgaaacttcgggagaaacaggacgtcttttgtgactccaagctgatgagcgctgccgtgaaagataacagagctgtccacgccgacatgggctattggatcgaatctgcgctcaatgatacctggaagatggagaaggcctccttcatcgaggtgaaaagctgccactggcctaagtctcatacgctgtggagcaacggggtgctggaatccgagatgattatccccaaaaacttcgctggaccggtcagccagcacaattaccgccctggctatcatacacaaaccgccgggccctggcaccttggaaagctcgaaatggactttgatttctgtgagggcaccacagttgtggtgaccgaagactgcgggaaccggggaccctctctgagaacgacaaccgcttccggcaaactgattacagagtggtgctgtcggagctgcaccctccctccgctgcgctacagaggcgaggatgggtgttggtacggaatggaaatccggccccttaaggagaaggaagagaatctggtcaactccctcgtgacagccggccatgggcagattgacaatttttctctgggagttctgggcatggcccttttcctcgaagagatgctgagaacccgcgtggggacgaaacacgctatcctgctcgtcgcggtgagctttgttaccctgattacaggaaacatgtccttccgggatcttggcagagtgatggtcatggtgggcgccaccatgacagacgatatcgggatgggagttacctatctggctctcctggccgcctttaaggtgcgccctacgttcgctgccggcctgcttctgagaaaactcacatctaaggagctgatgatggcgaccatcggggtcgctctcctgagccagtccacaattcccgaaaccatccttgagctgaccgacgccctcgccctgggaatgatggctctgaaaattgtgaagaatatggaaaagtaccaacttgccgtgacaatcatggcgatttcttgcgtccctaacgctgttatcctgcagaatgcctggaaagtgagctgtacgatcctcgccgctgtgtccgtcagccccctgctcctgacctcttcccagcagaaggccgattggattcctcttgctctgacaatcaaaggcctcaaccccaccgccatttttctgacaaccctgagccggacgtctaagaaacgctcctggccgcttaatgaggcgatcatggccgtggggatggttagcattctggcttcttccctcctgaagaacgacatccctatgacaggacccctcgtggccggcggcctgcttaccgtctgctatgtgctgaccgggagaagcgctgacctggaactcgagcgggccgccgatgttaaatgggaggaccaagctgaaatctccggaagctctcctattctgagcatcacaatttccgaggatggctctatgagcatcaagaatgaagaggaggaacagacccttacaattctgatccgcacggggctcctggtgatttccggagtcttccccgtgtctatcccgatcaccgcggccgcttggtacctctgggaggtcaagaaacagagagccggcgtgctgtgggacgttccttctccccctcccgtggggaaggccgaacttgaggaaggagcttatcggattaaacagcgcggcatcctgggctactcccaaattggggccggagtctataaggagggcacatttcacaccatgtggcatgtgacaagaggggcggttctgatgcaccggggaaaacgcatcgagccctcctgggctgatgtgaagaaggacctcgtcagctacggcgggggatggaaactggaaggcgagtggaaggaaggcgaggaagtccaggtgcttgccctggagcctgggaaaaacccgagagccgttcagaccaagcccggaattttcaaaacgaataccggcacaatcggggctgtctccctcgattttagccctggaacctctggctcccccatcgtggaccggaaggggaaggtggtcggactgtacggcaacggcgtggttacaagaagcggggcctatgtgtctgcgattgctcagaccgataaatccatcgaggacaaccctgaaattgaggatgacatcttccgcaagaaacggctcacaattatggatctgcatcccggagccggcaagacgaaaagataccttcctgccatcgtccgcgaagctatcaagcgggggctgagaaccctgattctcgccccgacacgcgtggttgctgccgagatggaagaggcgctgcggggacttcccatcagatatcaaacccctgccattcgcgctgagcacaccggccgggaaatcgtggacctgatgtgtcatgccacattcacgatgagactcctgagccccgtccgggtgcctaattacaacctcattatcatggacgaggctcactttaccgatcccgcctccattgccgctcgcgggtatatctctacaagagttgaaatgggcgaggcggccggaatcttcatgaccgctacaccgcctggcagccgggacccctttccccagtccaatgcccctattatggatgaggaacgcgagatccccgaaagaagctggaactctgggcacgagtgggtgaccgacttcaagggaaaaacggtctggtttgtgccttccattaaggccggcaatgatatcgctgcctgcctgcggaaaaacgggaagaaagtgattcagcttagcagaaagacattcgactctgaatacgtcaagacccgcgcgaatgattgggactttgttgtgaccacagatatcagcgagatgggagctaacttcaaagccgagcgggtgatcgacccgagacgctgtatgaagcccgtcattctgaccgatggcgaagaacgggtgatcctggccgggcctatgcccgttacacattcctctgctgcccaaagacgcggccggattggaagaaatcctaaaaacgaaaatgaccagtatatctacatgggcgagcccctcgaaaacgacgaggattgcgcgcactggaaggaggccaaaatgctgcttgacaatattaacaccccggaagggatcatccctagcatgtttgagcccgaacgcgagaaggtggatgctattgacggagaatacagactgcggggcgaggcccgcaaaacgttcgtcgatctcatgagaagaggggacctgcctgtgtggctggcttataaggttgccgctgagggaatcaattacgccgatcgcagatggtgttttgacggcattaagaacaaccagatcctcgaagagaatgtggaagtcgagatttggacaaaagagggggaacggaagaaacttaagcccagatggctggatgcgcgcatctattccgaccctctggccctcaaagagttcaaggagttcgctgccggccggaagtctctgacccttaacctgattacagagatgggaagactccccacctttatgacgcagaaagctcgcaatgccctggataacctggccgtgctccataccgctgaagcgggcgggaaggcctacaatcacgctcttagcgagctgccggagacactggaaaccctcctgcttctgacactcctggccaccgtcacaggaggcatcttcctgtttctcatgtccgggaaaggaatcggcaagatgacccttggcatgtgctgcattatcacggccagcattctgctgtggtatgctcaaatccagcctcactggattgccgcgtctatcatcctcgagttctttctgattgtgcttctgatccccgaacccgagaaacagcggacacctcaggacaaccaactcacctacgttgtgattgccatcctgaccgtggtcgctgccacaatggctaatgaaatggggttcctggagaagaccaagaaagatctcggacttggctccattacaacgcaggagagcgaatccaacatcctggacatcgacctgagaccggcctctgcgtggaccctctatgccgttgctacaacctttgtgacacccatgctgcggcatagcattgaaaatagctctgtgaacgtcagccttaccgccatcgctaatcaggccacggtgctgatggggctcggaaagggctggcctctgtccaaaatggatattggggttcccctgctcgctatcggatgttacagccaggtgaaccctattacccttacagccgcgctgctgctcctggtcgcccactacgctatcattggccccggccttcaagccaaggctacccgcgaagcccagaaaagagccgcggctgggatcatgaagaatcctacagtggacggaatcaccgtcattgatctggagccgatcccctatgaccctaagttcgaaaaacagctcggccaggtgatgctgctgattctctgcgttacgcaagtgcttatgatgcggacaacctgggccctgtgtgaggctctgacactcgccaccgggcccatctctaccctgtgggagggaaaccctggccgcttttggaatacaacgattgccgtctccatggctaacatcttcagagggagctaccttgccggagcgggcctgctcttttctatcatgaagaataccacaaacacccggcgcggcacagggaacattggagaaaccctgggcgagaaatggaagtccagactgaatgccctcgggaaaagcgagttccagatctataagaaatctggcattcaggaggtggatcggacgcttgctaaggagggcatcaagcgcggggaaacagaccatcacgccgttagcagaggatccgctaaactgcggtggtttgtggagagaaacatggtcacccccgaaggcaaggtggtggatctgggctgcgggcgcggaggctggtcttactattgtgggggactcaaaaatgttcgggaggtcaagggcctgaccaaagggggaccgggccatgaggaacctattcccatgagcacatacggctggaaccttgtgagactgcaatccggggtggacgtcttcttcacaccccctgagaagtgcgataccctcctgtgtgacatcggagaaagctcccccaatcctacgatcgaggccggccgcaccctgcgggttctcaaccttgtggaaaattggctgaacaataacacacagttttgcattaaggtgctgaatccgtatatgccctctgtcatcgagaaaatggaaaccctccagagaaagtacgggggagcgctggtgcgcaaccctcttagcagaaattccacacacgagatgtactgggtttctaacgccaccggcaatattgtgagctccgtcaacatgatctctagaatgctgattaaccgcttcacgatgaaacacaagaaagctacctatgagcccgatgtggacctcgggagcggaacacggaatatcggcatcgaatccgaggttcctaacctggatattatcggcaagagaattgaaaagatcaaacaggagcatgaaaccagctggcactacgaccaagaccatccctataagacatgggcctaccacgggtcttatgagaccaaacagacaggatccgctagctctatggtgaatggcgtcgtgcgcctgctcaccaagccgtgggatgtggtccctatggttacgcagatggccatgacagacaccaccccctttgggcagcaacgggtgttcaaagagaaggtggatacaagaacgcaggaacctaaggagggaaccaagaaacttatgaaaattacagctgaatggctgtggaaagagctgggcaaaaagaaaatcccccgcatgtgtaccagagaggaatttacacggaaggtccgctccaacgccgcgctcggggccattttcaccgacgagaataagtggaaaagcgctagagaagccgtggaggatggacggttttgggaactggttgacagagagcggaaccttcacctggagggcaagtgcgaaacatgtgtgtacaatatgatgggcaaacgcgagaagaaactcggggagttcggaaaggctaagggctctagagccatctggtatatgtggctgggggcccggtttctggagttcgaagcgctcggatttctgaacgaggatcattggttctcccgcggcaatagcctttccggggtcgagggcgaaggactgcacagactcggctacatcctgcgggacgtgagcaaaaaggaagggggagctatgtacgccgatgacaccgccggctgggatacgcgcattacccttgaagacctgaaaaacgaggaaatgatcacaaatcatatgaagggggagcacaaaaagctcgctgaggccatttttaagctgacctatcagaacaaagttgtgagagtccagcggcctacaccccgcggaaccgtgatggacatcatttctagacgggatcaacgcggcagcgggcaggttggcacgtacggactgaatacattcaccaacatggaagctcagctcatcagacaaatggagggcgaagggatcttcaagtccattcagcatctgacagtgaccgaggagatcgccgtccagaattggcttgcgcgggtgggacgcgaaagactgacgcggatggccatttctggcgacgattgcgtcgtgaaaccgatcgacgatagatttgctaacgccctcaccgctctgaacgacatggggaaggttcgcaaagatattcagcaatgggagcctagccggggatggaatgactggacacaggtgcccttctgctcccaccactttcatgaacttgtcatgaaggatggcagagtgctggtggttccctgtcgcaaccaggacgagctcatcgggcgggccagaatctctcagggcgcgggatggagcctgaaggaaaccgcctgcctgggcaaatcctatgctcaaatgtggacactcatgtacttccaccgccgggatctgagacttgccgctaatgccatttgttctgctgtgcctagccattgggtcccgacctcccgcacaacctggagcatccacgccaagcacgagtggatgacgacagaggacatgctggcggtgtggaaccgggtttggattcaggaaaatccctggatggaggataaaacccctgtggaatcttgggaggaagtcccctatctcgggaagagagaggaccagtggtgcggatccctgatcggccttaccagccgcgccacatgggctaaaaacattcagaccgccatcaatcaagtgcggtctctgattgggaacgagggatacacagactatatgccttccatgaagagatttcggagagaagaggaagaggccggcgtcctctggtga

SEQ ID NO: 19639 - RNA, 9876 nt, synthetic construct
  misc_feature 1..9876: note = derived and/or modified CDS sequence (opt5) from DENV-2__FJ850085__SS-prME
  source 1..9876: mol_type = other RNA
accgtgggagttatcgttatgctgattcccacagccatggctttccacctcacgacccggaacggggagcctcatatgatcgtgggacggcaggaaaagggcaagagcctgctttttaagacagagaatggggtgaacatgtgcaccctgatggccattgacctcggagaactgtgtgaggatacaatcacctacaagtgcccgcttctgcgccaaaatgaacccgaggacattgattgttggtgcaactccacatctacctgggtgacgtatggcacctgtacaaccacaggggagcaccggcgggaaaagcgcagcgtggcgctcgttcctcatgtgggaatgggcctggagaccagaacggaaacatggatgtcctctgagggcgcttggaagcacgtccagcggatcgagacctggatcctgcgccatcccgggttcacaattatggccgccatcctcgcttacaccattggaaccacacactttcagagagccctgatcttcattcttctgacggctgtggcccctagcatgaccatgcggtgcatcggcatttccaatcgcgactttgttgaaggggtgtctggaggcagctgggtcgatatcgtgctcgagcacgggtcctgtgtgacaaccatggcgaagaacaagcccacactggacttcgaacttatcaagaccgaggccaagcagcctgctacgctgagaaaatattgcgtcgaagccaagctcacaaataccaccacagagagccggtgtccgacccaaggagagccctctctgaacgaggaacaggataaacgctttatttgcaagcattccatggttgacagaggctggggcaatgggtgtggactgttcggcaaagggggaatcgtgacatgcgctatgtttacgtgcaaaaagaacatggaaggcaaagtggtccagcctgagaatctcgaatacaccattgtgatcacaccccacagcggggaggagcatgccgttggaaacgataccggcaagcacggcaaagaaattaagatcacacctcagtcttccatcaccgaggcggaactgacggggtatggaaccgtgacaatggagtgtagcccccggaccggccttgacttcaatgaaatggtcctgctccaaatggaggataaagcctggctggtgcaccgccagtggtttcttgacctgccgctcccttggctgcccggggctgatacacagggatctaactggattcagaaggagaccctggttacgttcaagaatcctcatgccaaaaagcaagacgtggtcgtgctcggctcccaggaaggggctatgcacacagccctgaccggcgccacagagatccagatgagctccggaaaccttctgtttaccggccatctcaaatgcagactgcggatggacaaacttcaactgaaagggatgtcttacagcatgtgtaccggaaagttcaagattgtcaaagaaatcgctgagacacagcacggcacgattgtgatcagagttcagtatgagggggatggatccccctgcaagatccccttcgaaattatggacctcgagaaacgccatgtgctgggccggctgatcaccgtcaaccctattgtggcggaaaaggatagcccggttaatatcgaggccgaacccccttttggggactcttacattatcattggcgtggagcccggacagctcaaactgaactggttcaagaagggctccagcatcgggcaaatgtttgagacaaccatgagaggagctaaacgcatggccatccttggcgatacagcctgggacttcgggtctctgggaggcgtctttaccagcattgggaaggctctccaccaggtgttcggcgccatctacggagcggctttttccggcgtgtcttggacgatgaaaattctgatcggggttattatcacatggatcggaatgaatagccggtccaccagcctgtctgtctcccttgtgctcgtgggcgtcgtgaccctgtatctgggggccatggttcaggccgatagcggatgtgtggtctcttggaagaacaaagaactcaagtgcggctccgggattttcatcacagacaatgtgcacacctggacagagcagtacaagtttcaacctgaaagcccctccaaactggcttctgccattcagaaggctcatgaggaaggcatctgtggaattagaagcgttacgcgccttgagaacctgatgtggaaacagatcaccccggagctcaatcacatcctgtccgaaaacgaggtgaagctgacaattatgaccggcgatatcaaagggattatgcaggccggaaagcggtctcttagacctcaacccacagaactcaaatatagctggaagacctggggcaaggcgaaaatgctgtccacggagagccataatcagaccttcctgatcgacgggcctgaaacagccgagtgccccaacaccaatcgcgcttggaactctctcgaggtcgaagattacggatttggcgtgttcacaaccaatatttggctgaaacttcgggagaaacaggacgtcttttgtgactccaagctgatgagcgccgctgtgaaagataacagagccgtccacgcggacatgggctattggatcgaatctgccctcaatgatacatggaagatggagaaggcttccttcatcgaggtgaaaagctgccactggcctaagtctcataccctgtggagcaacggggtgctggaatccgagatgattatccccaaaaacttcgccggaccggtcagccagcacaattaccgccctggctatcatacgcaaacagctgggccctggcaccttggaaagctcgaaatggactttgatttctgtgagggcaccaccgttgtggtgacagaagactgcgggaaccggggaccctctctgagaaccacgacagcctccggcaaactgattaccgagtggtgctgtcggagctgcacactccctccgctgcgctacagaggcgaggatgggtgttggtacggaatggaaatccggccccttaaggagaaggaagagaatctggtcaactccctcgtgaccgccggccatgggcagattgacaatttttctctgggagttctgggcatggctcttttcctcgaagagatgctgagaacacgcgtggggaccaaacacgcgatcctgctcgtcgccgtgagctttgttacgctgattaccggaaacatgtccttccgggatcttggcagagtgatggtcatggtgggcgctacaatgaccgacgatatcgggatgggagttacatatctggccctcctggccgcttttaaggtgcgccctaccttcgccgcgggcctgcttctgagaaaactcacgtctaaggagctgatgatggctacaatcggggtcgccctcctgagccagtccaccattcccgaaacaatccttgagctgaccgacgccctcgctctgggaatgatggccctgaaaattgtgaagaatatggaaaagtaccaacttgcggtgaccatcatggctatttcttgcgtccctaacgccgttatcctgcagaatgcctggaaagtgagctgtacaatcctcgctgccgtgtccgtcagccccctgctcctgacgtcttcccagcagaaggctgattggattcctcttgccctgaccatcaaaggcctcaaccccacagcgatttttctgaccacactgagccggacctctaagaaacgctcctggccgcttaatgaggccatcatggctgtggggatggttagcattctggcctcttccctcctgaagaacgacatccctatgacgggacccctcgtggctggcggcctgcttacagtctgctatgtgctgaccgggagaagcgccgacctggaactcgagcgggccgctgatgttaaatgggaggaccaagcggaaatctccggaagctctcctattctgagcatcaccatttccgaggatggctctatgagcatcaagaatgaagaggaggaacagacacttaccattctgatccgcacagggctcctggtgatttccggagtcttccccgtgtctatcccgatcacggccgctgcctggtacctctgggaggtcaagaaacagagagccggcgtgctgtgggacgttccttctccccctcccgtggggaaggctgaacttgaggaaggagcctatcggattaaacagcgcggcatcctgggctactcccaaattggggcgggagtctataaggagggcacctttcacacaatgtggcatgtgaccagaggggctgttctgatgcaccggggaaaacgcatcgagccctcctgggccgatgtgaagaaggacctcgtcagctacggcgggggatggaaactggaaggcgagtggaaggaaggcgaggaagtccaggtgcttgccctggagcctgggaaaaacccgagagctgttcagacaaagcccggaattttcaaaaccaatacgggcaccatcggggccgtctccctcgattttagccctggaacatctggctcccccatcgtggaccggaaggggaaggtggtcggactgtacggcaacggcgtggttaccagaagcggggcgtatgtgtctgctattgcccagacagataaatccatcgaggacaaccctgaaattgaggatgacatcttccgcaagaaacggctcaccattatggatctgcatcccggagccggcaagacaaaaagataccttcctgctatcgtccgcgaagccatcaagcgggggctgagaacgctgattctcgctccgacccgcgtggttgccgcggagatggaagaggccctgcggggacttcccatcagatatcaaacccctgctattcgcgccgagcacaccggccgggaaatcgtggacctgatgtgtcatgctaccttcacaatgagactcctgagccccgtccgggtgcctaattacaacctcattatcatggacgaggcccactttacggatcccgcctccattgctgcgcgcgggtatatctctaccagagttgaaatgggcgaggccgctggaatcttcatgacagccaccccgcctggcagccgggacccctttccccagtccaatgcccctattatggatgaggaacgcgagatccccgaaagaagctggaactctgggcacgagtgggtgacagacttcaagggaaaaaccgtctggtttgtgccttccattaaggctggcaatgatatcgccgcgtgcctgcggaaaaacgggaagaaagtgattcagcttagcagaaagacgttcgactctgaatacgtcaagacacgcgctaatgattgggactttgttgtgaccaccgatatcagcgagatgggagccaacttcaaagccgagcgggtgatcgacccgagacgctgtatgaagcccgtcattctgacagatggcgaagaacgggtgatcctggctgggcctatgcccgttacccattcctctgccgcgcaaagacgcggccggattggaagaaatcctaaaaacgaaaatgaccagtatatctacatgggcgagcccctcgaaaacgacgaggattgcgcccactggaaggaggctaaaatgctgcttgacaatattaacacaccggaagggatcatccctagcatgtttgagcccgaacgcgagaaggtggatgccattgacggagaatacagactgcggggcgaggctcgcaaaaccttcgtcgatctcatgagaagaggggacctgcctgtgtggctggcctataaggttgctgccgagggaatcaattacgcggatcgcagatggtgttttgacggcattaagaacaaccagatcctcgaagagaatgtggaagtcgagatttggacgaaagagggggaacggaagaaacttaagcccagatggctggatgcccgcatctattccgaccctctggctctcaaagagttcaaggagttcgccgctggccggaagtctctgacacttaacctgattaccgagatgggaagactccccacatttatgacccagaaagcccgcaatgccctggataacctggctgtgctccatacggcggaagccggcgggaaggcttacaatcacgcccttagcgagctgccggagaccctggaaacactcctgcttctgaccctcctggccacagtcaccggaggcatcttcctgtttctcatgtccgggaaaggaatcggcaagatgacacttggcatgtgctgcattatcaccgctagcattctgctgtggtatgcccaaatccagcctcactggattgcggcctctatcatcctcgagttctttctgattgtgcttctgatccccgaacccgagaaacagcggacgcctcaggacaaccaactcacatacgttgtgattgctatcctgaccgtggtcgccgctaccatggccaatgaaatggggttcctggagaagacaaagaaagatctcggacttggctccattaccacacaggagagcgaatccaacatcctggacatcgacctgagaccggcgtctgcctggacgctctatgctgttgccaccacatttgtgacccccatgctgcggcatagcattgaaaatagctctgtgaacgtcagccttacagctatcgccaatcaggctaccgtgctgatggggctcggaaagggctggcctctgtccaaaatggatattggggttcccctgctcgccatcggatgttacagccaggtgaaccctattacgcttaccgcggccctgctgctcctggtcgctcactacgccatcattggccccggccttcaagctaaggccacacgcgaagcccagaaaagagcggctgccgggatcatgaagaatcctaccgtggacggaatcacagtcattgatctggagccgatcccctatgaccctaagttcgaaaaacagctcggccaggtgatgctgctgattctctgcgttacccaagtgcttatgatgcggacgacatgggctctgtgtgaggccctgaccctcgccacagggcccatctctaccctgtgggagggaaaccctggccgcttttggaataccacaattgctgtctccatggccaacatcttcagagggagctaccttgcgggagccggcctgctcttttctatcatgaagaatacgaccaacacacggcgcggcaccgggaacattggagaaacactgggcgagaaatggaagtccagactgaatgctctcgggaaaagcgagttccagatctataagaaatctggcattcaggaggtggatcggacccttgccaaggagggcatcaagcgcggggaaacggaccatcacgctgttagcagaggatccgccaaactgcggtggtttgtggagagaaacatggtcacacccgaaggcaaggtggtggatctgggctgcgggcgcggaggctggtcttactattgtgggggactcaaaaatgttcgggaggtcaagggcctgaccaaagggggaccgggccatgaggaacctattcccatgagcacctacggctggaaccttgtgagactgcaatccggggtggacgtcttcttcacaccccctgagaagtgcgataccctcctgtgtgacatcggagaaagctcccccaatcctacaatcgaggcgggccgcacgctgcgggttctcaaccttgtggaaaattggctgaacaataacacccagttttgcattaaggtgctgaatccgtatatgccctctgtcatcgagaaaatggaaacactccagagaaagtacgggggagccctggtgcgcaaccctcttagcagaaattccacccacgagatgtactgggtttctaacgctacaggcaatattgtgagctccgtcaacatgatctctagaatgctgattaaccgcttcaccatgaaacacaagaaagccacgtatgagcccgatgtggacctcgggagcggaacccggaatatcggcatcgaatccgaggttcctaacctggatattatcggcaagagaattgaaaagatcaaacaggagcatgaaacaagctggcactacgaccaagaccatccctataagacctgggcttaccacgggtcttatgagacaaaacagaccggatccgccagctctatggtgaatggcgtcgtgcgcctgctcacaaagccgtgggatgtggtccctatggttacccagatggctatgacggacacaaccccctttgggcagcaacgggtgttcaaagagaaggtggataccagaacacaggaacctaaggagggaacgaagaaacttatgaaaattaccgccgaatggctgtggaaagagctgggcaaaaagaaaatcccccgcatgtgtacaagagaggaatttacccggaaggtccgctccaacgcggccctcggggctattttcacagacgagaataagtggaaaagcgccagagaagctgtggaggatggacggttttgggaactggttgacagagagcggaaccttcacctggagggcaagtgcgaaacctgtgtgtacaatatgatgggcaaacgcgagaagaaactcggggagttcggaaaggccaagggctctagagccatctggtatatgtggctgggggcgcggtttctggagttcgaagctctcggatttctgaacgaggatcattggttctcccgcggcaatagcctttccggggtcgagggcgaaggactgcacagactcggctacatcctgcgggacgtgagcaaaaaggaagggggagccatgtacgccgatgacacagctggctgggatacccgcattacgcttgaagacctgaaaaacgaggaaatgatcaccaatcatatgaagggggagcacaaaaagctcgccgaggctatttttaagctgacatatcagaacaaagttgtgagagtccagcggcctacaccccgcggaacagtgatggacatcatttctagacgggatcaacgcggcagcgggcaggttggcacctacggactgaatacgttcacaaacatggaagcccagctcatcagacaaatggagggcgaagggatcttcaagtccattcagcatctgaccgtgacagaggagatcgcggtccagaattggcttgcccgggtgggacgcgaaagactgacccggatggctatttctggcgacgattgcgtcgtgaaaccgatcgacgatagatttgccaacgctctcacggccctgaacgacatggggaaggttcgcaaagatattcagcaatgggagcctagccggggatggaatgactggacccaggtgcccttctgctcccaccactttcatgaacttgtcatgaaggatggcagagtgctggtggttccctgtcgcaaccaggacgagctcatcgggcgggcgagaatctctcagggcgccggatggagcctgaaggaaacagcttgcctgggcaaatcctatgcccaaatgtggaccctcatgtacttccaccgccgggatctgagacttgctgccaatgctatttgttctgccgtgcctagccattgggtcccgacatcccgcaccacatggagcatccacgcgaagcacgagtggatgaccacggaggacatgctggccgtgtggaaccgggtttggattcaggaaaatccctggatggaggataaaacacctgtggaatcttgggaggaagtcccctatctcgggaagagagaggaccagtggtgcggatccctgatcggccttaccagccgcgctacctgggccaaaaacattcagacagccatcaatcaagtgcggtctctgattgggaacgagggatacaccgactatatgccttccatgaagagatttcggagagaagaggaagaggctggcgtcctctggtga

SEQ ID NO: 19640 - RNA, 9876 nt, synthetic construct
  misc_feature 1..9876: note = derived and/or modified CDS sequence (opt5) from DENV-2__FJ850088__SS-prME
  source 1..9876: mol_type = other RNA
accgccggagtgatcgtcatgctgattcccacagttatggctttccacctcacgaccagaaatggggagcctcatatgatcgtgggacggcaggaaaagggcaagagcctgctttttaagacagaggacggggtgaatatgtgcaccctgatggccattgatctcggagaactgtgtgaggacacaatcacctacaagtgcccccttctgcgccaaaacgaacccgaggatattgactgttggtgcaattccacatctacctgggtcacgtatggcacctgtacaaccacaggggagcacagacgggaaaagcgcagcgtggcgctcgttcctcatgtgggaatgggcctggagaccagaacggaaacatggatgtcctctgagggcgcttggaaacacgtccagcggatcgagacctggatcctgcgccatcccgggttcacaatgatggccgccattctcgcttacaccatcggaaccacacactttcagagagccctgattttcatccttctgacggctgtggcccctagcatgaccatgcggtgcattggcatctccaaccgcgattttgttgaaggggtgtctggaggcagctgggtcgacattgtgctcgagcacgggtcctgtgtgacaaccatggcgaagaataagcccacactggatttcgaacttatcaaaaccgaggccaagcagcctgctacgctgagaaaatattgcgtcgaagccaagctcacaaacaccaccacagagagccggtgtccgacccaaggagagccctctctgaatgaggaacaggacaaacgctttatctgcaagcattccatggttgatagaggctggggcaacgggtgtggactgttcggcaaagggggaattgtgacatgcgctatgtttacgtgcaaaaagaatatggaaggcaaagtggtccagcctgagaacctcgaatacaccatcgtgattacaccccacagcggggaggagcatgccgttggaaatgacaccggcaagcacggcaaagaagtgaagatcacacctcagtcttccattaccgaggcggaactgacggggtatggaaccgtcacaatggagtgtagcccccggaccggccttgatttcaacgaaatggtgctgctccaaatggaggacaaagcctggctggttcaccgccagtggtttcttgatctgccgctcccttggctgcccggggctgacacacagggatctaattggatccagaaggagaccctggtgacgttcaagaaccctcatgccaaaaagcaagacgtcgtggtcctcggctcccaggaaggggctatgcacacagccctgaccggcgccacagagatccagatgagctccggaaatcttctgtttaccggccatctcaaatgcagactgcggatggataaacttcaactgaaagggatgtcttacagcatgtgtaccggaaagttcaagattgtgaaagaaatcgctgagacacagcacggcacgattgttatcagagtgcagtatgagggggacggatccccctgcaagattcccttcgaaatcatggatctcgagaaacgccatgtcctgggccggctgatcaccgtgaaccctattgttacagaaaaggacagcccggtgaacatcgaggcggaacccccttttggggattcttacattatcgtcggcgtggagcccggacagctcaaactgaattggttcaagaagggctccagcattgggcaaatgtttgagaccacaatgagaggagccaaacgcatggctatccttggcgacaccgcctgggatttcgggtctctgggaggcgtgtttacgagcattgggaaggccctccaccaggttttcggcgctatctacggagccgcgtttaacggcgtctcctggacaatgaaaatcctgattggggtgatcattacctggatcggaatgaactctcggagcacctccctgagcgtgtctcttgtcctcgtgggcgttgtgacactgtatctgggggctatggtccaggccgactccggatgtgtggttagctggaagaacaaagaactcaagtgcggctctgggattttcatcaccgataatgtgcacacatggacggagcagtacaagtttcaacctgaatcccccagcaaactggcctccgctatccagaaggcccatgaggaaggcatttgtggaatcagatctgtcacccgccttgagaacctgatgtggaaacagattacaccggagctcaatcacatcctgagcgaaaacgaggtgaagctgaccattatgacaggcgacatcaaagggatcatgcaggctggaaagcggtcccttagacctcaacccaccgaactcaaatattcttggaagacgtggggcaaggccaaaatgctgcctaccgagagccataatcagacattcctgattgatgggcccgaaaccgcggagtgccctaacgccaatcgcgcttggaactccctcgaggttgaagactacggatttggcgtgttcacaaccaatatctggctgaaacttcgggagaaacaggacgtcttttgtgatagcaagctgatgtctgccgctattaaagacaacagagccgtgcacgcggatatgggctattggatcgaatccgccctcaatgacacatggaagatggagaaggctagcttcattgaggtgaaatcttgccactggcccaagtcccataccctgtggagcaacggggtcctggaatctgagatgatcatcccgaaaaacttcgccggacctgttagccagcacaattaccgccccggctatcatacgcaaacagctgggccctggcaccttggaaagctcgaaatggattttgacttctgtgagggcaccaccgtggtggtcacagaagattgcgggaaccggggaccttccctgagaaccacgacagccagcggcaaactgattaccgagtggtgctgtcggtcttgcacactcccgcccctgcgctacagaggcgaggacgggtgttggtacggaatggaaatccggcctcttaaggagaaggaagagaatctggtgaactccctcgttaccgccggccatgggcagattgataattttagcctgggagtgctgggcatggctcttttcctcgaagagatgctgagaacacgcgtcgggaccaaacacgcgatcctgctcgtggccgtttccctggtgacgcttattaccggaaacatgtcttttcgggacctgggcagagtcatggtgatggttggcgctacaatgaccgatgacatcgggatgggagtgacatatctcgccctgctggccgctttcaaggtccgccccacctttgccgcgggccttctgctcagaaaactgacgagcaaggagctcatgatggctacaattggggtggccctgctttcccagtctaccatccctgaaacaatcctggagctcaccgatgccctggctctgggaatgatggcccttaaagtggtcaagaatatggaaaagtaccaactggcggttaccattatggctatcagctgcgtgcccaacgccgtgattctccagaatgcctggaaagtctcctgtacaatcctggctgccgtgtctgttagccctctcctgcttacgtccagccagcagaaggctgactggattcccctggccctcaccatcaaaggcctgaacccgacagcgatcttcctgaccacactttctcggacctccaagaaacgcagctggcctctgaatgaggccgtgatggctgtcgggatggtgtctattctcgcctccagcctgctcaagaacgacatccccatgacgggacctctggttgctggcggccttctgacagtgtgctatgtcctgaccgggagatctgccgatctcgaactggagcgggccgctgacgtgaaatgggaggatcaagcggaaatttccggaagctcccccatccttagcattaccatctctgaggacggcagcatgtccatcaagaatgaagaggaggaacagacactgaccattctcatccgcacagggctgctcgtcatttctggagtgtttccggttagcatccctattacggccgctgcctggtacctgtgggaggtgaagaaacagagagccggcgtcctttgggatgtgccctcccctccgcccgttgaaaaggctgagctggaagacggggcctatcggatcaaacagcgcggcattctgggatactctcaaatcggcgcgggggtgtataaggagggaaccttccacacaatgtggcatgtcaccagaggcgctgtgctcatgcaccgggggaaacgcatcgagcctagctgggccgatgtgaagaaggacctggtttcctacggaggcgggtggaaacttgaaggagagtggaaggaaggcgaggaagtccaggtgctggccctcgagccgggcaaaaaccccagagctgtgcagacaaagcctgggatttttaaaaccaatacgggaaccatcggcgccgtctctctggatttcagccccgggacatccggaagccctattgtggaccggaagggcaaggttgtggggctctacggaaacggcgtcgtgaccagatctggcgcgtatgtttccgctatcgcccagacagagaaaagcattgaagataaccccgagatcgaagacgatatctttcgcaagaaacggctgaccattatggaccttcatcctggggccggaaagacaaaaagatacctgccggctatcgtgcgcgaggccattaagcggggcctgagaacgctcatcctggctcccacccgcgtcgtggccgcggaaatggaggaggcccttcgggggctgcctattagatatcaaacacccgctatccgcgccgaacacaccggacgggagatcgttgacctcatgtgtcatgctaccttcacaatgagactgctctctcctgtgcgggtccccaattacaacctgattatcatggatgaagcccacttcacggacccggcctccattgctgcgcgcggctatatcagcaccagagtggagatgggggaggccgctggcatttttatgacagccacccctcccggatcccgggatcccttccctcagtctaatgcccccatcatggacgaggaacgcgaaattcctgagagaagctggaactccggccacgaatgggtgacagattttaaggggaaaaccgtctggttcgttccgagcatcaaggctggaaatgacatcgccgcgtgccttcggaaaaacggcaagaaagtgattcagctgtctagaaagacgtttgattccgagtacgtgaagacacgcagcaatgactgggatttcgtcgtgaccaccgacatctctgagatgggggctaactttaaagccgaacgggttattgatcccagacgctgtatgaagcctgtgatcctgacagacggagaggaacgggtcattctcgccggccccatgcctgtgacccatagctccgctgcccaaagacgcgggcggatcggcagaaatcccaaaaacgagaatgaccagtatatctacatgggagaaccgctggagaacgatgaggactgcgcgcactggaaggaagccaaaatgcttctggataatattaacacacctgagggcatcattccctctatgttcgaacctgagcgcgaaaaggttgacgctatcgatggggagtacagactccggggagaggcccgcaaaacctttgtggacctgatgagacggggcgatctgcccgtctggctcgcttataaggtggccgctgaagggattaattacgccgaccgcagatggtgtttcgatggaatcaagaacaaccagatccttgaggaaaatgtcgaggtggagatttggacgaaagaaggcgagcggaagaaactgaagcctagatggctggacgcgcgcatctatagcgatcccctcgccctgaaagaatttaaggagttcgctgccgggcggaagtcccttacactgaacctcattaccgaaatgggcagactgccgacattcatgacccagaaagctcgcaatgccctggacaacctcgccgttcttcatacggctgaggcgggaggcaaggcctacaatcacgctctgtctgagctgcctgaaaccctcgagacactgcttctgctcgccctgctggccaccgtgacagggggaatctttctcttccttatgagcggcaaagggattggaaagatgaccctgggcatgtgctgcatcattacagcttccatcctgctctggtatgcccaaatccagccccactggattgcggccagcatcattctggaatttttccttatcgtgctgctcattcccgagcctgaaaaacagcggaccccgcaggataaccaactgacgtacgtcgttatcgctatcctgacagtggtggccgctaccatggccaatgagatgggctttctcgagaagaccaagaaagaccttgggctgggatctattacaacccaggaatccgagagcaacatcctggacattgatctcagacccgcgtccgcctggacactgtatgctgtcgccacgaccttcgtgacacctatgcttcggcattctatcgaaaatagctccgttaacgtgtctctgaccgctattgccaatcaggctacagtcctcatgggcctggggaagggatggcccctgagcaaaatggacatcggcgtgcctctccttgccatcgggtgttactcccaggtcaaccccattaccctgacggcggccctgctcctgcttgtggctcactacgccatcattggacctggcctgcaagctaaggccacccgcgaggcccagaaaagagcggctgccggcatcatgaagaatccgacagttgatgggattaccgtgatcgacctcgaacccattccttatgatcccaagtttgagaaacagctgggacaggtcatgctgctcatcctttgcgtgacacaagttctgatgatgcggaccacgtgggctctgtgtgaggccctcacactggccaccggccctatcagcacactttgggaagggaaccccggacgcttctggaataccaccattgctgtgtctatggccaacatctttagaggctcctacctggcgggggccggactcctgttcagcgtcatgaagaatacaacgaacacccggcgcggcacaggcaacattggggagaccctgggagaaaaatggaagtctagactcaatgctcttggcaaatccgagtttcagatctataagaaaagcgggattcaggaggtggaccggacactggccaaggaaggaatcaagcgcggcgagaccgatcatcacgctgtgtctagagggagcgccaaactgcggtggttcgttgaaagaaacatggtcacgccggagggaaaggtggtggacctcggctgcggccgcgggggatggtcctactattgtggcgggctgaaaaatgtccgggaagttaagggacttacaagaggcgggcctggacatgaggagcccatccccatgtctacctacggctggaacctggtgcgcctccaaagcggcgtggatgtctttttcacccctcccgaaaaatgcgacacactgctgtgtgatattggggagtccagccctaatccgaccatcgaagcgggacggacactcagagtgcttaacctggttgagaattggctgaacaataacacgcagttctgcattaaggtgctcaatccctatatgccttccgtcatcgaaaagatggagaccctgcagcgcacatacggcggggcccttgtgcggaaccccctgtctagaaatagcacccacgagatgtactgggtttccaacgctacaggaaatattgtgtctagcgtcaacatgatctcccgcatgctcatcaaccggtttaccatgaaacacaagaaagccacgtatgaacctgacgtggatctgggctctgggaccagaaatattggaatcgagagcgaaattcccaacctggacatcattggcaagcgcatcgagaaaatcaagcaggaacatgagacatcctggcactacgaccaagatcatccgtataagacctgggcttaccacggcagctatgagacaaaacagaccgggtctgcctccagcatggtgaatggagtcgttcggctccttacaaagccttgggacgtggtgcccatggtcacccagatggctatgacggatacaacccctttcggccagcaaagagtgtttaaagaaaaggttgacacccgcacacaggagcccaaagaagggacgaagaagctgatgaaaattaccgccgagtggctgtggaaggagctcggcaagaagaaaacacctagaatgtgtacccgggaagagttcacacgcaaggtgagatctaacgcggccctgggcgctatctttaccgatgaaaataaatggaagtccgcccgggaggctgtcgaagacgggagattctgggagcttgtggatcgggagcgcaacctgcacctcgaaggaaagtgcgagacatgtgtttacaatatgatgggcaaaagagaaaagaaactgggcgagtttgggaaggccaaaggaagccgggccatttggtatatgtggctgggcgcgcgcttcctcgaatttgaggctctggggttccttaacgaggaccattggttttctagaggaaattccctgagcggcgtggaaggggagggcctccaccggctgggatacatccttcgcgatgtctccagaaaggaaggcggggccatgtacgccgacgataccgctggatgggacacgcggattaccctggaggacctcaagaacgaagagatggtgacaaatcatatgaaaggcgagcacaagaaactggccgaagctatcttcaagctgacctatcagaacaaagttgtgcgcgtccagagacccacaccgcgggggaccgtgatggatattatcagccgcagagaccaacggggatctggccaggtcgggacgtacggcctcaatacatttaccaacatggaggcccagctgatccgccaaatggaaggagagggcattttcaagagcatccagcatcttacagtgaccgaggaaattgcggttcagaattggctggccagagtggggcgggagagactcacgcgcatggctatctccggagatgactgcgtcgtgaagcctattgatgaccggttcgccaacgctctgaccgcccttaacgatatgggcaaagtgagaaaggacatccagcaatgggaaccctctcgcgggtggaatgattggacacaggttcccttttgcagccaccacttccatgagctggtgatgaaagacggacgggtcctcgtggttccttgtagaaaccaggatgaactgatcggccgcgcgcggatttcccagggggccggctggtctctgaaggagaccgcttgcctcggaaaaagctatgcccaaatgtggacactgatgtactttcacagacgcgaccttcggctggctgccaatgctatctgttccgccgtgccgtctcattgggtccccaccagcagaacaacctggtccattcacgcgaagcacgagtggatgacgacagaagatatgctcgccgtgtggaaccgcgtctggatccaggagaatccttggatggaagacaagacccccgtggagagctgggaagaggttccttatctgggcaaacgggaggaccagtggtgcgggtctcttattggactgacctccagagctacatgggccaagaacatccagaccgccatcaatcaagtgcggagcctcattggcaacgaagagtacacagattatatgccctctatgaaaagattccgccgggaagaggaagaggctggggtcctgtggtga

SEQ ID NO: 19641 - RNA, 9876 nt, synthetic construct
  misc_feature 1..9876: note = derived and/or modified CDS sequence (opt5) from DENV-2__FJ850091__SS-prME
  source 1..9876: mol_type = other RNA
accgccggcgtgatcgtcatgctgattcccacagctatggccttccacctcacgaccagaaacggggagcctcatatgatcgttggacggcaggaaaagggcaaaagcctgctttttaagacagaggacggggtgaatatgtgcaccctgatggcgatggatctcggagaactgtgtgaggacacaattacctacaaatgcccgcttctgcgccaaaacgaacccgaggatatcgactgttggtgcaattccacatctacctgggtgacgtatggcacctgtacaaccacaggggagcacagacgggaaaagcgcagcgtcgctctcgtgcctcatgttggaatgggcctggagaccagaacggaaacatggatgtcctctgagggcgcctggaaacacgtgcagcggattgagacctggatcctgcgccatcccgggttcacaatcatggccgctattctcgcctacaccatcggaaccacacactttcagagagctctgattttcatccttctgacggccgtcgcgcctagcatgaccatgcggtgcattggcatctccaaccgcgattttgtggaaggggtttctggaggcagctgggtggacattgtcctcgagcacgggtcctgtgtgacaaccatggccaagaataagcccacactggatttcgaacttatcaaaaccgaggctaagcagcctgccacgctgagaaaatattgcatcgaagctaagctcacaaacaccaccacagagagccggtgtccgacccaaggagagccctctctgaatgaagagcaggacaaacgctttatttgcaagcattccatggtggatagaggctggggcaacgggtgtggactgttcggcaaggggggaatcgtcacatgcgccatgtttacgtgcaaaaagaatatggaaggcaaaattgttcagcctgagaacctcgaatacaccatcgtgattacaccccacagcggggaggagcatgcggtgggaaatgacaccggcaagcacggcaaagaaatcaagatcacacctcagtcttccaccacggaggccgaactgaccgggtatggaacagtcaccatggagtgtagcccccggacaggccttgatttcaacgaaatggtgctgctccaaatggaggacaaagcttggctggttcaccgccagtggtttcttgatctgccgctcccttggctgcccggggccgacacccagggatctaattggattcagaaggagacgctggtgacattcaagaaccctcatgctaaaaagcaagacgtcgtggttctcggctcccaggaaggggccatgcacaccgccctgacaggcgctaccgagatccagatgagctccggaaatcttctgtttaccggccatctcaaatgcagactgcggatggataagcttcaactgaaagggatgtcttacagcatgtgtacaggaaagttcaagattgtgaaagaaatcgcggagacgcagcacggcaccattgtcatcagagtgcagtatgagggggacggatccccctgcaagatccccttcgaaattacagatctcgagaaacgccatgtcctgggccggctgatcaccgtgaaccctattgttacagaaaaggacagcccggtgaacatcgaggccgaacccccttttggggattcttacattatcgtcggcgtggagcccggacagctcaaactgaattggttcaagaagggctccagcattgggcaaatgtttgagaccacgatgagaggagctaaacgcatggccatccttggcgacacagcctgggatttcgggtctctgggaggcgtttttaccagcatcgggaaggctctccaccaggtgttcggcgccatttacggagcggctttttccggcgtctcttggaccatgaaaatcctgattggggtgatcattacatggatcggaatgaacagccggtccaccagcctgtctgtgtcccttgttctcgtcggcgtggtgacactgtatctgggggccatggtccaggccgacagcggatgtatcgtgtcttggaagaataaagaactcaagtgcggctccgggattttcatcacggataacgttcacacctggacagagcagtacaagtttcaacctgaaagcccctccaaactggcttctgccattcagaaggctcatgaggaaggcatctgtggaattagaagcgtgacccgccttgagaatctgatgtggaaacagatcacaccggagctcaaccacatcctgtccgaaaatgaggtcaagctgaccattatgacgggcgacatcaaagggattatgcaggccggaaagcggtctcttagacctcaacccaccgaactcaaatatagctggaagacatggggcaaggcgaaaatgctgtccaccgagagccataaccagacattcctgatcgatgggcctgaaaccgccgagtgccccaatacaaaccgcgcttggaattctctcgaggtggaagactacggatttggcgttttcaccacgaacatttggctgaagcttcgggagaaacaggacgtgttttgtgattccaagctgatgagcgccgctatcaaagacaatagagccgtccacgcggatatgggctattggatcgaatctgccctcaacgacacatggaagatggagaaggcttccttcattgaggtgaaaagctgccactggcctaagtctcataccctgtggagcaatggggttctggaatccgagatgatcattcccaaaaacttcgccggaccggtgagccagcacaactaccgccctggctatcatacccaaacagctgggccctggcaccttggaaagctcgaaatggattttgacttctgtgagggcaccacggtcgtggtgacagaagattgcgggaatcggggaccctctctgagaaccacaaccgcctccggcaaactgatcacagagtggtgctgtcggagctgcaccctccctccgctgcgctacagaggcgaggacgggtgttggtacggaatggaaattcggccccttaaggagaaggaagagaacctggtcaattccctcgttacggccggccatgggcagatcgataacttttctctgggagtgctgggcatggctcttttcctcgaagagatgctgagaacccgcgtggggacaaaacacgcgattctgctcgtcgccctgagctttgtgacccttatcacaggaaatatgtccttccgggacctgggcagagttatggtgatggtcggcgctaccatgacggatgacatcgggatgggagtgacatatctcgccctgctggccgcttttaaggttcgccctaccttcgccgcgggccttctgctcagaaaactgacatctaaggagctcatgatggctaccattgggatcgccctgcttagccagtccaccctgcccgaaacaattctcgagctgacggatgccctggctcttggaatgatggccctgaaaatcgtgcggaacatggaaaagtaccaactcgcggtcaccattatggctatctcttgcgtgcctaatgccgttatcctgcagaacgcctggaaggtgagctgtacaattctcgctgccgtctccgtgagccccctgcttctgacctcttcccagcagaaagctgactggatccctctcgccctgacaattaagggcctgaatcccaccgcgatctttcttacgacactgagccgcacctctaaaaagagatcctggccgctcaacgaggccattatggctgtggggatggtcagcatcctggcctcttccctcctgaaaaatgacatccctatgaccggaccccttgttgctggcggcctgctgacagtgtgctatgtgctcaccgggcgggccgccgatctggaacttgagcgcgctgcggacgtcaagtgggaggatcaagccgaaattagcggatccagccctatcctgtctattacaatcagcgaggacggctccatgtctattaaaaacgaagaggaggaacagacgctcaccatcctgattagaacagggctcctggtgatcagcggagttttccccgtgtccatcccgattaccgctgccgcctggtacctttgggaggtcaagaagcagcgggctggcgtgctgtgggatgttccttctccccctcccgtggggaaagccgaactggaggacggagcgtatcgcatcaagcagagaggcattctcggctacagccaaatcggggctggagtctataaagaaggcacatttcacaccatgtggcatgtgacgcggggggccgtcctgatgcaccgcggaaagagaattgagccctcctgggccgatgtgaaaaaggaccttatctcttacggcgggggatggaagctggagggcgaatggaaagagggcgaagaggttcaggtgctcgctctggaacctgggaagaatccgcgggccgtccagaccaaacccggaatcttcaagacaaacaccggcacaattggggcggtgagcctcgatttttcccctggaaccagcggctctcccatcgttgacagaaaagggaaggtggtcggactgtacggcaatggcgtggtgacacgctccggggcttatgttagcgccattgcccagacggagaagtctatcgaggataaccctgaaattgaggacgatatcttccggaaaaagagacttaccatcatggacctgcatcccggagctggcaaaacaaagcgctacctgcctgccattgtccgggaagctatcaaaagagggctccgcaccctgattcttgccccgacccgggtggtggcggccgagatggaagaggctctgagaggactccccatccgctatcaaacacctgccattcgggctgagcacacgggcagagaaatcgtcgacctgatgtgtcatgccaccttcacaatgcggctcctgtcccccgtgcgcgttcctaactacaatcttattatcatggatgaggcccactttaccgaccccgctagcatcgcggccagagggtatatttccacacgggtggaaatgggcgaggctgccggaatcttcatgaccgccacgccgcctggctctcgcgatccctttccccagagcaacgctcctattatggacgaggaaagagagatccccgaacggtcctggaatagcgggcacgagtgggtcacagatttcaagggaaagaccgtgtggtttgttccttctattaaagccggcaacgacatcgcggcttgcctgagaaagaatgggaaaaaggtgatccagctgtcccgcaaaaccttcgatagcgaatacgccaagacacgggccaacgactgggattttgtcgtgaccacagacatttctgagatgggagctaatttcaaggccgagagagttatcgatccgcgccggtgtatgaaacccgtgattctcaccgacggcgaagagagagtcatcctggcggggcctatgcccgtgacgcatagctccgccgctcaacgccggggcagaattggacgcaaccctaagaatgaaaacgaccagtatatctacatgggcgagccccttgaaaatgatgaggactgcgcccactggaaagaggctaagatgctgctcgataacatcaatacaccggaagggattatcccttctatgtttgagcccgaaagagagaaagtggacgccattgatggagaataccggctgcgcggcgaggctagaaagaccttcgtcgacctgatgcggcgcggggatctccctgtttggcttgcctataaagtggcggccgagggaatcaactacgctgacagaaagtggtgttttgatggcattaagaataaccagatcctggaagagaacgtggaagtcgagatttggacaaaagagggggaacggaagaaactgaagcccagatggctcgacgcccgcatctatagcgatcctctggctcttaaagagttcaaggaattcgccgccggccggaagtccctgaccctcaatctgatcacggagatgggaagactgcccacctttatgacacagaaagctcgcaacgcgctcgacaatcttgccgtgctgcataccgctgaagttggcgggaaggcctacacacacgccctgtctgagctcccggagaccctggaaacacttctgctcctgaccctgctcgctgccgtgacgggaggcattttcctttttctgatgagcgggaaaggaatcggcaagatgacactgggcatgtgctgcattatcaccgcgtccattctcctgtggtatgcccaaatccagcctcactggatcgctgccagcattatccttgagttctttctgattgtcctcctgatccccgaacccgagaaacagcggacccctcaggataaccaactgacatacgtggttattgctatcctcaccgtggtcgccgcgacaatggccaatgaaatggggttccttgagaagacgaagaaagacctgggatttggctctatcaccacacaggagtccgaaagcaacattctggacatcgatctcagaccggcttccgcctggaccctgtatgctgtggccacaaccttcgtcacgcccatgcttcggcattctattgagaatagctccgtgaacgtttctctgaccgctatcgccaatcaggcgacagtgctcatggggctgggaaagggctggcctctgagcaaaatggacattggggtgcccctccttgccatcggatgttactcccaggtcaaccctattaccctgacagctgccctgctcctgcttgttgctcactacgccatcatcggccccggcctgcaagccaaggcgacccgcgaagctcagaaaagagccgctgccgggattatgaagaatcctacggtggatggaatcacagtgattgacctcgagccgatcccctatgatcctaagtttgaaaaacagctgggccaggtcatgctgctcattctttgcgtgacccaagttctgatgatgcggacaacctgggccctgtgtgaggctctcaccctggccacagggcccatcagcacgctttgggagggaaaccctggccgcttctggaataccacaatcgcggtgtctatggccaacatttttagagggtcctacctggctggagccggcctcctgttcagcatcatgaagaataccacaaacacccggcgcggcacggggaatgtcggagaaacactgggcgagaaatggaagtctagactcaacgctcttgggaaatccgaatttcagatttataagaaaagcggaatccaggaggtggaccggaccctggccaaggagggcattaagcgcggggaaaccgatcatcacgcggtctctagaggaagcgccaaactgcggtggttcgtggagagaaacatggttacacccgaaggcaaggtggtcgacctcggctgcgggcgcggaggctggtcctactattgtgggggactgaaaaatgtgcgggaggttaagggccttaccaaagggggaccgggccatgaagagcctatccccatgtctacatacggctggaacctggtgagactccaaagcggggtcgatgtgttctttacgccccctgagaagtgcgacaccctgctgtgtgatatcggagaatccagccccaatcctacaattgaggctggccgcaccctccgggtgcttaacctggttgaaaattggctgaacaataacacacagttctgcatcaaggtcctcaatccgtatatgccctccgtgattgagaaaatggaaaccctgcagagaaagtacgggggagcccttgtgcgcaaccctctgtctcggaatagcacgcacgagatgtactgggtctccaacgctaccggcaatatcgtttctagcgtgaacatgatttccagaatgctcatcaatcgctttacaatgaaacacaagaaagccacctatgagcccgacgtggatctggggtctggaacacggaacatcggcattgaaagcgagatccctaacctggacattatcggcaagagaattgaaaagatcaaacaggagcatgaaacctcctggcactacgaccaagatcatccctataagacatgggcttaccacgggagctatgagaccaaacagacgggatctgcctccagcatggtcaatggcgtggttcgcctccttacaaagccgtgggacgtggtccctatggtgacccagatggcgatgaccgatacaacgcccttcgggcagcaacgggtttttaaagagaaggtggacaccagaacacaggaacctaaggagggaaccaaaaagctgatgaaaattacagccgaatggctgtggaaggagctcggcaaagagaagaccccccgcatgtgtacaagagaagagttcacccggaaagtccgctctaacgctgccctgggggctgtgtttacggatgaaaataagtggaagtccgccagagaggccgtggaagacggacggttctgggagcttgtcgatagagagcggaacctgcacctcgaaggcaaatgcgagacctgtgtttacaatatgatgggcaagcgcgaaaaaaagctgggggagtttggaaaagcgaagggcagcagagctatctggtatatgtggctgggggcccggttcctcgaatttgaggccctgggattccttaacgaggaccattggttttctcgcggcaattccctgagcggggtggaaggcgagggactccacagactgggctacatccttcgggaagtggggaagaaagagggaggcgctatgtacgccgatgacacagctgggtgggatacccgcattacactggaagacctcaagaacgaggagatggtcaccaatcatatgaaaggagaacacaagaaactggccgaggcgatcttcaagctgacgtatcagaacaaggtggttagagtgcagcggcctacaccccgcggcaccgtcatggacattatctccagaaaagatcaacgggggagcggccaggtgggaacatacggcctcaataccttcacgaacatggaagcccagctgattcgccaaatggagggggagggaatctttaagtctatccagcatcttaccgctacagaagagattgccgttcagaattggctggctagagtgggccgggaacgcctcagcagaatggccatctccggggacgattgcgtcgtgaaaccgattgacgatcggttcgcgtctgccctgaccgctcttaacgacatgggaaaggttagaaaagatatccagcaatgggagcctagccgcggctggaatgactggacacaggtgcccttttgctcccaccacttccatgaactggtcatgaaggatgggcgggtgctcgtcgtgccctgtagaaaccaggacgagctgattggccgcgcccggatctctcagggagctggctggagcctgaaggagaccgcctgcctcgggaaatcctatgctcaaatgtggacactgatgtactttcacagacgcgatcttcggctggccgcgaacgccatctgttctgctgttcctagccattgggtgccgacctccagaacgacatggagcattcacgccaagcacgaatggatgaccaccgaggacatgctcgccgtctggaatcgcgtgtggatccaggaaaacccctggatggaggataaaacacctgtggaatcttgggaggaggttccctatctgggaaagcgggaagaccagtggtgcggctcccttattgggctgaccagcagagctacatgggccaaaaatatccagacggcgattaaccaagtgcgctctctcatcggaaatgagggctacaccgactatatgccttccatgaagcggttcagacgggaagaggaagaggctggggtcctgtggtga

SEQ ID NO: 19642 - RNA, 9876 nt, synthetic construct
  misc_feature 1..9876: note = derived and/or modified CDS sequence (opt5) from DENV-2__GQ199890__SS-prME
  source 1..9876: mol_type = other RNA
accgccggcgtgatcgtcatgctgattcccaccgctatggccttccacctcacgaccagaaatggggagcctcatatgatcgttggacggcaggaaaagggcaaaagcctgctttttaagacagaggacggggtgaatatgtgcaccctgatggcgattgatctcggagaactgtgtgaggacacaatcacctacaaatgcccgcttctgcgccaaaatgaacccgaggatattgactgttggtgcaatagcacatctacctgggtgacgtatggcacctgtacaaccatcggggagcacagacgggaaaagcgcagcgtcgctctcgtgcctcatgttggaatgggcctggagacaagaaccgaaacgtggatgtcctctgagggcgcctggaaacacgtgcagcggatcgagacatggattctgcgccatcccgggttcaccatcatggccgctattctcgcctacacaatcggaaccacccactttcagagagctctgattttcatccttctgacagccgtcgcgcctagcatgacgatgcggtgcattggcatctccaaccgcgattttgtggaaggggtttctggaggcagctgggtggacatcgtcctcgagcacgggtcctgtgtgaccacaatggccaagaataagcccaccctggatttcgaacttattaaaacagaggctaagcagcctgccaccctgagaaaatattgcatcgaagctaagctcacgaacacaaccaccgagagccggtgtccgacacaaggagagccctctctgaatgaagaacaggacaaacgctttatttgcaagcattccatggtggatagaggctggggcaacgggtgtggactgttcggcaaagggggaatcgtcacatgcgccatgtttacatgcaaaaagaatatggaaggcaaaattgttcagcctgagaacctcgaatacacgatcgtgatcacaccccacagcggggaggagcgggcggtgggaaatgacacaggcaagcatggcaaagaaattaagatcacccctcagtcttccacaaccgaggccgaactgacggggtatggaaccgtcacaatggagtgtagcccccgcaccggccttgatttcaacgaaatggtgctgctccaaatggaggacaaggcttggctggttcacagacagtggtttcttgatctgccgctcccttggctgcccggggccgacacacagggatctaattggattcagaaggagaccctggtgacgttcaagaaccctcacgctaaaaagcaagacgtcgtggttctcggctcccaggaaggggccatgcatacagccctgaccggcgctacagagatccagatgagctccggaaatcttctgtttaccggccacctcaaatgccggctgagaatggataaacttcaactgaaagggatgtcttacagcatgtgtaccggaaagttcaagattgtgaaagaaatcgcggagacacagcatggcacgatcgtcattcgcgtgcagtatgagggggacggatccccctgcaagatccccttcgaaattaccgatctcgagaaacggcacgtcctgggcagactgatcacagtgaaccctattgttaccgaaaaggacagcccggtgaacatcgaggccgaacccccttttggggattcttacattatcgtcggcgtggagcccggacagctcaaactgaattggttcaagaagggctccagcatcgggcaaatgtttgagacaaccatgcgcggagctaaacggatggccattcttggcgacacggcctgggatttcgggtctctgggaggcgtttttacaagcatcgggaaggctctccatcaggtgttcggcgccatttacggagcggctttttccggcgtctcttggaccatgaaaatcctgattggggtgatcatcacctggattggaatgaacagcagatccacaagcctgtctgtgtcccttgttctcgtcggcgtggtgaccctgtatctgggggccatggtccaggccgacagcggatgtatcgtgtcttggaagaataaagaactcaagtgcggctccgggattttcatcacagataacgttcacacgtggaccgagcagtacaagtttcaacctgaaagcccctccaaactggcttctgccattcagaaggctcacgaggaaggcatctgtggaatccgcagcgtgacacggcttgagaatctgatgtggaaacagattaccccggagctcaaccatatcctgtccgaaaatgaggtcaagctgacaattatgaccggcgacatcaaagggattatgcaggccggaaagagatctcttcgccctcaacccacggaactcaaatatagctggaagacctggggcaaggcgaaaatgctgtccacagagagccacaaccagaccttcctgatcgatgggcctgaaacagccgagtgccccaataccaaccgggcttggaactctctcgaggtggaagactacggatttggcgttttcacaaccaacatctggctgaaacttagagagaaacaggacgtgttttgtgattccaagctgatgagcgccgctattaaagacaatcgcgccgtccatgcggatatgggctattggatcgaatctgccctcaacgacacgtggaagatggagaaggcttccttcattgaggtgaaaagctgccactggcctaagtctcacacactgtggagcaatggggttctggaatccgagatgatcattcccaaaaacttcgccggaccggtgagccagcataactaccggcctggctatcacacccaaaccgctgggccctggcatcttggaaagctcgaaatggattttgacttctgtgagggcacaaccgtcgtggtgacggaagattgcgggaatagaggaccctctctgcggacaaccacagcctccggcaaactgatcaccgagtggtgctgtcgcagctgcacactccctccgctgagataccggggcgaggacgggtgttggtacggaatggaaattagaccccttaaggagaaggaagagaacctggtcaattccctcgttaccgccggccacgggcagatcgataacttttctctgggagtgctgggcatggctcttttcctcgaagagatgctgcgcacgcgggtggggaccaaacatgcgatcctgctcgtcgccctgagctttgtgacacttattaccggaaatatgtccttcagagacctgggccgcgttatggtgatggtcggcgctacaatgaccgatgacatcgggatgggagtgacgtatctcgccctgctggccgcttttaaggttagacctacattcgccgcgggccttctgctccggaaactgacctctaaggagctcatgatggctacaattgggatcgccctgcttagccagtccaccctgcccgaaaccattctcgagctgacagatgccctggctcttggaatgatggccctgaaaatcgtgcgcaacatggaaaagtaccaactcgcggtcacgatcatggctatttcttgcgtgcctaatgccgttatcctgcagaacgcctggaaggtgagctgtaccattctcgctgccgtctccgtgagccccctgcttctgacatcttcccagcagaaagctgactggatccctctcgccctgaccattaagggcctgaatcccacagcgatctttcttaccacgctgagcagaacatctaaaaagcggtcctggccgctcaacgaggccatcatggctgtggggatggtcagcattctggcctcttccctcctgaaaaatgacatccctatgaccggaccccttgttgctggcggcctgctgaccgtgtgctatgtgctcacagggcgcagcgccgatctggaacttgagagagccgctgacgtcaagtgggaggatcaagcggaaatttccggaagctctcctatcctgagcattaccatctccgaggacggctctatgagcattaaaaacgaagaggaggaacagacactcacgatcctgatccggaccgggctcctggtgatttccggagttttccccgtgtctatcccgattacagccgctgcctggtacctttgggaggtcaagaagcagcgcgccggcgtgctgtgggatgttccttctccccctcccgtggggaaagctgaactggaggacggagcctatagaatcaagcagcggggcattctcggctactcccaaatcggggcgggagtctataaagaaggcacctttcacacaatgtggcacgtgacccgcggggctgtcctgatgcatagaggaaagcggatcgagccctcctgggccgatgtgaaaaaggaccttattagctacggcgggggatggaagctggagggcgaatggaaagagggcgaagaggttcaggtgctcgccctggaacctgggaagaatccgagagctgtccagacgaaacccggaatcttcaagaccaacacaggcaccattggggccgtgtccctcgattttagccctggaacatctggctcccccatcgttgaccgcaaagggaaggtggtcggactgtacggcaatggcgtggtgacccggagcggggcgtatgtttctgctattgcccagacagagaagtccatcgaggataaccctgaaatcgaggacgatattttccgcaagaagcgccttacgatcatggacctgcaccccggagccggcaaaaccaagcggtacctgcctgctattgtcagagaagccatcaaacgcgggctccggacactgattcttgctccgaccagagtggtggccgcggagatggaagaggccctgcgcggactccccatccggtatcaaacccctgctattagagccgagcatacaggccgggaaatcgtcgacctgatgtgtcacgctacgttcaccatgcgcctcctgagccccgtgagagttcctaactacaatcttatcattatggatgaggcccattttacagaccccgcctccatcgctgcgcgggggtatatttctacccgcgtggaaatgggcgaggccgctggaatcttcatgacagccaccccgcctggcagcagagatccctttccccagtccaacgcccctattatggacgaggaacgggagatccccgaaagaagctggaactctgggcacgagtgggtcacggatttcaagggaaagacagtgtggtttgttccttccatcaaagctggcaacgacattgccgcgtgcctgcgcaagaatgggaaaaaggtgatccagctgagccggaaaaccttcgattctgaatacgtcaagaccagagctaacgactgggattttgtggttacaaccgacattagcgagatgggagccaatttcaaggccgagcgcgtgatcgatccgcggagatgtatgaaacccgtcattctcacagacggcgaagaaagagtgatcctggctgggcctatgcccgtgacccactcctctgccgcgcaacggagaggccgcatcggaagaaaccctaagaatgaaaacgaccagtatatttacatgggcgagccccttgaaaatgatgaggactgcgcccattggaaagaggctaagatgctgctcgataacatcaatacgccggaagggattatccctagcatgtttgagcccgaacgggagaaagtcgacgccattgatggagaataccgcctgagaggcgaggctcggaagacattcgttgacctgatgcgcagaggggatctccctgtgtggcttgcctataaagtggctgccgagggaatcaactacgcggaccggaagtggtgttttgatggcattaagaataaccagatcctggaagagaacgtcgaagtggagatctggaccaaagagggggaaagaaagaaactgaagccccgctggctcgacgcccggatttattccgatcctctggctcttaaagagttcaaggagttcgccgctggcagaaagtctctgacactcaatctgatcaccgagatgggacgcctgcccacgtttatgacccagaaagcccggaacgccctcgacaatcttgctgttctgcacacagcggaagtgggcgggaaggcctacacccatgctctgagcgagctcccggagacactggaaacccttctgctcctgacactgctcgccaccattacgggaggcatcttcctttttctgatgtccgggaaaggaattggcaagatgacactgggcatgtgctgcatcatcaccgccagcattctcctgtggtatgctcaaatccagcctcactggattgccgcgtctatcattcttgagttctttctgatcgtcctcctgatccccgaacccgagaaacagagaacccctcaggataaccaactgacatacgtggttattgccatcctcaccgtggtcgctgccacaatggctaatgaaatggggttccttgagaagacgaagaaagacctgggatttggcaccattacaacccaggagtccgaaagcaacatcctggacattgatctccggccggcctccgcgtggacactgtatgccgtggctaccacgttcgtcacccccatgcttcgccactctatcgagaatagctccgtgaacgtttctctgacagccattgctaatcaggccaccgtgctcatggggctgggaaagggctggcctctgagcaaaatggacatcggggtgcccctccttgctatcggatgttactcccaggtcaaccctattacactgaccgccgcgctgctcctgcttgttgcccattacgctatcattggccccggcctgcaagccaaggctacgagagaagcccagaaacgggccgcggctgggatcatgaagaatcctacagtggatggaattaccgtgatcgacctcgagccgatcccctatgatcctaagtttgaaaaacagctgggccaggtcatgctgctcattctttgcgtgacacaagttctgatgatgcgcaccacctgggccctgtgtgaggctctcacactggccacggggcccatcagcaccctttgggagggaaaccctggcagattctggaatacaaccattgccgtgtctatggctaacatctttcgggggtcctacctggccggagcgggcctcctgttcagcattatgaagaatacaaccaacacgcgcagaggcacagggaatgtcggagaaaccctgggcgagaaatggaagtctcggctcaacgcccttgggaaatccgaatttcagatctataagaaaagcggaatccaggaggtggaccgcaccctggctaaggagggcattaagagaggggaaacagatcaccatgccgtctctcggggaagcgctaaactgagatggttcgtggagcgcaacatggttacccccgaaggcaaggtggtcgacctcggctgcgggcggggaggctggtcctactattgtgggggactgaaaaatgtgagagaggttaagggccttacaaaagggggaccgggccacgaggaacctatccccatgtctacgtacggctggaacctggtgcgcctccaaagcggggtcgatgtgttctttacaccccctgagaagtgcgacaccctgctgtgtgatattggagaatccagccccaatcctaccatcgaggccggccggacactcagagtgcttaacctggttgaaaattggctgaacaataacacccagttctgcattaaggtcctcaatccgtatatgccctccgtgatcgagaaaatggaaacgctgcagcgcaagtacgggggagcgcttgtgcggaaccctctgtctagaaatagcacccatgagatgtactgggtctccaacgccacaggcaatatcgtttctagcgtgaacatgatttcccgcatgctcatcaatcggtttaccatgaaacacaagaaagctacatatgagcccgacgtggatctggggtctggaaccagaaacattggcatcgaaagcgagattcctaacctggacatcattggcaagcgcatcgaaaagatcaaacaggagcacgaaacatcctggcattacgaccaagatcacccctataagacctgggcctaccatgggagctatgagacgaaacagacaggatctgcttccagcatggtcaatggcgtggttcggctccttaccaagccgtgggacgtggtccctatggtgacccagatggccatgacagatacgacccccttcgggcagcaaagagtttttaaagagaaggtggacacacgcacccaggaacctaaggagggaaccaagaagctgatgaaaattaccgctgaatggctgtggaaggagctcggcaaagagaagacacccagaatgtgtacccgggaagagttcacgcgcaaagtcagatctaacgccgcgctgggggccatctttaccgatgaaaataagtggaagtccgctcgggaggccgtggaagacggaagattctgggagcttgtggatcgggagcgcaacctgcacctcgaaggcaaatgcgagacatgtgtctacaatatgatgggcaagagagagaaaaagctgggggagtttggaaaagctaagggcagccgggccatttggtatatgtggctgggggcccgcttcctcgaatttgaggcgctgggattccttaacgaggaccactggttttctagaggcaattccctgagcggggttgaaggcgagggactccatcggctgggctacatccttcgcgaagtggggaagaaagagggaggcgctatgtacgccgatgacaccgccgggtgggatacaagaattaccctggaagacctcaagaacgaggagatggtgacgaatcacatgaaaggagaacataagaaactggctgaggccatcttcaagctgacatatcagaacaaggtcgtgcgggttcagcgccctacccccagaggcacagtgatggacatcatttcccggaaagatcaacgcgggagcggccaggtcggaacctacggcctcaatacgttcaccaacatggaagctcagctgatcagacaaatggagggggagggaatttttaagtctatccagcaccttacagccaccgaagagattgcggtgcagaattggctggcccgggttggccgcgaaagactcagccggatggctatctccggggacgattgcgtggtcaaaccgatcgacgatagattcgcctctgctctgacagcccttaacgacatgggaaaggtgcgcaaagatattcagcaatgggagcctagccggggctggaatgactggacccaggttcccttttgctcccatcacttccacgaactggtgatgaaggatgggagagtcctcgtggtcccctgtcgcaaccaggacgagctgatcggccgggcgagaatttctcagggagccggctggagcctgaaggagacagcttgcctcgggaaatcctatgcccaaatgtggaccctgatgtactttcatcgccgggatcttagactggctgccaacgctatctgttctgccgtgcctagccactgggttccgacgtcccgcacaacctggagcattcatgcgaagcacgaatggatgaccacagaggacatgctcgccgtgtggaatcgggtctggatccaggaaaacccctggatggaggataaaacccctgtggaatcttgggaggaggtgccctatctgggaaagagagaagaccagtggtgcggctcccttattgggctgacaagccgcgctacgtgggccaaaaatatccagaccgccatcaaccaagttcggtctctcattggaaatgagggctacacagactatatgccttccatgaagagattccggaaggaagaggaagaggctggggtgctgtggtga

SEQ ID NO: 19643 - RNA, 9876 nt, synthetic construct
  misc_feature 1..9876: note = derived and/or modified CDS sequence (opt5) from DENV-2__GQ868549__SS-prME
  source 1..9876: mol_type = other RNA
accgccggagtgatcgtcatgctgattcccacagctatggccttccacctcacgacccggaatggggagcctcatatgatcgttggacggcaggaaaagggcaagagcctgctttttaagacagaggacggggtgaatatgtgcaccctgatggcgattgatctcggagaactgtgtgaggacacaatcacctacaagtgcccgcttctgcgccaaaatgaacccgaggatattgactgttggtgcaattccacatctacctgggtgacgtatggcacctgtacaaccacaggggagcaccggcgggaaaagcgcagcgtcgctctcgtgcctcatgttggaatgggcctggagaccagaacggaaacatggatgtcctctgagggcgcctggaaacacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaagaacaggacaaacgctttatctgcaagcattccatggtggatagaggctggggcaacgggtgtggactgttcggcaaagggggaattgtcacatgcgccatgtttacgtgcaaaaagaatatggaaggcaaaatcgttcagcctgagaacctcgaatacaccattgtgatcacaccccacagcggggaggagcatgcggtgggaaatgacaccggcaagcacggcaaagaaatcaagattacacctcagtcttccaccacggaggccgaactgaccgggtatggaacagtcaccatggagtgtagcccccggacaggccttgatttcaacgaaatggtgctgctccaaatggaggacaaggcttggctggttcaccgccagtggtttcttgatctgccgctcccttggctgcccggggccgacacccagggatctaattggatccagaaggagacgctggtgacattcaagaaccctcatgctaaaaagcaagacgtcgtggttctcggctcccaggaaggggccatgcacaccgccctgacaggcgctaccgagattcagatgagctccggaaatcttctgtttaccggccatctcaaatgcagactgcggatggataaacttcaactgaaagggatgtcttacagcatgtgtacaggaaagttcaagatcgtgaaagaaattgcggagacgcagcacggcaccatcgtcatcagagtgcagtatgagggggacggatccccctgcaagattcccttcgaaatcacagatctcgagaaacgccatgtcctgggccggctgattaccgtgaaccctatcgttacagaaaaggacagcccggtgaacattgaggccgaacccccttttggggattcttacatcattgtcggcgtggagcccggacagctcaaactgaattggttcaagaagggctccagcatcgggcaaatgtttgagaccacgatgagaggagctaaacgcatggccatccttggcgacacagcctgggatttcgggtctctgggaggcgtttttaccagcattgggaaggctctccaccaggtgttcggcgccatctacggagcggctttttccggcgtctcttggaccatgaaaattctgatcggggtgattatcacatggatcggaatgaacagccggtccaccagcctgtctgtgtcccttgttctcgtcggcgtggtgacactgtatctgggggccatggtccaggccgacagcggatgtattgtgtcttggaagaataaagaactcaagtgcggctccgggatcttcattacggataacgttcacacctggacagagcagtacaagtttcaacctgaaagcccctccaaactggcttctgccatccagaaggctcatgaggaaggcatttgtggaatcagaagcgtgacccgccttgagaatctgatgtggaaacagatcacaccggagctcaaccacattctgtccgaaaatgaggtcaagctgaccatcatgacgggcgacattaaagggatcatgcaggccggaaagcggtctcttagacctcaacccaccgaactcaaatatagctggaagacatggggcaaggcgaaaatgctgtccaccgagagccataaccagacattcctgattgatgggcctgaaaccgccgagtgccccaatacaaaccgcgcttggaactctctcgaggtggaagactacggatttggcgttttcaccacgaacatctggctgaaacttcgggagaaacaggacgtgttttgtgattccaagctgatgagcgccgctatcaaagacaatagagccgtccacgcggatatgggctattggattgaatctgccctcaacgacacatggaagatggagaaggcttccttcatcgaggtgaaaagctgccactggcctaagtctcataccctgtggagcaatggggttctggaatccgagatgattatccccaaaaacttcgccggaccggtgagccagcacaactaccgccctggctatcatacccaaacagctgggccctggcaccttggaaagctcgaaatggattttgacttctgtgagggcaccacggtcgtggtgacagaagattgcgggaatcggggaccctctctgagaaccacaaccgcctccggcaaactgattacagagtggtgctgtcggagctgcaccctccctccgctgcgctacagaggcgaggacgggtgttggtacggaatggaaatccggccccttaaggagaaggaagagaacctggtcaattccctcgttacggccggccatgggcagattgataacttttctctgggagtgctgggcatggctcttttcctcgaagagatgctgagaacccgcgtggggacaaaacacgcgatcctgctcgtcgccctgagctttgtgacccttatcacaggaaatatgtccttccgggacctgggcagagttatggtgatggtcggcgctaccatgacggatgacattgggatgggagtgacatatctcgccctgctggccgcttttaaggttcgccctaccttcgccgcgggccttctgctcagaaaactgacatctaaggagctcatgatggctaccatcgggattgccctgcttagccagtccaccctgcccgaaacaatcctcgagctgacggatgccctggctcttggaatgatggccctgaaaattgtgcggaacatggaaaagtaccaactcgcggtcaccatcatggctatctcttgcgtgcctaatgccgttattctgcagaacgcctggaaggtgagctgtacaatcctcgctgccgtctccgtgagccccctgcttctgacctcttcccagcagaaagctgactggattcctctcgccctgacaatcaagggcctgaatcccaccgcgatttttcttacgacactgagccgcacctctaaaaagagatcctggccgctcaacgaggccatcatggctgtggggatggtcagcatcctggcctcttccctcctgaaaaatgacattcctatgaccggaccccttgttgctggcggcctgctgacagtgtgctatgtgctcaccgggcggagcgccgatctggaacttgagcgcgccgctgacgtcaagtgggaggatcaagcggaaatctccggaagctctcctattctgagcatcacaatttccgaggacggctctatgagcatcaaaaacgaagaggaggaacagacgctcaccattctgatcagaacagggctcctggtgatctccggagttttccccgtgtctattccgatcaccgccgctgcctggtacctttgggaggtcaagaagcagcgggccggcgtgctgtgggatgttccttctccccctcccgtggggaaagctgaactggaggacggagcctatcgcattaagcagagaggcatcctcggctactcccaaattggggcgggagtctataaagaaggcacatttcacaccatgtggcatgtgacgagaggggctgtcctgatgcaccgcggaaagagaatcgagccctcctgggccgatgtgaaaaaggaccttatcagctacggcgggggatggaagctggagggcgaatggaaagagggcgaagaggttcaggtgctcgccctggaacctgggaagaatccgcgggctgtccagaccaaacccggaattttcaagacaaacaccggcacaatcggggccgtgtccctcgattttagccctggaacctctggctcccccattgttgacagaaaagggaaggtggtcggactgtacggcaatggcgtggtgacacgcagcggggcgtatgtttctgctatcgcccagacggagaagtccattgaggataaccctgaaatcgaggacgatatcttccggaaaaagagacttaccattatggacctgcatcccggagccggcaaaacaaagcgctacctgcctgctatcgtccgggaagccattaaaagagggctccgcaccctgatccttgctccgacccgggtggtggccgcggagatggaagaggccctgagaggactccccattcgctatcaaacccctgctatccgggccgagcacacgggcagagaaattgtcgacctgatgtgtcatgctaccttcacaatgcggctcctgagccccgtgcgcgttcctaactacaatcttatcatcatggatgaggcccactttaccgaccccgcctccattgctgcgagagggtatatctctacacgggtggaaatgggcgaggccgctggaattttcatgaccgccacgccgcctggcagccgcgatccctttccccagtccaacgcccctatcatggacgaggaaagagagattcccgaacggagctggaactctgggcacgagtgggtcacagatttcaagggaaagaccgtgtggtttgttccttccatcaaagctggcaacgacatcgccgcgtgcctgagaaagaatgggaaaaaggtgattcagctgagccgcaaaaccttcgattctgaatacgtcaagacacgggctaacgactgggattttgtggttaccacagacatcagcgagatgggagccaatttcaaggccgagagagtgattgatccgcgccggtgtatgaaacccgtcatcctcaccgacggcgaagagagagtgattctggctgggcctatgcccgtgacgcattcctctgccgcgcaacgccggggcagaatcggacgcaaccctaagaatgaaaacgaccagtatatctacatgggcgagccccttgaaaatgatgaggactgcgcccactggaaagaggctaagatgctgctcgataacattaatacaccggaagggatcattcctagcatgtttgagcccgaaagagagaaagtcgacgccatcgatggagaataccggctgcgcggcgaggctagaaagaccttcgttgacctgatgcggcgcggggatctccctgtgtggcttgcctataaagtggctgccgagggaattaactacgcggacagaaagtggtgttttgatggcatcaagaataaccagattctggaagagaacgtcgaagtggagatctggacaaaagagggggaacggaagaaactgaagcccagatggctcgacgcccgcatctattccgatcctctggctcttaaagagttcaaggagttcgccgctggccggaagtctctgaccctcaatctgattacggagatgggaagactgcccacctttatgacacagaaagcccgcaacgccctcgacaatcttgctgttctgcataccgcggaagtgggcgggaaggcctacacacacgctctgagcgagctcccggagaccctggaaacacttctgctcctgaccctgctcgccgccgtcacgggaggcatcttcctttttctgatgtccgggaaaggaattggcaagatgacactgggcatgtgctgcatcattaccgctagcatcctcctgtggtatgcccaaatccagcctcactggattgcggcctctatcattcttgagttctttctgatcgtgctcctgattcccgaacccgagaaacagcggacccctcaggataaccaactgacatacgttgtgatcgctatcctcaccgtcgtggccgctacaatggccaatgaaatggggttccttgagaagacgaagaaagacctgggatttggctccattaccacacaggagagcgaatccaacatcctggacattgatctcagaccggcgtctgcctggaccctgtatgctgtcgccacaaccttcgtgacgcccatgcttcggcatagcatcgaaaatagctctgttaacgtgagcctgaccgctattgccaatcaggctacagtgctcatggggctgggaaagggctggcctctgtccaaaatggacatcggggtccccctccttgccattggatgttacagccaggttaaccctatcaccctgacagcggccctgctcctgcttgtggctcactacgccatcattggccccggcctgcaagctaaggccacccgcgaagcccagaaaagagcggctgccgggatcatgaagaatcctacggtggatggaattacagtcatcgacctcgagccgattccctatgatcctaagtttgaaaaacagctgggccaggtgatgctgctcatcctttgcgttacccaagtgctgatgatgcggacaacctgggctctgtgtgaggccctcaccctggccacagggcccatctctacgctttgggagggaaaccctggccgcttctggaataccacaattgctgtctccatggccaacatctttagagggagctacctggcgggagccggcctcctgttctctattatgaagaataccacaaacacccggcgcggcacggggaatgtgggagaaacactgggcgagaaatggaagtccagactcaacgctcttgggaaaagcgaatttcagatctataagaaatctggcattcaggaggtcgaccggaccctggccaaggagggcatcaagcgcggggaaaccgatcatcacgctgtgagcagaggatccgccaaactgcggtggttcgttgagagaaacatggtgacacccgaaggcaaggtcgtggacctcggctgcgggcgcggaggctggtcttactattgtgggggactgaaaaatgttcgggaggtgaagggccttaccaaagggggaccgggccatgaggaacctatccccatgagcacatacggctggaacctggtcagactccaatccggggtggatgtgttctttacgccccctgagaagtgcgacaccctgctgtgtgatattggagaaagctcccccaatcctacaatcgaggcgggccgcaccctccgggttcttaacctggtcgaaaattggctgaacaataacacacagttctgcattaaggtgctcaatccgtatatgccctctgtgatcgagaaaatggaaaccctgcagagaaagtacgggggagcccttgtccgcaaccctctgagcagaaattccacgcacgagatgtactgggtttctaacgctaccggcaatattgtgagctccgtgaacatgatctctagaatgctcatcaatcgctttacaatgaaacacaagaaagccacctatgagcccgacgtcgatctggggagcggaacacggaacattggcatcgaatccgagattcctaacctggacatcattggcaagagaatcgaaaagattaaacaggagcatgaaaccagctggcactacgaccaagatcatccctataagacatgggcttaccacgggtcttatgagaccaaacagacgggatccgccagctctatggtgaatggcgttgtgcgcctccttacaaagccgtgggacgtcgtgcctatggttacccagatggctatgaccgatacaacgcccttcgggcagcaacgggtgtttaaagagaaggtcgacaccagaacacaggaacctaaggagggaaccaaaaagctgatgaaaatcacagccgaatggctgtggaaggagctcggcaaagagaagacaccccgcatgtgtacaagagaagagttcacccggaaagtgcgctccaacgcggccctgggggctgtgtttacggatgaaaataagtggaaaagcgccagagaggctgtcgaagacggacggttctgggagcttgttgatagagagcggaacctgcacctcgaaggcaaatgcgagacctgtgtgtacaatatgatgggcaagcgcgagaagaagctgggggagtttggaaaagccaagggctctagagccatctggtatatgtggctgggggcgcggttcctcgaatttgaggctctgggattccttaacgaggaccattggttttcccgcggcaatagcctgtccggggtggaaggcgagggactccacagactgggctacattcttcgggaagtcgggaagaaagagggaggcgccatgtacgccgatgacacagctgggtgggatacccgcatcacactggaagacctcaagaacgaggagatggtgaccaatcatatgaaaggagaacacaagaaactggccgaggctattttcaagctgacgtatcagaacaaggttgtgagagtccagcggcctacaccccgcggcaccgtgatggacatcattagcagaaaagatcaacgggggtctggccaggttggaacatacggcctcaataccttcacgaacatggaagcccagctgatccgccaaatggagggggagggaatctttaagagcattcagcatcttaccgcgacagaagagatcgccgtgcagaattggctggctagagtcggccgggaacgcctctccagaatggccatttctggggacgattgcgtggttaaaccgatcgacgatcggttcgctagcgccctgaccgcgcttaacgacatgggaaaggtgagaaaagatattcagcaatgggagccttcccgcggctggaatgactggacacaggtccccttttgctctcaccacttccatgaactggtgatgaaggatgggcgggtcctcgtggttccctgtagaaaccaggacgagctgatcggccgcgcccggatcagccagggagctggctggtccctgaaggagaccgcctgcctcgggaaatcttatgctcaaatgtggacactgatgtactttcacagacgcgatcttcggctggccgctaacgccatttgtagcgcggtgccttcccattgggtcccgaccagcagaacgacatggtctatccacgccaagcacgaatggatgaccaccgaggacatgctcgctgtgtggaatcgcgtgtggattcaggaaaacccctggatggaggataaaacacctgttgaatcctgggaggaggtgccctatctgggaaagcgggaagaccagtggtgcggcagccttatcgggctgacctctagagccacatgggccaaaaatattcagacggctatcaaccaagtccgctccctcatgggaaatgagggctacaccgactatatgcctagcatgaagcggttcagacgggaagaggaagaggccggggtgctgtggtga

SEQ ID NO: 19644 - RNA, 9876 nt, synthetic construct
  misc_feature 1..9876: note = derived and/or modified CDS sequence (opt5) from DENV-2__GQ868551__SS-prME
  source 1..9876: mol_type = other RNA
accgccggagtgatcgtcatgctgattcccacagctatggccttccacctcacgacccggaatggggagcctcatatgatcgttggacggcaggaaaagggcaagagcctgctttttaagacagaggacggggtgaatatgtgcaccctgatggcgattgatctcggagaactgtgtgaggacacaatcacctacaagtgcccgcttctgcgccaaaatgaacccgaggatattgactgttggtgcaattccacatctacctgggtgacgtatggcacctgtacaaccacaggggagcaccggcgggaaaagcgcagcgtcgctctcgtgcctcatgttggaatgggcctggagaccagaacggaaacatggatgtcctctgagggcgcctggaaacacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaagaacaggacaaacgctttatctgcaagcattccatggtggatagaggctggggcaacgggtgtggactgttcggcaaagggggaattgtcacatgcgccatgtttacgtgcaaaaagaatatggaaggcaaaatcgttcagcctgagaacctcgaatacaccattgtgatcacaccccacagcggggaggagcatgcggtgggaaatgacaccggcaagcacggcaaagaaatcaagattacacctcagtcttccaccacggaggccgaactgaccgggtatggaacagtcaccatggagtgtagcccccggacaggccttgatttcaacgaaatggtgctgctccaaatggaggacaaggcttggctggttcaccgccagtggtttcttgatctgccgctcccttggctgcccggggccgacacccagggatctaattggatccagaaggagacgctggtgacattcaagaaccctcatgctaaaaagcaagacgtcgtggttctcggctcccaggaaggggccatgcacaccgccctgacaggcgctaccgagattcagatgagctccggaaatcttctgtttaccggccatctcaaatgcagactgcggatggataaacttcaactgaaagggatgtcttacagcatgtgtacaggaaagttcaagatcgtgaaagaaattgcggagacgcagcacggcaccatcgtcatcagagtgcagtatgagggggacggatccccctgcaagattcccttcgaaatcacagatctcgagaaacgccatgtcctgggccggctgattaccgtgaaccctatcgttacagaaaaggacagcccggtgaacattgaggccgaacccccttttggggattcttacatcattgtcggcgtggagcccggacagctcaaactgaattggttcaagaagggctccagcatcgggcaaatgtttgagaccacgatgagaggagctaaacgcatggccatccttggcgacacagcctgggatttcgggtctctgggaggcgtttttaccagcattgggaaggctctccaccaggtgttcggcgccatctacggagcggctttttccggcgtctcttggaccatgaaaattctgatcggggtgattatcacatggatcggaatgaacagccggtccaccagcctgtctgtgtcccttgttctcgtcggcgtggtgacactgtatctgggggccatggtccaggccgacagcggatgtattgtgtcttggaagaataaagaactcaagtgcggctccgggatcttcattacggataacgttcacacctggacagagcagtacaagtttcaacctgaaagcccctccaaactggcttctgccatccagaaggctcatgaggaaggcatttgtggaatcagaagcgtgacccgccttgagaatctgatgtggaaacagatcacaccggagctcaaccacattctgtccgaaaatgaggtcaagctgaccatcatgacgggcgacattaaagggatcatgcaggccggaaagcggtctcttagacctcaacccaccgaactcaaatatagctggaagacatggggcaaggtgaaaatgctgtccaccgagagccataaccagacattcctgattgatgggcctgaaaccgcggagtgccccaatacaaaccgcgcctggaactctctcgaggttgaagactacggatttggcgtgttcaccacgaacatctggctgaaacttcgggagaaacaggacgtcttttgtgattccaagctgatgagcgctgccatcaaagacaatagagctgtgcacgccgatatgggctattggattgaatctgcgctcaacgacacatggaagatggagaaggcctccttcatcgaggttaaaagctgccactggcctaagtctcataccctgtggagcaatggggtgctggaatccgagatgattatccccaaaaacttcgctggaccggtcagccagcacaactaccgccctggctatcatacccaaacagccgggccctggcaccttggaaagctcgaaatggattttgacttctgtgagggcaccacggtggtggtcacagaagattgcgggaatcggggaccctctctgagaaccacaaccgcttccggcaaactgattacagagtggtgctgtcggagctgcaccctccctccgctgcgctacagaggcgaggacgggtgttggtacggaatggaaatccggccccttaaggagaaggaagagaacctggttaattccctcgtgacggccggccatgggcagattgataacttttctctgggagtgctgggcatggcccttttcctcgaagagatgctgagaacccgcgtcgggacaaaacacgctatcctgctcgtggcgctgagctttgttacccttatcacaggaaatatgtccttccgggacctgggcagagtgatggtcatggtgggcgccaccatgacggatgacattgggatgggagttacatatctcgctctgctggccgcctttaaggtgcgccctaccttcgctgccggccttctgctcagaaaactgacatctaaggagctcatgatggcgaccatcgggattgctctgcttagccagtccaccctgcccgaaacaatcctcgagctgacggatgccctggcccttggaatgatggctctgaaaattgtccggaacatggaaaagtaccaactcgccgtgaccatcatggcgatctcttgcgttcctaatgctgtgattctgcagaacgcctggaaggtcagctgtacaatcctcgccgctgtgtccgtgagccccctgcttctgacctcttcccagcagaaagccgactggattcctctcgctctgacaatcaagggcctgaatcccaccgccatttttcttacgacactgagccgcacctctaaaaagagatcctggccgctcaacgaggcgatcatggccgtcgggatggttagcatcctggcttcttccctcctgaaaaatgacattcctatgaccggaccccttgtggccggcggcctgctgacagtgtgctatgtcctcaccgggcggagcgctgatctggaacttgagcgcgccgccgacgtgaagtgggaggatcaagctgaaatctccggaagctctcctattctgagcatcacaatttccgaggacggctctatgagcatcaaaaacgaagaggaggaacagacgctcaccattctgatcagaacagggctcctggttatctccggagtgttccccgtctctattccgatcaccgcggccgcttggtacctttgggaggtgaagaagcagcgggccggcgttctgtgggatgtgccttctccccctcccgtcgggaaagccgaactggaggacggagcttatcgcattaagcagagaggcatcctcggctactcccaaattggggccggagtgtataaagaaggcacatttcacaccatgtggcatgtcacgagaggggcggtgctgatgcaccgcggaaagagaatcgagccctcctgggctgatgttaaaaaggaccttatcagctacggcgggggatggaagctggagggcgaatggaaagagggcgaagaggtgcaggtcctcgccctggaacctgggaagaatccgcgggccgtgcagaccaaacccggaattttcaagacaaacaccggcacaatcggggctgtttccctcgattttagccctggaacctctggctcccccattgtggacagaaaagggaaggtcgtgggactgtacggcaatggcgtggttacacgcagcggggcctatgtctctgcgatcgctcagacggagaagtccattgaggataaccctgaaatcgaggacgatatcttccggaaaaagagacttaccattatggacctgcatcccggagccggcaaaacaaagcgctacctgcctgccatcgtgcgggaagctattaaaagagggctccgcaccctgatccttgccccgacccgggtggtcgctgccgagatggaagaggcgctgagaggactccccattcgctatcaaacccctgccatccgggctgagcacacgggcagagaaattgtggacctgatgtgtcatgccaccttcacaatgcggctcctgagccccgttcgcgtgcctaactacaatcttatcatcatggatgaggctcactttaccgaccccgcctccattgccgctagagggtatatctctacacgggtcgaaatgggcgaggcggccggaattttcatgaccgctacgccgcctggcagccgcgatccctttccccagtccaacgcccctatcatggacgaggaaagagagattcccgaacggagctggaactctgggcacgagtgggtgacagatttcaagggaaagaccgtttggtttgtgccttccatcaaagccggcaacgacatcgctgcctgcctgagaaagaatgggaaaaaggtcattcagctgagccgcaaaaccttcgattctgaatacgtgaagacacgggcgaacgactgggattttgttgtgaccacagacatcagcgagatgggagctaatttcaaggccgagagagtcattgatccgcgccggtgtatgaaacccgtgatcctcaccgacggcgaagagagagtgattctggccgggcctatgcccgtcacgcattcctctgctgcccaacgccggggcagaatcggacgcaaccctaagaatgaaaacgaccagtatatctacatgggcgagccccttgaaaatgatgaggactgcgcgcactggaaagaggccaagatgctgctcgataacattaatacaccggaagggatcattcctagcatgtttgagcccgaaagagagaaagttgacgctatcgatggagaataccggctgcgcggcgaggccagaaagaccttcgtggacctgatgcggcgcggggatctccctgtgtggcttgcttataaagtcgccgctgagggaattaactacgccgacagaaagtggtgttttgatggcatcaagaataaccagattctggaagagaacgtggaagttgagatctggacaaaagagggggaacggaagaaactgaagcccagatggctcgacgcgcgcatctattccgatcctctggcccttaaagagttcaaggagttcgctgccggccggaagtctctgaccctcaatctgattacggagatgggaagactgcccacctttatgacacagaaagctcgcaacgccctcgacaatcttgccgtgctgcataccgctgaagtcggcgggaaggcgtacacacacgccctgagcgagctcccggagaccctggaaacacttctgctcctgaccctgctcgctgccgtgacgggaggcatcttcctttttctgatgtccgggaaaggaattggcaagatgacactgggcatgtgctgcatcattaccgccagcatcctcctgtggtatgctcaaatccagcctcactggattgccgcgtctatcattcttgagttctttctgatcgttctcctgattcccgaacccgagaaacagcggacccctcaggataaccaactgacatacgtggtcatcgccatcctcaccgtggtcgctgccacaatggctaatgaaatggggttccttgagaagacgaagaaagacctgggatttggctccattaccacacaggagagcgaatccaacatcctggacattgatctcagaccggcctctgcgtggaccctgtatgccgtggctacaaccttcgttacgcccatgcttcggcatagcatcgaaaatagctctgtgaacgtgagcctgaccgccattgctaatcaggccacagtcctcatggggctgggaaagggctggcctctgtccaaaatggacatcggggttcccctccttgctattggatgttacagccaggtgaaccctatcaccctgacagccgcgctgctcctgcttgtggcccactacgctatcattggccccggcctgcaagccaaggctacccgcgaagcccagaaaagagccgcggctgggatcatgaagaatcctacggtcgatggaattacagtgatcgacctcgagccgattccctatgatcctaagtttgaaaaacagctgggccaggttatgctgctcatcctttgcgtgacccaagtcctgatgatgcggacaacctgggccctgtgtgaggctctcaccctggccacagggcccatctctacgctttgggagggaaaccctggccgcttctggaataccacaattgccgtgtccatggctaacatctttagagggagctacctggccggagcgggcctcctgttctctattatgaagaataccacaaacacccggcgcggcacggggaatgtcggagaaacactgggcgagaaatggaagtccagactcaacgcccttgggaaaagcgaatttcagatctataagaaatctggcattcaggaggtggaccggaccctggctaaggagggcatcaagcgcggggaaaccgatcatcacgccgttagcagaggatccgctaaactgcggtggttcgtggagagaaacatggtcacacccgaaggcaaggtggttgacctcggctgcgggcgcggaggctggtcttactattgtgggggactgaaaaatgtgcgggaggtcaagggccttaccaaagggggaccgggccatgaggaacctatccccatgagcacatacggctggaacctggtgagactccaatccggggtggatgttttctttacgccccctgagaagtgcgacaccctgctgtgtgatattggagaaagctcccccaatcctacaatcgaggccggccgcaccctccgggtccttaacctggtggaaaattggctgaacaataacacacagttctgcattaaggtgctcaatccgtatatgccctctgtcatcgagaaaatggaaaccctgcagagaaagtacgggggagcgcttgttcgcaaccctctgagcagaaattccacgcacgagatgtactgggtgtctaacgccaccggcaatattgtgagctccgtcaacatgatctctagaatgctcatcaatcgctttacaatgaaacacaagaaagctacctatgagcccgacgtggatctggggagcggaacacggaacattggcatcgaatccgagattcctaacctggacatcattggcaagagaatcgaaaagattaaacaggagcatgaaaccagctggcactacgaccaagatcatccctataagacatgggcctaccacgggtcttatgagaccaaacagacgggatccgctagctctatggttaatggcgtggtccgcctccttacaaagccgtgggacgtggttcctatggtgacccagatggccatgaccgatacaacgcccttcgggcagcaacgggtctttaaagagaaggtggacaccagaacacaggaacctaaggagggaaccaaaaagctgatgaaaatcacagctgaatggctgtggaaggagctcggcaaagagaagacaccccgcatgtgtacaagagaagagttcacccggaaagtgcgctccaacgccgcgctgggggccgtctttacggatgaaaataagtggaaaagcgctagagaggccgttgaagacggacggttctgggagcttgtggatagagagcggaacctgcacctcgaaggcaaatgcgagacctgtgtgtacaatatgatgggcaagcgcgagaagaagctgggggagtttggaaaagctaagggctctagagccatctggtatatgtggctgggggcccggttcctcgaatttgaggcgctgggattccttaacgaggaccattggttttcccgcggcaatagcctgtccggggtcgaaggcgagggactccacagactgggctacattcttcgggaagtggggaagaaagagggaggcgctatgtacgccgatgacacagccgggtgggatacccgcatcacactggaagacctcaagaacgaggagatggttaccaatcatatgaaaggagaacacaagaaactggctgaggccattttcaagctgacgtatcagaacaaggtggtcagagtgcagcggcctacaccccgcggcaccgttatggacatcattagcagaaaagatcaacgggggtctggccaggtgggaacatacggcctcaataccttcacgaacatggaagctcagctgatccgccaaatggagggggagggaatctttaagagcattcagcatcttaccgccacagaagagatcgcggtccagaattggctggccagagtgggccgggaacgcctctccagaatggctatttctggggacgattgcgttgtgaaaccgatcgacgatcggttcgccagcgctctgaccgcccttaacgacatgggaaaggtcagaaaagatattcagcaatgggagccttcccgcggctggaatgactggacacaggtgcccttttgctctcaccacttccatgaactggtcatgaaggatgggcgggtgctcgttgtgccctgtagaaaccaggacgagctgatcggccgcgcgcggatcagccagggagccggctggtccctgaaggagaccgcttgcctcgggaaatcttatgcccaaatgtggacactgatgtactttcacagacgcgatcttcggctggctgccaacgctatttgtagcgccgtcccttcccattgggtgccgaccagcagaacgacatggtctatccacgcgaagcacgaatggatgaccaccgaggacatgctcgccgtgtggaatcgcgtttggattcaggaaaacccctggatggaggataaaacacctgtggaatcctgggaggaggtcccctatctgggaaagcgggaagaccagtggtgcggcagccttatcgggctgacctctagagctacatgggccaaaaatattcagacggccatcaaccaagtgcgctccctcatgggaaatgagggctacaccgactatatgcctagcatgaagcggttcagacgggaagaggaagaggctggggttctgtggtga

SEQ ID NO: 19645 - RNA, 9876 nt, synthetic construct
  misc_feature 1..9876: note = derived and/or modified CDS sequence (opt5) from DENV-2__HM181971__SS-prME
  source 1..9876: mol_type = other RNA
accgccggcgtgatcgtcatgctgattcccacagctatggccttccacctcacgacccggaatggggagcctcatatgatcgttggacggcaggaaaagggcaagagcctgctttttaagacagaggacggggtgaatatgtgcaccctgatggcgattgatctcggagaactgtgtgaggacacaatcacctacaagtgcccgcttctgcgccaaaatgaacccgaggatattgactgttggtgcaattccacatctacctgggtgacgtatggcacctgtacaaccacaggggagcaccggcgggaaaagcgcagcgtcgctctcgtgcctcatgttggaatgggcctggagaccagaacggaaacatggatgtcctctgagggcgcctggaaacacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaagaacaggacaaacgctttatctgcaagcattccatggtggatagaggctggggcaacgggtgtggactgttcggcaaagggggaattgtcacatgcgccatgtttacgtgcaaaaagaatatggaaggcaaaatcgttcagcctgagaacctcgaatacaccattgtgatcacaccccacagcggggaggagcatgcggtgggaaatgacaccggcaagcacggcaaagaaatcaagattacacctcagtcttccaccacggaggccgaactgaccgggtatggaacagtcaccatggagtgtagcccccggacaggccttgatttcaacgaaatggtgctgctccaaatggaggacaaggcttggctggttcaccgccagtggtttcttgatctgccgctcccttggctgcccggggccgacacccagggatctaattggatccagaaggagacgctggtgacattcaagaaccctcatgctaaaaagcaagacgtcgtggttctcggctcccaggaaggggccatgcacaccgccctgacaggcgctaccgagattcagatgagctccggaaatcttctgtttaccggccatctcaaatgcagactgcggatggataaacttcaactgaaagggatgtcttacagcatgtgtacaggaaagttcaagatcgtgaaagaaattgcggagacgcagcacggcaccatcgtcatcagagtgcagtatgagggggacggatccccctgcaagattcccttcgaaatcacagatctcgagaaacgccatgtcctgggccggctgattaccgtgaaccctatcgttacagaaaaggacagcccggtgaacattgaggccgaacccccttttggggattcttacatcattgtcggcgtggagcccggacagctcaaactgaattggttcaagaagggctccagcatcgggcaaatgtttgagaccacgatgagaggagctaaacgcatggccatccttggcgacacagcctgggatttcgggtctctgggaggcgtttttaccagcattgggaaggctctccaccaggtgttcggcgccatctacggagcggctttttccggcgtctcttggaccatgaaaattctgatcggggtgattatcacatggatcggaatgaacagccggtccaccagcctgtctgtgtcccttgttctcgtcggcgtggtgacactgtatctgggggccatggtccaggccgacagcggatgtattgtgtcttggaagaataaagaactcaagtgcggctccgggatcttcattacggataacgttcacacctggacagagcagtacaagtttcaacctgaaagcccctccaaactggcttctgccatccagaaggctcatgaggaaggcatttgtggaatcagaagcgtgacccgccttgagaatctgatgtggaaacagatcacaccggagctcaaccacattctgtccgaaaatgaggtcaagctgaccatcatgacgggcgacattaaagggatcatgcaggccggaaagcggtctcttagacctcaacccaccgaactcaaatatagctggaagacatggggcaaggcgaaaatgctgtccaccgagagccataaccagacattcctgattgatgggcctgaaaccgccgagtgccccaatacaaaccgcgcttggaactctctcgaggtggaagactacggatttggcgttttcaccacgaacatctggctgaaacttcgggagaaacaggacgtgttttgtgattccaagctgatgagcgccgctatcaaagacaatagagccgtccacgcggatatgggctattggattgaatctgccctcaacgacacatggaagatggagaaggcttccttcatcgaggtgaaaagctgccactggcctaagtctcataccctgtggagcaatggggttctggaatccgagatgattatccccaaaaacttcgccggaccggtgagccagcacaactaccgccctggctatcatacccaaacagctgggccctggcaccttggaaagctcgaaattgattttgacttctgtgagggcaccacggtcgtggtgacagaagattgcgggaatcggggaccctctctgagaaccacaaccgcctccggcaaactgatcacagagtggtgctgtcggagctgcaccctccctccgctgcgctacagaggcgaggacgggtgttggtacggaatggaaattcggccccttaaggagaaggaagagaacctggtcaattccctcgttacggccggccatgggcagatcgataacttttctctgggagtgctgggcatggctcttttcctcgaagagatgctgagaacccgcgtggggacaaaacacgcgatcctgctcgtcgccctgagctttgtgacccttattacaggaaatatgtccttccgggacctgggcagagttatggtgatggtcggcgctaccatgacggatgacatcgggatgggagtgacatatctcgccctgctggccgcttttaaggttcgccctaccttcgccgcgggccttctgctcagaaaactgacatctaaggagctcatgatggctaccattgggatcgccctgcttagccagtccaccctgcccgaaacaattctcgagctgacggatgccctggctcttggaatgatggccctgaaaatcgtgcggaacatggaaaagtaccaactcgcggtcaccatcatggctatttcttgcgtgcctaatgccgttatcctgcagaacgcctggaaggtgagctgtacaattctcgctgccgtctccgtgagccccctgcttctgacctcttcccagcagaaagctgactggatccctctcgccctgacaattaagggcctgaatcccaccgcgatctttcttacgacactgagccgcacctctaaaaagagatcctggccgctcaacgaggccatcatggctgtggggatggtcagcattctggcctcttccctcctgaaaaatgacatccctatgaccggaccccttgttgctggcggcctgctgacagtgtgctatgtgctcaccgggcggagcgccgatctggaacttgagcgcgccgctgacgtcaagtgggaggatcaagcggaaatttccggaagctctcctatcctgagcattacaatctccgaggacggctctatgagcattaaaaacgaagaggaggaacagacgctcaccatcctgatcagaacagggctcctggtgatttccggagttttccccgtgtctatcccgattaccgccgctgcctggtacctttgggaggtcaagaagcagcgggccggcgtgctgtgggatgttccttctccccctcccgtggggaaagctgaactggaggacggagcctatcgcatcaagcagagaggcattctcggctactcccaaatcggggcgggagtctataaagaaggcacatttcacaccatgtggcatgtgacgagaggggctgtcctgatgcaccgcggaaagagaatcgagccctcctgggccgatgtgaaaaaggaccttattagctacggcgggggatggaagctggagggcgaatggaaagagggcgaagaggttcaggtgctcgccctggaacctgggaagaatccgcgggctgtccagaccaaacccggaatcttcaagacaaacaccggcacaattggggccgtgtccctcgattttagccctggaacctctggctcccccatcgttgacagaaaagggaaggtggtcggactgtacggcaatggcgtggtgacacgcagcggggcgtatgtttctgctattgcccagacggagaagtccatcgaggataaccctgaaatcgaggacgatattttccggaaaaagagacttaccatcatggacctgcatcccggagccggcaaaacaaagcgctacctgcctgctattgtccgggaagccatcaaaagagggctccgcaccctgattcttgctccgacccgggtggtggccgcggagatggaagaggccctgagaggactccccatccgctatcaaacccctgctattcgggccgagcacacgggcagagaaatcgtcgacctgatgtgtcatgctaccttcacaatgcggctcctgagccccgtgcgcgttcctaactacaatcttatcattatggatgaggcccactttaccgaccccgcctccatcgctgcgagagggtatatttctacacgggtggaaatgggcgaggccgctggaatcttcatgaccgccacgccgcctggcagccgcgatccctttccccagtccaacgcccctattatggacgaggaaagagagatccccgaacggagctggaactctgggcacgagtgggtcacagatttcaagggaaagaccgtgtggtttgttccttccatcaaagctggcaacgacattgccgcgtgcctgagaaagaatgggaaaaaggtgatccagctgagccgcaaaaccttcgattctgaatacgtcaagacacgggctaacgactgggattttgtggttaccacagacattagcgagatgggagccaatttcaaggccgagagagtgatcgatccgcgccggtgtatgaaacccgtcattctcaccgacggcgaagagagagtgatcctggctgggcctatgcccgtgacgcattcctctgccgcgcaacgccggggcagaatcggacgcaaccctaagaatgaaaacgaccagtatatttacatgggcgagccccttgaaaatgatgaggactgcgcccactggaaagaggctaagatgctgctcgataacatcaatacaccggaagggattatccctagcatgtttgagcccgaaagagagaaagtcgacgccattgatggagaataccggctgcgcggcgaggctagaaagaccttcgttgacctgatgcggcgcggggatctccctgtgtggcttgcctataaagtggctgccgagggaatcaactacgcggacagaaagtggtgttttgatggcattaagaataaccagatcctggaagagaacgtcgaagtggagatctggacaaaagagggggaacggaagaaactgaagcccagatggctcgacgcccgcatttattccgatcctctggctcttaaagagttcaaggagttcgccgctggccggaagtctctgaccctcaatctgatcacggagatgggaagactgcccacctttatgacacagaaagcccgcaacgccctcgacaatcttgctgttctgcataccgcggaagtgggcgggaaggcctacacacacgctctgagcgagctcccggagaccctggaaacacttctgctcctgaccctgctcgccgccgtcacgggaggcattttcctttttctgatgtccgggaaaggaatcggcaagatgacactgggcatgtgctgcattatcaccgctagcatcctcctgtggtatgcccaaattcagcctcactggatcgcggcctctattatccttgagttctttctgattgtgctcctgatccccgaacccgagaaacagcggacccctcaggataaccaactgacatacgttgtgatcgctattctcaccgtcgtggccgctacaatggccaatgaaatggggttccttgagaagacgaagaaagacctgggatttggctccatcaccacacaggagagcgaatccaacattctggacatcgatctcagaccggcgtctgcctggaccctgtatgctgtcgccacaaccttcgtgacgcccatgcttcggcatagcattgaaaatagctctgttaacgtgagcctgaccgctatcgccaatcaggctacagtgctcatggggctgggaaagggctggcctctgtccaaaatggacattggggtccccctccttgccatcggatgttacagccaggttaaccctatcaccctgacagcggccctgctcctgcttgtggctcactacgccattatcggccccggcctgcaagctaaggccacccgcgaagcccagaaaagagcggctgccgggattatgaagaatcctacggtggatggaatcacagtcattgacctcgagccgatcccctatgatcctaagtttgaaaaacagctgggccaggtgatgctgctcatcctttgcgttacccaagtgctgatgatgcggacaacctgggctctgtgtgaggccctcaccctggccacagggcccatttctacgctttgggagggaaaccctggccgcttctggaataccacaatcgctgtctccatggccaacatttttagagggagctacctggcgggagccggcctcctgttctctatcatgaagaataccacaaacacccggcgcggcacggggaatgtgggagaaacactgggcgagaaatggaagtccagactcaacgctcttgggaaaagcgaatttcagatttataagaaatctggaatccaggaggtcgaccggaccctggccaaggagggcatcaagcgcggggaaaccgatcatcacgctgtgagcagaggatccgccaaactgcggtggttcgttgagagaaacatggtgacacccgaaggcaaggtcgtggacctcggctgcgggcgcggaggctggtcttactattgtgggggactgaaaaatgttcgggaggtgaagggccttaccaaagggggaccgggccatgaggaacctattcccatgagcacatacggctggaacctggtcagactccaatccggggtggatgtgttctttacgccccctgagaagtgcgacaccctgctgtgtgatatcggagaaagctcccccaatcctacaattgaggcgggccgcaccctccgggttcttaacctggtcgaaaattggctgaacaataacacacagttctgcatcaaggtgctcaatccgtatatgccctctgtgattgagaaaatggaaaccctgcagagaaagtacgggggagcccttgtccgcaaccctctgagcagaaattccacgcacgagatgtactgggtttctaacgctaccggcaatatcgtgagctccgtgaacatgatctctagaatgctcattaatcgctttacaatgaaacacaagaaagccacctatgagcccgacgtcgatctggggagcggaacacggaacatcggcattgaatccgagatccctaacctggacattatcggcaagagaattgaaaagatcaaacaggagcatgaaaccagctggcactacgaccaagatcatccctataagacatgggcttaccacgggtcttatgagaccaaacagacgggatccgccagctctatggtgaatggcgttgtgcgcctccttacaaagccgtgggacgtcgtgcctatggttacccagatggctatgaccgatacaacgcccttcgggcagcaacgggtgtttaaagagaaggtcgacaccagaacacaggaacctaaggagggaaccaaaaagctgatgaaaatcacagccgaatggctgtggaaggagctcggcaaagagaagacaccccgcatgtgtacaagagaagagttcacccggaaagtgcgctccaacgcggccctgggggctgtgtttacggatgaaaataagtggaaaagcgccagagaggctgtcgaagacggacggttctgggagcttgttgatagagagcggaacctgcacctcgaaggcaaatgcgagacctgtgtgtacaatatgatgggcaagcgcgagaagaagctgggggagtttggaaaagccaagggctctagagccatttggtatatgtggctgggggcgcggttcctcgaatttgaggctctgggattccttaacgaggaccattggttttcccgcggcaatagcctgtccggggtggaaggcgagggactccacagactgggctacatccttcgggaagtcgggaagaaagagggaggcgccatgtacgccgatgacacagctgggtgggatacccgcattacactggaagacctcaagaacgaggagatggtgaccaatcatatgaaaggagaacacaagaaactggccgaggctatcttcaagctgacgtatcagaacaaggttgtgagagtccagcggcctacaccccgcggcaccgtgatggacattatcagcagaaaagatcaacgggggtctggccaggttggaacatacggcctcaataccttcacgaacatggaagcccagctgatccgccaaatggagggggagggaatttttaagagcatccagcatcttaccgcgacagaagagattgccgtgcagaattggctggctagagtcggccgggaacgcctctccagaatggccatctctggggacgattgcgtggttaaaccgattgacgatcggttcgctagcgccctgaccgcgcttaacgacatgggaaaggtgagaaaagatatccagcaatgggagccttcccgcggctggaatgactggacacaggtccccttttgctctcaccacttccatgaactggtgatgaaggatgggcgggtcctcgtggttccctgtagaaaccaggacgagctgatcggccgcgcccggattagccagggagctggctggtccctgaaggagaccgcctgcctcgggaaatcttatgctcaaatgtggacactgatgtactttcacagacgcgatcttcggctggccgctaacgccatctgtagcgcggtgccttcccattgggtcccgaccagcagaacgacatggtctattcacgccaagcacgaatggatgaccaccgaggacatgctcgctgtgtggaatcgcgtgtggatccaggaaaacccctggatggaggataaaacacctgttgaatcctgggaggaggtgccctatctgggaaagcgggaagaccagtggtgcggcagccttattgggctgacctctagagccacatgggccaaaaatatccagacggctattaaccaagtccgctccctcatgggaaatgagggctacaccgactatatgcctagcatgaagcggttcagacgggaagaggaagaggccggggtgctgtggtga

SEQ ID NO: 19646 - RNA, 9876 nt, synthetic construct
  misc_feature 1..9876: note = derived and/or modified CDS sequence (opt5) from DENV-2__GU131881__SS-prME
  source 1..9876: mol_type = other RNA
accgccggagtgatcgtcatgctgattcccacagctatggccttccacctcacgacccggaatggggagcctcatatgatcgttggacggcaggaaaagggcaagagcctgctttttaagacagaggacggggtgaatatgtgcaccctgatggcgattgatctcggagaactgtgtgaggacacaatcacctacaagtgcccgcttctgcgccaaaacgaacccgaggatattgactgttggtgcaatagcacatctacctgggtgacgtatggcacctgtacaaccacaggggagcacagacgggaaaagcgcagcgtcgctctcgtgcctcatgttggaatgggcctggagaccagaacggaaacatggatgtcctctgagggcgcctggaaacacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaagaacaggacaaacgctttatctgcaagcattccatggtggatagaggctggggcaacgggtgtggactgttcggcaaagggggaattgtcacatgcgccatgtttacgtgcaaaaagaatatggaaggcaaaatcgttcagcctgagaacctcgaatacaccattgtgatcacaccccacagcggggaggagcatgcggtgggaaatgacaccggcaagcacggcaaagaaatcaagattacacctcagtcttccaccacggaggccgaactgaccgggtatggaacagtcaccatggagtgtagcccccggacaggccttgatttcaacgaaatggtgctgctccaaatggaggacaaggcttggctggttcaccgccagtggtttcttgatctgccgctcccttggctgcccggggccgacacccagggatctaattggatccagaaggagacgctggtgacattcaagaaccctcatgctaaaaagcaagacgtcgtggttctcggctcccaggaaggggccatgcacaccgccctgacaggcgctaccgagattcagatgagctccggaaatcttctgtttaccggccatctcaaatgcagactgcggatggataaacttcaactgaaagggatgtcttacagcatgtgtacaggaaagttcaagatcgtgaaagaaattgcggagacgcagcacggcaccatcgtcatcagagtgcagtatgagggggacggatccccctgcaagattcccttcgaaatcacagatctcgagaaacgccatgtcctgggccggctgattaccgtgaaccctatcgttacagaaaaggacagcccggtgaacattgaggccgaacccccttttggggattcttacatcattgtcggcgtggagcccggacagctcaaactgaattggttcaagaagggctccagcatcgggcaaatgtttgagaccacgatgagaggagctaaacgcatggccatccttggcgacacagcctgggatttcgggtctctgggaggcgtttttaccagcattgggaaggctctccaccaggtgttcggcgccatctacggagcggctttttccggcgtctcttggaccatgaaaattctgatcggggtgattatcacatggatcggaatgaacagccggtccaccagcctgtctgtgtcccttgttctcgtcggcgtggtgacactgtatctgggggccatggtccaggccgacagcggatgtattgtgtcttggaagaataaagaactcaagtgcggctccgggatcttcattacggataacgttcacacctggacagagcagtacaagtttcaacctgaaagcccctccaaactggcttctgccatccagaaggctcatgaggaaggcatttgtggaatcagaagcgtgacccgccttgagaatctgatgtggaaacagatcacaccggagctcaaccacattctgtccgaaaatgaggtcaagctgaccatcatgacgggcgacattaaagggatcatgcaggccggaaagcggtctcttagacctcaacccaccgaactcaaatatagctggaagacatggggcaaggcgaaaatgctgtccaccgagagccataaccagacattcctgattgatgggcctgaaaccgccgagtgccccaatacaaaccgcgcttggaactctctcgaggtggaagactacggatttggcgttttcaccacgaacatctggctgaaacttcgggagaaacaggacgtgttttgtgattccaagctgatgagcgccgctatcaaaaataacagagccgtccacgcggacatgggctattggattgaatctgccctcaatgatacatggaagatggagaaggcttccttcatcgaggtgaaaagctgccactggcctaagtctcataccctgtggagcaacggggttctggaatccgagatgattatccccaaaaacttcgccggaccggtgagccagcacaattaccgccctggctatcatacccaaacagctgggccctggcaccttggaaagctcgaaatggactttgatttctgtgagggcaccacggtcgtggtgacagaagactgcgggaaccggggaccctctctgagaaccacaaccgcctccggcaaactgattacagagtggtgctgtcggagctgcaccctccctccgctgcgctacagaggcgaggatgggtgttggtacggaatggaaatccggccccttaaggagaaggaagagaatctggtcaactccctcgttacggccggccatgggcagattgacaatttttctctgggagtgctgggcatggctcttttcctcgaagagatgctgagaacccgcgtggggacaaaacacgcgatcctgctcgtcgccctgagctttgtgacccttatcacaggaaacatgtccttccgggatctgggcagagttatggtgatggtcggcgctaccatgacggacgatattgggatgggagtgacatatctcgccctgctggccgcttttaaggttcgccctaccttcgccgcgggccttctgctcagaaaactgacatctaaggagctcatgatggctaccatcgggattgccctgcttagccagtccaccctgcccgaaacaatcctcgagctgacggacgccctggctcttggaatgatggccctgaaaattgtgcggaatatggaaaagtaccaactcgcggtcaccatcatggctatctcttgcgtgcctaacgccgttattctgcagaatgcctggaaggtgagctgtacaatcctcgctgccgtctccgtgagccccctgcttctgacctcttcccagcagaaagctgattggattcctctcgccctgacaatcaagggcctgaaccccaccgcgatttttcttacgacactgagccgcacctctaaaaagagatcctggccgctcaatgaggccatcatggctgtggggatggtcagcatcctggcctcttccctcctgaaaaacgacattcctatgaccggaccccttgttgctggcggcctgctgacagtgtgctatgtgctcaccgggcggagcgccgacctggaacttgagcgcgccgctgatgtcaagtgggaggaccaagcggaaatctccggaagctctcctattctgagcatcacaatttccgaggatggctctatgagcatcaaaaatgaagaggaggaacagacgctcaccattctgatcagaacagggctcctggtgatctccggagttttccccgtgtctattccgatcaccgccgctgcctggtacctttgggaggtcaagaagcagcgggccggcgtgctgtgggacgttccttctccccctcccgtggggaaagctgaactggaggatggagcctatcgcattaagcagagaggcatcctcggctactcccaaattggggcgggagtctataaagaaggcacatttcacaccatgtggcatgtgacgagaggggctgtcctgatgcaccgcggaaagagaatcgagccctcctgggccgacgtgaaaaaggatcttatcagctacggcgggggatggaagctggagggcgaatggaaagagggcgaagaggttcaggtgctcgccctggaacctgggaagaacccgcgggctgtccagaccaaacccggaattttcaagacaaataccggcacaatcggggccgtgtccctcgactttagccctggaacctctggctcccccattgttgatagaaaagggaaggtggtcggactgtacggcaacggcgtggtgacacgcagcggggcgtatgtttctgctatcgcccagacggagaagtccattgaggacaaccctgaaatcgaggatgacatcttccggaaaaagagacttaccattatggatctgcatcccggagccggcaaaacaaagcgctacctgcctgctatcgtccgggaagccattaaaagagggctccgcaccctgatccttgctccgacccgggtggtggccgcggagatggaagaggccctgagaggactccccattcgctatcaaacccctgctatccgggccgagcacacgggcagagaaattgtcgacctgatgtgtcatgctaccttcacaatgcggctcctgagccccgtgcgcgttcctaattacaaccttatcatcatggacgaggcccactttaccgatcccgcctccattgctgcgagagggtatatctctacacgggtggaaatgggcgaggccgctggaattttcatgaccgccacgccgcctggcagccgcgacccctttccccagtccaatgcccctatcatggatgaggaaagagagattcccgaacggagctggaactctgggcacgagtgggtcacagacttcaagggaaagaccgtgtggtttgttccttccatcaaagctggcaatgatatcgccgcgtgcctgagaaagaacgggaaaaaggtgattcagctgagccgcaaaaccttcgactctgaatacgtcaagacacgggctaatgattgggactttgtggttaccacagatatcagcgagatgggagccaacttcaaggccgagagagtgattgacccgcgccggtgtatgaaacccgtcatcctcaccgatggcgaagagagagtgattctggctgggcctatgcccgtgacgcattcctctgccgcgcaacgccggggcagaatcggacgcaatcctaagaacgaaaatgaccagtatatctacatgggcgagccccttgaaaacgacgaggattgcgcccactggaaagaggctaagatgctgctcgacaatattaacacaccggaagggatcattcctagcatgtttgagcccgaaagagagaaagtcgatgccatcgacggagaataccggctgcgcggcgaggctagaaagaccttcgttgatctgatgcggcgcggggacctccctgtgtggcttgcctataaagtggctgccgagggaattaattacgcggatagaaagtggtgttttgacggcatcaagaacaaccagattctggaagagaatgtcgaagtggagatctggacaaaagagggggaacggaagaaactgaagcccagatggctcgatgcccgcatctattccgaccctctggctcttaaagagttcaaggagttcgccgctggccggaagtctctgaccctcaacctgattacggagatgggaagactgcccacctttatgacacagaaagcccgcaatgccctcgataaccttgctgttctgcataccgcggaagtgggcgggaaggcctacacacacgctctgagcgagctcccggagaccctggaaacacttctgctcctgaccctgctcgccgccgtcacgggaggcatcttcctttttctgatgtccgggaaaggaattggcaagatgacactgggcatgtgctgcatcattaccgctagcatcctcctgtggtatgcccaaatccagcctcactggattgcggcctctatcattcttgagttctttctgatcgtgctcctgattcccgaacccgagaaacagcggacccctcaggacaatcaactgacatacgttgtgatcgctatcctcaccgtcgtggccgctacaatggccaacgaaatggggttccttgagaagacgaagaaagatctgggatttggctccattaccacacaggagagcgaatccaatatcctggacattgacctcagaccggcgtctgcctggaccctgtatgctgtcgccacaaccttcgtgacgcccatgcttcggcatagcatcgagaactcctctgttaatgtgagcctgaccgctattgccaaccaggctacagtgctcatggggctgggaaagggctggcctctgtccaaaatggatatcggggtccccctccttgccattggatgttacagccaggttaatcctatcaccctgacagcggccctgctcctgcttgtggctcactacgccatcattggccccggcctgcaagctaaggccacccgcgaagcccagaaaagagcggctgccgggatcatgaagaaccctacggtggacggaattacagtcatcgatctcgagccgattccctatgaccctaagtttgaaaaacagctgggccaggtgatgctgctcatcctttgcgttacccaagtgctgatgatgcggacaacctgggctctgtgtgaggccctcaccctggccacagggcccatctctacgctttgggagggaaatcctggccgcttctggaacaccacaattgctgtctccatggccaatatctttagagggagctacctggcgggagccggcctcctgttctctattatgaagaacaccacaaatacccggcgcggcacggggaacgtgggagaaacactgggcgagaaatggaagtccagactcaacgctcttgggaaaagcgaatttcagatctataagaaatctggcattcaggaggtcgatcggaccctggccaaggagggcatcaagcgcggggaaaccgaccatcacgctgtgagcagaggatccgccaaactgcggtggttcgttgagagaaatatggtgacacccgaaggcaaggtcgtggatctcggctgcgggcgcggaggctggtcttactattgtgggggactgaaaaacgttcgggaggtgaagggccttaccaaagggggaccgggccatgaagaacctatccccatgagcacatacggctggaatctggtcagactccaatccggggtggacgtgttctttacgccccctgagaagtgcgataccctgctgtgtgacattggagaaagctcccccaaccctacaatcgaggcgggccgcaccctccgggttcttaatctggtcgaaaactggctgaataacaatacacagttctgcattaaggtgctcaacccgtatatgccctctgtgatcgagaaaatggaaaccctgcagagaaagtacgggggagcccttgtccgcaatcctctgagccggaactccacgcacgagatgtactgggtttctaatgctaccggcaacattgtgagctccgtgaatatgatctctagaatgctcatcaaccgctttacaatgaaacacaagaaagccacctatgagcccgatgtcgacctggggagcggaacacggaacattggcatcgaatccgagattcctaatctggatatcattggcaagagaatcgaaaagattaaacaggagcatgaaaccagctggcactacgaccaagaccatccctataagacatgggcttaccacgggtcttatgagaccaaacagacgggatccgccagctctatggtgaacggcgttgtgcgcctccttacaaagccgtgggatgtcgtgcctatggttacccagatggctatgaccgacacaacgcccttcgggcagcaacgggtgtttaaagagaaggtcgataccagaacacaggaacctaaggagggaaccaaaaagctgatgaaaatcacagccgaatggctgtggaaggagctcggcaaagagaagacaccccgcatgtgtacaagagaagagttcacccggaaagtgcgctccaatgcggccctgggggctgtgtttacggacgaaaacaagtggaaaagcgccagagaggctgtcgaagatggacggttctgggagcttgttgacagagagcggaatctgcacctcgaaggcaaatgcgagacctgtgtgtacaacatgatgggcaagcgcgagaagaagctgggggagtttggaaaagccaagggctctagagccatctggtatatgtggctgggggcgcggttcctcgaatttgaggctctgggattccttaatgaggatcattggttttcccgcggcaacagcctgtccggggtggaaggcgagggactccacagactgggctacattcttcgggaagtcgggaagaaagagggaggcgccatgtacgccgacgatacagctgggtgggacacccgcatcacactggaagatctcaagaatgaggagatggtgaccaaccatatgaaaggagaacacaagaaactggccgaggctattttcaagctgacgtatcagaataaggttgtgagagtccagcggcctacaccccgcggcaccgtgatggacatcattagcagaaaagaccaacgggggtctggccaggttggaacatacggcctcaacaccttcacgaatatggaagcccagctgatccgccaaatggagggggagggaatctttaagagcattcagcatcttaccgcgacagaagagatcgccgtgcagaactggctggctagagtcggccgggaacgcctctccagaatggccatttctggggatgactgcgtggttaaaccgatcgatgaccggttcgctagcgccctgaccgcgcttaatgatatgggaaaggtgagaaaagacattcagcaatgggagccttcccgcggctggaacgattggacacaggtccccttttgctctcaccacttccatgaactggtgatgaaggacgggcgggtcctcgtggttccctgtagaaaccaggatgagctgatcggccgcgcccggatcagccagggagctggctggtccctgaaggagaccgcctgcctcgggaaatcttatgctcaaatgtggacactgatgtactttcacagacgcgaccttcggctggccgctaatgccatttgtagcgcggtgccttcccattgggtcccgaccagcagaacgacatggtctatccacgccaagcacgaatggatgaccaccgaggatatgctcgctgtgtggaaccgcgtgtggattcaggaaaatccctggatggaggacaaaacacctgttgaatcctgggaggaggtgccctatctgggaaagcgggaagatcagtggtgcggcagccttatcgggctgacctctagagccacatgggccaaaaacattcagacggctatcaatcaagtccgctccctcattggaaacgagggctacaccgactatatgcctagcatgaagcggttcagacgggaagaggaagaggccggggtgctgtggtga

SEQ ID NO: 19647 - RNA, 9876 nt, synthetic construct
  misc_feature 1..9876: note = derived and/or modified CDS sequence (opt5) from DENV-2__FJ898461__SS-prME
  source 1..9876: mol_type = other RNA
accgccggagtgatcgtcatgctgattcccacggctatggccttccacctcacgaccagaaatggggagcctcatatgatcgttggacggcaggaaaagggcaagagcctgctttttaagacagaggacggggtgaatatgtgcaccctgatggcgattgatctcggagaactgtgtgaggacacaatcacctacaaatgcccgcttctgagacaaaatgaacccgaggatattgactgttggtgcaattccacatctacctgggtgacgtatggcacctgtacaaccacaggggagcacagacgggaaaagcgcagcgttgctctcgtgcctcatgttggaatgggcctggagaccagaacggaaacatggatgtcctctgagggcgcctggaaacacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaggaacaggacaaacgctttatctgcaagcattccatggtggatagaggctggggcaacgggtgtggactgttcggcaaagggggaattgtcacatgcgccatgtttacgtgcaaaaagaatatggaaggcaaagttgtgcagcctgagaacctcgaatacaccatcgtgattacaccccacagcggggaggagcatgcggtcggaaatgacaccggcaagcacggcaaagaaatcaagatcacacctcagtcttccattaccgaggccgaactgacggggtatggaaccgtgacaatggagtgtagcccccggaccggccttgatttcaacgaaatggttctgctccaaatggaggacaaggcttggctggtgcaccgccagtggtttcttgatctgccgctcccttggctgcccggggccgacacacagggatctaattggatccagaaggagaccctggtcacgttcaagaaccctcatgctaaaaagcaagacgtggttgtgctcggctcccaggaaggggccatgcacacagccctgaccggcgctacagagattcagatgagctccggaaatcttctgtttaccggccatctcaaatgcagactgcggatggataaacttcaactgaaagggatgtcttacagcatgtgtaccggaaagttcaagatcgtcaaagaaattgcggagacacagcacggcacgatcgtgatcagagtccagtatgagggggacggatccccctgcaagattcccttcgaaatcaccgatctcgagaaacgccatgtgctgggccggctgattacagttaaccctatcgtgaccgaaaaggacagcccggtcaacattgaggccgaacccccttttggggattcttacatcattatcggcgtggagcccggacagctcaaactgaattggttcaagaagggctccagcatcgggcaaatgtttcagacaaccgttagaggagctaaacgcatggccattcttggcgacacggcctgggatttcgggtctctgggaggcgtgtttacaagcatcgggaaggctctccaccaggtcttcggcgccatttacggagcggctttttccggcgtgtcttggaccatgaaaatcctgattggggtgatcatcacctggattggaatgaacagccggtccacaagcctgtctgtttcccttgtcctcgtgggcgtggtcaccctgtatctgggggccatggtgcaggccgacagcggatgtgttgtgtcttggaagaataaagagctcaagtgcggctccgggatcttcattacagataacgtccacacgtggaccgaacaatacaagtttcagcctgagagcccctccaaactggcttctgccatccagaaggctcatgaagagggcatttgtggaatcagaagcgtgacacgccttgaaaatctgatgtggaaacagatcaccccggagctcaaccacattctgtccgagaatgaagttaagctgacaatcatgaccggcgacattaaagggatcatgcaagccggaaagcggtctcttagacctcagcccacggagctcaaatatagctggaagacctggggcaaggcgaaaatgctgtccacagaaagccataaccagaccttcctgattgatgggcctgagacagccgaatgccccaataccaaccgcgcttggaactctctcgaggtggaggactacggatttggcgtcttcacaaccaacatctggctgaaacttcgggaaaaacaggacgtgttttgtgattccaagctgatgagcgccgctatcaaagacaatagagccgttcacgcggatatgggctattggattgagtctgccctcaacgacacgtggaagatggaaaaggcttccttcatcgaggtgaaaagctgccactggcctaagtctcatacactgtggagcaatggggtcctggagtccgaaatgattatccccaaaaacttcgccggaccggtgagccaacacaactaccgccctggctatcatacccagaccgctgggccctggcaccttggaaagctcgagatggattttgacctgtgtgaaggcacaaccgtggtcgttacggaggattgcgggaatcggggaccctctctgagaacaaccacagcctccggcaaactcattaccgaatggtgctgtcggagctgcacactgcctccgcttcgctacagaggcgaggacgggtgttggtacggaatggagatccggcccctgaaggaaaaggaggaaaacctcgtgaatagcctggtgaccgccggccatgggcagattgataacttctctctgggagtccttggcatggctctctttctggaggaaatgctgagaacgcgcatcgggaccaaacacgcgatcctcctggtggttgtgagcttcgtcacacttattaccggaaatatgtcctttcgggacctgggcagagtgatggttatggtgggcgccacaatgaccgatgacatcgggatgggagtcacgtatctcgctctgctggccgccttcaaggtgcgccctacatttgctgccggccttctgctcagaaaactgacctctaaggagctcatgatggcgacaattgggatcgctctgcttagccaatccaccattcccgagaccatcctggaactcacagatgccctggccctgggaatgatggttcttaaaatcgtgcggaacatggagaagtaccagctggctgtcacgattatggccatctcttgcgtgcctaatgcggtgattctccagaacgcttggaaggtcagctgtaccatcctggccgccgtttccgtgagccccctcctgcttacatcttcccagcaaaaagctgactggattcctctggccctcaccatcaagggcctgaatcccacagctatcttcctgaccacgcttagccgcacatctaaaaagagatcctggccgctgaacgaagccattatggcggtggggatggtcagcatcctcgcctcttccctgctcaaaaatgacattcctatgaccggacccctggtggctggcggccttctgaccgtttgctatgtgctgacagggcggagcgccgatctcgagctggaacgcgctgccgacgtcaagtgggaggatcaggccgagatctccggaagctctcctattcttagcatcaccatttccgaagacggctctatgagcatcaaaaacgaggaagaggagcagacactgacgatcctcattagaaccgggctgctcgtgatctccggagtttttcccgtgtctattccgatcacagctgcggcctggtacctgtgggaagtcaagaagcagcgggctggcgtgctttgggatgtcccttctccccctcccgtggagaaagccgaactggaggacggggcctatcgcattaagcaaagaggaatcctgggctactcccagatcggcgctggggtttataaagaaggaaccttccacacaatgtggcatgtgacccggggcgccgtcctcatgcaccgcgggaagagaattgagccctcctgggcggatgtgaaaaaggacctgatcagctacggaggcgggtggaaacttgagggagaatggaaagagggcgaagaggttcaggtgctggctctcgaacctggcaagaatccgcgggccgtccagacgaaacccgggatttttaagaccaacacaggaaccatcggcgccgtgtccctggatttcagccctgggacatctggatcccccattgtggacagaaaaggcaaggttgtcgggctctacggaaatggcgtggtgacccgcagcggcgcttatgtctctgccatcgcgcaaacagagaagtccatcgaggataaccctgaaattgaggacgatatctttcggaaaaagagactgacgattatggaccttcatcccggggctggaaaaaccaagcgctacctgcctgccatcgtgcgggaagccattaaaagaggcctgcgcacactcatcctggctccgacccgggttgtggccgctgagatggaagaggcccttagagggctgcccattcgctatcagacccctgcgatcaagacagagcacacgggacgggaaatcgtcgacctcatgtgtcatgccaccttcacaatgagactgctcagccccgtgcgggttcctaactacaatctgattatcatggatgaggctcacttcaccgaccccgcctccattgctgcccgcggctatatctctacaagagtggaaatgggggaggccgctggcatttttatgaccgcgacgccgcctggaagccgggatcccttcccccagtccaacgcccctatcatggacgaggaacgcgagatccccgaaagaagctggaactctggccacgagtgggtcacagattttaaggggaaaaccgtgtggttcgttccttccattaaggctggaaacgacatcgccgcctgccttcggaaaaatggcaagaaagtgattcaactgagcagaaagacctttgattctgaatacgtcaagacacgcgctaacgactgggatttcgtggtgaccacagacatcagcgagatgggggccaattttaaagcggagcgggtcattgatccgagacgctgtatgaagcccgttatcctgaccgacggagaagaacgggtgatcctcgctggccctatgcccgtgacgcattcctctgccgcccagagacgcgggcggattggcagaaaccctaaaaatgaaaacgaccagtatatctacatgggagagcccctggaaaatgatgaggactgcgctcactggaaggaggccaaaatgcttctggataacattaatacaccggaaggcatcattcctagcatgttcgagcccgaacgcgagaaggtcgacgcgatcgatggggaatacagactccggggagaggcccgcaaaacctttgtggacctgatgagacggggcgatctgcctgtttggctcgcttataaggtggccgctgaggggattaactacgccgaccgcaagtggtgtttcgatggaatcaaaaataaccagatccttgaagagaacatggaagtcgagatttggacaaaggagggcgaacgcaagaagctgaaaccccggtggctggacgctagaatctattccgatcctctcgccctgaaggagtttaaggagttcgcggccgggcgcaaatctcttaccctgaatctcattacggagatgggccggctgcccaccttcatgacacaaaaggctagaaacgccctggacaatctcgctgtgcttcataccgccgaagccggaggccgcgcttacaaccacgcgctgagcgagctgccggagacactcgaaaccctgcttctgctcacactgctggccaccgttacagggggaatctttctcttccttatgtccggcaaagggattggaaagatgacactgggcatgtgctgcatcatcaccgctagcattctgctctggtatgcccagatccagcctcactggattgccgcttctatcattctggagtttttccttatcgtgctgctcatccccgaacccgagaaacagcggacccctcaagataatcagctgacatacgtcgtgattgccatcctgaccgtcgtggcggccacaatggctaacgaaatgggctttctcgagaagacgaagaaagaccttgggctgggatccattaccacacaggagccggaaagcaatatcctggacattgatctcagacccgcctccgcttggaccctgtatgccgttgcgacaaccttcgtgacgcctatgcttcggcattctatcgagaacagctccgtgaatgtctctctgaccgccattgctaaccaggccacagttctcatgggcctggggaagggatggcccctgagcaaaatggacatcggcgtgcctctccttgctatcgggtgttactcccaagtgaatcccattaccctgacagccgctctgctcctgcttgtcgcccactacgcgatcattggacctggcctgcaggccaaggctacccgcgaagcccagaaaagagctgccgccggcatcatgaagaacccgacggtggatgggattacagttatcgacctcgagcccatcccttatgatcccaagtttgaaaaacagctgggacaagtgatgctgctcattctttgcgtcacccaggtgctgatgatgcggacaacctgggcgctgtgtgaggctctcaccctggccacaggccctatcagcacgctttgggaggggaatcccggacgcttctggaacaccacaattgctgtctctatggccaatatctttagaggctcctacctggccggggctggactcctgttcagcattatgaagaacaccacaaatacccggcgcggcacgggcaacatcggggaaacactgggagagaaatggaagtctagactcaacgcccttggcaaatccgaatttcagatctataagaaaagcgggattcaagaggtggaccggaccctggcgaaggagggaatcaagcgcggcgaaaccgatcatcacgccgtttctagagggagcgctaaactgcggtggttcgtggagagaaatatggtcacaccggaaggaaaggtggttgacctcggctgcggccgcgggggatggtcctactattgtggcgggctgaaaaacgtgcgggaggtcaagggacttaccaaaggcgggcctggacatgaggaacccattcccatgtctacatacggctggaatctggtgagactccagagcggcgtggatgtctttttcacgcctcccgagaagtgcgacaccctgctgtgtgatatcggggaatccagccctaacccgacaattgaggccggacgcaccctccgggtccttaatctggtggaaaactggctgaataacaatacacagttctgcatcaaggtgctcaacccctatatgccttccgtcatcgagaaaatggaaaccctgcagagaaagtacggcggggctcttgttcgcaatcccctgtctcggaacagcacgcacgagatgtactgggtgtccaatgccaccggaaacattgtgtctagcgtcaatatgatctccagaatgctcattaaccgctttacaatgaaacacaagaaagcgacctatgagcctgacgtggatctgggctctgggacacggaacatcggaattgaaagcgagatccccaatctggacattatcggcaagagaatcgaaaagattaaacaagagcatgaaacctcctggcactacgaccaggatcatccgtataagacatgggcctaccacggcagctatgagaccaaacagacggggtctgcttccagcatggttaacggagtggtccgcctccttacaaagccttgggacgtggttcccatggtgacccagatggccatgaccgatacaacgcctttcggccaacagcgggtctttaaagagaaggtggacaccagaacacaggaacccaaggaggggaccaaaaagctgatgaaaatcacagctgaatggctgtggaaggagctcggcaagaagaaaacccctcgcatgtgtacaagagaggagttcacccggaaggtgcgctctaatgccgctctgggcgccatttttacggatgagaacaagtggaaatccgcgagagaagccgtcgaggacgggcggttctgggaacttgttgatagagagcggaatctgcacctcgagggaaagtgcgaaacctgtgtgtacaacatgatgggcaaacgcgagaagaaactgggcgaatttgggaaggctaagggaagcagagccatctggtatatgtggctgggcgctcggttcctcgagtttgaagccctggggttccttaatgaggaccattggttttctcgcggaaactccctgagcggcgtggagggggaaggcctccacagactgggatacattcttcgggatgtcggcaaaaaggaagggggagccatgtacgcggacgatacagctggctgggacacccgcatcacactggaagacctcaaaaatgaggaaatggtgaccaaccatatgaagggggagcacaaaaagctggccgaggccatcttcaagctgacgtatcagaataaagttgtgagagtccaacggcccacaccgcgcggaaccgtgatggatattatctccagacgggaccagcgcggcagcgggcaggttggcacatacggactcaacacctttacgaatatggaagctcaactgattagacagatggagggcgaagggatcttcaagtctattcagcatcttaccgccacagaggagatcgctgtgcagaactggctggcccggctcggacgcgaaagactgagccggatggcgatctccggcgatgactgcgtcgtgaaacctattgatgacagattcgcctctgctcttaccgccctgaatgatatggggaaggttcgcaaagacatccaacagtgggagcccagccggggatggaacgattggacacaggtgcccttttgctcccaccacttccatgaactcgtcatgaaggacggcagagtgctggtcgtgccttgtcgcaaccaggatgagctgattgggcgggctagaatctctcaaggcgccggatggagcctcaaggaaaccgcgtgcctgggcaaatcctatgcccagatgtggacacttatgtactttcaccgccgggacctgagactcgctgccaatgctatttgttctgccgttccgagccattgggtgcccacctcccgcacgacatggagcatccacgctaagcacgagtggatgaccaccgaggatatgctggccgtctggaaccgggtgtggattcaggaaaatccttggatggaggacaaaacacccgtggaatcttgggaggaagttccttatcttgggaagagagaggaccagtggtgcggatccctgatcggcctcaccagccgcgcgacatgggccaaaaacatccaaacggctattaatcaggtgcggtctctgatcgggaacgaggaatacaccgattatatgccctccatgaagagattccggagagaggaagaggaagccggagtcctgtggtga

SEQ ID NO: 19648 - RNA, 9876 nt, synthetic construct
  misc_feature 1..9876: note = derived and/or modified CDS sequence (opt5) from DENV-2__FJ024473__SS-prME
  source 1..9876: mol_type = other RNA
accgccggagtgatcgtcatgctgattcccaccgctatggccttccacctcacgaccagaaacggggaacctcatatgatcgttggacggcaggaaaagggcaagtccctgctttttaagaccgaggacggggtgaatatgtgcaccctgatggcgattgatctcggagaactgtgtgaggacaccatcacctacaaatgcccgcttctgagacaaaacgaacccgaggatattgactgttggtgcaattccacctctacctgggtgacgtatggcacctgtacaaccacaggggagcacagacgggaaaagagaagcgtcgctctcgtgcctcatgttggaatgggcctggagaccagaacggaaacatggatgtcctctgagggcgcctggaaacacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcacatccaaccgcgattttgtggaaggggtttctggaggcagctgggtggacattgtcctcgagcacgggtcctgtgtgaccacaatggccaagaataagcccaccctggatttcgaacttatcaaaacggaggctaagcagcctgccacactgagaaaatattgcatcgaagctaagctcaccaacaccacaaccgagagccggtgtccgacacaaggagagccctctctgaatgaagaacaggacaaacgctttatttgcaagcattccatggtggatagaggctggggcaacgggtgtggactgttcggcaaagggggaatcgtcacgtgcgccatgtttacctgcaaaaagaatatggaaggcaaagttgtgcagcctgagaacctcgaatacacaattgtgatcacaccccacagcggggaggagcatgcggtcggagacgatacaggcaagcacggcaaagaaattaagatcacccctcagtcttccatcacggaggccgaactgaccgggtatggaacagtgaccatggagtgtagcccccggacaggccttgacttcaatgaaatggttctgctccaaatggaggataaggcttggctggtgcaccgccagtggtttcttgacctgccgctcccttggctgcccggggccgacacccagggatctaactggattcagaaggagacgctggtcacattcaagaatcctcatgctaaaaagcaagatgtggttgtgctcggctcccaggaaggggccatgcacaccgccctgacaggcgctaccgagatccagatgagctccggaaaccttctgtttaccggccatctcaaatgcagactgcggatggacaaacttcaactgaaagggatgtcttacagcatgtgtacaggaaagttcaagattgtcaaagaaatcgcggagacgcagcacggcaccattgtgatcagagtccagtatgagggggatggatccccctgcaagatccccttcgaaattacagacctcgagaaacgccatgtgctgggccggctgatcaccgttaatcctattgtgatcgaaaaggatagcccggtcaacattgaggccgaacccccttttggggactcttacatcattatcggcgtggagcccggacagctcaaactgaactggttcaagaagggctccagcatcgggcaaatgtttgagacaaccatgagaggagctaaacgcatggccattcttggcgatacggcctgggacttcgggtctctgggaggcgtttttacaagcatcgggaaggctctccaccaggtgttcggcgccatttacggagcggctttttccggcgtctcttggaccatgaaaatcctgattggggtggtgatcacctggatcggaatgaatagccggtccacaagcctgtctgtttcccttgtcctcgtgggcgtggtcaccctgtatctgggggccatggtgcaggccgatagcggatgtgttgtgtcttggaagaacaaagaactcaagtgcggctccgggattttcatcacagacaatgtccacacgtggaccgagcagtacaagtttcaacctgaaagcccctccaaactggcttctgccattcagaaggctcatgaggaaggcatctgtggaattagaagcgtgacacgccttgagaacctgatgtggaaacagatcaccccggagctcaatcacatcctgtccgaaaacgaggttaagctgacaattatgaccggcgatacgaaagggatcatgcaggccggaaagcggtatcttagacctcaacccaccgaactcaaatactcttggaagacatggggcaaggcgaaaatgctgagcaccgagtcccataatcagacattcctgattgacgggcctgaaaccgccgagtgccccaacacaaatcgcgcttggaacagcctcgaggtggaagactatggatttggcgtcttcaccacgaatatctggctgaaacttcgggagaaacaggatgtgttttgtgactctaagctgatgtccgccgctattaaagataacagagccgttcacgcggacatgggctactggatcgaaagcgccctcaatgatacatggaagatggagaaggcttctttcatcgaggtgaaatcctgccactggcctaagagccataccctgtggtctaacggggtcctggaaagcgagatgattatccccaaaaatttcgccggaccggtgtcccagcacaactatcgccctggctaccatacccaaacagctgggccctggcaccttggaaagctcgaaatggactttgatttctgtgagggcaccacggtggtcgttacagaagactgcgggaaccggggacccagcctgagaaccacaaccgcctctggcaaactgattacagagtggtgctgtcggtcctgcaccctccctccgctgcgctacagaggcgaggatgggtgttggtatggaatggaaatccggccccttaaggagaaggaagagaatctggtgaacagcctcgtgacggccggccatgggcagattgacaatttttccctgggagtcctgggcatggctcttttcctcgaagagatgctgagaacccgcgtggggacaaaacacgcgatcctgctcgttgccgtgtcttttgtcaccctgattacaggaaacatgagcttccgggatcttggcagagtgatggttatggtgggcgctaccatgacggacgatatcgggatgggagtcacatacctggccctcctggccgcttttaaggtgcgccctaccttcgccgcgggcctgcttctgagaaaactcacatccaaggagctgatgatggctaccatcgggattaccctcctgtctcagagcacaatccccgaaacgattcttgagctgaccgacgccctcgccctgggaatgatggttctgaaaatcgtgcggaatatggaaaagtatcaacttgctgtcacaattatggccatctcctgcgtgcctaacgcggtgatcctgcgcaatgcttggaaggtctcttgtaccattctcgccgccgttagcgtgagccccctgctcctgacaagctctcagcagaaagctgactggatccctcttgccctgaccattaagggcctcaaccccacggctatctttctgacaaccctgtccagaaccagcaaaaagcggtcttggccgcttaatgaggccattatggcggtggggatggtctccatcctggccagctctctcctgaaaaacgatatccctatgacaggacccctcgtggctggcggcctgcttaccgtttgctacgtgctgacagggcgctccgccgacctggaactcgagagagctgccgatgtcaagtgggaggaccaggccgaaattagcggatccagccctatcctgtctattacgatcagcgaggatggctccatgtctattaaaaatgaagaggaggaaaccacacttaccatcctgattcggacagggctcctggtgatcagcggagttttccccgtgtccatcccgattaccgctgcggcctggtatctctgggaggtcaagaagcaacgcgctggcgtgctgtgggacgtcccttctccccctcttgtggggaaagccgaactggaggatggagcctacagaatcaagcagcggggcattctgggctatagccagatcggggctggagtttacaaagaaggcacgtttcacaccatgtggcatgtgacacgcggggccgtcctcatgcacagaggaaagcggattgagccctcctgggcggacgtgaaaaaggatctgatctcttacggcgggggatggaaacttgagggcgaatggaaagagggcgaagaggttcaggtgctggctctcgaacccgggaagaaccctagagccgtccaaaccaaaccgggaatcttcaagacaaataccggcacaattggggccgtgagcctggacttttcccccggaacgagcggctctcctatcgtggatcgcaaagggaaggttgtcggactctatggcaacggcgtggtgacccggtccggggcttacgtcagcgccattgcgcagacagagaagtctatcgaggacaatcccgaaattgaggatgacatcttccgcaagaagcgcctgaccatcatggaccttcatcctggagctggcaaaaccaagcggtatctgcccgccattgtgagagaagccatcaaacgcgggctgcggacactcattctggctcctacgagagttgtggccgctgagatggaagaggcccttcgcggactgccgatccggtaccagacccccgcgattaaggccgagcacacaggcagagaaatcgtcgatctcatgtgtcatgctaccttcacaatgcggctgctctcccctgtgcgcgttcccaactataacctgattatcatggacgaggcccactttaccgatcctgctagcatcgccgccagagggtacatttccacgcgggtggaaatgggcgaggctgcgggaatcttcatgacagccacacccccgggctctcgcgacccttttccccagagcaatgctcccattatggatgaggaaagagagatccctgaacggtcctggaacagcgggcacgagtgggtcaccgacttcaagggaaaaacagtgtggtttgttccctctattaaggccggcaatgatatcgccgcttgccttcgcaagaacgggaagaaagtgatccaactgtcccgcaagaccttcgacagcgaatatgtcaagacacgggccaatgattgggactttgtggtgaccacggatatttctgagatgggagcgaacttcaaagctgagagagtcatcgaccctcgccggtgtatgaagccggttattctgacagacggcgaagagagagtgatcctcgccgggcccatgcctgtgacccatagctccgccgctcagcgccggggcagaattggacgcaatcccaaaaacgaaaatgatcagtacatctacatgggcgagcctctggaaaacgacgaggattgcgcccactggaaggaggcgaaaatgcttctggacaatatcaacacacccgaagggattatcccgtctatgtttgagcctgaaagagagaaggtcgatgccgtggacggagaatatcggctccgcggcgaggctagaaaaaccttcgttgatctgatgcggcgcggggacctgcccgtgtggctcgcctacaaggtcgctgccgagggaattaattatgctgatagaaagtggtgttttgacggcatcaaaaacaatcaaattcttgaagagaacgtggaagttgagatctggacgaaggagggggaacggaaaaagctgaaacctagatggctggatgcccgcatttacagcgaccccctcgcgctgaaggagttcaaggagttcgccgctggccggaaatcccttaccctgaacctcatcacagagatgggaagactgcctacctttatgacacagaaggcccgcaatgctctggataacctcgccgtgcttcataccgccgaagctggcgggcgggcgtataatcacgccctgtctgagctgcccgagacactcgaaaccctgcttctgctcacgctgctggctacagtcaccggaggcatcttcctctttcttatgagcgggaaaggaattggcaagatgaccctgggcatgtgctgcatcattacagcctccgtgctgctctggtacgcccagatccagccgcactggattgctgccagcatcatcctggagttctttcttattgtcctgctcatccctgaacccgagaaacaaagaacaccccaggacaaccagctgacatatgtggttattgcgatcctgacggtggtggccgctaccatggccaatgaaatggggttcctcgagaagacaaagaaagaccttggactgggctctattaccacacaggagtccgaaagcaacatcctggatatcgacctccggcctgcttccgcctggaccctgtacgcggtcgccacgacctttgttacaccgatgcttcgccattctattgagaatagctccgtgaacgtgtctctgaccgctatcgccaatcaagctacagtcctcatggggctgggaaagggctggcccctgagcaaaatggatattggggtgcctctccttgccatcggatgttactcccaggttaaccccattaccctgacggctgccctgctcctgcttgtggcgcactatgccatcattggccctggcctgcaggctaaggccacaagagaagctcagaaacgggccgccgcggggatcatgaagaatcccaccgtcgacggaatcacagtgattgatctcgagcctatcccgtacgaccccaagttcgaaaaacaactgggccaggtcatgctgctcattctttgcgtgacccaggttctgatgatgcgcaccacatgggctctgtgtgaggccctcacgctggctaccgggcctatcagcacactttgggagggaaaccccggcagattttggaataccacaattgccgtgtctatggccaacatcttccgggggtcctatctggctggagccggcctcctgtttagcatcatgaagaataccacgaacacacgcagaggcaccgggaatattggagaaaccctgggcgagaaatggaagtctcggctcaacgcgcttgggaaatccgagttccagatctacaagaaaagcggcattcaagaggtcgatcgcacactggccaaggagggcatcaagagaggggaaaccgaccatcacgctgtgtctcggggaagcgccaaactgagatggtttgttgagcgcaacatggtgacacctgaaggcaaggtcgtggatctcggctgcgggcggggaggctggtcctattactgtgggggactgaaaaatgtgagagaggttaagggccttacgaaagggggacccggccatgaagaaccgattcctatgtctacctatggctggaacctggtccgcctccagagcggggtggacgtgttcttcacacctcccgagaagtgcgataccctgctgtgtgacatcggagaatccagccccaatcccacaatcgaggctggccggaccctcagagtccttaacctggttgaaaattggctgaacaataacacgcagttttgcattaaggtgctcaatccttacatgccgtccgtgatcgagaaaatggaaaccctgcaacgcaagtacgggggagcccttgtccggaaccccctgtctagaaatagcacacacgagatgtattgggtgtccaacgcgaccggcaatattgtttctagcgtgaacatgatctcccgcatgctcattaatcggttcacaatgaaacacaagaaagccacctacgaggctgatgtcgacctggggtctggaacaagaaacatcggcatcgaaagcgagattcctaacctggacatcattggcaagcgcatcgaaaagattaaacaggagcatgaaacctcctggcactatgatcaggaccatccctacaagacgtgggcctatcacgggagctacgagacaaaacagaccggatctgcttccagcatggtgaatggcgttgtgcggctccttaccaagccttgggatgtcgtgcccatggtgacacaaatggccatgacggacaccacaccgtttgggcagcagagagtcttcaaagagaaggttgatacccgcacacaggaacctaaggagggaaccaaaaagctgatgagaatcacagctgaatggctgtggaaagagctcggcaagaaaaagacaccccggatgtgtacgcgcgaggaatttaccagaaaagtgcggtctaacgccgcgctgggggccattttcacagacgagaataagtggaagtccgctagagaagccgtggaggatggacggttttgggaacttgtcgaccgcgagagaaacctgcacctcgagggcaaatgcgaaacctgtgtgtataatatgatgggcaagcgggagaaaaagctgggggagttcggaaaagctaagggcagccgcgccatctggtacatgtggctgggggccagatttctcgagttcgaagcgctgggatttcttaacgaggatcattggttctctcggggcaattccctgagcggggttgagggcgaaggactccaccgcctgggctacatccttagagacgtggggaagaaagagggaggcgctatgtatgccgatgacacagccgggtgggacacccggattacgctggaagatctcaagaacgaggaaatggtcacaaatcatatgaaaggagagcacaagaaactggctgaggccatctttaagctgacctaccaaaacaaggtggttcgcgtgcagagacctacaccccggggcaccgtcatggacattatctcccgcagagatcagcgggggagcggccaggtgggaacgtatggcctcaataccttcacaaacatggaagctcaactgattcgccagatggagggggaaggaatcttcaaatctatccagcatcttaccgccacagaggagattgcggcccaaaattggctggctagagttggccgggaaagactcagccgcatggccatctccggggacgattgcgtggtcaagcctattgacgatcggtttgcttctgccctgaccgcgcttaacgacatgggaaaagtgagaaaggatatccagcagtgggagcccagccgcggctggaatgactggacacaggtcccgttctgctcccaccactttcatgaactggtgatgaaagatgggcgggttctcgtggtcccttgtagaaaccaagacgagctgattggccgcgcccggatctctcagggagctggctggagcctgaaggaaaccgcctgcctcgggaagtcctacgctcagatgtggacgctgatgtatttccacagacgcgatcttcggctggccgctaacgccatctgttctgcggtgcccagccattgggtgcccacatccagaaccacctggagcattcacgccaaacacgagtggatgacaaccgaggacatgctcgctgtttggaatcgcgtgtggatccaggaaaacccttggatggaggacaagacaccggtcgaatcttgggaggaagtgccctacctgggaaaacgggaggatcaatggtgcggctcccttattgggctgacgagcagagccacctgggccaagaatatccagacagctattaaccaggttcggtctctcatcggaaatgaggaatataccgactacatgccttccatgaaaagatttcgccgggaggaagaggaagccggcgtgctgtggtga

SEQ ID NO: 19649 - RNA, 9876 nt, synthetic construct
  misc_feature 1..9876: note = derived and/or modified CDS sequence (opt5) from DENV-2__FJ024474__SS-prME
  source 1..9876: mol_type = other RNA
accgccggcgtgatcgtcatgctgattcccacagctatggccttccacctcacgaccagaaacggggagcctcatatgatcgttggacggcaggaaaagggcaaaagcctgctttttaagacagaggacggggtgaatatgtgcaccctgatggcgattgatctcggagaactgtgtgaggacacaatcacctacaaatgcccgcttctgaagcaaaacgaacccgaggatattgactgttggtgcaattccacatctacctgggtgacgtatggcacctgtacaaccacaggggagcaccgcagagaaaaacggagcgtcgctctcgtgcctcatgttggaatgggcctggagacccgcacggaaacatggatgtcctctgagggcgcctggaagcacgtgcagagaatcgagacctggatcctgcggcatcccgggttcacaattatggccgctatcctcgcctacaccattggaaccacacactttcagcgcgctctgatcttcattcttctgacggccgtcgcgcctagcatgaccatgagatgcatcggcatttccaaccgggattttgtggaaggggtttctggaggcagctgggtggacatcgtcctcgagcacgggtcctgtgtgacaaccatggccaagaataaacccacactggatttcgaacttatcaagaccgaggctaaacagcctgccacgctgcgcaagtattgcattgaagctaaactcacaaacaccaccacagagagcagatgtccgacccaaggagagccctctctgaatgaagagcaggacaagcggtttatctgcaagcattccatggtggatcgcggctggggcaacgggtgtggactgttcggcaaagggggaattgtcacatgcgccatgtttacgtgcaagaaaaatatggaaggcaaggttgtgcagcctgagaacctcgaatacaccatcgtgattacaccccacagcggggaggagcatgcggtcggaaatgacatcggcaaacacggcaaggaaatcaaaattacccctcagtcttccatcacagaggccgaactgaccgggtatggaacggtgaccatggagtgtagccccagaacaggccttgatttcaacgaaatggttctgctccaaatggaggacaaggcttggctggtgcaccggcagtggtttcttgatctgccgctcccttggctgcccggggccgacacccagggatctaattggattcagaaggagacactggtcaccttcaaaaaccctcatgctaagaaacaagacgtggttgtgctcggctcccaggaaggggccatgcacacggccctgacaggcgctaccgagatccagatgagctccggaaatcttctgtttacaggccatctcaagtgccgcctgagaatggataaacttcaactgaaggggatgtcttacagcatgtgtaccggaaagttcaaaattgtcaaggaaatcgcggagacccagcacggcacaatcgtgattcgggtccagtatgagggggacggatccccctgcaaaatccccttcgaaattacggatctcgagaagagacatgtgctgggccgcctgatcaccgttaaccctattgtgatcgaaaaagacagcccggtcaacattgaggccgaacccccttttggggattcttacatcatcattggcgtggagcccggacagctcaagctgaattggttcaagaaaggctccagcatcgggcaaatgtttgagacaaccatgcggggagctaagagaatggccattcttggcgacacagcctgggatttcgggtctctgggaggcgtttttaccagcatcgggaaagctctccaccaggtgttcggcgccatttacggagcggctttttccggcgtctcttggacgatgaagatcctgatcggggtggtgattacatggatcggaatgaacagccgctccaccagcctgtctgtttcccttgtcctcgtgggcgtggtcaccctgtatctgggggccatggtgcaggccgacagcggatgtgttgtgtcttggaaaaataaggaactcaagtgcggctccgggattttcatcacagataacgtccacacctggacagagcagtacaaatttcaacctgaaagcccctccaagctggcttctgccattcagaaagctcatgaggaaggcatctgtggaatccggagcgtgacgagacttgagaatctgatgtggaagcagattaccccggagctcaaccacatcctgtccgaaaatgaggttaaactgacaattatgaccggcgacacaaaggggatcatgcaggccggaaaacgctatcttcggcctcaacccaccgaactcaagtactcttggaagacgtggggcaaagcgaagatgctgagcaccgagtcccataaccagacattcctgattgatgggcctgaaaccgccgagtgccccaatacaaacagagcttggaatagcctcgaggtggaagactatggatttggcgtcttcaccacaaacatctggctgaaacttcgcgagaagcaggacgtgttttgtgattctaaactgatgtccgccgctatcaaggacaatcgggccgttcacgcggatatgggctactggattgaaagcgccctcaacgacacctggaagatggagaaagcttctttcatcgaggtgaagtcctgccactggcctaaaagccatacgctgtggtctaatggggtcctggaaagcgagatgattatccccaagaacttcgccggaccggtgtcccagcacaactatagacctggctaccatacacaaaccgctgggccctggcaccttggaaaactcgaaatggattttgacttctgtgagggcaccacagtggtcgttaccgaagattgcgggaatcgcggacccagcctgcggacgacaaccgcctctggcaagctgattacagagtggtgctgtagatcctgcaccctccctccgctgcggtaccgcggcgaggacgggtgttggtatggaatggaaatcagaccccttaaggagaaagaagagaacctggtgaatagcctcgtgacagccggccatgggcagattgataacttttccctgggagtcctgggcatggctcttttcctcgaagagatgctgcggaccagagtggggacgaagcacgcgatcctgctcgttgccgtgtcttttgtcaccctgatcacaggaaatatgagcttccgcgaccttggccgggtgatggttatggtgggcgctaccatgacagatgacattgggatgggagtcacctacctggccctcctggccgcttttaaagtgagacctacgttcgccgcgggcctgcttctgcgcaagctcacatccaaagagctgatgatggctaccatcgggattacactcctgtctcagagcaccatccccgaaaccattcttgagctgacagatgccctcgccctgggaatgatggttctgaagatcgtgagaaacatggaaaagtatcaacttgctgtcacgatcatggccatttcctgcgtgcctaatgcggtgatcctgcggaacgcttggaaagtctcttgtaccattctcgccgccgctagcgtttcccccctgctcctgacaagctctcagcagaaggccgactggatccctcttgctctgaccattaaaggcctcaatcccacagccatctttctgaccacgctgtcccgcacaagcaagaaaagatcttggccgcttaacgaggcgatcatggccgtggggatggtgtccattctggctagctctctcctgaagaatgacatccctatgaccggacccctcgtcgccggcggcctgcttaccgtgtgctacgttctgacagggcggtccgctgatctggaactcgagcgcgccgccgacgtgaaatgggaggatcaggctgaaattagcggatccagccctatcctgtctattaccatcagcgaggacggctccatgtctattaagaacgaagaggaggaacaaatccttacaatcctgattagaacggggctcctggtcatcagcggagtgttccccgtttccattccgatcaccgcggccgcttggtatctctgggaggtgaagaaacagcgggccggcgtcctgtgggatgtgccttctccccctcccgtcgggaaggccgaacttgaggacggagcttaccgcattaaacagagaggcatcctgggctatagccagatcggggccggagtgtacaaggaaggcacatttcacaccatgtggcatgttacacggggggcggtgctgatgcaccgcggaaaaagaattgagccctcctgggctgatgtcaagaaggacctcatctcttacggcgggggatggaaactggagggcgaatggaaggagggcgaagaggtgcaagttcttgccctggaacctgggaaaaatccgcgggccgtgcagaccaagcccggaattttcaaaacgaacaccggcacaatcggggctgtcagcctcgatttttcccctggaaccagcggctctcccattgtggacagaaaggggaaggtggttggactgtatggcaatggcgtcgtgacacgctccggggcctacgtgagcgcgatcgctcagaccgagaaatctatcgaggataaccctgaaattgaggacgatatcttccggaagaaaagactcacaattatggacctgcatcccggagccggcaagacgaaacgctatcttcctgccatcgtccgggaagctattaagagagggctgcgcaccctgatcctcgccccgacacgggtggttgctgccgagatggaagaggcgctgagaggacttcccattcgctaccagacccctgccatcaaggctgagcacaccggccgggaaatcgtggacctgatgtgtcatgccacattcacgatgagactcctgtcccccgtccgggtgcctaactataatctcattatcatggatgaggctcactttaccgaccccgccagcattgccgctcgcgggtacatctccacaagagttgaaatgggcgaggcggccggaattttcatgaccgctacaccgcctggctctcgggatccctttccccaaagcaacgcccctatcatggacgaggaacgcgagatccccgaaagatcctggaatagcgggcacgagtgggtgaccgatttcaaaggaaagacggtctggtttgtgccttctattaaagccggcaacgacatcgctgcctgcctgcggaagaatgggaaaaaggttattcagctttccagaaagacattcgatagcgaatatgtgaaaacccgcgcgaacgactgggattttgtcgtgaccacagacatctctgagatgggagctaatttcaaggccgagcgggtgattgatccgagacgctgtatgaaacccgtcatcctgacccatggcgaagagcgggttatcctggccgggcctatgcccgtgacacacagctccgctgcccagagacgcggccggattggaagaaaccctaagaatgaaaacgaccaatacatctacatgggcgagcccctcgaaaatgacgaggattgcgcgcattggaaagaggccaagatgctgcttgacaacattaataccccggaagggatcattccttctatgtttgagcccgaacgcgagaaagtggatgctgtcgacggagaatatagactgcggggcgaggcccgcaagacgttcgtggatctcatgagacggggggacctgcctgtttggctggcttacaaggtggccgctgagggaatcaactatgccgatcgcaaatggtgttttgacggcattaagaataaccagatcctcgaagagaacgtcgaagtggagatctggacaaaagagggggaaagaaagaaacttaagccccggtggctggatgcgagaatttacagcgaccctctggccctcaaggagttcaaagaattcgctgccggccgcaagtccctgacccttaatctgatcacagagatgggacggctccccacctttatgacgcagaaagctagaaacgccctggataatctggccgttctccacaccgctgaagcgggcgggcgcgcctataaccacgctctttctgagctgccggagacactggaaaccctcctgcttctgacactcctggccaccgtgacaggaggcattttcctgtttctcatgagcgggaagggaatcggcaaaatgacccttggcatgtgctgcattatcacggcctccgtcctgctgtggtacgctcagatccaacctcattggattgccgcgagcatcattctcgagttctttctgatcgtgcttctgattcccgaacccgagaagcagcggacacctcaggacaatcagctcacctatgtcgtgatcgccatcctgaccgttgtggctgccacaatggctaacgaaatggggttcctggagaagaccaaaaaggatctcggacttggctctattacaacgcaagagtccgaaagcaatatcctggacattgacctgagaccggcctccgcgtggaccctctacgccgtggctacaacctttgtcacacccatgctgcggcactctatcgagaacagctccgttaatgtgtctcttaccgccattgctaaccaggccacggtgctgatggggctcggaaaaggctggcctctgagcaagatggatatcggggtccccctgctcgctattggatgttactcccaggtgaatcctatcacccttacagccgcgctgctgctcctggttgcccattatgctatcattggccccggccttcaggccaaagctacccgcgaagcccaaaagagagccgcggctgggatcatgaagaaccctacagtggacggaattaccgtcatcgatctggagccgattccctacgaccctaaattcgaaaagcagctcggccaggtgatgctgctgatcctctgcgtcacgcaggtgcttatgatgcggacaacctgggccctgtgtgaggctctgacactcgccaccgggcccatcagcaccctgtgggagggaaatcctggccgcttttggaacacaacgattgccgtttctatggctaatatcttcagagggtcctatcttgccggagcgggcctgctctttagcattatgaaaaacaccacaaatacccggcgcggcacagggaacatcggagaaaccctgggcgagaagtggaaatctagactgaacgccctcgggaagtccgaattccaaatttacaaaaagagcggaatccaggaggtggatcggacgcttgctaaggagggcatcaaacgcggggaaacagaccaccatgccgtctctagaggaagcgctaagctgcggtggtttgtggagagaaatatggttacccccgaaggcaaagtggtcgatctgggctgcgggcgcggaggctggtcctattactgtgggggactcaagaacgtgcgggaggtgaaaggcctgaccaaggggggaccgggccacgaagagcctattcccatgtctacatatggctggaatcttgttagactgcagagcggggtcgacgtgttcttcaccccccctgagaagtgcgatacactcctgtgtgacatcggagaatccagccccaaccctacgattgaggccggccgcaccctgcgggtgctcaatcttgtcgaaaactggctgaataacaatacacaattttgcatcaaagttctgaacccgtacatgccctccgtgattgagaagatggaaaccctccagagaaaatacgggggagcgctggtgcgcaatcctctttctcggaacagcacacacgagatgtattgggtctccaatgccaccggcaacatcgtgtctagcgttaatatgatctccagaatgctgattaaccgcttcacgatgaagcataaaaaggctacctacgagcccgatgtggacctcgggtctggaacacggaacatcggcattgaaagcgagatccctaatctggatattatcggcaagagaattgaaaaaatcaagcaggagcacgaaacctcctggcattatgaccaggaccacccctacaaaacatgggcctatcacgggagctacgagaccaagcaaacaggatctgcttccagcatggtcaacggcgtggttcgcctgctcaccaaaccgtgggatgtggtccctatggtgacgcagatggccatgacagacaccaccccctttgggcagcagcgggtgttcaaggagaaggtcgatacaagaacgcaagaacctaaagagggaaccaagaaacttatgcgcatcacagctgaatggctgtggaaggagctgggcaaaaagaaaacccccagaatgtgtacacgggaggaatttacccgcaaggttagatctaatgccgcgctcggggccattttcacagacgagaacaagtggaaatccgctcgggaagccgtggaggatggaagattttgggaactggtggaccgggagcgcaatcttcatctggagggcaagtgcgaaacctgtgtctataacatgatgggcaaaagagagaagaaactcggggaattcggaaaggctaagggcagccgggccatctggtacatgtggctgggggcccgctttctggagttcgaagcgctcggatttctgaatgaggatcactggttctctagaggcaactcccttagcggggtggagggcgaaggactgcatcggctcggctacattctgcgcgacgttgggaaaaaggagggaggcgctatgtatgccgatgacacggccgggtgggataccagaatcacacttgaagacctgaaaaatgaggaaatggtgaccaaccacatgaagggagagcataaaaagctcgctgaggccatttttaagctgacataccagaataaagtcgtgcgggttcagcgccctacccccagaggcacggtgatggacatcatctcccggcgcgatcagagagggagcggccaagtcggaacatatggcctgaacaccttcacaaatatggaagctcagctcattcggcagatggagggggaaggaatcttcaagtctattcaacacctgaccgccacggaggagatcgcggcccagaactggcttgctcgcgtgggcagagaacggctgagcagaatggccatttccggggacgattgcgttgtgaaaccgatcgacgatcgctttgcttctgccctcaccgcgctgaatgacatgggaaaggtccggaaagatatccagcagtgggagcctagcagaggctggaacgactggacacaagtgcccttctgctcccaccattttcacgaacttgtcatgaaggatgggcgcgtgctggttgtgccctgtcggaaccaggacgagctcattggcagagcccgcatctctcagggagctggctggagcctgaaggaaaccgcctgcctggggaaatcctacgctcagatgtggacactcatgtatttccatcggagagatctgcgccttgccgctaatgccatttgttctgcggtccctagccactgggtgccgacctcccggacaacctggagcatccacgccaagcatgagtggatgacgacagaggacatgctggctgtgtggaacagagtttggattcaagaaaatccctggatggaggataaaacccctgtggaatcttgggaggaagtcccctacctcggaaagcgcgaggaccagtggtgcggctccctgatcgggcttaccagccgggccacatgggccaaaaacattcagaccgctatcaatcaggtgagatctctgatcggaaacgaggaatatacagactacatgccttccatgaagcggtttagacgcgaggaagaggaagccggcgttctctggtga

SEQ ID NO: 19650 - RNA, 9876 nt, synthetic construct
  misc_feature 1..9876: note = derived and/or modified CDS sequence (opt5) from DENV-2__FJ024475__SS-prME
  source 1..9876: mol_type = other RNA
accgccggagtgatcgtcatgctgattcccacagctatggccttccacctcacgaccagaaacggggaacctcatatgatcgttggacggcaggaaaagggcaagtccctgctttttaagacagaggacggggtgaatatgtgcaccctgatggcgattgatctcggagaactgtgtgaggacacaatcacctacaaatgcccgcttctgagacaaaacgaacccgaggatattgactgttggtgcaattccacatctacctgggtgacgtatggcacctgtacaaccacaggggagcacagacgggaaaagagaagcgtcgctctcgtgcctcatgttggaatgggcctggagaccagaacggaaacatggatgtcctctgagggcgcctggaaacacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaagaacaggacaaacgctttatctgcaagcattccatggtggatagaggctggggcaacgggtgtggactgttcggcaaagggggaattgtcacatgcgccatgtttacgtgcaaaaagaatatggaaggcaaagttgtgcagcctgagaacctcgaatacaccatcgtgattacaccccacagcggggaggagcatgcggtcggagacgataccggcaagcacggcaaagaaatcaagatcacacctcagtcttccattaccgaggccgaactgacggggtatggaaccgtgacaatggagtgtagcccccggaccggccttgacttcaatgaaatggttctgctccaaatggaggataaggcttggctggtgcaccgccagtggtttcttgacctgccgctcccttggctgcccggggccgacacacagggatctaactggatccagaaggagaccctggtcacgttcaagaatcctcatgctaaaaagcaagatgtggttgtgctcggctcccaggaaggggccatgcacacagccctgaccggcgctacagagattcagatgagctccggaaaccttctgtttaccggccatctcaaatgcagactgcggatggacaaacttcaactgaaagggatgtcttacagcatgtgtaccggaaagttcaagatcgtcaaagaaattgcggagacacagcacggcacgatcgtgatcagagtccagtatgagggggatggatccccctgcaagattcccttcgaaatcaccgacctcgagaaacgccatgtgctgggccggctgattacagttaatcctatcgtgattgaaaaggatagcccggtcaacatcgaggccgaacccccttttggggactcttacattatcatcggcgtggagcccggacagctcaaactgaactggttcaagaagggctccagcattgggcaaatgtttgagaccacaatgagaggagctaaacgcatggccatccttggcgataccgcctgggacttcgggtctctgggaggcgtttttacgagcattgggaaggctctccaccaggtgttcggcgccatctacggagcggctttttccggcgtctcttggacaatgaaaattctgatcggggtggtgatcacctggattggaatgaatagccggtccaccagcctgtctgtttcccttgtcctcgtgggcgtggtcacactgtatctgggggccatggtgcaggccgatagcggatgtgttgtgtcttggaagaacaaagaactcaagtgcggctccgggatcttcattaccgacaatgtccacacatggacggagcagtacaagtttcaacctgaaagcccctccaaactggcttctgccatccagaaggctcatgaggaaggcatttgtggaatcagaagcgtgacccgccttgagaacctgatgtggaaacagatcacaccggagctcaatcacattctgtccgaaaacgaggttaagctgaccatcatgacaggcgataccaaagggattatgcaggccggaaagcggtatcttagacctcaacccacggaactcaaatactcttggaagacctggggcaaggcgaaaatgctgagcacagagtcccataatcagaccttcctgatcgacgggcctgaaacagccgagtgccccaacaccaatcgcgcttggaacagcctcgaggtggaagactatggatttggcgtcttcacaaccaatatttggctgaaacttcgggagaaacaggatgtgttttgtgactctaagctgatgtccgccgctatcaaagataacagagccgttcacgcggacatgggctactggatcgaaagcgccctcaatgatacgtggaagatggagaaggcttctttcattgaggtgaaatcctgccactggcctaagagccatacactgtggtctaacggggtcctggaaagcgagatgatcattcccaaaaatttcgccggaccggtgtcccagcacaactatcgccctggctaccatacccaaaccgctgggccctggcaccttggaaagctcgaaatggactttgatttctgtgagggcacaaccgtggtcgttacggaagactgcgggaaccggggacccagcctgagaacaaccacagcctctggcaaactgatcaccgagtggtgctgtcggtcctgcacactccctccgctgcgctacagaggcgaggatgggtgttggtatggaatggaaattcggccccttaaggagaaggaagagaatctggtgaacagcctcgtgaccgccggccatgggcagatcgacaatttttccctgggagtcctgggcatggctcttttcctcgaagagatgctgagaacgcgcgtggggaccaaacacgcgattctgctcgttgccgtgtcttttgtcacactgatcaccggaaacatgagcttccgggatcttggcagagtgatggttatggtgggcgctacaatgaccgacgatatcgggatgggagtcacgtacctggccctcctggccgcttttaaggtgcgccctacattcgccgcgggcctgcttctgagaaaactcacctccaaggagctgatgatggctacaattgggatcaccctcctgtctcagagcaccattcccgaaacaatccttgagctgacggacgccctcgccctgggaatgatggttctgaaaattgtgcggaatatggaaaagtatcaacttgctgtcaccatcatggccatctcctgcgtgcctaacgcggtgattctgcgcaatgcttggaaggtctcttgtacaatcctcgccgccgttagcgtgagccccctgctcctgaccagctctcagcagaaagctgactggattcctcttgccctgacaatcaagggcctcaaccccaccgctatttttctgacgacactgtccagaaccagcaaaaagcggtcttggccgcttaatgaggccatcatggcggtggggatggtctccatcctggccagctctctcctgaaaaacgatattcctatgaccggacccctcgtggctggcggcctgcttacagtttgctacgtgctgaccgggcgctccgccgacctggaactcgagagagctgccgatgtcaagtgggaggaccaggccgaaatcagcggatccagccctattctgtctatcacaattagcgaggatggctccatgtctatcaaaaatgaagaggaggaaacgacccttacaattctgatccggaccgggctcctggtgatcagcggagttttccccgtgtccattccgatcacagctgcggcctggtatctctgggaggtcaagaagcaacgcgctggcgtgctgtgggacgtcccttctccccctcccgtggggaaagccgaacttgaggatggagcctacagaattaagcagcggggcatcctgggctatagccagattggggctggagtttacaaagaaggcacctttcacacgatgtggcatgtgacccgcggggccgtcctgatgcacagaggaaagcggatcgagccctcctgggcggacgtgaaaaaggatctcatctcttacggcgggggatggaagctggagggcgaatggaaagagggcgaagaggttcaggtgcttgctctggaacctgggaagaacccgagagccgtccaaacaaaacccggaattttcaagaccaatacaggcaccatcggggccgtgagcctcgacttttcccctggaacaagcggctctcccattgtggatcgcaaagggaaggttgtcggactgtatggcaacggcgtggtgacgcggtccggggcttacgtcagcgccatcgcgcagaccgagaagtctattgaggacaatcctgaaatcgaggatgacatcttccgcaagaagcgcctcacaattatggacctgcatcccggagctggcaaaaccaagcggtatcttcctgccatcgtgagagaagccattaaacgcgggctgcggaccctgatcctcgctccgacaagagttgtggccgctgagatggaagaggccctgcgcggacttcccattcggtaccagacgcctgcgatcaaggccgagcacaccggcagagaaattgtcgatctgatgtgtcatgctacattcaccatgcggctcctgtcccccgtgcgcgttcctaactataacctcatcatcatggacgaggcccactttacagatcccgctagcattgccgccagagggtacatctccacccgggtggaaatgggcgaggctgcgggaattttcatgacggccacaccgcctggctctcgcgacccctttccccagagcaatgctcctatcatggatgaggaaagagagattcccgaacggtcctggaacagcgggcacgagtgggtcaccgacttcaagggaaaaaccgtgtggtttgttccttctatcaaggccggcaatgatatcgccgcttgcctgcgcaagaacgggaagaaagtgattcaactttcccgcaagacattcgacagcgaatatgtcaagacccgggccaatgattgggactttgtggtgacaaccgatatctctgagatgggagcgaacttcaaagctgagagagtcattgacccgcgccggtgtatgaagcccgttatcctgacggacggcgaagagagagtgattctggccgggcctatgcccgtgacacatagctccgccgctcagcgccggggcagaatcggacgcaatcctaaaaacgaaaatgatcagtacatctacatgggcgagcccctcgaaaacgacgaggattgcgcccactggaaggaggcgaaaatgctgcttgacaatattaacaccccggaagggatcattccttctatgtttgagcccgaaagagagaaggtcgatgccgtggacggagaatatcggctgcgcggcgaggctagaaaaacattcgttgatctcatgcggcgcggggacctgcctgtgtggctggcctacaaggtcgctgccgagggaatcaattatgctgatagaaagtggtgttttgacggcattaaaaacaatcaaatcctcgaagagaacgtggaagttgagatttggaccaaggagggggaacggaagaaacttaaacccagatggctggatgcccgcatctacagcgaccctctggcgctcaaagagttcaaggagttcgccgctggccggaaatccctgacgcttaacctgatcaccgagatgggaagactccccacatttatgacccagaaggcccgcaatgctctggataacctggccgtgctccatacagccgaagctggcgggcgggcgtataatcacgccctttctgagctgccggagaccctggaaacactcctgcttctgaccctcctggctacggtcacaggaggcattttcctgtttctcatgagcgggaaaggaatcggcaagatgacccttggcatgtgctgcattatcaccgcctccgtgctgctgtggtacgcccagattcagcctcactggatcgctgccagcatcattctcgagttctttctgatcgtccttctgattcccgaacccgagaaacaaagaacacctcaggacaaccagctcacctatgtggttatcgcgattctgacagtggtggccgctacgatggccaatgaaatggggttcctggagaagaccaagaaagacctcggacttggctctatcacaacccaggagtccgaaagcaacatcctggatattgacctgcggccggcttccgcctggacactctacgcggtcgccaccacgtttgttacccccatgctgcgccattctatcgagaatagctccgtgaacgtgtctcttacagctattgccaatcaagctaccgtcctgatggggctcggaaagggctggcctctgagcaaaatggatatcggggtgcccctgctcgccattggatgttactcccaggttaaccctatgacacttaccgctgccctgctgctcctggtggcgcactatgccatcattggccccggccttcaggctaaggccacgagagaagctcagaaacgggccgccgcggggatcatgaagaatcctacagtcgacggaatcaccgtgattgatctggagccgatcccctacgaccctaagttcgaaaaacaactcggccaggtcatgctgctgattctctgcgtgacacaggttcttatgatgcgcaccacctgggctctgtgtgaggccctgacactcgctacggggcccatcagcaccctgtgggagggaaaccctggcagattttggaatacaaccattgccgtgtctatggccaacatcttccgggggtcctatcttgctggagccggcctgctctttagcatcatgaagaatacaaccaacacgcgcagaggcacagggaatattggagaaaccctgggcgagaaatggaagtctcggctgaacgcgctcgggaaatccgagttccagatctacaagaaaagcggcattcaagaggtcgatcgcacccttgccaaggagggcatcaagagaggggaaacagaccatcacgctgtgtctcggggaagcgccaaactgagatggtttgttgagcgcaacatggtgacccccgaaggcaaggtcgtggatctgggctgcgggcggggaggctggtcctattactgtgggggactcaaaaatgtgagagaggttaagggcctgacaaaagggggaccgggccatgaagaacctattcccatgtctacgtatggctggaaccttgtccgcctgcagagcggggtggacgtgttcttcacaccccctgagaagtgcgataccctcctgtgtgacatcggagaatccagccccaatcctaccatcgaggctggccggacactgagagtcctcaaccttgttgaaaattggctgaacaataacacccagttttgcattaaggtgctgaatccgtacatgccctccgtgatcgagaaaatggaaacgctccaacgcaagtacgggggagccctggtccggaaccctctttctagaaatagcacccacgagatgtattgggtgtccaacgcgacaggcaatattgtttctagcgtgaacatgatctcccgcatgctgattaatcggttcaccatgaaacacaagaaagccacatacgagcccgatgtcgacctcgggtctggaaccagaaacatcggcatcgaaagcgagattcctaacctggacatcattggcaagcgcatcgaaaagattaaacaggagcatgaaacatcctggcactatgatcaggaccatccctacaagacctgggcttatcacgggagctacgagacgaaacagacaggatctgcctccagcatggtgaatggcgttgtgcggctgctcaccaagccgtgggatgtcgtgcctatggtgacccaaatggctatgacagacacgaccccctttgggcagcagagagtcttcaaagagaaggttgatacacgcacccaggaacctaaggagggaaccaagaaacttatgagaatcaccgccgaatggctgtggaaagagctgggcaagaaaaagacaccccggatgtgtacccgcgaggaatttacgagaaaagtgcggtctaacgctgccctcggggcgattttcaccgacgagaataagtggaagtccgccagagaagctgtggaggatggacggttttgggaactggtcgaccgcgagagaaaccttcacctggagggcaaatgcgaaacatgtgtgtataatatgatgggcaagcgggagaaaaagctcggggagttcggaaaagccaagggcagccgcgctatctggtacatgtggctgggggccagatttctggagttcgaagccctcggatttctgaacgaggatcattggttctctcggggcaattcccttagcggggttgagggcgaaggactgcaccgcctcggctacatcctgagagacgtggggaagaaagagggaggcgcgatgtatgctgatgacaccgccgggtgggacacacggattacccttgaagatctgaagaacgaggaaatggtcacgaatcatatgaaaggagagcacaagaaactcgccgaggctatctttaagctgacataccaaaacaaggtggttcgcgtgcagagacctacaccccggggcacagtcatggacattatctcccgcagagatcagcgggggagcggccaggtgggaacctatggcctgaatacgttcaccaacatggaagcccaactcattcgccagatggagggggaaggaatcttcaaatctatccagcatctgacagctaccgaggagattgccgcgcaaaattggcttgccagagttggccgggaaagactgagccgcatggctatctccggggacgattgcgtggtcaagccgattgacgatcggtttgcctctgctctcacagccctgaacgacatgggaaaagtgagaaaggatatccagcagtgggagcctagccgcggctggaatgactggacccaggtccccttctgctcccaccactttcatgaacttgtgatgaaagatgggcgggttctggtggtcccctgtagaaaccaagacgagctcattggccgcgcgcggatctctcagggagccggctggagcctgaaggaaacagcttgcctggggaagtcctacgcccagatgtggaccctcatgtatttccacagacgcgatctgcggcttgctgccaacgctatctgttctgccgtgcctagccattgggtgccgacgtccagaacaacctggagcattcacgcgaaacacgagtggatgaccacagaggacatgctggccgtttggaatcgcgtgtggatccaggaaaacccctggatggaggacaagacccctgtcgaatcttgggaggaagtgccctacctcggaaaacgggaggatcaatggtgcggctccctgattgggcttacaagcagagctacgtgggccaagaatatccagaccgccattaaccaggttcggtctctgatcggaaatgaggaatatacagactacatgccttccatgaaaagatttcgccgggaggaagaggaagctggcgtgctctggtga

SEQ ID NO: 19651 - RNA, 9867 nt, synthetic construct
  misc_feature 1..9867: note = derived and/or modified CDS sequence (opt5) from DENV-2__FJ182012__SS-prME
  source 1..9867: mol_type = other RNA
accgccggcgtgatcgtcatgctgattcccacagctatggccttccacctcacgaccagaaacggggagcctcatatgatcgttggacggcaggaaaagggcaaaagcctgctttttaagacagaggacggggtgaatatgtgcaccctgatggcgattgatctcggagaactgtgtgaggacacaatcacctacaaatgcccgcttctgcgccaaaacgaacccgaggatattgactgttggtgcaattccacatctacctgggtgacgtatggcacctgtacaaccacaggggagcacagacgggaaaagcgcagcgtcgctctcgtgcctcatgttggaatgggcctggagaccagaacggaaacatggatgtcctctgagggcgcctggaaacacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaagagcaggacaaacgctttatctgcaagcattccatggtggatagaggctggggcaacgggtgtggactgttcggcaaggggggaattgtcacatgcgccatgtttacgtgcaaaaagaatatggaaggcaaagttgtgcagcctgagaacctcgaatacaccatcgtgattacaccccacagcggggaggagcatgcggtcggaaatgacaacggcaaggaaatcaaaatcacccctcagtcttccattacagaggccgaactgaccggctatgggacggtgaccatggagtgtagcccccggacaggacttgatttcaatgaaatggttctgctccaaatggaggacaaggcttggctggtgcaccgccagtggtttcttgatctgccgctcccttggctgcccggcgccgacacccaggggtctaactggatccagaaagagacactggtcaccttcaagaatcctcacgctaagaaacaagacgtggttgtgctcggatcccaggaaggcgccatgcatacggccctgacaggggctaccgagattcagatgagctccggcaaccttctgtttacaggacacctcaagtgcagactgcggatggataaacttcaactgaagggcatgtcttacagcatgtgtaccgggaaattcaagatcgtcaaggaaattgcggagacccagcatggaacaatcgtgatcagagtccagtatgagggcgacgggtccccctgcaaaattcccttcgaaatcacggatctcgagaagcgccacgtgctgggacggctgattaccgttaaccctatcgtgattgaaaaagacagcccggtcaatatcgaggccgaacccccttttggcgattcttacattatcatcggggtggagcccggccagctcaagctgaactggttcaaaaagggatccagcattggccaaatgtttgagacaaccatgagaggggctaagcgcatggccatccttggagacacagcctgggatttcggctctctggggggagtttttaccagcattggcaaagctctccatcaggtgttcggggccatctacggcgcggctttttccggagtctcttggacgatgaagattctgatcggcgtggtgatcacatggattgggatgaatagccggtccaccagcctgtctgtttcccttgtcctcgtgggagtggtcaccctgtatctgggcgccatggtgcaggccgacagcgggtgtgttgtgtcttggaaaaacaaggaactcaaatgcggatccggcatcttcattacagataatgtccacacctggacagagcagtacaagtttcaacctgaaagcccctccaagctggcttctgccatccagaaagctcacgaggaagggatttgtggcatcagaagcgtgacgcgccttgagaacctgatgtggaagcagatcaccccggagctcaatcatattctgtccgaaaacgaggttaaactgacaatcatgaccggagacacaaagggcattatgcaggccgggaaacggtatcttagacctcaacccaccgaactcaagtactcttggaaaacgtggggaaaggcgaagatgctgagcaccgagtcccacaatcagacattcctgatcgatggccctgaaaccgccgagtgccccaacacaaatcgcgcttggaacagcctcgaggtggaagactatgggtttggagtcttcaccacaaatatttggctgaaacttcgggagaagcaggacgtgttttgtgattctaaactgatgtccgccgctatcaaggacaacagagccgttcatgcggatatgggctactggatcgaaagcgccctcaatgacacctggaaaatggagaaggcttctttcattgaggtgaagtcctgccactggcctaaaagccacacgctgtggtctaacggcgtcctggaaagcgagatgatcattcccaagaacttcgccgggccggtgtcccagcataattatcgccctggataccacacacaaaccgctggcccctggcatcttgggaaactcgaaatggattttgacttctgtgagggaaccacagtggtcgttaccgaagattgcggcaaccgggggcccagcctgagaacgacaaccgcctctggaaagctgatcacagagtggtgctgtcggtcctgcaccctccctccgctgcgctacagaggcgaggacggctgttggtatgggatggaaattcggccccttaaagagaaggaagagaatctggtgaacagcctcgtgacagccggacacggccagatcgataatttttccctgggggtcctgggaatggctcttttcctcgaagagatgctgagaacccgcgtgggcacgaagcatgcgattctgctcgttgccgtgtcttttgtcaccctgatcacagggaacatgagcttccgggaccttggaagagtgatggttatggtgggcgctaccatgacagatgacatcggcatgggggtcacctacctggccctcctggccgcttttaaagtgcgccctacgttcgccgcgggactgcttctgagaaagctcacatccaaagagctgatgatggctaccattggcatcacactcctgtctcagagcaccattcccgaaaccatccttgagctgacagatgccctcgccctggggatgatggttctgaagattgtgcggaatatggaaaaatatcaacttgctgtcacgatcatggccatctcctgcgtgcctaacgcggtgattctgcgcaatgcttggaaggtctcttgtaccatcctcgccgccgttagcgtgtcccccctgctcctgacaagctctcagcagaaggctgactggattcctcttgccctgaccatcaaaggactcaaccccacagctatttttctgaccacgctgtccagaacaagcaagaaacggtcttggccgcttaatgaggccatcatggcggtgggcatggtctccatcctggccagctctctcctgaagaacgacattcctatgaccgggcccctcgtggctggaggcctgcttaccgtttgctacgtgctgacaggccgctccgccgatctggaactcgagagagctgccgacgtcaaatgggaggatcaggccgaaatcagcgggtccagccctattctgtctatcaccattagcgaggacggatccatgtctatcaagaatgaagaggaggaacaaattcttacaatcctgatccggacgggcctcctggtgattagcggggttttccccgtgtccatcccgattaccgctgcggcctggtatctctgggaggtcaaaaagcagcgcgctggagtgctgtgggatgtcccttctccccctcccgtgggcaaggccgaacttgaggacggggcctacagaatcaaacagcggggaattctgggctatagccagatcggcgctggggtttacaaggaaggaacatttcacaccatgtggcacgtgacacgcggcgccgtcctgatgcatagagggaaacggatcgagccctcctgggcggatgtgaagaaagacctcatttcttacggaggcgggtggaagctggagggagaatggaaggagggcgaagaggttcaagtgcttgctctggaacctggcaaaaacccgagagccgtccagaccaagcccgggatcttcaaaacgaataccggaacaattggcgccgtgagcctcgatttttcccctgggaccagcggatctcccatcgtggaccgcaagggcaaagttgtcgggctgtatggaaacggcgtggtgacacggtccggcgcttacgtcagcgccattgcgcagaccgagaagtctatcgaggataaccctgaaatcgaggacgatattttcagaaagaaacgcctcacaatcatggacctgcaccccggggctggaaagacgaaacggtatcttcctgccattgtgagagaagccatcaagcgcggcctgcggaccctgattctcgctccgacaagagttgtggccgctgagatggaagaggccctgcgcgggcttcccatccggtaccagacccctgcgattaaagccgagcataccggaagagaaatcgtcgacctgatgtgtcacgctacattcacgatgcggctcctgtcccccgtgcgcgttcctaattataacctcatcattatggatgaggcccattttaccgaccccgctagcatcgccgccagaggctacatttccacacgggtggaaatgggggaggctgcgggcatcttcatgaccgccacaccgcctggatctcgcgatccctttccccaaagcaatgctcctattatggacgaggaaagagagatccccgaacggtcctggaacagcggccacgagtgggtcaccgatttcaaggggaagacggtgtggtttgttccttctatcaaagccggaaatgacattgccgcttgcctgagaaagaacggcaaaaaggtgatccagctttcccgcaaaacattcgatagcgaatatgtcaagacccgggccaatgactgggattttgtggtgaccacagacatttctgagatgggggcgaacttcaaggctgagagagtcatcgatccgcgccggtgtatgaaacccgttattctgacccacggagaagagagagtgatcctggccggccctatgcccgtgacacatagctccgccgctcagcgccgggggagaatcggccgcaatcctaagaacgaaaatgaccaatacatttacatgggagagcccctcgaaaacgacgaggattgcgcccactggaaagaggcgaagatgctgcttgacaatatcaacaccccggaaggcattatcccttctatgtttgagcccgaaagagagaaagtcgatgccgtggacggggaatatcggctgcgcggagaggctagaaagacgttcgttgatctcatgcggcgcggcgacctgcctgtgtggctggcctacaaagtcgctgccgaggggattaattatgctgatagaaagtggtgttttgacggaatcaagaacaaccagattctcgaagagaatgtggaagttgagatctggacaaaagagggcgaacggaagaaacttaagcccagatggctggatgcccgcatctacagcgaccctctggcgctcaaagagttcaaggaattcgccgctgggcggaagtccctgacccttaacctgattacagagatgggcagactccccacctttatgacgcagaaagcccgcaatgctctggataacctggccgtgctccataccgccgaagctggaggccgggcgtataatcacgccctttctgagctgccggagacactggaaaccctcctgcttctgacactcctggctaccgtcacagggggaatcttcctgtttctcatgagcggcaaggggattggaaaaatgacccttggcatgtgctgcatcattacggcctccgtgctgctgtggtacgcccagatccaacctcactggatcgctgccagcattatcctcgagttctttctgattgtccttctgatccccgaacccgagaagcagagaacacctcaggacaaccagctcacctatgtggttattgcgatcctgaccgtggtggccgctacaatggccaatgaaatgggcttcctggagaaaaccaagaaggatctcgggcttggatctatcacaacgcaagagtccgaaagcaacattctggacatcgacctgcggccggcttccgcctggaccctctacgcggtcgccacaacctttgttacacccatgctgcgccattctattgagaatagctccgtgaacgtgtctcttaccgctatcgccaatcaggctacggtcctgatgggcctcgggaaaggatggcctctgagcaagatggatattggcgtgcccctgctcgccatcgggtgttactcccaggttaaccctattacccttacagctgccctgctgagcctcgtggcgcactatgccatcatcggacccggcctgcaggctaaagccaccagagaagctcaaaagcgggccgccgcgggcattatgaaaaatcctacagtcgacgggatcaccgtgattgatcttgagccgatcccctacgaccctaagttcgaaaagcagctgggacaggtcatgctcctgattctgtgcgtgacgcaggttctcatgatgcgcacaacctgggctctttgtgaggccctgacactggctaccggccccatctctaccctctgggaggggaaccctggaagattttggaatacaacgatcgccgtgtccatggccaacattttccggggcagctatctggctggggccggacttctgttttctatcatgaaaaataccacaaacacccgcagaggcacaggcaacattggggaaaccctcggagagaagtggaaatcccggctgaatgcgctgggcaagagcgaattccaaatctacaaaaagtctgggattcaggaggtcgatcgcacgctcgccaaagagggaatcaagagaggcgaaacagaccatcacgctgtgagccgggggtccgccaagcttagatggtttgttgagcgcaacatggtgacccccgaaggaaaagtcgtggatctgggctgcggccgggggggatggtcttattactgtggcgggctgaagaatgtgagagaggttaaaggactcaccaagggcgggccgggacatgaagagcctatccccatgagcacatatggctggaacctggtccgccttcagtccggcgtggacgtgttcttcaccccccctgagaaatgcgatacactgctctgtgacattggggaaagctcccccaatcctacgatcgaggctggacggaccctgagagtcctgaacctcgttgaaaattggcttaacaataacacacaattttgcattaaggtgctgaatccgtacatgccctctgtgatcgagaagatggaaaccctgcagcgcaaatacggcggggccctcgtccggaaccctctgagcagaaattccacacacgagatgtattgggtgtctaacgcgaccggaaatattgttagctccgtgaacatgatctctcgcatgcttatcaaccggttcacgatgaagcacaaaaaggccacctacgagcccgatgtcgacctgggcagcgggacaagaaatattggaatcgaatccgagattcctaacctcgatatcattggcaaacgcatcgaaaagattaagcaggagcatgaaaccagctggcactatgaccaggaccatccctacaaaacatgggcttatcacggctcttacgagaccaagcaaacagggtccgccagctctatggtgaatggagttgtgcggctgctgaccaaaccgtgggatgtcgtgcctatggtgacgcagatggctatgacagacaccaccccctttggccagcagagagtcttcaaggagaaagttgatacacgcacgcaagaacctaaggaggggaccaagaaactcatgagaatcacagccgaatggctttggaaggagctgggaaaaaagaaaaccccccggatgtgtacacgcgaggaatttaccagaaaggtgcggtccaacgctgccctgggcgcgatcttcacagacgagaataaatggaagagcgccagagaagctgtggaggatgggcggttttgggaactcgtcgaccgcgagagaaacctgcaccttgagggaaagtgcgaaacctgtgtgtataatatgatgggcaaacgggagaagaaactgggcgaattcgggaaggccaaaggatctcgcgctatttggtacatgtggctcggcgccagatttctggagttcgaagccctggggtttctcaacgaggatcattggttctcccggggaaatagcctgtccggcgttgagggggaaggccttcaccgcctgggatacatcctcagagacgtgggcaagaaggaggggggagcgatgtatgctgatgacacggccggctgggatacccggattacactggaagaccttaaaaacgaggaaatggtcaccaatcatatgaagggggagcacaaaaagctggccgaggctatctttaaactcacataccagaacaaggtggttcgcgtgcagagacctaccccccggggaacggtcatggacattatcagccgcagagatcagcggggctctgggcaagtgggcacatatggactgaataccttcacaaacatggaagcccagctgatccgccagatggagggcgaagggattttcaagagcatccaacatctcaccgctacggaggagattgccgcgcagaattggctggccagagttggacgggaaagactttcccgcatggctatctctggcgacgattgcgtggtcaaaccgattgacgatcggtttgccagcgctctgaccgccctcaacgacatggggaaggtgagaaaagatatccagcagtgggagccttcccgcggatggaacgactggacacaagtccccttctgctctcaccactttcatgaactggtgatgaaggatggccgggttcttgtggtcccctgtagaaatcaggacgagctgatcgggcgcgcgcggattagccagggcgccggatggtccctcaaagaaaccgcttgcctgggcaagtcttacgcccagatgtggacactgatgtatttccacagacgcgatctccggctggctgccaacgctatctgtagcgccgtgccttcccattgggtgccgaccagcagaacaacctggtctattcacgcgaagcacgagtggatgacgacagaggacatgcttgccgtttggaatcgcgtgtggatccaagaaaacccctggatggaggataaaacccctgtcgaatcctgggaggaagtgccctacctggggaagcgggaggaccagtggtgcggaagcctcattggcctgacctctagagctacatgggccaaaaatatccagaccgccattaaccaggttcggtcccttatcgggaatgaggaatatacagactacatgcctagcatgaagagatttcgccgggaggaagaggaagctggagtgctgtggtga

SEQ ID NO: 19652 - RNA, 9876 nt, synthetic construct
  misc_feature 1..9876: note = derived and/or modified CDS sequence (opt5) from DENV-2__EU854293__SS-prME
  source 1..9876: mol_type = other RNA
accgccggaatgatcattatgctgatccccaccgtgatggctttccacctcacgaccagaaacggggaacctcatatgattgtgagccggcaggaaaagggaaaatccctgctttttaagaccggcgacggggttaatatgtgcaccctgatggccatggatctcggagagctgtgtgaagacaccatcacctacaaatgcccgcttctgagacaaaacgagcccgaagatattgactgttggtgcaattctacgagcacctgggtgacgtatggcacctgtacgaccacaggggagcaccggcgggagaagcgctccgtggcgctcgtccctcatgtgggaatgggcctggaaaccagaacggagacatggatgtctagcgaaggcgcttggaaacacgcccagcggatcgagacctggatcctgcgccatcccgggttcacaattatggccgctatcctcgcctacaccattggaaccacacactttcagagagctctgatcttcattcttctgacggccgttgcgccttccatgaccatgcggtgcatcggcatttctaaccgcgattttgtggagggggtcagcggaggctcctgggtggacatcgttctcgaacacgggagctgtgtgacaaccatggccaagaataagcccacactggatttcgagcttatcaaaaccgaagctaagcagtctgccacgctgagaaaatattgcattgaggctaagctcacaaacaccaccacagaatcccggtgtcctacccaaggagagccgagcctgaatgaggaacaggacaaacgctttgtctgcaagcattctatggtggatagaggctggggcaacgggtgtggactgttcggcaaaggagggatcgtgacatgcgccatgtttacgtgcaaaaagaatatgaaaggcaaggtcgttcagcccgagaacctcgaatacaccattgtgatcacacctcactccggggaggaacatgcggtgggaaatgacaccggcaaacacggcaaggagattaaaatcacaccccagagctctatcaccgaggccgaactgacggggtatggaaccgtcacaatggagtgttcccctcggaccggccttgatttcaacgaaatggtgctgctccaaatggagaataaggcttggctggttcaccgccagtggtttcttgacctgcccctcccgtggctgcctggggccgatacacagggaagcaactggattcagaaggaaaccctggtgacgttcaaaaatccccatgctaagaaacaagacgtcgtggttctcggctcccaggagggggccatgcacacagccctgaccggcgctacagagatccagatgtctagcggaaaccttctgtttaccggccatctcaagtgcagactgcggatggacaaacttcaactgaaggggatgtcctacagcatgtgtaccggaaagttcaaagtggtcaaggaaattgcggagacacagcacggcacgatcgtgattagagtccagtatgaaggggatggatctccttgcaaaatccccttcgagatcatggacctcgagaagcgccatgtgctgggccggctgattaccgttaaccccatcgtgacagaaaaagattcccctgtcaatattgaggccgaaccgccctttggggacagctacatcattatcggcgtggagcctggacagctcaagctgaactggttcaagaaaggctctagcattgggcaaatgtttgaaaccacaatgagaggagctaagcgcatggccatccttggcgataccgcctgggacttcgggtccctgggaggcgtttttacgtctatcgggaaagctctccaccaggtgttcggcgccatttacggagcggcttttagcggcgtctcctggacaatgaagatcctgattggggtgatcattacctggatcggaatgaatagccggtctacctccctgagcgtgtctcttgttctcgtcggcgtggtgacactgtatctgggggtcatggtgcaggccgattccggatgtgttgtgagctggaaaaacaaggagctcaagtgcggctccgggatcttcattaccgacaatgtccacacatggacggagcagtacaaatttcaacccgaatctcctagcaagctggcctccgctatccagaaagcccatgaggaaggcatttgtggaatcagatctgtgacccgccttgagaacctgatgtggaagcagattacacccgaactcaatcacatcctgagcgagaacgaggttaaactgaccatcatgacaggcgatattaaggggatcatgcaggctggaaaacggtcccttagaccgcaacctaccgaactcaagtatagctggaagacgtggggcaaagccaagatgctgtctaccgagtcccataatcagacattcctgattgacgggcccgaaaccgcggagtgccctaacacaaatcgcgcctggaacagcctcgaagtggaggattacggatttggcgtcttcaccacaaatatctggctgaaacttcgggagaagcaggacgtgttttgtgactctaaactgatgtccgctgccattaaggataacagagctgttcacgccgacatgggctattggatcgaaagcgcgctcaatgatacctggaagatcgagaaagcctctttcattgaagtcaagagctgccactggcccaaatcccatacgctgtggagcaacgaggtcctggagtctgaaatgatcattcctaagaacttcgctgggcccgtgtcccagcacaattaccgcccgggatatcatacacaaaccgccggcccttggcaccttgggaaactcgagatggactttgatttctgtgaaggaaccacagtggtcgttaccgaggactgcggcaaccgggggcccagcctgagaacgacaaccgcttccggaaagctgatcacagaatggtgctgtcggtcttgcaccctgccccctctgcgctacagaggcgaggatggctgttggtacgggatggagattcggccgcttaaggaaaaagaggaaaatctggtgaacagcctcgtgacagccggacatggccagatcgacaatttttccctgggggtcctgggaatggcccttttcctcgaggaaatgctgagaacccgcgtgggcacgaagcacgctattctgctcgttgcggtgtcttttgtcaccctgatcacagggaacatgagcttccgggatcttggaagagtgatggttatggtgggcgccaccatgacagacgatatcggcatgggggtcacctatctggctctcctggccgcctttaaagtgcgccccacgttcgctgccggactgcttctgagaaagctcacatccaaagagctgatgatgaccacaattggcatcgttctcctgtctcagagcaccattcctgagaccatccttgaactgacagacgcgctcgctctggggatgatggtgctgaagatggtccggaagatggagaaataccaacttgccgtgacgattatggccatcctgtgcgtgcccaatgctgtcatcctccagaacgcctggaaggtttcctgtaccattctggcggtggtgagcgtctctcctctctttctgacatccagccagcagaaagctgattggatcccccttgccctgaccattaagggactcaatcctacagccatcttcctgaccacgctgtctcgcacaaacaaaaagagatcctggccccttaatgaagctattatggccgtgggcatggttagcatcctggcttcttccctcctgaaaaacgacatcccgatgaccgggcctctcgtggccggaggcctgcttaccgtctgctatgtgctgacaggccggagcgcggacctggagctcgaacgcgccgctgatgttaagtgggaggaccaagccgagatttccgggagctctcccatcctgagcattaccatctccgaagatggatctatgagcattaagaatgaggaagaggagcagatccttacaattctgatcagaacgggcctcctggtgatctccgggctctttcctgtctctatgcccattaccgctgccgcctggtacctgtgggaagtgaaaaagcagcgggctggagtcctttgggacgtgccgagccctccccctgttggcaaagcggagctggaagatggggcctatcgcatcaagcagaaagggattctcggctactcccaaatcggcgctggggtgtataaggagggaacattccacaccatgtggcatgtcacaagaggcgccgtgctcatgcacaaggggaaacggattgaaccctcttgggccgacgttaagaaagatctgatcagctacggaggcgggtggaaacttgagggagagtggaaagaaggcgaggaagtgcaggtcctggctctcgagcccggcaagaaccctcgcgccgtgcagaccaagccggggctgtttaaaacgaatgcgggaaccatcggcgctgtgtccctcgacttcagccccgggacatctggatcccctattatcgataagaaaggcaaggttgtcgggctgtacggaaacggcgtggtgaccagaagcggcgcctatgtctctgccattgctcagacagaaaaatccatcgaggacaaccccgagattgaagatgacatcttccggaagagaaaacttaccatcatggatctgcatcctggggccggaaaaacaaagcgctacctgcccgcgattgtgcgggaggctatcaaaagaggcctccgcacgctgattcttgcccctacccgggttgtggccgctgaaatggaggaagccctgagagggctcccgatccgctatcaaacacccgctattcgggccgagcacaccggaagagagatcgtcgacctgatgtgtcatgcgacctttacaatgcgcctcctgagccctgtgcgggttcccaattacaaccttattatcatggacgaagcccacttcacggatcctgcttccatcgccgctagaggctatatttctacccgggtggagatgggggaagccgccggcatctttatgacagctacacccccgggaagccgcgaccctttcccccagtccaatgcgcccattatggatgaggagagagaaatccctgagcggagctggtcttccggccacgaatgggtcacagactttaaggggaaaaccgtgtggttcgttcccagcattaaggccggaaacgatatcgctgcctgcctgcgcaagaatggcaaaaaggtgatccagctgtctagaaaaacgtttgacagcgagtacgtcaagacacggaccaacgattgggacttcgtggtgaccacagatatttccgaaatgggggccaattttaaagctgagagagtcatcgaccctcgccggtgtatgaagccggttattctcaccgatggagaggaaagagtgatcctggccggccccatgcctgtgacacattctagcgcggctcaacgccgggggagaattggccgcaaccccaaaaatgagaacgaccagtatatctacatgggagaacctcttgagaatgacgaagattgcgcccactggaaggaggccaagatgctgctcgacaacatcaatacccccgagggcattatcccgtccatgttcgaacctgagcgggaaaaagtcgatgctattgacggggagtacagactgcgcggagaagccagaaagacgtttgtggatctgatgcggcgcggcgacctccccgtttggcttgcgtatagagtggccgctgaggggatcaactacgccgatcggcgctggtgtttcgacggaattaaaaataaccagatcctggaggaaaacgtcgaggtggaaatttggacaaaggagggcgagcgcaagaagctgaagcctcggtggctcgatgctagaatctattctgaccccctggcccttaaagagttcaaggagtttgctgccgggcgcaaaagcctgaccctcaatctgatcacagaaatgggccggctgcctaccttcatgacgcagaaggcgagagatgccctcgacaaccttgctgttctgcataccgccgaggctggaggccgcgcctacaatcacgccctgtccgaactccccgagacactggagacccttctgctcctgacactgctcgctaccgtgacagggggaatttttcttttcctgatgagcggccgggggatcggaaaaatgaccctgggcatgtgctgcattatcacggcgtctattctcctgtggtatgcccaaatccagccgcactggatcgctgcctccattatccttgaatttttcctgattgtcctcctgatccctgagcccgaaaagcagagaacaccccaggataaccaactgacctacgtggtcattgccatcctcaccgtggttgctgccacaatggcgaatgagatgggctttcttgaaaagaccaaaaaggacctggggctgggaagcatcacaacgcagcagcctgagtccaacattctcgacatcgatctgcggccggcctctgcttggaccctttatgccgtggctacaaccttcgtgacacccatgctgcgccatagcattgaaaattcctctgtcaacgttagcctcaccgccatcgcgaatcaggccacggtgctgatgggcctggggaaaggatggcctctctccaagatggacattggcgtgccccttctggctatcgggtgttacagccaagtcaaccctattaccctgacagccgctctctttctgcttgtggcccactacgctatcatcggacccggcctgcaggccaaagcgaccagagaagcccagaagcgggctgccgctggcattatgaagaatcctacagttgatgggatcaccgtgattgacctcgatccgatcccctatgaccctaaattcgagaagcagctgggacaagtcatgctgctcgtgctttgcgtcacacaggtgctgatgatgcgcacaacctgggccctgtgtgaagccctcacactggcgaccggccccatttctaccctttgggaggggaaccctggaagattttggaatacaacgatcgctgtttccatggccaacatcttccggggcagctacctggctggggccggactcctgttttctattatgaaaaataccacaaacacccgcagaggcacaggcaatatcggggaaaccctgggagagaagtggaaatcccggctcaacgcccttggcaagagcgagttccagatttataaaaagtctgggatccaagaagtggatcgcacgctggctaaggagggaattaaaagaggcgaaacagaccatcacgccgtcagccgggggtccgcgaagctgagatggttcgtggagcgcaacatggttacccccgagggaaaagtggtcgatctcggctgcggcagagggggatggtcttactattgtggcgggctgaagaatgtgagagaagtgaaaggacttaccaagggcgggccgggacatgaggaacctatccccatgagcacatacggctggaacctggttcgcctccagtccggcgtcgacgtgtttttcacaccccctgagaagtgcgatacactgctgtgtgacatcggggaaagctcccccaatcctacggtggaggccggacggaccctcagagtccttaacctggttgagaattggctgaacaataacacacagttttgcattaaagtgctcaatccgtatatgccctctgtgatcgaaaagatggaggctctgcagcgcaaatacggcggggcccttgtccggaaccctctgagcagaaattccacccacgaaatgtactgggtgtctaacgctagcggaaatattgtttcctctgtgaacatgatcagccgcatgctcattaatcggttcacaatgagacacaagaaagccacctatgagcccgatgtcgacctgggctccgggacgcgcaacatcggaatcgaaagcgagattcctaacctggacatcattggcaagcggatcgagaagattaaacaagaacatgagacctcttggcactacgatcaggaccatccctataagacatgggcgtaccacggctcctatgaaaccaaacagacagggagcgcctcttccatggtgaatggagttgtgagactccttaccaagccgtgggatgtcgtgcctatggtgacacagatggctatgaccgacacgacaccctttggccaacagcgcgtcttcaaagagaaggttgataccagaacccaggaacctaaggaggggaccaagaagctgatgaaaatcacggccgagtggctgtggaaggaactcggcaagaagaaaacaccccggatgtgtacacgcgaggaatttaccagaaaggtgcggagcaacgctgccctgggcgctattttcacagacgagaataagtggaaatctgccagagaggcggtggaagattcccggttttgggagcttgtcgacaaggaacgcaacctgcacctcgaggggaaatgcgaaacctgtgtgtacaatatgatgggaaagagagagaaaaagctgggcgagttcggcaaggccaaagggagccgggctatctggtatatgtggctgggagcccgctttctcgagttcgaggctctgggctttcttaacgaagatcattggttctccagagagaatagcctgtctggggttgaaggagagggcctccacaagctggggtacatccttcgggacgtgagcaaaaaggagggcggagccatgtacgccgatgacacagcgggctgggacacccgcattacgctggaagatctcaaaaacgaggaaatggtcaccaatcatatggagggggaacacaagaagctggctgaggccatcttcaaactgacatatcagaacaaggtggttagagtgcaacggcctacaccccgcggaaccgtcatggacattatctccagacgggatcagcgcggctctggacaggtgggaacctacggcctcaatacgtttacaaacatggaggcccaactgattagacagatggaaggggagggcgttttcaaaagcatccagcatcttaccgtgacagaagagatcgctgtccagaattggctggcccgggtgggacgcgagagactctcccggatggctatttctggcgacgattgcgtcgtgaagccgctggacgatagatttgccagcgcgcttaccgccctgaacgacatggggaaagttcgcaaggatatccaacagtgggaaccttcccggggatggaatgactggacacaggtgcccttctgctctcaccactttcatgagctcattatgaaggatggcagagtcctggtggtgccctgtcgcaaccaggacgaactgatcgggcgggctagaattagccaaggagccggctggtccctccgcgagaccgcttgcctggggaaaagctatgcccagatgtggtctcttatgtacttccaccggagagatctgcgcctcgcggccaacgctatctgttccgccgttcctagccattgggtgccgacatctcggaccacatggtccatccacgctaagcacgaatggatgaccacagaggacatgctgaccgtctggaatagagtgtggattcaggagaacccctggatggaagacaaaacgcctgttgagagctgggaagagatcccctatcttggcaagcgcgaagatcagtggtgcggatccctgattggcctcacatctcgggccacctgggctaaaaatatccaaaccgccattaaccaggtgagaagcctgatcgggaatgaggagtacacagactatatgccttccatgaagcggtttagacgcgaagaggaagaggcgggagtcctgtggtga

SEQ ID NO: 19653 - RNA, 9876 nt, synthetic construct
  misc_feature 1..9876: note = derived and/or modified CDS sequence (opt5) from DENV-2__EU854294__SS-prME
  source 1..9876: mol_type = other RNA
accgccggcgtgatcgtcatgctgattcccacagctatggccttccacctcacgaccagaaacggggaacctcatatgatcgttggacggcaggaaaagggcaagtccctgctttttaagacagaggacggggtgaatatgtgcaccctgatggcgattgatctcggagaactgtgtgaggacacaatcacctacaagtgcccgcttctgagacaaaacgaacccgaggatattgactgttggtgcaattccacatctacctgggtgacgtatggcacctgtacaaccacaggggagcacagacgggaaaagagaagcgtcgctctcgtgcctcatgttggaatgggcctggagaccagaacggaaacatggatgtcctctgagggcgcctggaaacacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaagaacaggacaaacgctttatctgcaagcattccatggtggatagaggctggggcaacgggtgtggactgttcggcaaagggggaattgtcacatgcgccatgtttacgtgcaaaaagaatatggaaggcaaagttgtgcagcctgagaacctcgaatacaccatcgtgattacaccccacagcggggaggagcatgcggtcggaaatgacaccggcaagcacggcaaagaaatcaagatcacacctcagtcttccattaccgaggccgaactgacggggtatggaaccgtgacaatggagtgtagcccccggaccggccttgatttcaacgaaatggttctgctccaaatggaggacaaggcttggctggtgcaccgccagtggtttcttgatctgccgctcccttggctgcccggggccgacacacagggatctaattggatccagaaggagaccctggtcacgttcaagaaccctcatgctaaaaagcaagacgtggttgtgctcggctcccaggaaggggccatgcacacagccctgaccggcgctacagagattcagatgagctccggaaatcttctgtttaccggccatctcaaatgcagactgcggatggataaacttcaactgaaagggatgtcttacagcatgtgtaccggaaagttcaagatcgtcaaagaaattgcggagacacagcacggcacgatcgtgatcagagtccagtatgagggggacggatccccctgcaagattcccttcgaaatcaccgatctcgagaaacgccatgtgctgggccggctgattacagttaaccctatcgtgattgaaaaggacagcccggtcaacatcgaggccgaacccccttttggggattcttacattatcatcggcgtggagcccggacagctcaaactgaattggttcaagaagggctccagcattgggcaaatgtttgagaccacaatgagaggagctaaacgcatggccatccttggcgacaccgcctgggatttcgggtctctgggaggcgtttttacgagcattgggaaggctctccaccaggtgttcggcgccatctacggagcggctttttccggcgtctcttggacaatgaaaattctgatcggggtggtgatcacctggattggaatgaacagccggtccaccagcctgtctgtttcccttgtcctcgtgggcgtggtcacactgtatctgggggccatggtgcaggccgacagcggatgtgttgtgtcttggaagaataaagaactcaagtgcggctccgggatcttcattaccgataacgtccacacatggacggagcagtacaagtttcaacctgaaagcccctccaaactggcttctgccatccagaaggctcatgaggaaggcatttgtggaatcagaagcgtgacccgccttgagaatctgatgtggaaacagatcacaccggagctcaaccacattctgtccgaaaatgaggttaagctgaccatcatgacaggcgacaccaaagggattatgcaggccggaaagcggtatcttagacctcaacccacggaactcaaatactcttggaagacctggggcaaggcgaaaatgctgagcacagagtcccataaccagaccttcctgatcgatgggcctgaaacagccgagtgccccaataccaaccgcgcttggaatagcctcgaggtggaagactatggatttggcgtcttcacaaccaacatttggctgaaacttcgggagaaacaggacgtgttttgtgattctaagctgatgtccgccgctatcaaagacaatagagccgttcacgcggatatgggctactggatcgaaagcgccctcaacgacacgtggaagatggagaaggcttctttcattgaggtgaaatcctgccactggcctaagagccatacactgtggtctaatggggtcctggaaagcgagatgatcattcccaaaaacttcgccggaccggtgtcccagcacaactatcgccctggctaccatacccaaaccgctgggccctggcaccttggaaagctcgaaatggattttgacttctgtgagggcacaaccgtggtcgttacggaagattgcgggaatcggggacccagcctgagaacaaccacagcctctggcaaactgatcaccgagtggtgctgtcggtcctgcacactccctccgctgcgctacagaggcgaggacgggtgttggtatggaatggaaattcggccccttaaggagaaggaagagaacctggtgaatagcctcgtgaccgccggccatgggcagatcgataacttttccctgggagtcctgggcatggctcttttcctcgaagagatgctgagaacgcgcgtggggaccaaacacgcgattctgctcgttgccgtgtcttttgtcacactgatcaccggaaatatgagcttccgggaccttggcagagtgatggttatggtgggcgctacaatgaccgatgacatcgggatgggagtcacgtacctggccctcctggccgcttttaaggtgcgccctacattcgccgcgggcctgcttctgagaaaactcacctccaaggagctgatgatggctacaattgggatcaccctcctgtctcagagcaccattcccgaaacaatccttgagctgacggatgccctcgccctgggaatgatggttctgaaaattgtgcggaacatggaaaagtatcaacttgctgtcaccatcatggccatctcctgcgtgcctaatgcggtgattctgcgcaacgcttggaaggtctcttgtacaatcctcgccgccgttagcgtgagccccctgctcctgaccagctctcagcagaaagctgactggattcctcttgccctgacaatcaagggcctcaatcccaccgctatttttctgacgacactgtccagaaccagcaaaaagcggtcttggccgcttaacgaggccatcatggcggtggggatggtctccatcctggccagctctctcctgaaaaatgacattcctatgaccggacccctcgtggctggcggcctgcttacagtttgctacgtgctgaccgggcgctccgccgatctggaactcgagagagctgccgacgtcaagtgggaggatcaggccgaaatcagcggatccagccctattctgtctatcacaattagcgaggacggctccatgtctatcaaaaacgaagaggaggaacaaacgcttaccattctgatccggacagggctcctggtgatcagcggagttttccccgtgtccattccgatcaccgctgcggcctggtatctctgggaggtcaagaagcagcgcgctggcgtgctgtgggatgtcccttctccccctcccgtggggaaagccgaacttgaggacggagcctacagaattaagcagcggggcatcctgggctatagccagattggggctggagtttacaaagaaggcacatttcacaccatgtggcatgtgacgcgcggggccgtcctgatgcacagaggaaagcggatcgagccctcctgggcggatgtgaaaaaggacctcatctcttacggcgggggatggaagctggagggcgaatggaaagagggcgaagaggttcaagtgcttgctctggaacctgggaagaatccgagagccgtccagaccaaacccggaattttcaagacaaacaccggcacaatcggggccgtgagcctcgatttttcccctggaaccagcggctctcccattgtggaccgcaaagggaaggttgtcggactgtatggcaatggcgtggtgacacggtccggggcttacgtcagcgccatcgcgcagacggagaagtctattgaggataaccctgaaatcgaggacgatatcttccgcaagaagcgcctcaccattatggacctgcatcccggagctggcaaaacaaagcggtatcttcctgccatcgtgagagaagccattaaacgcgggctgcggaccctgatcctcgctccgaccagagttgtggccgctgagatggaagaggccctgcgcggacttcccattcggtaccagacccctgcgatcaaggccgagcacacgggcagagaaattgtcgacctgatgtgtcatgctaccttcacaatgcggctcctgtcccccgtgcgcgttcctaactataatctcatcatcatggatgaggcccactttaccgaccccgctagcattgccgccagagggtacatctccacacgggtggaaatgggcgaggctgcgggaattttcatgaccgccacgccgcctggctctcgcgatccctttccccaaagcaacgctcctatcatggacgaggaaagagagattcccgaacggtcctggaatagcgggcacgagtgggtcacagatttcaagggaaaaaccgtgtggtttgttccttctatcaaggccggcaacgacatcgccgcttgcctgcgcaagaatgggaagaaagtgattcagctttcccgcaagaccttcgatagcgaatatgtcaagacacgggccaacgactgggattttgtggtgaccacagacatctctgagatgggagcgaatttcaaagctgagagagtcattgatccgcgccggtgtatgaagcccgttatcctgaccgacggcgaagagagagtgattctggccgggcctatgcccgtgacgcatagctccgccgctcagcgccggggcagaatcggacgcaaccctaaaaatgaaaacgaccaatacatctacatgggcgagcccctcgaaaatgatgaggactgcgcccactggaaggaggcgaaaatgctgcttgataacattaatacaccggaagggatcattccttctatgtttgagcccgaaagagagaaggtcgacgccgtggatggagaatatcggctgcgcggcgaggctagaaaaaccttcgttgacctcatgcggcgcggggatctgcctgtgtggctggcctacaaggtcgctgccgagggaatcaactatgctgacagaaagtggtgttttgatggcattaaaaataaccagatcctcgaagagaacgtggaagttgagatttggacaaaggagggggaacggaagaaacttaaacccagatggctggacgcccgcatctacagcgatcctctggcgctcaaagagttcaaggagttcgccgctggccggaaatccctgacccttaatctgatcacggagatgggaagactccccacctttatgacacagaaggcccgcaacgctctggacaatctggccgtgctccataccgccgaagctggcgggcgggcgtataaccacgccctttctgagctgccggagacactggaaaccctcctgcttctgacactcctggctaccgtcacgggaggcattttcctgtttctcatgagcgggaaaggaatcggcaagatgacacttggcatgtgctgcattatcaccgcctccgtgctgctgtggtacgcccagattcaacctcactggatcgctgccagcatcattctcgagttctttctgatcgtccttctgattcccgaacccgagaaacagagaacccctcaggataatcagctcacatatgtggttatcgcgattctgaccgtggtggccgctacaatggccaacgaaatggggttcctggagaagacgaagaaagacctcggacttggctctatcaccacacaagagtccgaaagcaatatcctggacattgatctgcggccggcttccgcctggaccctctacgcggtcgccacaacctttgttacgcccatgctgcgccattctatcgagaacagctccgtgaatgtgtctcttaccgctattgccaaccaggctacagtcctgatggggctcggaaagggctggcctctgagcaaaatggacatcggggtgcccctgctcgccattggatgttactcccaggttaatcctatcacccttacagctgccctgctgctcctggtggcgcactatgccattatcggccccggccttcaggctaaggccaccagagaagctcaaaaacgggccgccgcggggatcatgaagaaccctacggtcgatggaattacagtgatcgacctggagccgattccctacgatcctaagttcgaaaaacagctcggccaggtcatgctgctgatcctctgcgtgacccaggttcttatgatgcgcacaacctgggctctgtgtgaggccctgaccctcgctacagggcccattagcacgctgtgggagggaaatcctggcagattttggaacaccacaatcgccgtgtctatggccaatatcttccgggggtcctatcttgctggagccggcctgctctttagcattatgaagaacaccacaaatacccgcagaggcacggggaacatcggagaaacactgggcgagaaatggaagtctcggctgaacgcgctcgggaaatccgagttccaaatttacaagaaaagcggaatccaggaggtcgaccgcacccttgccaaggagggcattaagagaggggaaaccgatcatcacgctgtgtctcggggaagcgccaaactgagatggtttgttgagcgcaatatggtgacacccgaaggcaaggtcgtggacctgggctgcgggcggggaggctggtcctattactgtgggggactcaaaaacgtgagagaggttaagggcctgaccaaagggggaccgggccatgaagaacctatccccatgtctacatatggctggaatcttgtccgcctgcagagcggggtggatgtgttcttcacgccccctgagaagtgcgacaccctcctgtgtgatatcggagaatccagccccaaccctacaattgaggctggccggaccctgagagtcctcaatcttgttgaaaactggctgaataacaatacacaattttgcatcaaggtgctgaacccgtacatgccctccgtgattgagaaaatggaaaccctccagcgcaagtacgggggagccctggtccggaatcctctttctagaaacagcacgcacgagatgtattgggtgtccaatgcgaccggcaacatcgtttctagcgtgaatatgatttcccgcatgctgatcaaccggttcacaatgaaacacaagaaagccacctacgagcccgacgtcgatctcgggtctggaacaagaaacatcggcattgaaagcgagatccctaatctggacattatcggcaagcgcattgaaaagatcaaacaggagcatgaaacctcctggcactatgaccaggatcatccctacaagacatgggcttatcacgggagctacgagaccaaacaaacgggatctgcctccagcatggtgaacggcgttgtgcggctgctcacaaagccgtgggacgtcgtgcctatggtgacccagatggctatgaccgatacaacgccctttgggcagcagagagtcttcaaagagaaggttgacacccgcacacaagaacctaaggagggaaccaagaaacttatgagaattacagccgaatggctgtggaaagagctgggcaaaaagaaaacaccccggatgtgtacacgcgaggaatttaccagaaaagtgcggtctaatgctgccctcggggcgatcttcacggatgagaacaagtggaagtccgccagagaagctgtggaggacggacggttttgggaactggtcgatcgcgagagaaatcttcacctggagggcaaatgcgaaacctgtgtgtataacatgatgggcaagcgggagaaaaagctcggggagttcggaaaagccaagggcagccgcgctatctggtacatgtggctgggggccagatttctggagttcgaagccctcggatttctgaatgaggaccattggttctctcggggcaactcccttagcggggttgagggcgaaggactgcaccgcctcggctacattctgagagatgtggggaagaaagagggaggcgcgatgtatgctgacgatacagccgggtgggacacccggatcacacttgaagacctgaagaatgaggaaatggtcaccaaccatatgaaaggagagcacaagaaactcgccgaggctatttttaagctgacgtaccagaataaggtggttcgcgtgcagagacctacaccccggggcaccgtcatggatatcatttcccgcagagaccagcgggggagcggccaagtgggaacatatggcctgaacaccttcacgaatatggaagcccagctcatccgccagatggagggggaaggaatcttcaaatctattcaacatctgaccgctacagaggagatcgccgcgcagaactggcttgccagagttggccgggaaagactgagccgcatggctatttccggggatgactgcgtggtcaagccgatcgatgaccggtttgcctctgctctcaccgccctgaatgatatgggaaaagtgagaaaggacattcagcagtgggagcctagccgcggctggaacgattggacacaagtccccttctgctcccaccactttcatgaacttgtgatgaaagacgggcgggttctggtggtcccctgtagaaaccaggatgagctcatcggccgcgcgcggatctctcagggagccggctggagcctgaaggaaaccgcttgcctggggaagtcctacgcccagatgtggacactcatgtatttccacagacgcgacctgcggcttgctgccaatgctatttgttctgccgtgcctagccattgggtgccgacctccagaacgacatggagcatccacgcgaaacacgagtggatgaccaccgaggatatgctggccgtttggaaccgcgtgtggattcaagaaaatccctggatggaggacaagacacctgtcgaatcttgggaggaagtgccctacctcggaaaacgggaggaccagtggtgcggctccctgatcgggcttaccagcagagctacatgggccaagaacattcagacggccatcaatcaggttcggtctctgattggaaacgaggaatataccgattacatgccttccatgaaaagatttcgccgggaggaagaggaagctggcgtgctctggtga

SEQ ID NO: 19654 - RNA, 9876 nt, synthetic construct
  misc_feature 1..9876: note = derived and/or modified CDS sequence (opt5) from DENV-2__FJ024477__SS-prME
  source 1..9876: mol_type = other RNA
acagccggcgtgatcgtcatgctgattcccacagctatggccttccacctcacgacccggaatggggagcctcatatgatcgttggacggcaggaaaagggcaagagcctgctttttaagacagaggacggggtgaatatgtgcaccctgatggcgattgatctcggagaactgtgtgaggacacaatcacctacaagtgcccgcttctgagacaaaatgaacccgaggatattgactgttggtgcaatagcacatctacctgggtgacgtatggcacctgtacaaccacaggggagcaccggcgggaaaagcgcagcgtcgctctcgtgcctcatgttggaatgggcctggagaccagaacggaaacatggatgtcctctgagggcgcctggaaacacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaggaacaggacaaacgctttatctgcaagcattccatggtggatagaggctggggcaacgggtgtggactgttcggcaaagggggaattgtcacatgcgccatgtttacgtgcaaaaagaatatggaaggcaaagttgtgcagcctgagaacctcgaatacaccatcgtgattacaccccacagcggggaggagcatgcggtcggaaatgacaccggcaagcacggcaaagaaatcaagatcacacctcagtcttccattaccgaggccgaactgacggggtatggaaccgtgacaatggagtgtagcccccggaccggccttgatttcaacgaaatggttctgctccaaatggaggacaaggcttggctggtgcaccgccagtggtttcttgatctgccgctcccttggctgcccggggccgacacacagggatctaattggatccagaaggagaccctggtcacgttcaagaaccctcatgctaaaaagcaagacgtggttgtgctcggctcccaggaaggggccatgcacacagccctgaccggcgctacagagattcagatgagctccggaaatcttctgtttaccggccatctcaaatgcagactgcggatggataaacttcaactgaaagggatgtcttacagcatgtgtaccggaaagttcaagatcgtcaaagaaattgcggagacacagcacggcacgatcgtgatcagagtccagtatgagggggacggatccccctgcaagattcccttcgaaatcaccgatctcgagaaacgccatgtgctgggccggctgattacagttaaccctatcgtgaccgaaaaggacagcccggtcaacattgaggccgaacccccttttggggattcttacatcattatcggcgtggagcccggacagctcaaactgaattggttcaagaagggctccagcatcgggcaaatgtttgagacaaccatgagaggagctaaacgcatggccattcttggcgacacggcctgggatttcgggtctctgggaggcgtttttacaagcatcgggaaggctctccaccaggtgttcggcgccatttacggagcggctttttccggcgtctcttggaccatgaaaatcctgattggggtgatcatcacctggattggaatgaacagccggtccacaagcctgtctgtgtcccttgttctcgtcggcgtggtgaccctgtatctgggggccatggtccaggccgacagcggatgtgtggtttcttggaagaataaagaactcaagtgcggctccgggatcttcattacagataacgtgcacacgtggaccgagcagtacaagtttcaacctgaaagcccctccaaactggcttctgccatccagaaggctcatgaggaaggcatttgtggaatcagaagcgccacacgccttgagaatctgatgtggaaacagatcaccccggagctcaaccacattctgtccgaaaatgaggtcaagctgacaatcatgaccggcgacattaaagggatcatgcaggcgggaaagcggtctcttagacctcaacccacggaactcaaatatagctggaagacctggggcaaggccaaaatgctgtccacagagagccataaccagaccttcctgattgatgggcctgaaacagctgagtgccccaataccaaccgcgcctggaactctctcgaggtggaagactacggatttggcgttttcacaaccaacatctggctgaaacttcgggagaaacaggacgtgttttgtgattccaagctgatgagcgctgccatcaaagacaatagagcggtccacgccgatatgggctattggattgaatctgctctcaacgacacgtggaagatggagaaggcctccttcatcgaggtgaaaagctgccactggcctaagtctcatacactgtggagcaatggggttctggaatccgagatgattatccccaaaaacttcgctggaccggtgagccagcacaactaccgccctggctatcatacccaaaccgccgggccctggcaccttggaaagctcgaaatggattttgacttctgtgagggcacaaccgtcgtggtgacggaagattgcgggaatcggggaccctctctgagaacaaccacagcctccggcaaactgattaccgagtggtgctgtcggagctgcacactccctccgctgcgctacagaggcgaggacgggtgttggtacggaatggaaatccggccccttaaggagaaggaagagaacctggtcaattccctcgttaccgctggccatgggcagattgataacttttctctgggagtgctgggcatggcgcttttcctcgaagagatgctgagaacgcgcgtggggaccaaacacgccatcctgctcgctgccgtcagctttgtgacactgatcaccggaaatatgtccttccgggaccttggcagagttatggtgatggtcggcgccacaatgaccgatgacattgggatgggagtgacgtatctggctctcctggccgcgtttaaggttcgccctacattcgctgccggcctgcttctgagaaaactcacctctaaggagctgatgatggccacaatcgggattgctctcctgagccagtccaccatccccgaaaccattcttgagctgacagatgccctcgcgctgggaatgatggtgctgaaaatcgtccggaacatggaaaagtaccaacttgctgtgacgatcatggccatttcttgcgttcctaatgccgtgatcctgcagaacgcttggaaggtcagctgtaccattctcgccgtggtgtccgtcagccccctgctcctgacatcttcccagcagaaagctgactggatccctcttgccctgaccattaagggcctcaatcccacagcgatctttctgaccacgctgagccgcacatctaaaaagagatcctggccgcttaacgaggccatcatggctgttgggatggtgagcattctggcctcttccctcctgaaaaatgacatccctatgaccggacccctcgtggctggcggcctgcttaccgtctgctatgtgctgacagggcggagcgccgatctggaactcgagcgcgccgctgacgttaagtgggaggatcaagcggaaatttccggaagctctcctatcctgagcattaccatctccgaggacggctctatgagcattaaaaacgaagaggaggaacagacacttacgatcctgatcagaaccgggctcctggtgatttccggagtcttccccgtgtctatcccgattacagccgctgcctggtacctctgggaggttaagaagcagcgggccggcgtgctgtgggatgtcccttctccccctcccgtggggaaagctgaacttgaggacggagcctatcgcatcaagcagagaggcattctgggctactcccaaatcggggcgggagtctataaagaaggcacctttcacacaatgtggcatgtgaccagaggggctgttctgatgcaccgcggaaagagaatcgagccctcctgggccgatgtgaaaaaggacctcattagctacggcgggggatggaagctggagggcgaatggaaagagggcgaagaggtccaggtgcttgccctggaacctgggaagaatccgcgggctgttcagacgaaacccggaatcttcaagaccaacacaggcaccattggggccgtgtccctcgattttagccctggaacatctggctcccccatcgtcgacagaaaagggaaggtggtgggactgtacggcaatggcgttgtcacccgcagcggggcgtatgtgtctgctattgcccagacagagaagtccatcgaggataaccctgaaatcgaggacgatattttccggaaaaagagactcacgatcatggacctgcatcccggagccggcaaaaccaagcgctaccttcctgctattgtgcgggaagccatcaaaagagggctgcgcacactgattctcgctccgacccgggtcgtggccgcggagatggaagaggccctgagaggacttcccatccgctatcaaacccctgctattaaggccgagcacacaggccgggaaatcgttgacctgatgtgtcatgctacgttcaccatgagactcctgagccccgtgcgggtccctaactacaatctcatcattatggatgaggcccactttacagaccccgcctccatcgctgcgcgcgggtatatttctaccagagtggaaatgggcgaggccgctggaatcttcatgacagccaccccgcctggcagccgggatccctttccccagtccaacgcccctattatggacgaggaacgcgagatccccgaaagaagctggaactctgggcacgagtgggttacggatttcaagggaaaaacagtgtggtttgtcccttccatcaaggctggcaacgacattgccgcgtgcctgcggaaaaatgggaagaaagtgatccagcttagcagaaagaccttcgattctgaatacgttaagacccgcgctaacgactgggattttgtggtcacaaccgacattagcgagatgggagccaatttcaaagccgagcgggtgatcgatccgagacgctgtatgaagcccgtgattctgacagacggcgaagaacgggtcatcctggctgggcctatgcccgttacccattcctctgccgcgcaaagacgcggccggatcggaagaaaccctaaaaatgaaaacgaccagtatatttacatgggcgagcccctcgaaaatgatgaggactgcgcccactggaaggaggctaaaatgctgcttgataacatcaatacgccggaagggattatccctagcatgtttgagcccgaacgcgagaaggtggacgccattgatggagaatacagactgcggggcgaggctcgcaaaacattcgtggacctcatgagaagaggggatctgcctgtctggctggcctataaggtggctgccgagggaatcaactacgcggaccgcaagtggtgttttgatggcattaaaaataaccagatcctcgaagagaacgttgaagtggagatctggaccaaggagggggaacgcaagaaacttaaaccccggtggctggacgccagaatttattccgatcctctggctctcaaggagttcaaggagttcgccgctggccgcaaatctctgacacttaatctgatcaccgagatgggacggctccccacgtttatgacccagaaggccagaaacgccctggacaatctggctgtcctccatacagcggaagccggcgggcgcgcttacaaccacgcccttagcgagctgccggagaccctggaaacactcctgcttctgaccctcctggccacagtgaccggaggcattttcctgtttctcatgtccgggaaaggaatcggcaagatgacgcttggcatgtgctgcattatcacagctagcgttctgctgtggtatgcccaaatccagcctcactggattgcggcctctatcattctcgagttctttctgatcgtgcttctgattcccgaacccgagaaacagcggacccctcaggataatcaactcacctacgtcgtgatcgctatcctgacagtcgtggccgctaccatggccaacgaaatggggttcctggagaagacaaagaaagacctcggacttggctccattacgacccaggagagcgaatccaatatcctggacattgatctgagaccggcgtctgcctggacactctatgctgttgccaccacatttgtgacccccatgctgcggcatagcatcgagaactcctctgtgaatgtcagccttacggctattgccaaccaggctaccgttctgatggggctcggaaagggctggcctctgtccaaaatggacatcggggtgcccctgctcgccattggatgttacagccaggtgaatcctatcacacttaccgcggccctgctgctcctggtcgctcactacgccatcattggccccggccttcaagctaaggccacacgcgaagcccagaaaagagcggctgccgggatcatgaagaaccctaccgtggatggaattacggttatcgacctggagccgattccctatgatcctaagttcgaaaaacagctcggccaggtgatgctgctgatcctctgcgtcacacaagtgcttatgatgcggaccacatgggctctgtgtgaggccctgaccctcgccaccgggcccatctctacactgtgggagggaaatcctggccgcttttggaacacgaccattgctgtctccatggccaatatcttcagagggagctaccttgcgggagccggcctgctcttttctattatgaagaacacaaccaatacacggcgcggcaccgggaacatcggagaaacgctgggcgagaaatggaagtccagactgaacgctctcgggaaaagcgagttccagatttataagaaatctggaatccaggaggtggaccggacacttgccaaggagggcatcaagcgcggggaaaccgatcatcacgctgttagcagaggatccgccaaactgcggtggtttgtggagagaaatatggtcacccccgaaggcaaggtggttgacctgggctgcgggcgcggaggctggtcttactattgtgggggactcaaaaacgtgcgggaggtcaagggcctgacaaaagggggaccgggccatgaagaacctattcccatgagcacctacggctggaatcttgtgagactgcaatccggggtggatgttttcttcacaccccctgagaagtgcgacacgctcctgtgtgatatcggagaaagctcccccaaccctaccattgaggcgggccgcacactgcgggtcctcaatcttgtggaaaactggctgaataacaatacccagttttgcatcaaggtgctgaacccgtatatgccctctgtcattgagaaaatggaaacactccagagaaagtacgggggagccctggttcgcaatcctcttagccggaactccacccacgagatgtactgggtgtctaatgctacgggcaacatcgtgagctccgtcaatatgatctctagaatgctgattaaccgcttcaccatgaaacacaagaaagccacatatgagcccgacgtggatctcgggagcggaacccggaacatcggcattgaatccgagatccctaatctggacattatcggcaagagaattgaaaagatcaaacaggagcatgaaacaagctggcactacgaccaagatcatccctataagacctgggcttaccacgggtcttatgagacaaaacagaccggatccgccagctctatggttaacggcgtggtccgcctgctcacgaagccgtgggacgtggttcctatggtgacacagatggctatgaccgataccacaccctttgggcagcaacgggtcttcaaagagaaggtggacacgagaacccaggaacctaaggagggaaccaagaaacttatgaaaatcaccgccgaatggctgtggaaggagctgggcaaaaagaaaacaccccgcatgtgtaccagagaggaatttacacggaaggtgcgctccaatgcggccctcggggctattttcaccgatgagaacaagtggaaaagcgccagagaagctgtcgaggacggacggttttgggaactggttgatagagagcggaatcttcacctggagggcaagtgcgaaacgtgtgtgtacaacatgatgggcaaacgcgagaagaaactcggggagttcggaaaggccaagggctctagagccatctggtatatgtggctgggggcgcggtttctggagttcgaagctctcggatttctgaatgaggaccattggttctcccgcggcaacagcctttccggggtggagggcgaaggactgcacagactcggctacattctgcgggatgtcagcaaaaaggaagggggagccatgtacgccgacgataccgctggctgggacacacgcatcacccttgaagacctgaaaaatgaggaaatggtgacaaaccatatgaagggggagcacaaaaagctcgccgaggctatttttaagctgacctatcagaataaagttgtgagagtccagcggcctacgccccgcggaacagtgatggatatcatctctagacgggaccaacgcggcagcgggcaggttggcacctacggactgaacacattcaccaatatggaagcccagctcattagacaaatggagggcgaagggatcttcaagtccattcagcatctgacggcgaccgaggagatcgccgtgcagaactggcttgctcgggtcggacgcgaaagactgtctcggatggccattagcggcgatgactgcgtggttaaaccgatcgatgacagatttgcttccgccctcacagcgctgaatgatatggggaaggtgcgcaaagacatccagcaatgggagccttctcggggatggaacgattggacccaggtccccttctgcagccaccactttcatgaacttgtgatgaaggacggcagagtcctggtggttccctgtcgcaaccaggatgagctcattgggcgggccagaatctcccagggcgctggatggtctctgaaggaaacagcctgcctgggcaaaagctatgctcaaatgtggaccctcatgtacttccaccgccgggacctgagacttgccgctaatgccatttgttccgcggtgcctagccattgggtcccgacatctcgcaccacgtggtccatccacgccaagcacgagtggatgacaaccgaggatatgctggctgtgtggaaccgggtgtggattcaggaaaatccctggatggaggacaaaacccctgttgaaagctgggaggaagtgccctatctcgggaagagagaggaccagtggtgcggatctctgatcggccttacatcccgcgccacctgggccaaaaacattcagacagctatcaatcaagtccggagcctgatcgggaacgaggaatacacggattatatgccttccatgaagagatttcggagagaggaagaggaagccggagtgctctggtga

SEQ ID NO: 19655 - RNA, 9876 nt, synthetic construct
  misc_feature 1..9876: note = derived and/or modified CDS sequence (opt5) from DENV-2__GQ868552__SS-prME
  source 1..9876: mol_type = other RNA
accgcgggcgtgatcattatgctgatccccacagctatggccttccacctcacgaccagaaatggggagcctcatatgattgtcggacggcaggaaaagggcaaaagcctgctttttaagacagaggacggggttaatatgtgcaccctgatggcgatcgatctcggagaactgtgtgaggacacaattacctacaaatgcccgcttctgagacaaaacgaacccgaggatatcgactgttggtgcaatagcacatctacctgggtgacgtatggcacctgtacaaccacaggggagcacagacgggaaaagcgcagcgtggctctcgtccctcatgtgggaatgggcctggagaccagaacggaaacatggatgtcctctgagggcgcctggaaacacgttcagcggatcgagacctggattctgcgccatcccgggttcgccatcatggctgccattctcgcttacacaatcggaaccacccactttcagagagccctgattttcatccttctgacagcggtggcccctagcatgacgatgcggtgcattggcatctccaaccgcgattttgtcgaaggggtgtctggaggcagctgggttgacatcgtgctcgagcacgggtcctgtgtcaccacaatggctaagaataagcccaccctggatttcgaacttattaaaacagaggccaagcagcctgctaccctgagaaaatattgcatcgaagccaagctcacgaacacaaccaccgagagccggtgtccgacacaaggagagccctctctgaatgaagaacaggacaaacgctttatttgcaagcattccatggtggatagaggctggggcaacgggtgtggactgttcggcaaaggcgggatcgtgacctgcgcgatgtttacatgcaaaaagaatatggaagggaaagtcgttctccctgagaacctggaatacacgattgtgatcacaccccacagcggggaggagcatgccgtgggaaatgacacaggcaagcacggcaaagaaatcaagattacccctcagtcttccatcacagaggctgaacttaccgggtatggaacggtcaccatggagtgtagcccccggacaggcctggatttcaacgaaatggtgctcctgcagatggaggagaaagcctggcttgttcaccgccaatggtttctggacctcccgctgccttggctgcccggggctgatacccagggatctaattggattcagaaggaaacactcgtgaccttcaagaaccctcatgccaaaaagcaggacgtcgtggttctgggctcccaagagggggccatgcacacggctcttacaggcgcgaccgaaatccagatgagctccggaaatctgctctttacaggccatctgaaatgcagacttcggatggacaagctgcagctcaaagggatgtcttacagcatgtgtaccggaaagttcaagattgtgaaagagatcgccgagacccaacacggcacaatcgtcattagagtgcagtatgaaggggatggatccccctgcaagatccccttcgagattatggacctggaaaaacgccatgtcctgggccggctcatcacggtgaaccctattgttaccgagaaggatagcccggtgaacatcgaagctgagcccccttttggggactcttacattatcatcggcgtcgagcccggacagctgaaacttaattggttcaagaagggctccagcattgggcagatgtttgaaacaaccatgagaggagccaaacgcatggccatcctgggcgatacagcttgggacttcgggtctctcggaggcgtgtttaccagcattgggaaggccctgcaccaagttttcggcgcgatctacggagctgccttttccggcgtgtcttggacgatgaaaattctgatcggggtcatcattacatggatcggaatgaacagccggtccaccagcctttctgtgtccctcgtgctggttggcgtcgtgaccctgtatctcggggccatggtgcaggctgatagcggatgtgtcgtgtcttggaagaataaagagctgaagtgcggctccgggattttcatcacagacaacgttcacacctggacagaacagtacaagtttcagcctgagagcccctccaaacttgcctctgctattcaaaaggcccatgaagagggcatctgtggaatcagaagcgtgacgcgcctggagaatctcatgtggaaacagattaccccggaactgaaccacatcctgtccgagaatgaagtcaaacttacaattatgaccggcgatatcaaagggattatgcaggcgggaaagcggtctctcagacctcagcccacagagctgaaatatagctggaagacctggggcaaggccaaaatgctgtccacggaaagccataaccaaaccttcctcatcgacgggcctgagacagctgagtgccccaataccaaccgcgcctggaactctctggaagtggaggattacggatttggcgttttcacaaccaacatctggcttaagctgcgggaaaaacaggacgtgttttgtgactccaagctcatgagcgctgccattaaagataatagagcggtccacgccgacatgggctattggatcgagtctgctctgaacgatacatggaagatggagaaggcctccttcattgaagtgaaaagctgccactggcctaagtctcataccctgtggagcaatggggttcttgagtccgaaatgatcattcccaaaaacttcgctggaccggtgagccagcacaactaccgccctggctatcatacgcagacagccgggccctggcacctcggaaagctggagatggactttgatttctgtgaaggcaccaccgtcgtggtgacagaggactgcgggaatcggggaccctctctgagaaccacgacagcctccggcaaactcatcaccgagtggtgctgtcggagctgcacactgcctccgcttcgctacagaggcgaagatgggtgttggtacggaatggagattcggcccctgaaggaaaaggaggaaaacctcgtcaattccctggttaccgctggccatgggcaaatcgacaacttttctctgggagtgcttggcatcgccctcttcctggaggagatgctgagaacacgcgtggggaccaaacacgccattctcctggtcgctatcagctttgtgacgcttattaccggaaatatgtccttccgggatctgggcagagttatggtgatggtcggcgccacaatgaccgacgatatcgggatgggagtgacatatctcgccctgctggctgcctttaaggttcgccctaccttcgcggctggccttctgctcagacggctgacgtctaaagaactcatgatggccacaattgggatcgccctgcttagccagtccaccatccccgagacaattctggaactcaccgacgctctggccctgggaatgatggtgcttaagatcgtccgcaacatggagaaataccagctggcggtgaccattatggctatctcttgcgttcctaatgccgtgattctcctgaacgcctggaaggtcagctgtacaatcctcgctgccgtgtccgtgagccccctgcttctgacgtcttcccaacagaaggctgattggatccctctcgccctgaccattaaaggcctgaatcccacagcgatctttcttaccacactgagcagaacctctaagaaacggtcctggccgctcaacgaagccgtcatggctgttgggatggtgagcattctggcctcttccctcctgaagaatgacatccctatgacgggaccccttgtggctggcggcctgctgacagtctgctatgtgctcaccgggcgcagcgccgacctggagcttgagagagccgctgatgttaaatgggaagaccacgcggagatttccggaagctctcctatcctgagcattaccatctccgaagatggctctatgagcatcaagaacgaggaggaagaacagacactcaccattctgatccggacagggctcctggtgatttccggagtcttccccgtgtctatcccgattacggccgctgcctggtacctttgggaagttaaaaagcagcgcgccggcgtgctgtgggacgtcccttctccccctcccgtggagaaggctgaactggaggatggggcctatagaatcaaacaacggggaatcctcggctactcccagattggcgcgggggtctataaggagggaacctttcatacaatgtggcacgtgacccgcggcgctgttctgatgcatagagggaaacggatcgaaccctcctgggccgacgtgaagaaagatcttattagctacggaggcgggtggaagctggagggagaatggaaggagggcgaagaggtccaggtgctcgccctggagcctggcaaaaatccgagagctgttcagacaaagcccggactcttcaaaaccaacacgggaaccatcggcgccgtgtccctggactttagccctgggacatctggatcccccattgtcgatcgcaagggcaaagtggtggggctttacggaaatggcgttgtcacccggagcggcgcgtatgtgtctgctatcgcccaaacagaaaagtccatcgagaacaaccctgaaattgaggacgatatcttcagaaagaaacgcctgaccattatggacctgcaccccggggccggaaagacaaaacggtacctccctgctatcgtgagagaagccattaagcgcggcctgcggacgcttatcctggctccgaccagagtcgtggccgcggagatggaggaagccctccgcgggctgcccattcggtatcagacccctgctatcagagccgagcataccggacgggaaatcgttgatctcatgtgtcacgctaccttcacaatgcgcctgcttagccccgtgagagtccctaattacaacctgattatcatggacgaggcccactttacggaccccgcctccattgctgcgcggggctatatctctacccgcgtggagatgggggaagccgctggcattttcatgacagccaccccgcctggaagcagagatccctttccccagtccaatgcccctatcatggacgaggaacgggagatccccgaaagaagctggaactctggccatgagtgggttacagatttcaaagggaagaccgtgtggtttgtcccttccattaaggctggaaatgacatcgccgcgtgcctgcgcaaaaacggcaagaaagtgattcagctcagccggaagacgttcgattctgagtacgttaaaacaagagctaatgactgggattttgtggtcaccaccgacatcagcgaaatgggggccaacttccgcgccgagcgggtgattgatccgagacgctgtatgaagcccgtgatcctgacagacggagaagaacgggtcatccttgctggccctatgcccgttacccactcctctgccgcgcaaagacgcgggagaattggccggaatcctaagaacgaaaatgatcagtatatctacatgggagagcccctggagaacgacgaagactgcgcccattggaaagaggctaagatgctcctggataatattaacacaccggaaggcatcattcctagcatgtttgagcccgaacgcgagaaagtggacgccatcgatggggagtacagactgcggggagaagctcgcaagaccttcgtggacctcatgagacggggcgatcttcctgtctggctggcctatagagtggctgccgaggggattaattacgcggaccgccggtggtgttttgatggaatcaaaaacaaccagatcctggaagagaatgttgaggtggaaatttggacgaaggagggcgaacgcaagaagctcaagccccgctggctggacgcccggatctattccgatcctcttgctctgaaagagttcaaggagttcgccgctgggagaaaatctctcacactgaacctgattaccgagatgggccggctccccacatttatgacccaaaaggcccgcgacgcccttgataatctgagcgtcctgcacacggctgaggcgggaggcagagcctacaaccacgctctctccgaactgccggagacccttgaaacactgctcctgctgaccctccttgccacagtgaccgggggaatcttcctgtttctgatgagcggcaaagggattggaaagatgacactcggcatgtgctgcatcatcaccgcctctattctgctttggtatgctcagatccagcctcattggattgccgcgtccatcattctggagttctttctcatcgttctgctgatccccgaacccgagaagcagcggacgcctcaagacaatcagctcacatacgtggtcattgccatccttaccgtggtcgctgccaccatggctaacgagatgggcttcctggagaagacaaagaaagatctggggctcggaagcattaccacacaggagccggaatccaatatcctggacattgaccttcgccccgcctctgcgtggacgctgtatgccgtggctaccacatttgttacccctatgctcagacacagcatcgagaactcctctgtgaatgtgagcctgacagccattgctaaccaggccaccgtcctgatgggcctcgggaagggatggcccctttccaaaatggatatcggcgttcctctgctggctatcgggtgttacagccaagtgaatcccattacgctcaccgccgcgctgcttctgctcgtggcccattacgctatcattggacctggcctgcaggccaaggctacacgggaagcccagaagcgcgccgcggctggcatcatgaaaaacccgaccgtcgacgggattacagtgatcgatctggagcccatcccttatgaccccaagttcgagaaacagctcggacaagttatgcttctgattctgtgcgtgacccaggtcctcatgatgagaacgacatgggccctgtgtgaagctcttaccctggccacaggccctatctctaccctctgggaggggaatcccggacggttttggaacaccacaattgccgtgtccatggctaatatcttccgcggcagctacctggccggggcgggactgctcttttctattatgaagaacacgaccaatacaagacggggcaccggcaacatcggggaaacacttggagagaaatggaagtccagactgaacgccctgggcaagagcgagttccagatctataaaaagtctgggattcaggaagtcgatcgcaccctcgctaaagagggaatcaagcggggcgaaacggaccaccatgccgtgagcagagggtccgctaaactgcgctggtttgttgagcggaatatggtgacaccggaaggaaaggtcgtggatcttggctgcggcagagggggatggtcttactattgtggcgggctgaaaaacgttcgcgaggtgaagggactcaccaagggcgggcctggacacgaggaacccattcccatgagcacctacggctggaatctggtccggctgcaatccggcgtggacgtgttcttcacacctcccgagaaatgcgataccctcctttgtgacatcggggaaagctcccctaacccgacaattgaggccggaagaacgctgcgcgttctgaatctcgtcgaaaactggctgaataacaatacccagttttgcatcaaggtgcttaacccctatatgccttctgtgatcgagaaaatggagacactgcagcggaagtacggcggggcgctcgtcagaaatcccctgagccgcaactccacccacgaaatgtactgggtttctaatgccacaggaaacattgtgagctccgtgaatatgatctctcggatgctgattaacagattcaccatgaaacataagaaggctacgtatgagcctgatgtcgacctcggcagcgggacccgcaacatcggaattgaatccgagatccccaatcttgatattatcggcaaaagaatcgaaaagattaaacaagagcacgagacaagctggcattacgaccaggaccacccgtataagacctgggcctaccacggctcttatgaaacaaaacagaccgggtccgctagctctatggtgaacggagttgtgcggctgctgacaaagccttgggatgtcgtgcccatggttacccagatggccatgacggacacaaccccttttggccaacagcgcgtgttcaaggagaaagtcgataccagaacacaggaacccaaggaggggacgaaaaagctcatgaaaatcaccgctgagtggctgtggaaggaacttggaaagaaaaagacacctcggatgtgtaccagagaggaatttacacggaaagtgcgctccaatgccgcgctgggcgccattttcaccgacgagaacaagtggaaaagcgctagagaagccgtggaggattctcggttttgggagctcgtcgaccgcgaaagaaatctgcatctggaggggaagtgcgaaacatgtgtttacaacatgatgggaaaacgggagaagaagctcggcgagttcggcaaagctaaggggtcccgcgccatctggtatatgtggctgggagccagatttcttgagttcgaggcgctgggctttctcaatgaagatcactggttcagccgggggaactccctgagcggagtggagggcgaagggcttcatcgcctgggctacattctcagagacgtgtctaaaaaggagggaggcgctatgtacgccgatgacaccgccgggtgggatacgcggatcaccctggaagacctgaaaaatgaggagatggtcacaaaccacatgaagggagaacataagaaactcgctgaggccatctttaagctgacctatcagaataaagtggttcgcgtgcaaagacccacaccgcggggcaccgtcatggacattatcagccgcagagatcagcgggggtccggacaggtgggcacgtacgggcttaacacattcaccaatatggaagctcagctgattagacaaatggagggcgagggaatcttcaagtctattcagcacctcacagttaccgaagagatcgccgtgcagaactggctggcgcgcgtcggccgggaaagacttagccgcatggccatctccggggacgattgcgtggttaaacctctggacgatcggtttgcttctgccctcacggctctgaatgacatgggaaaggtgagaaaggatattcaacagtgggagcccagccgcggctggaacgactggacccaggtccccttctgctcccaccattttcacgaactggtgatgaaagatgggcgggtcctcgtggttccttgtagaaaccaggacgagctgatcggacgcgcccggatttctcaaggcgcggggtggagccttaaggagacagcctgcctgggcaaatcctatgctcagatgtggaccctcatgtacttccatagacgcgatctgcggcttgccgctaatgccatctgtagcgctgtgccgtctcactgggtccccacatccagaaccacatggagcattcacgccaagcatgaatggatgaccacggaggacatgctggcggtgtggaaccgggtgtggatccaggaaaatccttggatggaggataaaacacccgttgaatcttgggaggaggtgccttatctcggaaagagagaagaccagtggtgcggctccctgattgggctgaccagccgcgccacctgggctaagaacatccaaacagccatcaatcaggtccggtccctcattggaaacgaggaatacaccgactatatgccctctatgaaaagatttcgcagagaggaagaggaggccggcgtgctgtggtga

SEQ ID NO: 19656 - RNA, 9876 nt, synthetic construct
  misc_feature 1..9876: note = derived and/or modified CDS sequence (opt5) from DENV-2__GQ868553__SS-prME
  source 1..9876: mol_type = other RNA
accgccggcgtgatcgtcatgctgattcccacagctatggccttccacctcacgaccagaaatggggaacctcatatgatcgttggacggcaggaaaagggcaagagcctgctttttaagacagaggacggggtgaatatgtgcaccctgatggcgattgatctcggagaactgtgtgaggacacaatcacctacaagtgcccgcttctgcgccaaaatgaacccgaggatattgactgttggtgcaattccacatctacctgggtgacgtatggcacctgtacaaccacaggggagcacagacgggaaaagcgcagcgtcgctctcgtgcctcatgttggaatgggcctggagaccagaacggaaacatggatgtcctctgagggcgcctggaagcacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaagaacaggacaaacgctttatctgcaagcattccatggtggatagaggctggggcaacgggtgtggactgttcggcaaagggggaattgtcacatgcgccatgtttacgtgcaaaaagaatatggaaggcaaagttgtgcagcctgagaacctcgaatacaccatcgtgattacaccccacagcggggaggagcatgcggtcggaaatgacaccggcaagcacggcaaagaaatcaagatcacacctcagtcttccattaccgaggccgaactgacggggtatggaaccgtgacaatggagtgtagcccccggaccggccttgatttcaacgaaatggttctgctccaaatggaggacaaggcttggctggtgcaccgccagtggtttcttgatctgccgctcccttggctgcccggggccgacacacagggatctaattggatccagaaggagaccctggtcacgttcaagaaccctcatgctaaaaagcaagacgtggttgtgctcggctcccaggaaggggccatgcacacagccctgaccggcgctacagagattcagatgagctccggaaatcttctgtttaccggccatctcaaatgcagactgcggatggataaacttcaactgaaagggatgtcttacagcatgtgtaccggaaagttcaagatcgtcaaagaaattgcggagacacagcacggcacgatcgtgatcagagtccagtatgagggggacggatccccctgcaagattcccttcgaaatcaccgatctcgagaaacgccatgtgctgggccggctgattacagttaaccctatcgtgaccgaaaaggacagcccggtcaacattgaggccgaacccccttttggggattcttacatcattatcggcgtggagcccggacagctcaaactgaattggttcaagaagggctccagcatcgggcaaatgtttgagacaaccatgagaggagctaaacgcatggccattcttggcgacacggcctgggatttcgggtctctgggaggcgtttttacaagcatcgggaaggctctccaccaggtgttcggcgccatttacggagcggctttttccggcgtctcttggaccatgaaaatcctgattggggtgatcatcacctggattggaatgaacagccggtccacaagcctgtctgtgtcccttgttctcgtcggcgtggtgaccctgtatctgggggccatggtccaggccgacagcggatgtgtggtttcttggaagaataaagaactcaagtgcggctccgggatcttcattacagataacgtgcacacgtggaccgagcagtacaagtttcaacctgaaagcccctccaaactggcttctgccatccagaaggctcatgaggaaggcatttgtggaatcagaagcgtcacacgccttgagaatctgatgtggaaacaggtgaccccggagctcaaccacatcctgtccgaaaatgaggttaagctgacaattatgaccggcgacatcaaagggattatgcaggccggaaagcggtctcttagacctcaacccacggaactcaaatatagctggaagacctggggcaaggcgaaaatgctgtccacagagagccataaccagaccttcctgatcgatgggcctgaaacagccgagtgccccaataccaaccgcgcttggaactctctcgaggtggaagactacggatttggcgtcttcacaaccaacatttggctgaaacttcgggagaaacaggacgtgttttgtgattccaagctgatgagcgccgctatcaaagacaatagagccgttcacgcggatatgggctattggatcgaatctgccctcaacgacacgtggaagatggagaaggcttccttcattgaggtgaaaagctgccactggcctaagtctcatacactgtggagcaatggggtcctggaatccgagatgatcattcccaaaaacttcgccggaccggtgagccagcacaactaccgccctggctatcatacccaaaccgtggggccctggcaccttggaaagctcgaaatggattttgacttctgtgagggcacaaccgtcgttgtgacggaagattgcgggaatcggggaccctctctgagaacaaccacagcttccggcaaactgatcaccgagtggtgctgtcggagctgcacactccctccgctgcgctacagaggcgaggacgggtgttggtacggaatggaaattcggccccttaaggagaaggaagagaacctggtgaatagcctcgtcaccgccggccatgggcagatcgataacttttctctgggagtgctgggcatggcccttttcctcgaagagatgctgagaacgcgcgttgggaccaaacacgctattctgctcgtggcggtcagctttgtgacactgatcaccggaaatatgtccttccgggaccttggcagagttatggtgatggtcggcgccacaatgaccgatgacatcgggatgggagtgacgtatctggctctcctggccgcctttaaggttcgccctacattcgctgccggcctgcttctgagaaaactcacctctaaggagctgatgatggcgacaattgggatcgctctcctgagccagtccaccattcccgaaaccatctttgagcttacagatgccctggccctcggaatgatggtgctgaaaattgtccggaacatggaaaagtaccaactggctgtgacgatcatggccatctcttgcgtgcctaatgcggtcattcttcagaacgcttggaaggttagctgtaccatcctggccgccgtgtccgtgagccccctcctgctcacatcttcccagcagaaagctgactggattcctctggcccttaccatcaagggcctgaatcccacagctattttcctcaccacgctgagccgcacatctaaaaagagatcctggccgctgaacgaggccatcatggcggtcgggatggtgagcatccttgcctcttccctgctcaaaaatgacattcctatgaccggacccctggttgctggcggcctcctgaccgtgtgctatgtccttacagggcggagcgccgatctggaactggagcgcgctgccgacgtgaagtgggaggatcaagccgaaatctccggaagctctcctattctcagcatcaccatttccgaggacggctctatgagcatcaaaaacgaagaggaggaacagattctgacaatccttatcagaacggggctgctcgttatttccggagtgtttcccgtctctatcccgattaccgctgcggcctggtacctgtgggaggtgaagaagcagcgggctggcgtcctctgggatgtgccttctccccctcccgttgaaaaagccgagctggaagacggggcctatcgcatcaagcagagagggattcttggctactcccaaatcggcgctggggtgtataaagagggaacattccacaccatgtggcatgtcacacggggcgccgtgctgatgcaccgcgggaagagaatcgagccctcctgggcggatgttaaaaaggacctgattagctacggaggcgggtggaagctcgaaggagagtggaaagaaggcgaggaagtgcaggtcctggctcttgagcctggcaagaatccgcgggccgtgcagaccaaacccgggatctttagaacgaacaccggaacaattggcgccgtgtccctggatttcagccctgggacctctggatcccccatcgttgaccgcaagggcaaagtcgtggggctctacggaaatggcgtggtcacacggagcggcgcttatgtgtctgccattgcgcagaccgagaagtccatcgaagataaccctgagatcgaagacgatattttcagaaagaaacgcctgacaatcatggacctccatcccggggctggaaagacgaaacggtacctgcctgccattgttagagaggccatcaagcgcggccttcggaccctgattctggctccgacaagagtggtcgccgctgaaatggaggaggccctccgcgggctgcccatccggtatcaaacccctgcgattaaagccgaacacaccggaagagagatcgtggaccttatgtgtcatgctacatttacgatgcggctgctcagccccgttcgcgtgcctaactacaatctgatcattatggatgaagcccacttcaccgaccccgcttccatcgccgccagaggctatatttctacacgggtcgagatgggggaggctgcgggcatctttatgaccgccacaccgcctggaagccgcgatcccttcccccagtccaacgctcctattatggacgaagagagagaaatccccgagcggagctggaactctggccacgaatgggtgaccgattttaaggggaagacggtttggttcgtgccttccatcaaagccggaaacgacattgccgcttgcctcagaaagaatggcaaaaaggtcatccagctgagccgcaaaacatttgattctgagtacgtgaagacccgggccaacgactgggatttcgtggtcaccacagacattagcgagatgggggcgaattttaaggctgaaagagttatcgatccgcgccggtgtatgaaacccgtgattcttaccgacggagaggaaagagtgatcctggccggccctatgcccgtcacacattcctctgccgctcaacgccgggggagaatcggccgcaaccctaagaatgagaacgaccagtatatttacatgggagaacccctggagaatgatgaggactgcgcccactggaaagaagcgaagatgctcctggataacatcaataccccggagggcattatccctagcatgttcgaacccgagagagaaaaagtggacgccattgatggggagtaccggcttcgcggagaggctagaaagacgtttgttgacctgatgcggcgcggcgatctccctgtgtggctggcctataaagtcgctgccgaagggatcaactacgctgacagaaagtggtgtttcgatggaattaagaataaccagatcctggaggaaaacgtggaggttgagatctggacaaaagaaggcgagcggaagaaactcaagcccagatggcttgacgcccgcatttattccgatcctctggcgctgaaagagttcaaggagtttgccgctgggcggaagtctctcaccctgaatcttatcacagaaatgggcagactgcccaccttcatgacgcagaaagcccgcaacgctctcgacaatctggccgtgctgcataccgccgaggctggaggccgggcgtacaaccacgccctcagcgagcttccggaaacactggagaccctgctcctgcttacactgctcgctaccgtcacagggggaatttttctgttcctgatgtccggcaaggggatcggaaaaatgaccctcggcatgtgctgcattatcacggccagcatccttctgtggtatgcccaaattcagcctcactggatcgctgcctctattatcctggaatttttcctcattgtgctgcttatccccgagcccgaaaagcagagaacacctcaggataatcaactgacctacgtcgtgatcgcgattctcaccgttgtggccgctacaatggccaacgagatgggctttctggagaaaaccaagaaggacctggggctcggatccatcacaacgcaggaaagcgagtccaatattcttgacatcgatctgcggccggcttctgcctggaccctgtatgcggtggccacaaccttcgtcacacccatgctccgccatagcattgaaaactcctctgttaatgtgagcctgaccgctatcgccaaccaggctacggtgcttatgggcctggggaaaggatggcctctctccaagatggacattggcgtccccctgctggccatcgggtgttacagccaggtgaatcctatcaccctcacagctgcccttctgctgctcgttgcgcactacgccattatcggacccggcctgcaagctaaagccaccagagaggctcagaagcgggccgccgcgggcattatgaaaaaccctacagtggatgggatcaccgtcattgaccttgaaccgatcccctatgatcctaagtttgagaagcagctgggacaggtgatgctcctgatcctgtgcgtcacgcaagtgctcatgatgcgcacaacctgggctctttgtgaggccctgacactggctaccggccccatttctaccctctgggaagggaatcctggaagattctggaacacaacgatcgccgtttccatggccaatatttttcggggcagctacctggctggggccggacttctgttctctatcatgaaaaacaccacaaatacccgcagaggcacaggcaacattggggagaccctcggagaaaagtggaaatcccggctgaacgcgctgggcaagagcgagtttcagatctataaaaagtctgggatccaggaggtggaccgcacgctcgccaaagaaggaattaagagaggcgagacagatcatcacgctgtcagccgggggtccgccaaacttagatggttcgtggaacgcaatatggttacccccgagggaaaagtggtcgacctgggctgcggccggggaggatggtcttactattgtggcgggctgaagaacgtgagagaagtgaaaggactcaccaagggcgggccgggacatgaggagcctatccccatgagcacatacggctggaatctggttcgccttcaatccggcgtcgatgtgttctttacaccccctgaaaaatgcgacaccctgctctgtgatattggggagagctcccccaaccctacgatcgaagctggacggaccctgagagtgctgaatctcgtcgagaactggcttaataacaatacacagttctgcattaaggttctgaacccgtatatgccctctgtgatcgaaaagatggagaccctgcagcgcaaatacggcggggccctcgtgcggaatcctctgagcagaaactccacacacgagatgtactgggtctctaatgcgaccggaaacatcgtgagctccgttaatatgatttctcgcatgcttatcaaccggtttacgatgaagcacaaaaaggccacctatgaacccgacgtggatctgggcagcgggacaagaaacattggaatcgagtccgaaattcctaatctcgacatcattggcaaacgcatcgagaagatcaagcaggaacatgagaccagctggcactacgaccaagatcatccctataaaacatgggcttaccacggctcttatgagaccaagcagacagggtccgccagctctatggtcaacggagtggttcggctgctgaccaaaccgtgggacgtggtccctatggtgacgcagatggctatgacagataccacccccttcggccagcaaagagtgtttaaggaaaaagtcgacacacgcacgcaggagcctaaggaagggaccaagaaactcatgaagattacagccgagtggctttggaaagagctgggaaagaaaaagacccccagaatgtgtacacgggaagagttcacccgcaaagttagatccaatgctgccctgggcgcgatctttacagatgaaaacaagtggaaaagcgcccgggaggctgtggaagacgggagattctgggagctcgtggatcgggagcgcaatctgcaccttgaaggaaaatgcgagacctgtgtctacaacatgatgggcaagagagagaagaagctgggcgagtttgggaaagccaagggatctcgggctatttggtatatgtggctcggcgcccgcttcctggaatttgaggccctggggttcctcaatgaggaccattggttttccagaggaaacagcctgtccggcgtggaaggggagggccttcaccggctgggatacatcctccgcgatgttggcaagaaagaagggggagcgatgtacgctgacgatacggccggctgggacaccagaattacactggaggaccttaagaatgaagagatggtgaccaaccatatgaaaggggagcacaagaaactggccgaagctatcttcaagctcacatatcagaataaggtcgtgcgggttcagcgccctacccccagaggaacggtgatggatatcattagccggcgcgaccaaagaggctctgggcaggtcggcacatacggactgaacaccttcacaaatatggaggcccagctgatccggcaaatggaaggcgaggggatttttaaaagcatccagcatctcaccgctacggaggaaattgccgcgcagaactggctggcccgcgtgggaagagagcggctttccagaatggctatctctggcgatgactgcgttgtgaagccgatcgatgaccgcttcgccagcgctctgaccgccctcaatgatatggggaaagtccggaaggacattcagcaatgggaaccttccagaggatggaacgattggacacaggtgcccttttgctctcaccacttccatgagctggtcatgaaagacggccgcgtgcttgttgtgccctgtcggaaccaggatgaactgatcgggagagcgcgcattagccagggcgccggatggtccctcaaggagaccgcttgcctgggcaagtcttatgcccaaatgtggacactgatgtactttcaccggagagacctccgcctggctgccaatgctatctgtagcgccgtcccttcccattgggtgccgaccagccggacaacctggtctattcacgcgaaacacgagtggatgacgacagaagatatgcttgccgtgtggaacagagtttggatccaggagaatccctggatggaagacaagacccctgtggagtcctgggaagaggtcccctatctggggaaacgcgaggaccagtggtgcggaagcctcattggcctgacctctcgggctacatgggccaagaacatccagaccgccatcaatcaagtgagatcccttattgggaacgaagagtacacagattatatgcctagcatgaaacggttcagacgcgaagaggaagaggctggagttctgtggtga

SEQ ID NO: 19657 - RNA, 9876 nt, synthetic construct
  misc_feature 1..9876: note = derived and/or modified CDS sequence (opt5) from DENV-2__GQ868554__SS-prME
  source 1..9876: mol_type = other RNA
accgccggagtgatcgttatgctgattcccacagctatggccttccacctcacgaccagaaatggggaacctcatatgatcgttggacggcaggaaaagggcaagagcctgctttttaagacagaggacggggtgaatatgtgcaccctgatggcgattgatctcggagaactgtgtgaggacacaatcacctacaagtgcccgcttctgagacaaaatgaacccgaggatattgactgttggtgcaattccacatctacctgggtgacgtatggcacctgtacaaccacaggggagcacagacgggaaaagagaagcgtcgctctcgtgcctcatgttggaatgggcctggagaccagaacggaaacatggatgtcctctgagggcgcctggaagcacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaagaacaggacaaacgctttatctgcaagcattccatggtggatagaggctggggcaacgggtgtggactgttcggcaaagggggaattgtcacatgcgccatgtttacgtgcaaaaagaatatggaaggcaaagttgtgcagcctgagaacctcgaatacaccatcgtgattacaccccacagcggggaggagcatgcggtcggaaatgacaccggcaagcacggcaaagaaatcaagatcacacctcagtcttccattaccgaggccgaactgacggggtatggaaccgtgacaatggagtgtagcccccggaccggccttgatttcaacgaaatggttctgctccaaatggaggacaaggcttggctggtgcaccgccagtggtttcttgatctgccgctcccttggctgcccggggccgacacacagggatctaattggatccagaaggagaccctggtcacgttcaagaaccctcatgctaaaaagcaagacgtggttgtgctcggctcccaggaaggggccatgcacacagccctgaccggcgctacagagattcagatgagctccggaaatcttctgtttaccggccatctcaaatgcagactgcggatggataaacttcaactgaaagggatgtcttacagcatgtgtaccggaaagttcaagatcgtcaaagaaattgcggagacacagcacggcacgatcgtgatcagagtccagtatgagggggacggatccccctgcaagattcccttcgaaatcaccgatctcgagaaacgccatgtgctgggccggctgattacagttaaccctatcgtgattgaaaaggacagcccggtcaacatcgaggccgaacccccttttggggattcttacattatcatcggcgtggagcccggacagctcaaactgaattggttcaagaagggctccagcattgggcaaatgtttgagaccacaatgagaggagctaaacgcatggccatccttggcgacaccgcctgggatttcgggtctctgggaggcgtttttacgagcattgggaaggctctccaccaggtgttcggcgccatctacggagcggctttttccggcgtctcttggacaatgaaaattctgatcggggtggtgatcacctggattggaatgaacagccggtccaccagcctgtctgtttcccttgtcctcgtgggcgtggtcacactgtatctgggggccatggtgcaggccgacagcggatgtgttgtgtcttggaagaataaagaactcaagtgcggctccgggatcttcattaccgataacgtccacacatggacggagcagtacaagtttcaacctgaaagcccctccaaactggcttctgccatccagaaggctcatgaggaaggcatttgtggaatcagaagcgtgacccgccttgagaatctgatgtggaaacagatcacaccggagctcaaccacattctgtccgaaaatgaggttaagctgaccatcatgacaggcgacaccaaagggattatgcaggccggaaagcggtctcttagacctcaacccacggaactcaaatatagctggaagacctggggcaaggcgaaaatgctgtccacagagagccataaccagaccttcctgatcgatgggcctgaaacagtggagtgccccaataccaaccgcgcctggaactctctcgaggtcgaagactacggatttggcgtgttcacaaccaacatttggctgaaacttcgggagaaacaggacgtcttttgtgattccaagctgatgagcgctgccatcaaagacaatagagctgtgcacgccgatatgggctattggatcgaatctgcgctcaacgacacgtggaagatggagaaggcctccttcattgaggtcaaaagctgccactggcctaagtctcatacactgtggagcaatggggtgctggaatccgagatgatcattcccaaaaacttcgctggaccggtgagccagcacaactaccgccctggctatcatacccaaaccgccgggccctggcaccttggaaagctcgaaatggattttgacttctgtgagggcacaaccgtcgttgtgacggaagattgcgggaatcggggaccctctctgagaacaaccacagcttccggcaaactgatcaccgagtggtgctgtcggagctgcacactccctccgctgcgctacagaggcgaggacgggtgttggtacggaatggaaattcggccccttaaggagaaggaagagaacctggtgaatagcctcgtcaccgccggccatgggcagatcgataacttttctctgggagtgctgggcatggcccttttcctcgaagagatgctgagaacgcgcgttgggaccaaacacgctattctgctcgtggcggtcagctttgtgacactgatcaccggaaatatgtccttccgggaccttggcagagttatggtgatggtcggcgccacaatgaccgatgacatcgggatgggagtgacgtatctggctctcctggccgcctttaaggttcgccctacattcgctgccggcctgcttctgagaaaactcacctctaaggagctgatgatggcgacaattgggatcaccctcctgagccagtccaccattcccgaaacaatccttgagctgacggatgctctcgccctgggaatgatggtgctgaaaattgtccggaacatggaaaagtaccaacttgccgtgaccatcatggctatctcttgcgtgcctaatgccgtcattctgcgcaacgcgtggaaggttagctgtacaatcctcgctgccgtgtccgtgagccccctgctcctgacctcttcccagcagaaagccgactggattcctcttgctctgacaatcaagggcctcaatcccaccgccatttttctgacgacactgagcagaacctctaaaaagcggtcctggccgcttaacgaggctatcatggccgtcgggatggtgagcatcctggcgtcttccctcctgaaaaatgacattcctatgaccggacccctcgttgccggcggcctgcttacagtgtgctatgtcctgaccgggcgcagcgctgatctggaactcgagagagccgctgacgtgaagtgggaggatcaggccgaaatctccggaagctctcctattctgagcatcacaatttccgaggacggctctatgagcatcaaaaacgaagaggaggaacaaacgcttaccattctgatccggacagggctcctggttatctccggagtgttccccgtctctattccgatcaccgccgctgcgtggtacctctgggaggtgaagaagcagcgcgccggcgtcctgtgggatgtgccttctccccctcccgttgggaaagctgaacttgaggacggagcctatagaattaagcagcggggcatcctgggctactcccagattggggccggagtgtataaagaaggcacatttcacaccatgtggcatgtcacgcgcggggctgtgctgatgcacagaggaaagcggatcgagccctcctgggccgatgttaaaaaggacctcatcagctacggcgggggatggaagctggagggcgaatggaaagagggcgaagaggtgcaagtccttgcgctggaacctgggaagaatccgagagctgtgcagaccaaacccggaattttcaagacaaacaccggcacaatcggggccgtgtccctcgattttagccctggaacctctggctcccccattgttgaccgcaaagggaaggtcgtgggactgtacggcaatggcgtggtcacacggagcggggcctatgtgtctgctatcgcccagacggagaagtccattgaggataaccctgaaatcgaggacgatatcttccgcaagaagcgcctcaccattatggacctgcatcccggagcgggcaaaacaaagcggtaccttcctgctatcgttagagaagccattaaacgcgggctgcggaccctgatcctcgccccgaccagagtggtcgctgccgagatggaagaggctctgcgcggacttcccattcggtatcagacccctgccatcaaggcggagcacacgggcagagaaattgtggacctgatgtgtcatgccaccttcacaatgcggctcctgagccccgttcgcgtgcctaactacaatctcatcatcatggatgaggctcactttaccgaccccgcctccattgctgccagagggtatatctctacacgggtcgaaatgggcgaggccgctggaattttcatgaccgcgacgccgcctggcagccgcgatccctttccccaatccaacgcccctatcatggacgaggaaagagagattcccgaacggagctggaactctgggcacgagtgggtgacagatttcaagggaaaaaccgtttggtttgtgccttccatcaaggctggcaacgacatcgccgcctgcctgcgcaagaatgggaagaaagtcattcagcttagccgcaagaccttcgattctgaatacgtgaagacacgggctaacgactgggattttgtggtcaccacagacatcagcgagatgggagccaatttcaaagcggagagagttattgatccgcgccggtgtatgaagcccgtgatcctgaccgacggcgaagagagagtgattctggctgggcctatgcccgtcacgcattcctctgccgcccagcgccggggcagaatcggacgcaaccctaaaaatgaaaacgaccaatatatctacatgggcgagcccctcgaaaatgatgaggactgcgctcactggaaggaggccaaaatgctgcttgataacattaatacaccggaagggatcattcctagcatgtttgagcccgaaagagagaaggtggacgcgatcgatggagaataccggctgcgcggcgaggccagaaaaaccttcgttgacctcatgcggcgcggggatctgcctgtgtggctggcttataaggtcgccgctgagggaattaactacgccgacagaaagtggtgttttgatggcatcaaaaataaccagattctcgaagagaacgtggaagttgagatctggacaaaggagggggaacggaagaaacttaaacccagatggctggacgctcgcatctattccgatcctctggccctcaaagagttcaaggagttcgcggccggccggaaatctctgacccttaatctgattacggagatgggaagactccccacctttatgacacagaaggctcgcaacgccctggacaatctggctgtgctccataccgccgaagccggcgggcgggcttacaaccacgcgcttagcgagctgccggagacactggaaaccctcctgcttctgacactcctggccaccgtcacgggaggcatcttcctgtttctcatgtccgggaaaggaattggcaagatgacacttggcatgtgctgcatcattaccgctagcgtgctgctgtggtatgcccagatccaacctcactggatcgccgcttctattatcctcgagttctttctgattgtccttctgatccccgaacccgagaaacagagaacccctcaggataatcagctcacatacgtggttattgccatcctgaccgtggtggcggccacaatggctaacgaaatggggttcctggagaagacgaagaaagacctcggacttggctccatcaccacacaagagagcgaatccaatattctggacatcgatctgcggccggcctctgcttggaccctctatgccgtcgcgacaacctttgttacgcccatgctgcgccatagcattgagaactcctctgtgaatgtgagccttaccgccatcgctaaccaggccacagtcctgatggggctcggaaagggctggcctctgtccaaaatggacattggggtgcccctgctcgctatcggatgttacagccaggttaatcctattacccttacagccgctctgctgctcctggtggcccactacgcgatcatcggccccggccttcaggccaaggctaccagagaagcccaaaaacgggctgccgccgggattatgaagaaccctacggtcgatggaatcacagtgattgacctggagccgatcccctatgatcctaagttcgaaaaacagctcggccaggtcatgctgctgattctctgcgtgacccaggttcttatgatgcgcacaacctgggcgctgtgtgaggctctgaccctcgccacagggcccatctctacgctgtgggagggaaatcctggcagattttggaacaccacaatcgctgtgtccatggccaatattttccgggggagctaccttgccggagctggcctgctcttttctatcatgaagaacaccacaaatacccgcagaggcacggggaacattggagaaacactgggcgagaaatggaagtcccggctgaacgccctcgggaaaagcgagttccaaatctataagaaatctggcattcaggaggtcgaccgcacccttgcgaaggagggcatcaagagaggggaaaccgatcatcacgccgtgagccggggatccgctaaactgagatggtttgttgagcgcaatatggtgacacccgaaggcaaggtcgtggacctgggctgcgggcggggaggctggtcttactattgtgggggactcaaaaacgtgagagaggttaagggcctgaccaaagggggaccgggccatgaagaacctatccccatgagcacatacggctggaatcttgtccgcctgcagtccggggtggatgtgttcttcacgccccctgagaagtgcgacaccctcctgtgtgatattggagaaagctcccccaaccctacaatcgaggccggccggaccctgagagtcctcaatcttgttgaaaactggctgaataacaatacacaattttgcattaaggtgctgaacccgtatatgccctctgtgatcgagaaaatggaaaccctccagcgcaagtacgggggagctctggtccggaatcctcttagcagaaactccacgcacgagatgtactgggtgtctaatgccaccggcaacattgttagctccgtgaatatgatctctcgcatgctgatcaaccggttcacaatgaaacacaagaaagcgacctatgagcccgacgtcgatctcgggagcggaacaagaaacattggcatcgaatccgagattcctaatctggacatcattggcaagcgcatcgaaaagattaaacaggagcatgaaaccagctggcactacgaccaggatcatccctataagacatgggcctaccacgggtcttatgagaccaaacaaacgggatccgctagctctatggtgaacggcgttgtgcggctgctcacaaagccgtgggacgtcgtgcctatggtgacccagatggccatgaccgatacaacgccctttgggcagcagagagtcttcaaagagaaggttgacacccgcacacaagaacctaaggagggaaccaagaaacttatgagaatcacagctgaatggctgtggaaagagctgggcaaaaagaaaacaccccggatgtgtacacgcgaggaatttaccagaaaagtgcggtccaatgccgctctcggggccatcttcacggatgagaacaagtggaaaagcgcgagagaagccgtggaggacggacggttttgggaactggtcgatcgcgagagaaatcttcacctggagggcaaatgcgaaacctgtgtgtacaacatgatgggcaagcgggagaaaaagctcggggagttcggaaaagctaagggctctcgcgccatttggtatatgtggctgggggctagatttctggagttcgaagccctcggatttctgaatgaggaccattggttctcccggggcaacagcctttccggggttgagggcgaaggactgcaccgcctcggctacatcctgagagatgtggggaagaaagagggaggcgccatgtacgcggacgatacagctgggtgggacacccggattacacttgaagacctgaagaatgaggaaatggtcaccaaccatatgaaaggagagcacaagaaactcgccgaggccatctttaagctgacgtatcagaataaggtggttcgcgtgcagagacctacaccccggggcaccgtcatggatattatcagccgcagagaccagcgggggtctggccaagtgggaacatacggcctgaacaccttcacgaatatggaagctcagctcatccgccagatggagggggaaggaattttcaaaagcatccaacatctgaccgccacagaggagattgctgttcagaactggcttgccagagtgggccgggaaagactgtcccgcatggcgatctctggggatgactgcgtcgtgaagccgattgatgaccggtttgccagcgctctcaccgccctgaatgatatgggaaaagtcagaaaggacatccagcagtgggagccttcccgcggctggaacgattggacacaagtgcccttctgctctcaccactttcatgaacttgttatgaaagacgggcgggtgctggtcgtgccctgtagaaaccaggatgagctcatcggccgcgctcggattagccagggagccggctggtccctgaaggaaaccgcgtgcctggggaagtcttatgcccagatgtggacactcatgtacttccacagacgcgacctgcggcttgctgccaatgctatctgtagcgccgtgccttcccattgggttccgaccagcagaacgacatggtctattcacgctaaacacgagtggatgaccaccgaggatatgctggccgtgtggaaccgcgtctggatccaagaaaatccctggatggaggacaagacacctgtggaatcctgggaggaagttccctatctcggaaaacgggaggaccagtggtgcggcagcctgattgggcttacctctagagcgacatgggccaagaacatccagacggctattaatcaggtgcggtccctgatcggaaacgaggaatacaccgattatatgcctagcatgaaaagatttcgccgggaggaagaggaagccggcgtcctctggtga

SEQ ID NO: 19658 - RNA, 9876 nt, synthetic construct
  misc_feature 1..9876: note = derived and/or modified CDS sequence (opt5) from DENV-2__GQ868555__SS-prME
  source 1..9876: mol_type = other RNA
acagccggagtgatcgtcatgctgattcccacagctatcgccttccacctcacgaccagaaatggggagcctcatatgattgttggacggcaggaaaagggcaagagcctgctttttaagacagaggacggggtgaatatgtgcaccctgatggcgatcgatctcggagaactgtgtgaggacacaattacctacaaatgcccgcttctgagacaaaatgaacccgaggatatcgactgttggtgcaattccacatctacctgggtgacgtatggcacctgtacaaccacaggggagcacagacgggaaaagagaagcgtcgctctcgtgcctcatgttggaatgggcctggagaccagaacggaaacatggatgtcctctgagggcgcctggaaacacgtgcagcggatcgagacctggattctgcgccatcccgggttcacaatcatggccgctattctcgcctacaccatcggaaccacacactttcagagagctctgattttcatccttctgacggccgtcgcgcctagcatgaccatgcggtgcattggcatctccaaccgcgattttgtggaaggggtttctggaggcagctgggtggacatcgtcctcgagcacgggtcctgtgtgacaaccatggccaagaataagcccacactggatttcgaacttattaaaaccgaggctaagcagcctgccacgctgagaaaatattgcatcgaagctaagctcacaaacaccaccacagagagccggtgtccgacccaaggagagccctctctgaatgaggaacaggacaaacgctttatttgcaagcattccatggtggatagaggctggggcaacgggtgtggactgttcggcaaagggggaatcgtcacatgcgccatgtttacgtgcaaaaagaatatggaaggcaaagttgtgcagcctgagaacctcgaatacaccattgtgatcacaccccacagcggggaggagcatgcggtcggaaatgacaccggcaagcacggcaaagaaatcaagattacacctcagtcttccatcaccgaggccgaactgacggggtatggaaccgtgacaatggagtgtagcccccggaccggccttgatttcaacgaaatggttctgctccaaatggaggacaaggcttggctggtgcaccgccagtggtttcttgatctgccgctcccttggctgcccggggccgacacacagggatctaattggattcagaaggagaccctggtcacgttcaagaaccctcatgctaaaaagcaagacgtggttgtgctcggctcccaggaaggggccatgcacacagccctgaccggcgctacagagatccagatgagctccggaaatcttctgtttaccggccatctcaaatgcagactgcggatggataaacttcaactgaaagggatgtcttacagcatgtgtaccggaaagttcaagattgtcaaagaaatcgcggagacacagcacggcacgatcgtgattagagtccagtatgagggggacggatccccctgcaagatccccttcgaaattaccgatctcgagaaacgccatgtgctgggccggctgatcacagttaaccctattgtgaccgaaaaggacagcccggtcaacatcgaggccgaacccccttttggggattcttacattatcatcggcgtggagcccggacagctcaaactgaattggttcaagaagggctccagcattgggcaaatgtttgagacaaccatgagaggagctaaacgcatggccatccttggcgacacggcctgggatttcgggtctctgggaggcgtttttacaagcattgggaaggctctccaccaggtgttcggcgccatctacggagcggctttttccggcgtctcttggaccatgaaaattctgatcggggtggtgatcacctggattggaatgaacagccggtccacaagcctgtctgtttcccttgtcctcgtgggcgtggtcaccctgtatctgggggccatggtgcaggccgacagcggatgtgttgtgtcttggaagaataaagaactcaagtgcggctccgggatcttcattacagataacgtccacacgtggaccgagcagtacaagtttcaacctgaaagcccctccaaactggcttctgccatccagaaggctcatgaggaaggcatttgtggaatcagaagcgtgacacgccttgagaatctgatgtggaaacagatcaccccggagctcaaccacattctgtccgaaaatgaggttaagctgacaatcatgaccggcgacacgaaagggattatgcaggccggaaagcggtctcttagacctcaacccaccgaactcaaatatagctggaagacatggggcaaggcgaaaatgctgtccaccgagagccataaccagacattcctgatcgatgggcctgaaaccgccgagtgccccaatacaaaccgcgcttggaactctctcgaggtggaagactacggatttggcgtcttcaccacgaacatttggctgaaacttcgggagaaacaggacgtgttttgtgattccaagctgatgagcgccgctatcaaagacaatagagccgttcacgcggatatgggctattggatcgaatctgccctcaacgacacatggaagatggagaaggcttccttcattgaggtgaaaagctgccactggcctaagtctcataccctgtggagcaatggggtcctggaatccgagatgatcattcccaaaaacttcgccggaccggtgagccagcacaactaccgccctggctatcatacccaaacagctgggccctggcaccttggaaagctcgaaatggattttgacctgtgtgagggcaccacggtggtcgttacagaagattgcgggaatcggggaccctctctgagaaccacaaccgcctccggcaaactcatcacagagtggtgctgtcggagctgcaccctgcctccgcttcgctacagaggcgaggacgggtgttggtacggaatggaaattcggcccctgaaggagaaggaagagaacctcgtgaatagcctggtgacggccggccatgggcagatcgataacttctctctgggagtccttggcatggctctctttctggaagagatgctgagaacccgcgtggggacaaaacacgcgattctcctggttgccgtgagcttcgtcacccttatcacaggaaatatgtcctttcgggacctgggcagagtgatggttatggtgggcgctaccatgacggatgacatcgggatgggagtcacatatctcgccctgctggccgctttcaaggtgcgccctacctttgccgcgggccttctgctcagaaaactgacatctaaggagctcatgatggctaccattgggatcgccctgcttagccagtccaccattcccgaaacaatcctggagctcacggatgccctggctctgggaatgatggttcttaaaattgtgcggaacatggaaaagtaccaactggccgtcaccatcatggcgatctcttgcgtgcctaatgctgtgattctccgcaacgcctggaaggtcagctgtacaatcctggccgctgtttccgtgagccccctcctgcttacctcttcccagcagaaagccgactggattcctctggctctcacaatcaagggcctgaatcccaccgccattttcctgacgacacttagcagaacctctaaaaagcggtcctggccgctgaacgaggcgatcatggccgtggggatggtcagcatcctcgcttcttccctgctcaaaaatgacattcctatgaccggacccctggtggccggcggccttctgacagtttgctatgtgctgaccgggcgcagcgctgatctcgaactggagagagccgccgaggtcaagtgggaagaccaggctgagatctccggaagctctcctattcttagcatcacaatttccgaagatggctctatgagcatcaaaaacgaggaggaagaacaaacgctgaccattctcatccggacagggctgctcgtgatctccggagtttttcccgtgtctattccgatcaccgcggccgcttggtacctgtgggaagtcaagaagcagcgcgccggcgtgctttgggacgtcccttctccccctcccgtggggaaagccgagctggaagagggagcttatagaattaagcagcggggcatcctgggctactcccagattggggccggagtttataaagagggcacattccacaccatgtggcatgtgacgcgcggggcggtcctcatgcacagaggaaagcggatcgaaccctcctgggctgatgtgaaaaaggacctgatcagctacggcgggggatggaaacttgagggcgaatggaaagagggcgaagaggttcaagtgctggccctcgagcctgggaagaatccgagagccgtccagaccaaacccggaatttttaagacaaacaccggcacaatcggggctgtgtccctggatttcagccctggaacctctggctcccccattgtggaccgcaaagggaaggttgtcggactctacggcaatggcgtggtgacacggagcggggcctatgtctctgcgatcgctcagacggaaaagtccattgaggataaccctgaaatcgaggacgatatctttcgcaagaagcgcctgaccattatggaccttcatcccggagccggcaaaacaaagcggtacctgcctgccatcgtgagagaagctattaaacgcgggctgcggaccctcatcctggccccgaccagagttgtggctgccgagatggaggaagcgcttcgcggactgcccattcggtatcagacccctgccatcaaggctgagcacacgggcagagaaattgtcgatctcatgtgtcatgccaccttcacaatgcggctgctcagccccgtgcgcgttcctaactacaatctgatcatcatggacgaggctcacttcaccgaccccgcctccattgccgctagagggtatatctctacacgggtggagatgggcgaagcggccggaatttttatgaccgctacgccgcctggcagccgcgatcccttcccccaatccaacgcccctatcatggacgaggaaagagagattcccgaacggagctggaactctgggcacgagtgggtcacagattttaagggaaaaaccgtgtggttcgttccttccatcaaggccggcaacgacatcgctgcctgccttcgcaagaatgggaagaaagtgattcagctgagccgcaagacctttgattctgagtacgtcaagacacgggcgaacgactgggatttcgtggtgaccacagacatcagcgaaatgggagctaattttaaagccgagagagtcattgatccgcgccggtgtatgaagcccgttatcctgaccgacggcgaagagagagtgattctcgccgggcctatgcccgtgacgcattcctctgctgcccagcgccggggcagaatcggacgcaaccctaaaaatgaaaacgatcaatatatctacatgggcgagcccctggagaatgacgaagactgcgcgcactggaaggaggccaaaatgcttctggataacattaatacaccggaagggatcattcctagcatgttcgagcccgaaagagagaaggtcgacgctatcgatggagagtaccggctccgcggcgaagccagaaaaacctttgtggacctgatgcggcgcggggatctgcctgtttggctcgcttataaggtggccgctgagggaattaactacgccgacagaaagtggtgtttcgatggcatcaaaaataaccagattcttgaagagaacgtcgaggtggaaatctggacaaaggagggggaacggaaaaagctgaaacccagatggctggacgcgcgcatctattccgatcctctcgccctgaaggagtttaaggagttcgctgccggccggaaatctcttaccctgaatctcattacggagatgggaagactgcccaccttcatgacacagaaggctcgcaacgccctggacaatctcgccgttcttcataccgctgaggcgggcgggcgggcctacaaccacgctctgagcgaactgccggagacactcgaaaccctgcttctgctcacactgctggccaccgtgacgggaggcatctttctcttccttatgtccgggaaaggaattggcaagatgacactgggcatgtgctgcatcattaccgccagcgtcctgctctggtatgctcagatccaacctcactggatcgccgcgtctattatcctggagtttttccttattgtgctgctcatccccgaacccgagaaacagagaacccctcaggataatcagctgacatacgtcgtgattgccatcctgaccgttgtggctgccacaatggctaacgagatggggtttctcgaaaagacgaagaaagaccttggactgggctccatcaccacacaagagagcgaatccaatattctggatatcgacctccggccggcctctgcgtggaccctgtatgccgtggctacaaccttcgtcacgcccatgcttcgccatagcattgagaactcctctgttaatgtgagcctgaccgccatcgctaaccaggccacagtgctcatggggctgggaaagggctggcctctgtccaaaatggacattggggtccccctccttgctatcggatgttacagccaggtgaatcctattaccctgacagccgcgctgctcctgcttgttgcccactacgctatcatcggccccggcctgcaggccaaggctaccagagaagcccaaaaacgggccgcggctgggattatgaagaaccctacggtggatggaatcacagtcattgacctcgagccgatcccctatgatcctaagtttgagaaacagctgggccaggtgatgctgctcattctttgcgtcacccaggtgctgatgatgcgcacaacctgggccctgtgtgaagctctcaccctggccacagggcccatctctacgctttgggagggaaatcctggcagattctggaacaccacaatcgccgtttccatggctaatatttttcgggggagctacctggccggagcgggcctcctgttctctatcatgaagaacaccacaaatacccgcagaggcacggggaacattggagaaacactgggcgagaaatggaagtcccggctcaacgcccttgggaaaagcgagtttcaaatctataagaaatctggcattcaggaagtggaccgcaccctggctaaggagggcatcaagagaggggaaaccgatcatcacgccgtcagccggggatccgctaaactgagatggttcgtggagcgcaatatggttacacccgaaggcaaggtggtcgacctcggctgcgggcggggaggctggtcttactattgtgggggactgaaaaacgtgagagaggtgaagggccttaccaaagggggaccgggccatgaggaacctatccccatgagcacatacggctggaatctggttcgcctccagtccggggtcgatgtgtttttcacgccccctgagaagtgcgacaccctgctgtgtgatattggagaaagctcccccaaccctacaatcgaggccggccggaccctcagagtgcttaatctggtcgaaaactggctgaataacaatacacaattctgcattaaggttctcaacccgtatatgccctctgtgatcgagaaaatggagaccctgcagcgcaagtacgggggagcgcttgtgcggaatcctctgagcagaaactccacgcacgaaatgtactgggtctctaatgccaccggcaacattgtgagctccgttaatatgatctctcgcatgctcatcaaccggtttacaatgaaacacaagaaagctacctatgagcccgacgtggatctggggagcggaacaagaaacattggcatcgaatccgagattcctaatctggacatcattggcaagcgcatcgaaaagattaaacaggagcatgagaccagctggcactacgatcaggaccatccctataagacatgggcctaccacgggtcttatgaaaccaaacaaacgggatccgctagctctatggtcaacggcgtggttcggctccttacaaagccgtgggacgtggtccctatggtgacccagatggccatgaccgatacaacgcccttcgggcagcagagagtgtttaaagagaaggtcgacacccgcacacaagaacctaaggagggaaccaaaaagctgatgaaaatcacagctgagtggctgtggaaggaactcggcaaaaagaaaacccccagaatgtgtacacgggaggagttcacccgcaaggttagatccaatgccgcgctgggggccatctttacggatgagaacaagtggaaaagcgctcgggaagccgtggaggacggaagattctgggagcttgtggatcgggaacgcaatctgcacctcgagggcaagtgcgaaacctgtgtctacaacatgatgggcaaaagagagaagaaactgggggaatttggaaaggctaagggctctcgggccatttggtatatgtggctgggggcccgcttcctcgagtttgaggcgctgggattccttaatgaagaccattggttttccagaggcaacagcctgtccggggtggagggcgaaggactccaccggctgggctacatccttcgcgatgttagcaaaaaggaagggggagctatgtacgccgacgatacagccggctgggacaccagaattacactggaagatctcaaaaatgaggagatggtgaccaaccatatgaagggggaacacaaaaagctggctgaggccatcttcaagctgacgtatcagaataaagtcgtgcgggttcagcgccctacacccagaggaaccgtgatggacattatctctcggcgcgaccagagaggcagcgggcaagtcggcacatacggactcaacacctttacgaatatcgaagctcagctgattcggcagatggagggcgaggggatcttcaagtccattcaacatcttaccgccacagaagagatcgcggtgcagaactggctggcccgcgttggaagagaacggctctctagaatggctattagcggcgatgactgcgtggtcaaaccgatcgatgaccgcttcgcctccgctctgaccgcccttaatgatatggggaaggtgcggaaagacatccagcagtgggagccttctagaggatggaacgattggacacaagtccccttttgcagccaccacttccatgaactggtgatgaaggacggccgcgttctcgtggtcccctgtcggaaccaggatgagctgattgggagagcgcgcatctcccagggcgccggatggtctctgaaggagaccgcttgcctcggcaaaagctatgcccagatgtggacactgatgtactttcaccggagagaccttcgcctggctgccaatgctatttgttccgccgtgcctagccattgggtgccgacctctcggacgacatggtccatccacgcgaagcacgaatggatgaccaccgaggatatgctcgccgtttggaacagagtgtggattcaagaaaatccctggatggaggacaaaacacctgtcgaaagctgggaggaggtgccctatctggggaagcgcgaagatcagtggtgcggatctcttatcggcctgacctcccgggctacatgggccaaaaacattcagacggccatcaatcaggttagaagcctcatcgggaacgaggaatacaccgactatatgccttccatgaagcggttcagacgcgaggaagaggaggctggagtgctgtggtga

SEQ ID NO: 19659 - RNA, 9876 nt, synthetic construct
  misc_feature 1..9876: note = derived and/or modified CDS sequence (opt5) from DENV-2__GQ868556__SS-prME
  source 1..9876: mol_type = other RNA
accgccggagtgatcgtcatgctgattcccacagctatggccttccacctcacgaccagaaatggggaacctcatatgatcgttggacggcaggaaaagggcaagagcctgctttttaagacagaggacggggtgaatatgtgcaccctgatggcgattgatctcggagaactgtgtgaggacacaatcacctacaagtgcccgcttctgagacaaaatgaacccgaggatattgactgttggtgcaattccacatctacctgggtgacgtatggcacctgtacaaccacaggggagcacagacgggaaaagagaagcgtcgctctcgtgcctcatgttggaatgggcctggagaccagaacggaaacatggatgtcctctgagggcgcctggaagcacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaagaacaggacaaacgctttatctgcaagcattccatggtggatagaggctggggcaacgggtgtggactgttcggcaaagggggaattgtcacatgcgccatgtttacgtgcaaaaagaatatggaaggcaaagttgtgcagcctgagaacctcgaatacaccatcgtgattacaccccacagcggggaggagcatgcggtcggaaatgacaccggcaagcacggcaaagaaatcaagatcacacctcagtcttccattaccgaggccgaactgacggggtatggaaccgtgacaatggagtgtagcccccggaccggccttgatttcaacgaaatggttctgctccaaatggaggacaaggcttggctggtgcaccgccagtggtttcttgatctgccgctcccttggctgcccggggccgacacacagggatctaattggatccagaaggagaccctggtcacgttcaagaaccctcatgctaaaaagcaagacgtggttgtgctcggctcccaggaaggggccatgcacacagccctgaccggcgctacagagattcagatgagctccggaaatcttctgtttaccggccatctcaaatgcagactgcggatggataaacttcaactgaaagggatgtcttacagcatgtgtaccggaaagttcaagatcgtcaaagaaattgcggagacacagcacggcacgatcgtgatcagagtccagtatgagggggacggatccccctgcaagattcccttcgaaatcaccgatctcgagaaacgccatgtgctgggccggctgattacagttaaccctatcgtgattgaaaaggacagcccggtcaacatcgaggccgaacccccttttggggattcttacattatcatcggcgtggagcccggacagctcaaactgaattggttcaagaagggctccagcattgggcaaatgtttgagaccacaatgagaggagctaaacgcatggccatccttggcgacaccgcctgggatttcgggtctctgggaggcgtttttacgagcattgggaaggctctccaccaggtgttcggcgccatctacggagcggctttttccggcgtctcttggacaatgaaaattctgatcggggtggtgatcacctggattggaatgaacagccggtccaccagcctgtctgtttcccttgtcctcgtgggcgtggtcacactgtatctgggggccatggtgcaggccgacagcggatgtgttgtgtcttggaagaataaagaactcaagtgcggctccgggatcttcattaccgataacgtccacacatggacggagcagtacaagtttcaacctgaaagcccctccaaactggcttctgccatccagaaggctcatgaggaaggcatttgtggaatcagaagcgtgacccgccttgagaatctgatgtggaaacagatcacaccggagctcaaccacattctgtccgaaaatgaggttaagctgaccatcatgacaggcgacaccaaagggattatgcaggccggaaagcggtctcttagacctcaacccacggaactcaaatatagctggaagacctggggcaaggcgaaaatgctgtccacagagagccataaccagaccttcctgatcgatgggcctgaaacagccgagtgccccaataccaaccgcgcttggaactctctcgaggtggaagactacggatttggcgtcttcacaaccaacatttggctgaaacttcgggagaaacaggacgtgttttgtgattccaagctgatgagcgccgctatcaaagacaatagagccgttcacgcggatatgggctattggatcgaatctgccctcaacgacacgtggaagatggagaaggcttccttcattgaggtgaaaagctgccactggcctaagtctcatacactgtggagcaatggggtcctggaatccgagatgatcattcccaaaaacttcgccggaccggtgagccagcacaactaccgccctggctatcatacccaaaccgctgggccctggcaccttggaaagctcgaaatggattttgacttctgtgagggcacaaccgtggtcgttacggaagattgcgggaatcggggaccctctctgagaacaaccacagcctccggcaaactgatcaccgagtggtgctgtcggagctgcacactccctccgctgcgctacagaggcgaggacgggtgttggtacggaatggaaattcggccccttaaggagaaggaagagaacctggtgaatagcctcgtgaccgccggccatgggcagatcgataacttttctctgggagtcctgggcatggctcttttcctcgaagagatgctgagaacgcgcgtggggaccaaacacgcgattctgctcgttgccgtgagctttgtcacactgatcaccggaaatatgtccttccgggaccttggcagagtgatggttatggtgggcgctacaatgaccgatgacatcgggatgggagtcacgtatctggccctcctggccgcttttaaggtgcgccctacattcgccgcgggcctgcttctgagaaaactcacctctaaggagctgatgatggctacaattgggatcaccctcctgagccagtccaccattcccgaaacaatccttgagctgacggatgccctcgccctgggaatgatggttctgaaaattgtgcggaacatggaaaagtaccaacttgctgtcaccatcatggccatctcttgcgtgcctaatgcggtgattctgcgcaacgcttggaaggtcagctgtacaatcctcgccgccgtttccgtgagccccctgctcctgacctcttcccagcagaaagctgactggattcctcttgccctgacaatcaagggcctcaatcccaccgctatttttctgacgacactgagcagaacctctaaaaagcggtcctggccgcttaacgaggccatcatggcggtggggatggtcagcatcctggcctcttccctcctgaaaaatgacattcctatgaccggacccctcgtggctggcggcctgcttacagtttgctatgtgctgaccgggcgcagcgccgatctggaactcgagagagctgccgacgtcaagtgggaggatcaggccgaaatctccggaagctctcctattctgagcatcacaatttccgaggacggctctatgagcatcaaaaacgaagaggaggaacaaacgcttaccattctgatccggacagggctcctggtgatctccggagttttccccgtgtctattccgatcaccgctgcggcctggtacctctgggaggtcaagaagcagcgcgctggcgtgctgtgggatgtcccttctccccctcccgtggggaaagccgaacttgaggacggagcctatagaattaagcagcggggcatcctgggctactcccagattggggctggagtttataaagaaggcacatttcacaccatgtggcatgtgacgcgcggggccgtcctgatgcacagaggaaagcggatcgagccctcctgggcggatgtgaaaaaggacctcatcagctacggcgggggatggaagctggagggcgaatggaaagagggcgaagaggttcaagtgcttgctctggaacctgggaagaatccgagagccgtccagaccaaacccggaattttcaagacaaacaccggcacaatcggggccgtgtccctcgattttagccctggaacctctggctcccccattgtggaccgcaaagggaaggttgtcggactgtacggcaatggcgtggtgacacggagcggggcttatgtctctgccatcgcgcagacggagaagtccattgaggataaccctgaaatcgaggacgatatcttccgcaagaagcgcctcaccattatggacctgcatcccggagctggcaaaacaaagcggtaccttcctgccatcgtgagagaagccattaaacgcgggctgcggaccctgatcctcgctccgaccagagttgtggccgctgagatggaagaggccctgcgcggacttcccattcggtatcagacccctgcgatcaaggccgagcacacgggcagagaaattgtcgacctgatgtgtcatgctaccttcacaatgcggctcctgagccccgtgcgcgttcctaactacaatctcatcatcatggatgaggcccactttaccgaccccgcttccattgccgccagagggtatatctctacacgggtggaaatgggcgaggctgcgggaattttcatgaccgccacgccgcctggcagccgcgatccctttccccaatccaacgctcctatcatggacgaggaaagagagattcccgaacggagctggaactctgggcacgagtgggtcacagatttcaagggaaaaaccgtgtggtttgttccttccatcaaggccggcaacgacatcgccgcttgcctgcgcaagaatgggaagaaagtgattcagcttagccgcaagaccttcgattctgaatacgtcaagacacgggccaacgactgggattttgtggtgaccacagacatcagcgagatgggagcgaatttcaaagctgagagagtcattgatccgcgccggtgtatgaagcccgttatcctgaccgacggcgaagagagagtgattctggccgggcctatgcccgtgacgcattcctctgccgctcagcgccggggcagaatcggacgcaaccctaaaaatgaaaacgaccaatatatctacatgggcgagcccctcgaaaatgatgaggactgcgcccactggaaggaggcgaaaatgctgcttgataacattaatacaccggaagggatcattcctagcatgtttgagcccgaaagagagaaggtcgacgccatcgatggagaataccggctgcgcggcgaggctagaaaaaccttcgtggacctcatgcggcgcggggatctgcctgtttggctggcctataaggtggctgccgagggaattaactacgctgacagaaagtggtgttttgatggcatcaaaaataaccagattctcgaagagaacgtcgaagtggagatctggacaaaggagggggaacggaagaaacttaaacccagatggctggacgcccgcatctattccgatcctctggcgctcaaagagttcaaggagttcgccgctggccggaaatctctgacccttaatctgattacggagatgggaagactccccacctttatgacacagaaggcccgcaacgctctggacaatctggccgttctccataccgccgaagctggcgggcgggcgtacaaccacgcccttagcgagctgccggagacactggaaaccctcctgcttctgacactcctggctaccgtgacgggaggcatcttcctgtttctcatgtccgggaaaggaattggcaagatgacacttggcatgtgctgcatcattaccgccagcgtcctgctgtggtatgcccagatccaacctcactggatcgctgcctctattatcctcgagttctttctgattgtgcttctgatccccgaacccgagaaacagagaacccctcaggataatcagctcacatacgtcgtgattgcgatcctgaccgttgtggccgctacaatggccaacgaaatggggttcctggagaagacgaagaaagacctcggacttggctccatcaccacacaagagagcgaatccaatattctggacatcgatctgcggccggcttctgcctggaccctctatgcggtggccacaacctttgtcacgcccatgctgcgccatagcattgagaactcctctgttaatgtgagccttaccgctatcgccaaccaggctacagtgctgatggggctcggaaagggctggcctctgtccaaaatggacattggggtccccctgctcgccatcggatgttacagccaggtgaatcctattacccttacagctgccctgctgctcctggttgcgcactacgccatcatcggccccggccttcaggctaaggccaccagagaagctcaaaaacgggccgccgcggggattatgaagaaccctacggtggatggaatcacagtcattgacctggagccgatcccctatgatcctaagttcgaaaaacagctcggccaggtgatgctgctgattctctgcgtcacccaggtgcttatgatgcgcacaacctgggctctgtgtgaggccctgaccctcgctacagggcccatctctacgctgtgggagggaaatcctggcagattttggaacaccacaatcgccgtttccatggccaatattttccgggggagctaccttgctggagccggcctgctcttttctatcatgaagaacaccacaaatacccgcagaggcacggggaacattggagaaacactgggcgagaaatggaagtcccggctgaacgcgctcgggaaaagcgagttccaaatctataagaaatctggcattcaggaggtggaccgcacccttgccaaggagggcatcaagagaggggaaaccgatcatcacgctgtcagccggggatccgccaaactgagatggtttgtggagcgcaatatggttacacccgaaggcaaggtggtcgacctgggctgcgggcggggaggctggtcttactattgtgggggactcaaaaacgtgagagaggtgaagggcctgaccaaagggggaccgggccatgaagaacctatccccatgagcacatacggctggaatcttgttcgcctgcagtccggggtcgatgtgttcttcacgccccctgagaagtgcgacaccctcctgtgtgatattggagaaagctcccccaaccctacaatcgaggctggccggaccctgagagtgctcaatcttgtcgaaaactggctgaataacaatacacaattttgcattaaggttctgaacccgtatatgccctctgtgatcgagaaaatggaaaccctccagcgcaagtacgggggagccctggtgcggaatcctcttagcagaaactccacgcacgagatgtactgggtctctaatgcgaccggcaacattgtgagctccgttaatatgatctctcgcatgctgatcaaccggttcacaatgaaacacaagaaagccacctatgagcccgacgtggatctcgggagcggaacaagaaacattggcatcgaatccgagattcctaatctggacatcattggcaagcgcatcgaaaagattaaacaggagcatgaaaccagctggcactacgaccaggatcatccctataagacatgggcttaccacgggtcttatgagaccaaacaaacgggatccgccagctctatggtcaacggcgtggttcggctgctcacaaagccgtgggacgtggtccctatggtgacccagatggctatgaccgatacaacgccctttgggcagcagagagtgttcaaagagaaggtcgacacccgcacacaagaacctaaggagggaaccaagaaacttatgagaatcacagccgaatggctgtggaaagagctgggcaaaaagaaaacaccccggatgtgtacacgcgaggaatttaccagaaaagttcggtccaatgctgccctcggggcgatcttcacggatgagaacaagtggaaaagcgccagagaagctgtggaggacggacggttttgggaactggtggatcgcgagagaaatcttcacctggagggcaaatgcgaaacctgtgtctacaacatgatgggcaagcgggagaaaaagctcggggagttcggaaaagccaagggctctcgcgctatttggtatatgtggctgggggccagatttctggagttcgaagccctcggatttctgaatgaggaccattggttctcccggggcaacagcctttccggggtggagggcgaaggactgcaccgcctcggctacatcctgagagatgttgggaagaaagagggaggcgcgatgtacgctgacgatacagccgggtgggacacccggattacacttgaagacctgaagaatgaggaaatggtgaccaaccatatgaaaggagagcacaagaaactcgccgaggctatctttaagctgacgtatcagaataaggtcgtgcgcgttcagagacctacaccccggggcaccgtgatggatattatcagccgcagagaccagcgggggtctggccaagtcggaacatacggcctgaacaccttcacgaatatggaagcccagctcatccgccagatggagggggaaggaattttcaaaagcatccaacatctgaccgctacagaggagattgccgtgcagaactggcttgcgagagttggccgggaaagactgtcccgcatggccatctctggggatgactgcgtggtcaagccgattgatgaccggtttgctagcgccctcaccgctctgaatgatatgggaaaagtgagaaaggacatccagcagtgggagccttcccgcggctggaacgattggacacaagtccccttctgctctcaccactttcatgaacttgtgatgaaagacgggcgggttctggtggtcccctgtagaaaccaggatgagctcatcggccgcgcccggattagccagggagcgggctggtccctgaaggaaaccgcctgcctggggaagtcttatgctcagatgtggacactcatgtacttccacagacgcgacctgcggcttgccgctaatgccatctgtagcgctgtgccttcccattgggtgccgaccagcagaacgacatggtctattcacgccaaacacgagtggatgaccaccgaggatatgctggcggtttggaaccgcgtgtggatccaagaaaatccctggatggaggacaagacacctgtcgaatcctgggaggaagtgccctatctcggaaaacgggaggaccagtggtgcggcagcctgattgggcttacctctagagccacatgggctaagaacatccagacggccattaatcaggttcggtccctgatcggaaacgaggaatacaccgattatatgcctagcatgaaaagatttcgccgggaggaagaggaagccggcgtgctctggtga

SEQ ID NO: 19660 - RNA, 9876 nt, synthetic construct
  misc_feature 1..9876: note = derived and/or modified CDS sequence (opt5) from DENV-2__GQ868557__SS-prME
  source 1..9876: mol_type = other RNA
acagccggagtgatcgtcatgctgattcccacagctatcgccttccacctcacgaccagaaatggggagcctcatatgattgttggacggcaggaaaagggcaaaagcctgctttttaagacagaggacggggtgaatatgtgcaccctgatggcgatcgatctcggagaactgtgtgaggacacaattacctacaaatgcccgcttctgagacaaaatgaacccgaggatatcgactgttggtgcaattccacatctacctgggtgacgtatggcacctgtacaaccacaggggagcacagacgggaaaagagaagcgtcgctctcgtgcctcatgttggaatgggcctggagaccagaacggaaacatggatgtcctctgagggcgcctggaaacacgtgcagcggatcgagacctggattctgcgccatcccgggttcacaatcatggccgctattctcgcctacaccatcggaaccacacactttcagagagctctgattttcatccttctgacggccgtcgcgcctagcatgaccatgcggtgcattggcatctccaaccgcgattttgtggaaggggtttctggaggcagctgggtggacatcgtcctcgagcacgggtcctgtgtgacaaccatggccaagaataagcccacactggatttcgaacttattaaaaccgaggctaagcagcctgccacgctgagaaaatattgcatcgaagctaagctcacaaacaccaccacagagagccggtgtccgacccaaggagagccctctctgaatgaagaacaggacaaacgctttatttgcaagcattccatggtggatagaggctggggcaacgggtgtggactgttcggcaaagggggaatcgtcacatgcgccatgtttacgtgcaaaaagaatatggaaggcaaagttgtgcagcctgagaacctcgaatacaccattgtgatcacaccccacagcggggaggagcatgcggtcggaaatgacaccggcaagcacggcaaagaaatcaagattacacctcagtcttccatcaccgaggccgaactgacggggtatggaaccgtgacaatggagtgtagcccccggaccggccttgatttcaacgaaatggttctgctccaaatggaggacaaggcttggctggtgcaccgccagtggtttcttgatctgccgctcccttggctgcccggggccgacacacagggatctaattggattcagaaggagaccctggtcacgttcaagaaccctcatgctaaaaagcaagacgtggttgtgctcggctcccaggaaggggccatgcacacagccctgaccggcgctacagagatccagatgagctccggaaatcttctgtttaccggccatctcaaatgcagactgcggatggataaacttcaactgaaagggatgtcttacagcatgtgtaccggaaagttcaagattgtcaaagaaatcgcggagacacagcacggcacgatcgtgattagagtccagtatgagggggacggatccccctgcaagatccccttcgaaattaccgatctcgagaaacgccatgtgctgggccggctgatcacagttaaccctattgtgaccgaaaaggacagcccggtcaacatcgaggccgaacccccttttggggattcttacattatcatcggcgtggagcccggacagctcaaactgaattggttcaagaagggctccagcattgggcaaatgtttgagacaaccatgagaggagctaaacgcatggccatccttggcgacacggcctgggatttcgggtctctgggaggcgtttttacaagcattgggaaggctctccaccaggtgttcggcgccatctacggagcggctttttccggcgtctcttggaccatgaaaattctgatcggggtggtgatcacctggattggaatgaacagccggtccacaagcctgtctgtttcccttgtcctcgtgggcgtggtcaccctgtatctgggggccatggtgcaggccgacagcggatgtgttgtgtcttggaagaataaagaactcaagtgcggctccgggatcttcattacagataacgtccacacgtggaccgagcagtacaagtttcaacctgaaagcccctccaaactggcttctgccatccagaaggctcatgaggaaggcatttgtggaatcagaagcgtgacacgccttgagaatctgatgtggaaacagatcaccccggagctcaaccacattctgtccgaaaatgaggttaagctgacaatcatgaccggcgacacgaaagggattatgcaggccggaaagcggtctcttagacctcaacccaccgaactcaaatatagctggaagacatggggcaaggcgaaaatgctgtccaccgagagccataaccagacattcctgatcgatgggcctgaaaccgccgagtgccccaatacaaaccgcgcttggaactctctcgaggtggaagactacggatttggcgtcttcaccacgaacatttggctgaaacttcgggagaaacaggacgtgttttgtgattccaagctgatgagcgccgctatcaaagacaatagagccgttcacgcggatatgggctattggatcgaatctgccctcaacgacacatggaagatggagaaggcttccttcattgaggtgaaaagctgccactggcctaagtctcataccctgtggagcaatggggtcctggaatccgagatgatcattcccaaaaacttcgccggaccggtgagccagcacaactaccgccctggctatcatacccaaacagctgggccctggcaccttggaaagctcgaaatggattttgacctgtgtgagggcaccacggtggtcgttacagaagattgcgggaatcggggaccctctctgagaaccacaaccgcctccggcaaactcatcacagagtggtgctgtcggagctgcaccctgcctccgcttcgctacagaggcgaggacgggtgttggtacggaatggaaattcggcccctgaaggagaaggaagagaacctcgtgaatagcctggtgacggccggccatgggcagatcgataacttctctctgggagtccttggcatggctctctttctggaagagatgctgagaacccgcgtggggacaaaacacgcgattctcctggttgccgtgagcttcgtcacccttatcacaggaaatatgtcctttcgggacctgggcagagtgatggttatggtgggcgctaccatgacggatgacatcgggatgggagtcacatatctcgccctgctggccgctttcaaggtgcgccctacctttgccgcgggccttctgctcagaaaactgacatctaaggagctcatgatggctaccattgggatcgccctgcttagccagtccaccattcccgaaacaatcctggagctcacggatgccctggctctgggaatgatggttcttaaaattgtgcggaacatggaaaagtaccaactggccgtcaccatcatggcgatctcttgcgtgcctaatgctgtgattctccgcaacgcctggaaggtcagctgtacaatcctggccgctgtttccgtgagccccctcctgcttacctcttcccagcagaaagccgactggattcctctggctctcacaatcaagggcctgaatcccaccgccattttcctgacgacacttagcagaacctctaaaaagcggtcctggccgctgaacgaggcgatcatggccgtggggatggtcagcatcctcgcttcttccctgctcaaaaatgacattcctatgaccggacccctggtggccggcggccttctgacagtttgctatgtgctgaccgggcgcagcgctgatctcgaactggagagagccgccgaggtcaagtgggaagaccaggctgagatctccggaagctctcctattcttagcatcacaatttccgaagatggctctatgagcatcaaaaacgaggaggaggaacaaacgctgaccattctcatccggacagggctgctcgtgatctccggagtttttcccgtgtctattccgatcaccgcggccgcttggtacctgtgggaagtcaagaagcagcgcgccggcgtgctttgggacgtcccttctccccctcccgtggggaaagccgagctggaagatggagcttatagaattaagcagcggggcatcctgggctactcccagattggggccggagtttataaagagggcacattccacaccatgtggcatgtgacgcgcggggcggtcctcatgcacagaggaaagcggatcgagccctcctgggctgacgtgaaaaaggatctgatcagctacggcgggggatggaaacttgaaggcgagtggaaagaaggcgaggaagttcaagtgctggccctcgagcctgggaagaatccgagagccgtccagaccaaacccggaatttttaagacaaacaccggcacaatcggggctgtgtccctggacttcagccctggaacctctggctcccccattgtggatcgcaaagggaaggttgtcggactctacggcaatggcgtggtgacacggagcggggcctatgtctctgcgatcgctcagacggagaagtccattgaagacaaccctgagatcgaagatgacatctttcgcaagaagcgcctgaccattatggatcttcatcccggagccggcaaaacaaagcggtacctgcctgccatcgtgagagaggctattaaacgcgggctgcggaccctcatcctggccccgaccagagttgtggctgccgaaatggaggaggcgcttcgcggactgcccattcggtatcagacccctgccatcaaggctgaacacacgggcagagagattgtcgacctcatgtgtcatgccaccttcacaatgcggctgctcagccccgtgcgcgttcctaactacaatctgatcatcatggacgaagctcacttcaccgatcccgcctccattgccgctagagggtatatctctacacgggtggagatgggcgaggcggccggaatttttatgaccgctacgccgcctggcagccgcgaccccttcccccaatccaacgcccctatcatggatgaagagagagaaattcccgagcggagctggaactctgggcacgaatgggtcacagactttaagggaaaaaccgtgtggttcgttccttccatcaaggccggcaacgatatcgctgcctgccttcgcaagaatgggaagaaagtgattcagctgagccgcaagacctttgactctgagtacgtcaagacacgggcgaacgattgggacttcgtggtgaccacagatatcagcgagatgggagctaattttaaagccgaaagagtcattgacccgcgccggtgtatgaagcccgttatcctgaccgatggcgaggaaagagtgattctcgccgggcctatgcccgtgacgcattcctctgctgcccagcgccggggcagaatcggacgcaaccctaaaaatgagaacgaccaatatatctacatgggcgaacccctggagaatgacgaggattgcgcgcactggaaggaagccaaaatgcttctggacaacattaatacaccggaggggatcattcctagcatgttcgaacccgagagagaaaaggtcgatgctatcgacggagagtaccggctccgcggcgaggccagaaaaacctttgtggatctgatgcggcgcggggacctgcctgtttggctcgcttataaggtggccgctgaaggaattaactacgccgatagaaagtggtgtttcgacggcatcaaaaataaccagattcttgaggaaaacgtcgaggtggagatctggacaaaggaaggggagcggaaaaagctgaaacccagatggctggatgcgcgcatctattccgaccctctcgccctgaaggaatttaaggagttcgctgccggccggaaatctcttaccctgaatctcattacggaaatgggaagactgcccaccttcatgacacagaaggctcgcaacgccctggataatctcgccgttcttcataccgctgaggcgggcgggcgggcctacaaccacgctctgagcgagctgccggaaacactcgagaccctgcttctgctcacactgctggccaccgtgacgggaggcatctttctcttccttatgtccgggaaaggaattggcaagatgacactgggcatgtgctgcatcattaccgccagcgtcctgctctggtatgctcagatccaacctcactggatcgccgcgtctattatcctggaatttttccttattgtgctgctcatccccgagcccgaaaaacagagaacccctcaggacaatcagctgacatacgtcgtgattgccatcctgaccgttgtggctgccacaatggctaacgagatggggtttctcgagaagacgaagaaagatcttggactgggctccatcaccacacaagaaagcgagtccaatattctggacatcgacctccggccggcctctgcgtggaccctgtatgccgtggctacaaccttcgtcacgcccatgcttcgccatagcattgaaaactcctctgttaatgtgagcctgaccgccatcgctaaccaggccacagtgctcatggggctgggaaagggctggcctctgtccaaaatggatattggggtccccctccttgctatcggatgttacagccaggtgaatcctattaccctgacagccgcgctgctcctgcttgttgcccactacgctatcatcggccccggcctgcaggccaaggctaccagagaggcccaaaaacgggccgcggctgggattatgaagaaccctacggtggacggaatcacagtcattgatctcgaaccgatcccctatgaccctaagtttgagaaacagctgggccaggtgatgctgctcattctttgcgtcacccaggtgctgatgatgcgcacaacctgggccctgtgtgaggctctcaccctggccacagggcccatctctacgctttgggaaggaaatcctggcagattctggaacaccacaatcgccgtttccatggctaatatttttcgggggagctacctggccggagcgggcctcctgttctctatcatgaagaacaccacaaatacccgcagaggcacggggaacattggagagacactgggcgaaaaatggaagtcccggctcaacgcccttgggaaaagcgagtttcaaatctataagaaatctggcattcaggaggtggatcgcaccctggctaaggaaggcatcaagagaggggagaccgaccatcacgccgtcagccggggatccgctaaactgagatggttcgtggaacgcaatatggttacacccgagggcaaggtggtcgatctcggctgcgggcggggaggctggtcttactattgtgggggactgaaaaacgtgagagaagtgaagggccttaccaaagggggaccgggccatgaggagcctatccccatgagcacatacggctggaatctggttcgcctccagtccggggtcgacgtgtttttcacgccccctgaaaagtgcgataccctgctgtgtgacattggagagagctcccccaaccctacaatcgaagccggccggaccctcagagtgcttaatctggtcgagaactggctgaataacaatacacaattctgcattaaggttctcaacccgtatatgccctctgtgatcgagaagatggagaccctgcagcgcaagtacgggggagcgcttgtgcggaatcctctgagcagaaactccacgcacgagatgtactgggtctctaatgccaccggcaacattgtgagctccgttaatatgatctctcgcatgctcatcaaccggtttacaatgaaacacaagaaagctacctatgaacccgatgtggacctggggagcggaacaagaaacattggcatcgagtccgaaattcctaatctggatatcattggcaagcgcatcgagaagattaaacaggaacatgagaccagctggcactacgaccaggaccatccctataagacatgggcctaccacgggtcttatgagaccaaacaaacgggatccgctagctctatggtcaacggcgtggttcggctccttacaaagccgtgggatgtggtccctatggtgacccagatggccatgaccgacacaacgcccttcgggcagcagagagtgtttaaagaaaaggtcgatacccgcacacaagagcctaaggaaggaaccaaaaagctgatgaaaatcacagctgagtggctgtggaaggagctcggcaaaaagaaaacccccagaatgtgtacacgggaagagttcacccgcaaggttagatccaatgccgcgctgggggccatctttacggacgaaaacaagtggaaaagcgctcgggaggccgtggaagatggaagattctgggagcttgtggaccgggagcgcaatctgcacctcgaaggcaagtgcgagacctgtgtctacaacatgatgggcaaaagagaaaagaaactgggggagtttggaaaggctaagggctctcgggccatttggtatatgtggctgggggcccgcttcctcgaatttgaggcgctgggattccttaatgaggatcattggttttccagaggcaacagcctgtccggggtggaaggcgagggactccaccggctgggctacatccttcgcgacgttagcaaaaaggaagggggagctatgtacgccgatgacacagccggctgggataccagaattacactggaggacctcaaaaatgaagagatggtgaccaaccatatgaagggggagcacaaaaagctggctgaagccatcttcaagctgacgtatcagaataaagtcgtgcgggttcagcgccctacacccagaggaaccgtgatggacattatctctcggcgcgatcagagaggcagcgggcaagtcggcacatacggactcaacacctttacgaatatggaggctcagctgatccggcagatggaaggcgaggggattttcaagtccatccaacatcttaccgccacagaggaaaacgcggtgcagaattggctggcccgcgttggaagagagcggctctctagaatggctattagcggcgacgattgcgtggtcaaaccgatcgacgatcgcttcgcctccgctctgaccgcccttaacgacatggggaaggtgcggaaagatattcagcagtgggaaccttctagaggatggaacgactggacacaagtccccttttgcagccaccacttccatgagctggtgatgaaggatggccgcgttctcgtggtcccctgtcggaatcaggacgaactgatcgggagagcgcgcatctcccagggcgccggatggtctctgaaggagaccgcttgcctcggcaaaagctatgcccagatgtggacactgatgtactttcaccggagagatcttcgcctggctgccaacgctatttgttccgccgtgcctagccattgggtgccgacctctcggacgacatggtccatccacgcgaagcacgagtggatgaccaccgaagacatgctcgccgtttggaatagagtgtggattcaagagaacccctggatggaagataaaacacctgtcgagagctgggaagaggtgccctatctggggaagcgcgaggaccagtggtgcggatctcttatcggcctgacctcccgggctacatgggccaaaaatattcagacggccatcaaccaggttagaagcctcattgggaatgaagagtacaccgactatatgccttccatgaagcggttcagacgcgaagaggaagaggctggagtgctgtggtga

SEQ ID NO: 19661 - RNA, 9876 nt, synthetic construct
  misc_feature 1..9876: note = derived and/or modified CDS sequence (opt5) from DENV-2__GU131947__SS-prME
  source 1..9876: mol_type = other RNA
accgccggagtgatcgtcatgctgattcccacagctatcgccttccacctcacgacccggaatggggagcctcatatgattgttggacggcaggaaaagggcaagagcctgctttttaagacagaggacggggtgaatatgtgcaccctgatggcgatcgatctcggagaactgtgtgaggacacaattacctacaagtgcccgcttctgcgccaaaatgaacccgaggatatcgactgttggtgcaattccacatctacctgggtgacgtatggcacctgtacaaccacaggggagcacagacgggaaaagcgcagcgtcgctctcgtgcctcatgttggaatgggcctggagaccagaacggaaacatggatgtcctctgagggcgcctggaagcacgtgcagcggatcgagacctggattctgcgccatcccgggttcacaatcatggccgctattctcgcctacaccatcggaaccacacactttcagagagctctgattttcatccttctgacggccgtcgcgcctagcatgaccatgcggtgcattggcatctccaaccgcgattttgtggaaggggtttctggaggcagctgggtggacatcgtcctcgagcacgggtcctgtgtgacaaccatggccaagaataagcccacactggatttcgaacttattaagaccgaggctaagcagcctgccacgctgagaaaatattgcatcgaagctaagctcacaaacaccaccacagagagccggtgtccgacccaaggagagccctctctgaatgaagaacaggacaaacgctttatttgcaagcattccatggtggatagaggctggggcaacgggtgtggactgttcggcaaaggcgggatcgtcacatgcgccatgtttacgtgcaaaaagaatatggaagggaaagttgtgcagcctgagaacctcgaatacaccattgtgatcacaccccacagcggggaggagcatgcggtcggaaatgacaccggcaagcacggcaaagaaatcaagattacacctcagtcttccatcaccgaggccgaactgacggggtatggaaccgtgacaatggagtgtagcccccggaccggccttgatttcaacgaaatggttctgctccaaatggaggacaaggcttggctggtgcaccgccagtggtttcttgatctgccgctcccttggctgcccggggccgacacacagggatctaattggattcagaaggagaccctggtcacgttcaagaaccctcatgctaaaaagcaagacgtggttgtgctcggctcccaggaaggggccatgcacacagccctgaccggcgctacagagatccagatgagctccggaaatcttctgtttaccggccatctcaaatgcagactgcggatggataaacttcaactgaaagggatgtcttacagcatgtgtaccggaaagttcaagattgtcaaagaaatcgcggagacacagcacggcacgatcgtgattagagtccagtatgagggggacggatccccctgcaagatccccttcgaaattaccgatctcgagaaacgccatgtgctgggccggctgatcacagttaaccctattgtgaccgaaaaggacagcccggtcaacatcgaggccgaacccccttttggggattcttacattatcatcggcgtggagcccggacagctcaaactgaattggttcaagaagggctccagcattgggcaaatgtttgagacaaccatgagaggagctaaacgcatggccatccttggcgacacggcctgggatttcgggtctctgggaggcgtttttacaagcattgggaaggctctccaccaggtgttcggcgccatctacggagcggctttttccggcgtctcttggaccatgaaaattctgatcggggtggtgatcacctggattggaatgaacagccggtccacaagcctgtctgtttcccttgtcctcgtgggcgtggtcaccctgtatctgggggccatggtgcaggccgacagcggatgtgttgtgtcttggaagaataaagaactcaagtgcggctccgggatcttcattacagataacgtccacacgtggaccgagcagtacaagtttcaacctgaaagcccctccaaactggcttctgccatccagaaggctcatgaggaaggcatttgtggaatcagaagcgtgacacgccttgagaatctgatgtggaaacagatcaccccggagctcaaccacattctgtccgaaaatgaggttaagctgacaatcatgaccggcgacacgaaagggattatgcaggccggaaagcggtctcttagacctcaacccaccgaactcaaatatagctggaagacatggggcaaggcgaaaatgctgtccaccgagagccataaccagacattcctgatcgatgggcctgaaaccgccgagtgccccaatacaaaccgcgcttggaactctctcgaggtggaagactacggatttggcgtcttcaccacgaacatttggctgaaacttcgggagaaacaggacgtgttttgtgattccaagctgatgagcgccgctatcaaagacaatagagccgttcacgcggatatgggctattggatcgaatctgccctcaacgacacatggaagatggagaaggcttccttcattgaggtgaaaagctgccactggcctaagtctcataccctgtggagcaatggggtcctggaatccgagatgatcattcccaaaaacttcgccggaccggtgagccagcacaactaccgccctggctatcatacccaaacagctgggccctggcaccttggaaagctcgaaatggattttgacctgtgtgagggcaccacggtggtcgttacagaagattgcgggaatcggggaccctctctgagaaccacaaccgcctccggcaaactcatcacagagtggtgctgtcggagctgcaccctgcctccgcttcgctacagaggcgaggacgggtgttggtacggaatggaaattcggcccctgaaggagaaggaagagaacctcgtgaatagcctggtgacggccggccatgggcagatcgataacttctctctgggagtccttggcatggctctctttctggaagagatgctgagaacccgcgtggggacaaaacacgcgattctcctggttgccgtgagcttcgtcacccttatcacaggaaatatgtcctttcgggacctgggcagagtgatggttatggtgggcgctaccatgacggatgacatcgggatgggagtcacatatctcgccctgctggccgctttcaaggtgcgccctacctttgccgcgggccttctgctcagaaaactgacatctaaggagctcatgatggctaccattgggatcgccctgcttagccagtccaccattcccgaaacaatcctggagctcacggatgccctggctctgggaatgatggttcttaaaattgtgcggaacatggaaaagtaccaactggccgtcaccatcatggcgatctcttgcgtgcctaatgctatgattctccgcaacgcctggaaggtgagctgtacaatcctggccgctgtctccgttagccccctcctgcttacctcttcccagcagaaagccgactggattcctctggctctcacaatcaagggcctgaatcccaccgccattttcctgacgacacttagcagaacctctaaaaagcggtcctggccgctgaacgaggcgatcatggccgtggggatggtgagcatcctcgcttcttccctgctcaaaaatgacattcctatgaccggacccctggtcgccggcggccttctgacagtgtgctatgttctgaccgggcgcagcgctgatctcgaactggagagagccgccgaggtgaagtgggaagaccaggctgagatctccggaagctctcctattcttagcatcacaatttccgaagatggctctatgagcatcaaaaacgaggaggaagaacaaacgctgaccattctcatccggacagggctgctcgtcatctccggagtgtttcccgtttctattccgatcaccgcggccgcttggtacctgtgggaagtgaagaagcagcgcgccggcgtcctttgggacgtgccttctccccctcccgtcgggagagccgagctggaagatggagcttatcggattaaacagcgcggcatcctgggctactcccagattggggccggagtgtataaggagggcacattccacaccatgtggcatgttacgagaggggcggtgctcatgcaccggggaaaaagaatcgagccctcctgggctgacgtcaagaaagatctgatcagctacggcgggggatggaaacttgaaggcgagtggaaggaaggcgaggaagtgcaagttctggccctcgagcctgggaaaaatccgcgcgccgtgcagaccaagcccggaatttttaaaacaaacaccggcacaatcggggctgtctccctggacttcagccctggaacctctggctcccccattgtggatcggaaggggaaagtggttggactctacggcaatggcgtcgtgacaagaagcggggcctatgtgtctgcgatcgctcagacggagaagtccattgaagacaaccctgagatcgaagatgacatctttcgcaagaaacggctgaccattatggatcttcatcccggagccggcaagacaaaaagatacctgcctgccatcgtccgcgaggctattaagcgggggctgagaaccctcatcctggccccgacccgcgtggttgctgccgaaatggaggaggcgcttcggggactgcccattagatatcagacccctgccatcaaagctgaacacacgggccgggagattgtggacctcatgtgtcatgccaccttcacaatgcgcctgctcagccccgtcagagtgcctaactacaatctgatcatcatggacgaagctcacttcaccgatcccgcctccattgccgctcgggggtatatctctacacgcgttgagatgggcgaggcggccggaatttttatgaccgctacgccgcctggcagcagagaccccttcccccaatccaacgcccctatcatggatgaggagcgggaaattcccgagagaagctggaactctgggcacgaatgggtgacagactttaagggaaagaccgtctggttcgtgccttccatcaaagccggcaacgatatcgctgcctgccttcgcaagaatgggaaaaaggttattcagctgagccggaaaacctttgactctgagtacgtgaagacaagagcgaacgattgggacttcgtcgtgaccacagatatcagcgagatgggagctaattttaaggccgaacgcgtgattgacccgcggagatgtatgaaacccgtcatcctgaccgatggcgaggaacgcgttattctcgccgggcctatgcccgtgacgcattcctctgctgcccagcggagaggccgcatcggaagaaaccctaagaatgagaacgaccaatatatctacatgggcgaacccctggagaatgacgaggattgcgcgcactggaaagaagccaagatgcttctggacaacattaatacaccggaggggatcattcctagcatgttcgaacccgagcgggaaaaagtggatgctatcgacggagagtaccgcctcagaggcgaggcccggaagacctttgtcgatctgatgcgcagaggggacctgcctgtgtggctcgcttataaagttgccgctgaaggaattaactacgccgatcggaagtggtgtttcgacggcatcaagaataaccagattcttgaggaaaacgtggaggtcgagatctggacaaaagaaggggagagaaagaaactgaagccccgctggctggatgcgcggatctattccgaccctctcgccctgaaagaatttaaggagttcgctgccggcagaaagtctcttaccctgaatctcattacggaaatgggacgcctgcccaccttcatgacacagaaagctcggaacgccctggataatctcgccgtgcttcataccgctgaggcgggcgggagagcctacaaccacgctctgagcgagctgccggaaacactcgagaccctgcttctgctcacactgctggccaccgttacgggaggcatctttctcttccttatgtccgggaagggaattggcaaaatgacactgggcatgtgctgcatcattaccgccagcgtgctgctctggtatgctcagatccaacctcactggatcgccgcgtctattatcctggaatttttccttattgtcctgctcatccccgagcccgaaaagcagcggacccctcaggacaatcagctgacatacgtggtcattgccatcctgaccgtggttgctgccacaatggctaacgagatggggtttctcgagaaaacgaagaaggatcttggactgggctccatcaccacacaagaaagcgagtccaatattctggacatcgacctccgcccggcctctgcgtggaccctgtatgccgtggctacaaccttcgtgacgcccatgcttagacatagcattgaaaactcctctgtcaatgttagcctgaccgccatcgctaaccaggccacagtgctcatggggctgggaaaaggctggcctctgtccaagatggatattggggtgcccctccttgctatcggatgttacagccaggtcaatcctattaccctgacagccgcgctgctcctgcttgtggcccactacgctatcatcggccccggcctgcaggccaaagctacccgggaggcccaaaagcgcgccgcggctgggattatgaaaaaccctacggttgacggaatcacagtgattgatctcgaaccgatcccctatgaccctaagtttgagaagcagctgggccaggtcatgctgctcattctttgcgtgacccaggtcctgatgatgagaacaacctgggccctgtgtgaggctctcaccctggccacagggcccatctctacgctttgggaaggaaatcctggccggttctggaacaccacaatcgccgtgtccatggctaatatttttcgcgggagctacctggccggagcgggcctcctgttctctatcatgaaaaacaccacaaataccagacggggcacggggaacattggagagacactgggcgaaaagtggaaatcccgcctcaacgcccttggaaagagcgagtttcaaatctataaaaagtctggcattcaggaggttgatagaaccctggctaaagaaggcatcaagagaggggagaccgaccatcacgccgtgagcagaggatccgctaagctgcgctggttcgtcgaacggaatatggtgacacccgagggcaaagttgtggatctcggctgcgggagaggaggctggtcttactattgtgggggactgaagaacgtccgcgaagtgaaaggccttaccaaagggggaccgggccatgaggagcctatccccatgagcacatacggctggaatctggtgcggctccagtccggggttgacgtctttttcacgccccctgaaaaatgcgataccctgctgtgtgacattggagagagctcccccaaccctacaatcgaagccggcagaaccctccgcgtgcttaatctggtggagaactggctgaataacaatacacaattctgcattaaggtcctcaacccgtatatgccctctgttatcgaaaagatggagaccctgcagcggaaatacgggggagcgcttgtgagaaatcctctgagccgcaactccacgcacgagatgtactgggtgtctaatgccaccggcaacattgtcagctccgtgaatatgatctctcggatgctcatcaacagatttacaatgaagcacaaaaaggctacctatgaacccgatgttgacctggggagcggaacacgcaacattggcatcgagtccgaaattcctaatctggatatcattggcaaacggatcgagaagattaagcaggaacatgagaccagctggcactacgaccaggaccatccctataaaacatgggcctaccacgggtcttatgagaccaagcaaacgggatccgctagctctatggtgaacggcgtcgtgagactccttacaaaaccgtgggatgttgtgcctatggtcacccagatggccatgaccgacacaacgcccttcgggcagcagcgcgtgtttaaggaaaaagtggataccagaacacaagagcctaaggaaggaaccaagaaactgatgaagatcacagctgagtggctgtggaaagagctcggcaagaaaaagacaccccggatgtgtacacgcgaagagttcaccagaaaagtccggtccaatgccgcgctgggggccatctttacggacgaaaacaagtggaaaagcgctagagaggccgttgaagatggacggttctgggagcttgtggaccgcgagagaaatctgcacctcgaaggcaaatgcgagacctgtgtgtacaacatgatgggcaagcgggagaagaagctgggggagtttggaaaagctaagggctctcgcgccatttggtatatgtggctgggggccagattcctcgaatttgaggcgctgggattccttaatgaggatcattggttttcccggggcaacagcctgtccggggtcgaaggcgagggactccaccgcctgggctacatccttagagacgtgagcaagaaagaagggggagctatgtacgccgatgacacagccggctgggatacccggattacactggaggacctcaagaatgaagagatggttaccaaccatatgaaaggggagcacaagaaactggctgaagccatcttcaagctgacgtatcagaataaggtggtccgcgtgcagagacctacaccccggggaaccgttatggacattatctctcgcagagatcagcggggcagcgggcaagtgggcacatacggactcaacacctttacgaatatggaggctcagctgatccgccagatggaaggcgaggggattttcaaatccatccaacatcttaccgccattgaggaaatcgcggtccagaactggctggccagagtgggacgggagagactctctcgcatggctattagcggcgacgattgcgttgtgaagccgatcgacgatcggttcgcctccgctctgacagcccttaatgacatggggaaagtcagaaaggatatccagcagtgggaaccttctcgcggatggaacgactggacccaagtgcccttttgcagccaccacttccatgagctggtcatgaaagatggccgggtgctcgttgtgccctgtagaaaccaggacgaactgattgggcgcgcgcggatctcccagggcgccggatggtctctgaaggagacagcttgcctcggcaagagctatgcccagatgtggaccctgatgtactttcacagacgcgatcttcggctggctgccaatgctatttgttccgccgtccctagccattgggtgccgacatctagaaccacgtggtccatccacgcgaaacacgagtggatgacaaccgaagacatgctcgccgtgtggaaccgcgtttggattcaagagaatccctggatggaagataagacccctgtggagagctgggaagaggtcccctatctggggaaacgggaggaccagtggtgcggatctcttatcggcctgacatccagagctacctgggccaagaacattcagacagccatcaatcaggtgcggagcctcatcgggaacgaagagtacacggactatatgccttccatgaaaagattccgccgggaagaggaagaggctggagttctgtggtga

SEQ ID NO: 19662 - RNA, 9876 nt, synthetic construct
  misc_feature 1..9876: note = derived and/or modified CDS sequence (opt5) from DENV-2__GQ868558__SS-prME
  source 1..9876: mol_type = other RNA
acagccggagtgatcgtgatgctgattcccacagctatcgccttccacctcacgacccggaatggggagcctcatatgattgttggacggcaggaaaagggcaaaagcctgctttttaagacagaggacggggtgaatatgtgcaccctgatggcgatcgatctcggagaactgtgtgaggacacaattacctacaaatgcccgcttctgaagcaaaatgaacccgaggatatcgactgttggtgcaattccacatctacctgggtgacgtatggcacctgtacaaccacaggggagcaccgccgggaaaaacggagcgtggctctcgtgcctcatgttggaatgggcctggagacccgcacggaaacatggatgtcctctgagggcgcctggaagcacgtgcagagaatcgagacctggattctgcggcatcccgggttcacaatcatggccgctattctcgcctacaccatcggaaccacacactttcagcgcgctctgattttcatccttctgacggccgtcgcgcctagcatgaccatgagatgcattggcatctccaaccgggattttgtggaaggggtttctggaggcagctgggtggacatcgtcctcgagcacgggtcctgtgtgacaaccatggccaagaataaacccacactggatttcgaacttattaagaccgaggctaaacagcctgccacgctgcgcaagtattgcatcgaagctaaactcacaaacaccaccacagagagcagatgtccgacccaaggagagccctctctgaatgaagaacaggacaagcggtttatttgcaagcattccatggtggatcgcggctggggcaacgggtgtggactgttcggcaaagggggaatcgtcacatgcgccatgtttacgtgcaagaaaaatatggaaggcaaggttgtgcagcctgagaacctcgaatacaccattgtgatcacaccccacagcggggaggagcatgcggtcggaaatgacaccggcaaacacggcaaggaaatcaaaattacacctcagtcttccatcaccgaggccgaactgacggggtatggaaccgtgacaatggagtgtagccccagaaccggccttgatttcaacgaaatggttctgctccaaatggaggacaaggcttggctggtgcaccggcagtggtttcttgatctgccgctcccttggctgcccggggccgacacacagggatctaattggattcagaaggagaccctggtcacgttcaaaaaccctcatgctaagaaacaagacgtggttgtgctcggctcccaggaaggggccatgcacacagccctgaccggcgctacagagatccagatgagctccggaaatcttctgtttaccggccatctcaagtgccgcctgagaatggataaacttcaactgaaggggatgtcttacagcatgtgtaccggaaagttcaaaattgtcaaggaaatcgcggagacacagcacggcacgatcgtgattcgggtccagtatgagggggacggatccccctgcaaaatccccttcgaaattaccgatctcgagaagagacatgtgctgggccgcctgatcacagttaaccctattgtgaccgaaaaagacagcccggtcaacatcgaggccgaacccccttttggggattcttacattatcatcggcgtggagcccggacagctcaagctgaattggttcaagaaaggctccagcattgggcaaatgtttgagacaaccatgcggggagctaagagaatggccatccttggcgacacggcctgggatttcgggtctctgggaggcgtttttacaagcattgggaaagctctccaccaggtgttcggcgccatctacggagcggctttttccggcgtctcttggaccatgaagattctgatcggggtggtgatcacctggattggaatgaacagccgctccacaagcctgtctgtttcccttgtcctcgtgggcgtggtcaccctgtatctgggggccatggtgcaggccgacagcggatgtgttgtgtcttggaaaaataaggaactcaagtgcggctccgggatcttcattacagataacgtccacacgtggaccgagcagtacaaatttcaacctgaaagcccctccaagctggcttctgccatccagaaagctcatgaggaaggcatttgtggaatccggagcgtgacaagacttgagaatctgatgtggaagcagatcaccccggagctcaaccacattctgtccgaaaatgaggttaaactgacaatcatgaccggcgacacgaaggggattatgcaggccggaaaacgctctcttcggcctcaacccaccgaactcaagtatagctggaagacatggggcaaagcgaagatgcattccaccgagagccacaaccagacattcctgatcgatgggcctgaaaccgccgagtgccccaatacaaacagagcttggaactctctggaggtggaagactacggatttggcgtcttcaccacgaacatttggctcaaactgcgcgagaagcaggacgtgttttgtgattccaaacttatgagcgccgctatcaaggacaatcgggccgttcacgcggatatgggctattggatcgaatctgccctgaacgacacatggaagatggagaaggctagcttcattgaggtcaagagctgccattggcctaaatctcacaccctctggagcaatggggtcctggaatccgagatgatcattcccaagaacttcgccggaccggtgagccagcataactacagacctggctatcacacccaaacagctgggccctggcatctgggaaaacttgaaatggattttgacctctgtgagggcaccacggtggtcgttacagaagattgcgggaatcgcggaccctctctgcggaccacaaccgcctccggcaagctgatcacagagtggtgctgtagaagctgcaccctccctccgctgcggtaccgcggcgaggacgggtgttggtacggaatggaaattagaccccttaaggagaaagaagagaacctggtcaattccctcgtgacggccggccacgggcagatcgataacttctctctgggagtcctgggcatggctctttttctcgaagagatgctgcggaccagagtggggacaaagcacgcgattctgctcgttgccgtgagcttcgtcaccctgatcacaggaaatatgtcctttcgcgaccttggccgggtgatggttatggtgggcgctaccatgacggatgacatcgggatgggagtcacatatctggccctcctggccgctttcaaagtgagacctacctttgccgcgggcctgcttctgcgcaagctcacatctaaagagctgatgatggctaccattgggatcgccctcctgagccagtccaccattcccgaaacaatccttgagctgacggatgccctcgctctgggaatgatggttctgaagattgtgagaaacatggaaaagtaccaacttgccgtcaccatcatggcgatctcttgcgtgcctaatgctgtgattctgcggaacgcctggaaagtcagctgtacaatcctcgccgctgtttccgtgagccccctgctcctgacctcttcccagcagaaggccgactggattcctcttgtgctgacaatcaaaggcctcaatcccaccgctattttcctgacgacactgagccgcacctctaagaaaagatcctggccgcttaacgaggccatcatggcggtcgggatggtgagcatcctggcctcttccctcctgaagaatgacattcctatgaccggacccctcgttgctggcggcctgcttacagtgtgctatgtcctgaccgggcggagcgccgatctggaactcgagcgcgctgccgaggtgaaatgggaagaccaggccgagatctccggaagctctcctattctgagcatcacaatttccgaagatggctctatgagcatcaagaacgaggaggaagaacaaacgcttaccattctgatcagaacagggctcctggttatctccggagtgtttcccgtctctattccgatcaccgctgcggcctggtacctctgggaagtgaagaaacagcgggctggcgtcctgtgggacgtgccttctccccctcccgttgggaaggccgagcttgaagatggagcctatcgcattaaacagagaggcatcctgggctactcccagattggggctggagtgtataaggagggcacattccataccatgtggcacgtcacgagaggggccgtgctgatgcatcgcggaaaaagaatcgagccctcctgggcggacgttaagaaggatctcatcagctacggcgggggatggaaactggaaggcgagtggaaggaaggcgaggaagtgcaagtccttgctctggagcctgggaaaaatccgcgggccgtgcagaccaagcccggaatttttaaaacaaacgccggcaccatcggggctgtgtccctcgacttcagccctggaacatctggctcccccattgttgatagaaaggggaaggtcgtgggactgtacggcaatggcgtggtcacccgcagcggggcctatgtgtctgcgatcgctcagacagagaaatccattgaagacaaccctgagatcgaagatgacatctttcggaagaaaagactcacgattatggatctgcaccccggagccggcaagaccaaacgctaccttcctgccatcgttcgggaggctattaagagagggctgcgcacactgatcctcgccccgacccgggtggtcgctgccgaaatggaggaggcgctgagaggacttcccattcgctatcagacccctgccatcaaggctgaacatacaggccgggagattgtggacctgatgtgtcacgccacgttcaccatgagactcctgagccccgttcgggtgcctaactacaatctcatcatcatggacgaagctcacttcacagatcccgcctccattgccgctcgcgggtatatctctaccagagtcgagatgggcgaggcggccggaatttttatgacagctaccccgcctggcagccgggaccccttcccccaatccaacgcccctatcatggatgaggagcgcgaaattcccgagagaagctggaactctgggcatgaatgggtgacggactttaaaggaaagacagtttggttcgtgccttccatcaaagccggcaacgatatcgctgcctgcctgcggaagaatgggaaaaaggtcattcagcttagcagaaagacctttgactctgagtacgtgaaaacccgcgcgaacgattgggacttcgtggtcacaaccgatatcagcgagatgggagctaattttaaggccgaacgggttattgacccgagacgctgtatgaaacccgtgatcctgacagatggcgaggaacgggtgattctggccgggcctatgcccgtcacccactcctctgctgcccagagacgcggccggatcggaagaaaccctaagaatgagaacgaccaatatatctacatgggcgaacccctcgagaatgacgaggattgcgcgcattggaaagaagccaagatgctgcttgacaacattaatacgccggaggggatcattcctagcatgttcgaacccgagcgcgaaaaagtggatgctatcgacggagagtacagactgcggggcgaggcccgcaagacatttgttgatctcatgagaagaggggacctgcctgtgtggctggcttataaggtcgccgctgaaggaattaactacgccgatcgcaaatggtgtttcgacggcatcaagaataaccagattctcgaggaaaacgtggaggttgagatctggaccaaagaaggggagagaaagaaacttaagccccggtggctggatgcgagaatctattccgaccctctggccctcaaggaatttaaagagttcgctgccggccgcaagtctctgacacttaatctgattaccgaaatgggacggctccccacgttcatgacccagaaagctagaaacgccctggataatctggccgtgctccacacagctgaggcgggcgggcgcgcctacaaccacgctcttagcgagctgccggaaaccctggagacactcctgcttctgaccctcctggccacagtcaccggaggcatctttctgttcctcatgtccgggaagggaattggcaaaatgacgcttggcatgtgctgcatcattacagccagcgtgctgctgtggtatgctcagatccaacctcattggatcgccgcgtctattatcctcgaatttttcctgattgtccttctgatccccgagcccgaaaagcagcggacccctcaggacaatcagctcacctacgtggttattgccatcctgacagtggtggctgccaccatggctaacgagatggggtttctggagaagaccaagaaggatctcggacttggctccatcacgacccaagaaagcgagtccaatattctggacatcgacctgagaccggcctctgcgtggacactctatgccgtcgctaccacattcgttacccccatgctgcggcacagcattgaaaactcctctgtgaatgtgagccttacggccatcgctaaccaggccaccgtcctgatggggctcggaaaaggctggcctctgtccaagatggatattggggtgcccctgctcgctatcggatgttacagccaggttaatcctattacacttaccgccgcgctgctgctcctggtggcccattacgctatcatcggccccggccttcaggccaaagctacacgcgaggcccaaaagagagccgcggctgggattatgaagaaccctaccgtcgacggaatcacggtgattgatctggaaccgatcccctatgaccctaaatttgagaagcagctcggccaggtcatgctgctgattctctgcgtgacacaggttcttatgatgcggaccacatgggccctgtgtgaggctctgaccctcgccaccgggcccatctctacactgtgggaaggaaatcctggccgcttctggaacacgaccatcgccgtgtccatggctaatatttttagagggagctaccttgccggagcgggcctcctgttctctatcatgaaaaacacaaccaatacacggcgcggcaccgggaacattggagagacgctgggcgaaaagtggaaatccagactgaacgccctcggaaagagcgagtttcaaatctataaaaagtctggcattcaggaggtcgatcggacacttgctaaggaaggcatcaaacgcggggagaccgaccaccatgccgtgagcagaggatccgctaagctgcggtggttcgttgaaagaaatatggtgacccccgagggcaaagtcgtggatctgggctgcgggcgcggaggctggtcttactattgtgggggactcaagaacgtgcgggaagttaaaggcctgacaaaaggcgggccggggcacgaggagcctatccccatgagcacctacggctggaatcttgtcagactgcagtccggggtggacgtgtttttcacaccccctgaaaagtgcgatacgctcctgtgtgacattggagagagctcccccaaccctaccatcgaagccggccgcacactgcgggtcctcaatcttgttgagaactggctgaataacaatacccaattctgcattaaagtgctgaacccgtatatgccctctgtgatcgaaaagatggagacactccagagaaaatacgggggagcgctggtccgcaatcctcttagccggaactccacccacgagatgtactgggtgtctaatgccacgggcaacattgttagctccgtgaatatgatctctagaatgctgatcaaccgctttaccatgaagcataaaaaggctacatatgaacccgatgtcgacctcgggagcggaacccggaacattggcatcgagtccgaaattcctaatctggatatcattggcaagagaatcgagaaaattaagcaggaacacgagacaagctggcattacgaccaggaccacccctataaaacctgggcctaccacgggtcttatgagacaaagcaaaccggatccgctagctctatggtgaacggcgttgtgcgcctgctcacgaaaccgtgggatgtcgtgcctatggtgacacagatggccatgaccgacaccacacccttcgggcagcagcgggtctttaaggaaaaggttgatacgagaacccaagagcctaaagaaggaacaaagaaacttatgaagatcaccgctgagtggctgtggaaagagctgggcaagaaaaagacaccccgcatgtgtaccagagaagagttcacacggaaggtgcgctccaatgccgcgctcggggccatctttaccgacgaaaacaaatggaaaagcgctagagaggccgtggaagatggacggttctgggagctggtcgacagagagcggaatcttcatctggaaggcaaatgcgagacgtgtgtgtacaacatgatgggcaagcgcgagaaaaagctcggggagtttggaaaggctaaaggctctagagccatttggtatatgtggctgggggcccggttcctggaatttgaggcgctcggattcctgaatgaggatcactggttttcccgcggcaacagcctttccggggttgaaggcgagggactgcatagactcggctacatcctgcgggacgtgagcaagaaagaagggggagctatgtacgccgatgacaccgccggctgggatacacgcattacccttgaggacctgaagaatgaagagatggtcacaaaccacatgaaaggggagcataagaagctcgctgaagccatcttcaaactgacctatcagaataaggtggttagagtgcagcggcctacgccccgcggaacagtcatggacattatctctagacgggatcagcgcggcagcgggcaagtgggcacctacggactgaacacatttaccaatatggaggctcagctcatcagacagatggaaggcgaggggattttcaaatccatccaacacctgacggccattgaggaaatcgcggttcagaactggcttgccaaggtgggacgggagcgcctgtctagaatggctattagcggcgacgattgcgtcgtgaaaccgatcgacgatcggttcgcctccgctctcaccgccctgaatgacatggggaaggtcagaaaggatatccagcagtgggaaccttctcgcggatggaacgactggacacaagtgcccttttgcagccaccatttccacgagcttgttatgaaagatggccgggtgctggtcgtgccctgtagaaaccaggacgaactcattgggcgcgcgcggatctcccagggcgccggatggtctctgaaggagaccgcttgcctgggcaaaagctatgcccagatgtggacactcatgtactttcatagacgcgatctgcggcttgctgccaatgctatttgttccgccgtgcctagccactgggttccgacctctagaacaacctggtccatccacgcgaagcatgagtggatgacgacagaagacatgctggccgtgtggaaccgcgtctggattcaagagaatccctggatggaagataaaacccctgtggagagctgggaagaggttccctatctcgggaagcgggaggaccagtggtgcggatctctgatcggccttacctccagagctacatgggccaagaacattcagaccgccatcaatcaggtgcgcagcctgatcgggaacgaagagtacacagactatatgccttccatgaaacggttcagacgggaagaggaagaggctggagtcctctggtga

SEQ ID NO: 19663 - RNA, 9876 nt, synthetic construct
  misc_feature 1..9876: note = derived and/or modified CDS sequence (opt5) from DENV-2__KJ189305__SS-prME
  source 1..9876: mol_type = other RNA
accgccggcgtgatcgtcatgctgattcccaccgctatggccttccacctcacgaccagaaatggggaacctcatatgatcgttggacggcaggaaaagggcaagagcctgctttttaagacagaggacggggtgaatatgtgcaccctgatggcgattgatctcggagaactgtgtgaggacacaatcacctacaagtgcccgcttctgagacaaaatgaacccgaggatattgactgttggtgcaattccacatctacctgggtgacgtatggcacctgtacaaccacaggggagcacagacgggaaaagcgcagcgtcgctctcgtgcctcatgttggaatgggcctggagaccagaacggaaacatggatgtcctctgagggcgcctggaagcacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaagaacaggacaaacgctttatctgcaagcattccatggtggatagaggctggggcaacgggtgtggactgttcggcaaagggggaattgtcacatgcgccatgtttacgtgcaaaaagaatatggaaggcaaagttgtgcagcctgagaacctcgaatacaccatcgtgattacaccccacagcggggaggagcatgcggtcggaaatgacaccggcaagcacggcaaagaaatcaagatcacacctcagtcttccattaccgaggccgaactgacggggtatggaaccgtgacaatggagtgtagcccccggaccggccttgatttcaacgaaatggttctgctccaaatggaggacaaggcttggctggtgcaccgccagtggtttcttgatctgccgctcccttggctgcccggggccgacacacagggatctaattggatccagaaggagaccctggtcacgttcaagaaccctcatgctaaaaagcaagacgtggttgtgctcggctcccaggaaggggccatgcacacagccctgaccggcgctacagagattcagatgagctccggaaatcttctgtttaccggccatctcaaatgcagactgcggatggataaacttcaactgaaagggatgtcttacagcatgtgtaccggaaagttcaagatcgtcaaagaaattgcggagacacagcacggcacgatcgtgatcagagtccagtatgagggggacggatccccctgcaagattcccttcgaaatcaccgatctcgagaaacgccatgtgctgggccggctgattacagttaaccctatcgtgaccgaaaaggacagcccggtcaacattgaggccgaacccccttttggggattcttacatcattatcggcgtggagcccggacagctcaaactgaattggttcaagaagggctccagcatcgggcaaatgtttgagacaaccatgagaggagctaaacgcatggccattcttggcgacacggcctgggatttcgggtctctgggaggcgtttttacaagcatcgggaaggctctccaccaggtgttcggcgccatttacggagcggctttttccggcgtctcttggaccatgaaaatcctgattggggtgatcatcacctggattggaatgaacagccggtccacaagcctgtctgtgtcccttgttctcgtcggcgtggtgaccctgtatctgggggccatggtccaggccgacagcggatgtgtggtttcttggaagaataaagaactcaagtgcggctccgggatcttcattacagataacgtgcacacgtggaccgagcagtacaagtttcaacctgaaagcccctccaaactggcttctgccatccagaaggctcatgaggaaggcatttgtggaatcagaagcgtcacacgccttgagaatctgatgtggaaacagatcaccccggagctcaaccacattctgtccgaaaatgaggtgaagctgacaatcatgaccggcgacattaaagggatcatgcaggccggaaagcggtctcttagacctcaacccacggaactcaaatatagctggaagacctggggcaaggcgaaaatgctgtccacagagagccataaccagaccttcctgattgatgggcctgaaacagccgagtgccccaataccaaccgcgcttggaactctctcgaggttgaagactacggatttggcgtgttcacaaccaacatctggctgaaacttaaagagaagcaggacgtcttttgtgattccaaactgatgagcgccgctatcaaggacaatcgggccgtgcacgcggatatgggctattggattgaatctgccctcaacgacacgtggaagatggagaaggctagcttcatcgaggttaagagctgccactggcctaaatctcatacactgtggagcaatggggtgctggaatccgagatgattatccccaagaacttcgccggaccggctagccagcacaactacagacctggctattacacccaaaccgccgggccctggcatcttggaaaactcgaaatggattttgacttctgtgagggcacaaccgtcgtggtgacggaagattgcgggaatcgcggaccctctctgcggacaaccacagcctccggcaagctgattaccgagtggtgctgtagaagctgcacactccctccgctgcggtaccgcggcgaggacgggtgttggtatggaatggaaatcagaccccttaaggagaaagaagagaacctggtcaattccctcgttaccgctggccacgggcagattgataacttttctctgggagtgctgggcatggcgcttttcctcgaagagatgctgcggacgagagtggggaccaagcatgccatcctgctcgtcgctgtgagctttgttacactgatcaccggaaatatgtccttccgcgaccttggccgggtgatggtcatggtgggcgccacaatgaccgatgacattgggatgggagttacgtacctggccctcctggctgcctttaaagtgagacctacattcgcggctggcctgcttctgcgcaagctcacctctaaagagctgatgatggccacaatcgggattgccctcctgagccagtccaccatccccgaaaccattcttgagctgacagatgctctcgccctgggaatgatggtcctgaagatcgtgagaaacatggaaaagtatcaacttgcggttacgatcatggctatttcttgcgtgcctaatgccgtcatcctgcagaacgcctggaaagtgagctgtaccattctcgctgccgtgtccgtcagccccctgctcctgacatcttcccagcagaaggctgactggatccctcttgccctgaccattaaaggcctcaatcccacagcgatctttctgaccacgctgagccggacatctaagaaacgctcctggccgcttaacgaggccatcatggctgttgggatggtgagcattctggcctcttccctcctgaagaatgacatccctatgaccggacccctcgtggctggcggcctgcttaccgtctgctacgtgctgacagggagaagcgccgatctggaactcgagcgggccgctgacgttaaatgggaggatcaagcggaaatttccggaagctctcctatcctgagcattaccatctccgaggacggctctatgagcattaagaacgaagaggaggaacagacacttacgatcctgatccgcaccgggctcctggtgatttccggagtcttccccgtgtctatcccgattacagccgctgcctggtatctctgggaggttaagaaacagagagccggcgtgctgtgggatgtcccttctccccctcccgtggggaaggctgaacttgaggacggagcctaccggatcaaacagcgcggcattctgggctattcccaaatcggggcgggagtctacaaggaaggcacctttcacacaatgtggcacgtgaccagaggggctgttctgatgcatcggggaaaacgcatcgagccctcctgggccgatgtgaagaaggacctcattagctacggcgggggatggaaactggagggcgaatggaaggagggcgaagaggtccaggtgcttgccctggaacctgggaaaaatccgagagctgttcagacgaagcccggaatcttcaaaaccaacacaggcaccattggggccgtgtccctcgattttagccctggaacatctggctcccccatcgtcgacaagaaggggaaagtggtgggactgtatggcaatggcgttgtcacccggagcggggcgtacgtgtctgctattgcccagacagagaagtccatcgaggataaccctgaaatcgaggacgatattttccgcaagaagcgcctcacgatcatggacctgcaccccggagccggcaaaaccaagcggtatcttcctgctattgtgagagaagccatcaagcgcgggctgcggacactgattctcgctccgaccagagtcgtggccgcggagatggaagaggccctgcgcggacttcccatccggtaccaaacccctgctattaaagccgagcatacaggcagagaaatcgttgacctgatgtgtcacgctacgttcaccatgcgcctcctgagccccgtgcgggtccctaactataatctcatcattatggatgaggcccattttacagaccccgcctccatcgctgcgagagggtacatttctacccgggtggaaatgggcgaggccgctggaatcttcatgacagccaccccgcctggcagccgcgatccctttccccagtccaacgcccctattatggacgaggaaagagagatccccgaacggagctggaactctgggcacgagtgggttacggatttcaagggaaaaacagtgtggtttgtcccttccatcaaggctggcaacgacattgccgcgtgcctgcgcaaaaatgggaagaaggtgatccagcttagcagaaaaaccttcgattctgaatatgttaagacccgggctaacgactgggattttgtggtcacaaccgacattagcgagatgggagccaatttcaaagccgagagagtgatcgatccgcgccggtgtatgaagcccgtgattctgacagacggcgaagagagagtcatcctggctgggcctatgcccgttacccactcctctgccgcgcaacgccggggcagaatcggacgcaaccctaaaaatgaaaacgaccagtacatttacatgggcgagcccctcgaaaatgatgaggactgcgcccattggaaggaggctaaaatgctgcttgataacatcaatacgccggaagggattatccctagcatgtttgagcccgaacgggagaaggtggacgccattgatggagaatatagactgcgcggcgaggctagaaagacattcgtggacctcatgcggcgcggggatctgcctgtctggctggcctacaaagtggctgccgagggaatcaactatgcggacagaaagtggtgttttgatggcattaaaaataaccagatcctcgaagagaacgttgaagtggagatctggaccaaggagggggaacggaagaaacttaaaccccgctggctggacgccagaatttactccgatcctctggctctcaaagagttcaaggagttcgccgctggccggaaatctctgacacttaatctgatcaccgagatgggaagactccccacgtttatgacccagaaggcccgcaacgccctggacaatctggctgtcctccacacagcggaagccggcgggcgggcttataaccatgcccttagcgagctgccggagaccctggaaacactcctgcttctgaccctcctggccacagtgaccggaggcattttcctgtttctcatgtccgggaaaggaatcggcaagatgacgcttggcatgtgctgcattatcacagctagcatcctgctgtggtacgcccaaattcagcctcactggatcgcggcctctattatcctcgagttctttctgattgttcttctgatccccgaacccgagaagcagagaacccctcaggataatcaactcacctatgtggtcatcgctattctgacagtggtcgccgctaccatggccaacgaaatggggttcctggagaaaacaaagaaagacctcggacttggctccatcacgacccaggagagcgaatccaatattctggacatcgatctgcgcccggcgtctgcctggacactctacgctgtggccaccacatttgttacccccatgctgcggcacagcattgagaactcctctgtgaatgtgagccttacggctatcgccaaccaggctaccgtcctgatggggctcggaaagggctggcctctgtccaaaatggacattggggttcccctgctcgccatcggatgttacagccaggtgaatcctatcacacttaccgcggccctgctgctcctggtggctcattatgccattatcggccccggccttcaagctaaggccacaagagaagcccagaagcgggcggctgccgggattatgaaaaaccctaccgtcgatggaatcacggtgattgacctggagccgatcccctacgatcctaagttcgaaaaacagctcggccaggttatgctgctgatcctctgcgtgacacaagtccttatgatgcgcaccacatgggctctgtgtgaggccctgaccctcgccaccgggcccatttctacactgtgggagggaaatcctggcagattttggaacacgaccatcgctgtgtccatggccaatattttccgggggagctatcttgcgggagccggcctgctcttttctatcatgaagaacacaaccaatacacgcagaggcaccgggaacattggagaaacgctgggcgagaaatggaagtcccggctgaacacactcgggaaaagcgagttccagatctacaagaagtctggaatccaggaggtcgaccgcacccttgctaaagagggcattaagagaggggaaaccgatcaccatgccgtgagccggggatccgctaaactgcgctggtttgttgagagaaatatggtgacacccgaaggcaaggtcgtggacctgggctgcgggcggggaggctggtcttattactgtgggggactcaaaaacgttagagaggtgaagggcctgaccaaagggggaccgggccacgaagaacctatccccatgagcacatatggctggaatcttgtccgcctgcaatccggggtggatgtgttcttcacgccccctgagaaatgcgacaccctcctgtgtgatattggagaaagctcccccaaccctacaatcgaggccggccggaccctgagagttctcaatcttgtcgaaaactggctgaataacaatacacagttttgcattaaggtgctgaacccgtacatgccctctgtgatcgagaaaatggaaaccctccagcgcaagtacgggggagcgctggtccggaatcctcttagcagaaactccacgcatgagatgtattgggtttctaatgccaccggcaacatcgtgagctccgtgaatatgatttctcgcatgctgatcaaccggttcacaatgaaacacaagaaggctacctacgagcccgacgtcgatctcgggagcggaacaagaaacattggcatcgaatccgagattcctaatctggacatcattggcaaacgcatcgaaaagatcaaacaggagcacgaaaccagctggcattatgaccaagatcacccctacaagacatgggcctatcatgggtcttacgagaccaaacagacgggatccgctagctctatggtgaacggcgttgtgcggctgctcacaaagccgtgggacgtcgtgcctatggttacccagatggccatgaccgatacaacgccctttgggcagcaaagagtgttcaaggagaaagtcgacacccgcacacaggaacctaaggagggaaccaagaaacttatgaaaattacagctgaatggctgtggaaagagctgggcaaaaagaagacaccccggatgtgtacaagagaggaatttacccgcaaagtgagatccaatgccgcgctcggggccatcttcacggatgagaacaagtggaaaagcgctcgggaagccgtggaggacggacgcttttgggaactggtcgatagagagcggaatcttcacctggagggcaagtgcgaaacctgtgtttataacatgatgggcaaaagagagaagaagctcggggagttcggaaaagctaagggctctcgggccatttggtacatgtggctgggggcccgctttctggagttcgaagcgctcggatttctgaatgaggaccactggttctccagaggcaacagcctttccggggtggagggcgaaggactgcatcggctcggctacatcctgcgcgatgtggggaaaaaggagggaggcgctatgtatgccgacgatacagccgggtgggacaccagaattacacttgaagacctgaaaaatgaggaaatggtcaccaaccacatgaagggagagcataagaaactcgctgaggccatctttaagctgacgtaccagaataaagtggttcgggtgcagcgccctacacccagaggcaccgtcatggatatcattagccggcgcgaccaaagagggtctggccaggtgggaacatatggcctgaacaccttcacgaatatggaagctcagctcatccggcaaatggagggggaaggaattttcaagagcatccagcacctgaccgccacagaggagattgcggttcagaactggcttgcccgcgtgggcagagaacggctgtcccgcatggctatctctggggatgactgcgtcgtgaaaccgatcgatgacagatttgccagcgctctcaccgccctgaatgatatgggaaaggttcggaaggacattcagcaatgggagccttccagaggctggaacgattggacacaggtgcccttctgctctcatcactttcacgaacttgtcatgaaagacgggcgcgtgctggtcgtgccctgtcggaaccaggatgagctcatcggcagagcgcgcattagccagggagccggctggtccctgaaggaaaccgcttgcctggggaaatcttacgcccaaatgtggacactcatgtatttccatcggagagacctgcgccttgctgccaatgctatctgtagcgccgttccttcccactgggtgccgaccagccggacgacatggtctattcatgcgaagcacgagtggatgaccaccgaggatatgctggccgtctggaacagagtgtggatccaggaaaatccctggatggaggacaaaacacctgtggaatcctgggaggaagttccctacctcggaaagcgcgaggaccagtggtgcggcagcctgattgggcttacctctcgggctacatgggccaagaacatccagacggccatcaatcaagtgagatccctgattggaaacgaggaatataccgattacatgcctagcatgaaacgctttcggagagaggaagaggaagctggcgtcctctggtga

SEQ ID NO: 19664 - RNA, 9876 nt, synthetic construct
  misc_feature 1..9876: note = derived and/or modified CDS sequence (opt5) from DENV-2__FJ898451__SS-prME
  source 1..9876: mol_type = other RNA
accgccggagtgatcgtgatgctgattcccacagctatggccttccacctcacgacccggaatggggagcctcatatgatcgttggacggcaggaaaagggcaagagcctgctttttaagacagaggacggggtgaatatgtgcaccctgatggcgattgatctcggagaactgtgtgaggacacaatcacctacaagtgcccgcttctgcgccaaaatgaacccgaggatattgactgttggtgcaattccacatctacctgggtgacgtatggcacctgtacaaccacaggggagcacagacgggaaaagcgcagcgtcgctctcgtgcctcatgttggaatgggcctggagaccagaacggaaacatggatgtcctctgagggcgcctggaagcacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaagaacaggacaaacgctttatctgcaagcattccatggtggatagaggctggggcaacgggtgtggactgttcggcaaagggggaattgtcacatgcgccatgtttacgtgcaaaaagaatatggaaggcaaaatcgttcagcctgagaacctcgaatacaccattgtgatcacaccccacagcggggaggagcatgcggtgggaaatgacaccggcaagcacggcaaagaaatcaagattacacctcagtcttccaccacggaggccgaactgaccgggtatggaacagtcaccatggagtgtagcccccggacaggccttgatttcaacgaaatggtgctgctccaaatggaggacaaggcttggctggttcaccgccagtggtttcttgatctgccgctcccttggctgcccggggccgacacccagggatctaattggatccagaaggagacgctggtgacattcaagaaccctcatgctaaaaagcaagacgtcgtggttctcggctcccaggaaggggccatgcacaccgccctgacaggcgctaccgagattcagatgagctccggaaatcttctgtttaccggccatctcaaatgcagactgcggatggataaacttcaactgaaagggatgtcttacagcatgtgtacaggaaagttcaagatcgtgaaagaaattgcggagacgcagcacggcaccatcgtcatcagagtgcagtatgagggggacggatccccctgcaagattcccttcgaaatcacagatctcgagaaacgccatgtcctgggccggctgattaccgtgaaccctatcgttacagaaaaggacagcccggtgaacattgaggccgaacccccttttggggattcttacatcattgtcggcgtggagcccggacagctcaaactgaattggttcaagaagggctccagcatcgggcaaatgtttgagaccacgatgagaggagctaaacgcatggccatccttggcgacacagcctgggatttcgggtctctgggaggcgtttttaccagcattgggaaggctctccaccaggtgttcggcgccatctacggagcggctttttccggcgtctcttggaccatgaaaattctgatcggggtgattatcacatggatcggaatgaacagccggtccaccagcctgtctgtgtcccttgttctcgtcggcgtggtgacactgtatctgggggtcatggtgcaggccgacagcggatgtattgtttcttggaagaataaagaactcaagtgcggctccgggatcttcattacggataacgtgcacacctggacagagcagtacaagtttcaacctgaaagcccctccaaactggcctctgctatccagaaggcccatgaggaaggcatttgtggaatcagaagcgtcacccgccttgagaatctgatgtggaaacagatcacaccggagctcaaccacattctgtccgaaaatgaggtgaagctgaccatcatgacgggcgacattaaagggatcatgcaggctggaaagcggtctcttagacctcaacccaccgaactcaaatatagctggaagacatggggcaaggccaaaatgctgtccaccgagagccataaccagacattcctgattgatgggcctgaaaccgcggagtgccccaatacaaaccgcgcctggaactctctcgaggttgaagactacggatttggcgtgttctccaccaacatctggctgaaacttcgggagaaacaggacgtcttttgtgatagcaagctgatgtctgctgccatcaaagacaatagagctgtgcacgccgatatgggctattggattgaatccgttctcaacgacacgtggaagatggagaaggcgagcttcatcgaggtgaaatcttgccactggcctaagagccatacactgtggtccaatggggtcctggaaagcgagatgattatccccaaaaacttcgccggaccggtgtctcagcacaactaccgccctggctatcatacccaaaccgctgggccctggcaccttggaaagctcgaaatggattttgacttctgtgagggcacaaccgtggtcgttacggaagattgcgggaatcggggaccctccctgagaacaaccacagccagcggcaaactgattaccgagtggtgctgtcggtcctgcacactccctccgctgcgctacagaggcgaggacgggtgttggtacggaatggaaatccggccccttaaggagaaggaagagaacctggtcaattctctcgtgaccgctggccatgggcagattgataactttagcctgggagtcctgggcatggcccttttcctcgaagagatgctgagaacgcgcgtggggaccaaacacgccatcctgctcgttgctctgtcctttgtgacacttatcaccggaaatatgtctttccgggacctgggcagagtcatggtgatggttggcgcgacaatgaccgatgacattgggatgggagtgacgtatctcgccctgctggctgcctttaaggtccgccctacattcgccgctggccttctgctcagaaaactgaccagcaaggagctcatgatggccacaatcgggattgcgctgctttcccagtctaccctgcccgaaaccatcctcgagctgacagatgctctggcccttggaatgatggtgctgaaaattgttcggaacatggaaaagtaccaactcgccgtgacgatcatggctatcagctgcgtccctaatgccgtgattctgcagaacgcgtggaaggtgtcctgtaccatcctcgctgccgtcagcgtttctcccctgcttctgacatccagccagcagaaagccgactggattcctctcgctctgaccatcaagggcctgaatcccacagccatttttcttaccacgctgtctcgcacatccaaaaagagaagctggccgctcaacgaggctatcatggccgtggggatggtgtctatcctggcgtccagcctcctgaaaaatgacattcctatgaccggaccccttgtcgccggcggcctgctgaccgtgtgctatgttctcacagggcggtccgctgatctggaacttgagcgcgccgctgacgtgaagtgggaggatcaagccgaaatcagcggatctagccctattctgtccatcaccatttctgaggacggcagcatgtccatcaaaaacgaagaggaggaacagacactcacgattctgatcagaaccgggctcctggtcatctctggagtgttccccgttagcattccgatcacagccgctgcgtggtacctttgggaggtgaagaagcagcgggccggcgtcctgtgggatgtgccttctccccctcccgtcgggaaagctgaactggaggacggagcctatcgcattaagcagagaggcatcctcggctacagccaaattggggccggagtgtataaagaaggcacctttcacacaatgtggcatgttaccagaggggctgtgctgatgcaccgcggaaagagaatcgagcccagctgggccgatgtcaaaaaggaccttatctcctacggcgggggatggaagctggagggcgaatggaaagagggcgaagaggtgcaggttctcgcgctggaacctgggaagaatccgcgggctgtgcagacgaaacccggaattttcaagaccaacacaggcaccatcggggccgtcagcctcgatttttctcctggaacatccggcagccccattgtggacagaaaagggaaggtggttggactgtacggcaatggcgtcgtgacccgctctggggcctatgtgtccgctatcgcccagacagaaaagagcattgaggataaccctgaaatcgaggacgatatcttccggaaaaagagacttacgattatggacctgcatcccggagcgggcaaaaccaagcgctacctgcctgctatcgtccgggaagccattaaaagagggctccgcacactgatccttgccccgacccgggtggttgctgccgagatggaagaggctctgagaggactccccattcgctatcaaacccctgccatccgggcggagcacacaggcagagaaattgtggacctgatgtgtcatgccacgttcaccatgcggctcctgtcccccgtccgcgtgcctaactacaatcttatcatcatggatgaggctcactttacagaccccgcctctattgctgccagagggtatatcagcacccgggttgaaatgggcgaggccgctggaattttcatgacagcgaccccgcctggctcccgcgatccctttccccagagcaacgcccctatcatggacgaggaaagagagattcccgaacggtcttggaactccgggcacgagtgggtgacggatttcaagggaaagacagtctggtttgtgcctagcatcaaagctggcaacgacatcgccgcctgcctgagaaagaatgggaaaaaggttattcagctgtctcgcaaaaccttcgatagcgaatacgtgaagacccgggctaacgactgggattttgtcgtgacaaccgacatctccgagatgggagccaatttcaaggcggagagagtgattgatccgcgccggtgtatgaaacccgtcatcctcacagacggcgaagagagagttattctggctgggcctatgcccgtgacccattctagcgccgcccaacgccggggcagaatcggacgcaaccctaagaatgaaaacgaccagtatatctacatgggcgagccccttgaaaatgatgaggactgcgctcactggaaagaggccaagatgctgctcgataacattaatacgccggaagggatcattccttccatgtttgagcccgaaagagagaaagtggacgcgatcgatggagaataccggctgcgcggcgaggccagaaagacattcgtcgacctgatgcggcgcggggatctccctgtgtggcttgcttataaagttgccgctgagggaattaactacgccgacagaaagtggtgttttgatggcatcaagaataaccagattctggaagagaacgtggaagtcgagatctggaccaaagagggggaacggaagaaactgaagcccagatggctcgacgctcgcatctattctgatcctctggcccttaaagagttcaaggagttcgcggccggccggaagtccctgacactcaatctgattaccgagatgggaagactgcccacgtttatgacccagaaagctcgcaacgccctcgacaatcttgctgtgctgcatacagccgaagttggcgggcgggcctacaaccacgctctgtccgagctcccggagaccctggaaacacttctgctcctgaccctgctcgcgacagtgaccggaggcatcttcctttttctgatgagcgggaagggaattggcaaaatgacgctgggcatgtgctgcatcattacagcctctatcctcctgtggtatgctcaaatccagcctcactggattgccgcctccatcattcttgagttctttctgatcgtcctcctgattcccgaacccgagaagcagagaacccctcaggataatcaactgacctacgtggtcatcgctatcctcacagtggttgccgcgaccatggccaacgaaatggggttccttgagaaaacaaagaaggacctgggatttggcagcattacgacccaggagtccgaatctaatatcctggacattgatctccggccggctagcgcctggacactgtatgctgtggccaccacattcgtgacccccatgcttcgccattccatcgagaactctagcgtcaatgtttccctgacggcgattgccaaccaggctaccgtgctcatggggctgggaaaaggctggcctctgagcaagatggacatcggggtgcccctccttgccattggatgttactctcaggtcaatcctatcacactgaccgctgccctgctcctgcttgtggctcactacgccatcattggccccggcctgcaagcgaaagccacaagagaagctcagaagcgggccgctgccgggatcatgaaaaaccctaccgttgatggaattacggtgatcgacctcgagccgattccctatgatcctaagtttgaaaagcagctgggccaggtcatgctgctcatcctttgcgtgacacaagtcctgatgatgcgcaccacatgggccctgtgtgaggcgctcaccctggctaccgggcccatctccacactttgggagggaaatcctggcagattctggaacacgaccattgccgtgagcatggctaatatctttcgggggtcttacctggccggagccggcctcctgttctccattatgaaaaacacaaccaatacacgcagaggcaccgggaacgttggagaaacgctgggcgagaagtggaaaagccggctcaacgctcttgggaagtctgaatttcagatctataaaaagagcggcattcaggaggtggaccgcacactggccaaagagggcatcaagagaggggaaaccgatcatcacgcggtctcccggggatctgccaagctgagatggttcgtggagcgcaatatggttacccccgaaggcaaagtggtcgacctcggctgcgggcggggaggctggagctactattgtgggggactgaagaacgtgagagaggtgaaaggccttacaaaagggggaccgggccatgaggaacctatccccatgtccacctacggctggaatctggttcgcctccaaagcggggtcgatgtgttctttacaccccctgagaaatgcgacacgctgctgtgtgatattggagaatcctctcccaaccctaccatcgaggctggccggacactcagagtgcttaatctggtcgaaaactggctgaataacaatacccagttctgcattaaggttctcaacccgtatatgcccagcgtgatcgagaagatggaaacactgcagcgcaaatacgggggagcccttgtgcggaatcctctgtccagaaactctacccacgagatgtactgggtcagcaatgctacgggcaacattgtgtcctctgttaatatgatcagccgcatgctcatcaaccggtttaccatgaagcacaaaaaggccacatatgagcccgacgtggatctggggtccggaaccagaaacattggcatcgaaagcgagattcctaatctggacatcattggcaaacgcatcgaaaagattaagcaggagcatgaaacatcttggcactacgaccaagatcatccctataaaacctgggcgtaccacgggtcctatgagacaaagcagaccggaagcgcctcttccatggtcaacggcgtggttcggctccttacgaaaccgtgggacgtggtccctatggtgacacagatggctatgaccgataccacacccttcgggcagcaaagagtgtttaaggagaaagtcgacacgcgcacccaggaacctaaggagggaacaaagaaactgatgaagatcaccgccgaatggctgtggaaagagctcggcaagaaaaagacacccagaatgtgtacccgggaggagttcacacgcaaagttagaagcaatgctgccctgggggctatctttaccgatgagaacaagtggaagtctgcccgggaagcggtggaggacggaagattctgggaacttgtggatcgggagcgcaatctgcacctcgagggcaaatgcgaaacgtgtgtctacaacatgatgggcaagagagagaaaaagctgggggaatttggaaaagccaagggctcccgggctatttggtatatgtggctgggggcccgcttcctcgagtttgaagctctgggattccttaatgaggaccattggtttagcagaggcaactccctgagcggggtggagggcgaaggactccaccggctgggctacatccttcgcgaggttgggaagaaagaaggaggcgccatgtacgccgatgacaccgcggggtgggatacaagaattaccctggaggacctcaagaatgaagagatggtgacaaaccatatgaaaggagagcacaagaaactggctgaagccatcttcaagctgacctatcagaataaggtcgtgcgggttcagcgccctacgcccagaggcacagtgatggacattatctctcggaaagatcaacgcgggagcggccaggtcggaacctacggcctcaacacattcaccaatatggaggcccagctgatcagacaaatggaaggggagggaatttttaagtccatccagcatcttacggctaccgaggaaattgccgtgcagaactggctggctcgggttggccgcgagagactctctcggatggccatcagcggggacgattgcgtggtcaaaccgattgacgatagattcgcgtccgccctgacagctcttaatgacatgggaaaggtgcgcaaagatatccagcaatgggaaccttctcggggctggaacgactggacccaggtccccttttgcagccaccacttccatgagctggtgatgaaggatgggagagttctcgtggtcccctgtcgcaaccaggacgaactgatcggccgggccagaatttcccagggagctggctggtctctgaaggagacagcctgcctcgggaaaagctatgcgcaaatgtggaccctgatgtactttcaccgccgggatcttagactggccgctaatgccatctgttccgctgtgcctagccattgggtgccgacatctcgcaccacgtggtccattcacgccaagcacgagtggatgacaaccgaagacatgctcgctgtttggaaccgggtgtggatccaggagaatccctggatggaagataaaacccctgtcgagagctgggaagaggtgccctatctgggaaagagagaggaccagtggtgcggctctcttattgggctgacatcccgcgccacctgggcgaaaaacatccagacagccattaatcaagttcggagcctcatcggaaacgaagagtacacggactatatgccttccatgaagagattccggagagaagaggaagaggctggcgtgctgtggtga

SEQ ID NO: 19665 - RNA, 9876 nt, synthetic construct
  misc_feature 1..9876: note = derived and/or modified CDS sequence (opt5) from DENV-2__HM488257__SS-prME
  source 1..9876: mol_type = other RNA
accgccggaatcattatcatgatgattcccacggtgatggctttccacctgacgaccagaaacggggaacctcatatgatcgtcagccggcaggaaaagggaaaaagcctcctgtttaagacagagaatggcgttaacatgtgcacccttatggccatggacctgggggaactctgtgaggatacaattacctacaattgcccgctgcttcgccaaaacgaacccgaggacatcgattgttggtgcaattctacaagcacctgggtgacgtatggaacctgtacagtgaccggcgagcacagacgggaaaaacgctccgtcgcgctggtgcctcatgttgggatgggactcgagacaagaaccgaaacgtggatgtctagcgagggcgcttggaagcacgcccagcggatcgagacatgggtgctgcgccatcccggcttcaccattatggccgctatcctggcctacacaattgggaccacctattttcagagagtcctcatcttcattctgcttacagctgtggccccttccatgacgatgcggtgcatcggaatttctaaccgcgactttgttgaaggcgtgagcgggggatcctgggtcgatatcgtgctggagcacggcagctgtgtgaccacaatggcgaaaaataagcccaccctcgacttcgaactgatcaagacagaggccaaacaccctgctacccttagaaagtactgcattgaagccaaactgacgaacacaaccaccgcttctcggtgtccgacacagggggagccctccctcaatgaggaacaagataagcgctttgtctgcaaacatagcatggttgacagaggatggggcaacggctgtgggctgttcggaaagggcgggatcgtgacctgcgccatgtttacatgcaagaaaaatatggagggaaagattgtgcagcctgaaaacctggagtatacgatcgtcattacaccccactctggcgaagagaatgcggtggggaacgatacaggaaaacatggcaaggagatcaaagttacccctcagtccagcatcacagaagccgagctcaccggctacgggacggtgaccatggaatgttctccccggacaggactggacttcaatgagatggtccttctgcagatggaaaacaaggcttggctcgtgcaccgccaatggtttctggatcttccgctgccttggctccccggcgccgacacccaggggtccaactggattcagaaagagacactggttaccttcaagaatcctcacgctaagaaacaggatgtggtcgtgctgggaagccaagagggcgccatgcatacggccctcacaggggctaccgaaatccagatgtcctctggcaacctgctttttacaggacacctgaagtgcagactccggatggacaaactgcagcttaagggcatgagctattccatgtgtaccgggaaattcaaggtcgtgaaggagattgcggaaacccaacatggaacaatcgttattagagtgcagtacgagggcgacgggagcccctgcaaaatccccttcgagatcatggatctggaaaagcgccacgtcctcggacggctgattacggtgaatcctatcgttaccgagaaagactctccggtgaacattgaagccgagcccccttttggcgattcctacatcattgtcggggtggaacccggccagctgaagctcagctggttcaaaaagggatctagcatcggccagatgtttgagacaaccatgagaggggctaagcgcatggccattctgggagacacagcctgggatttcggctcccttgggggagtgtttacctctatcggcaaagctctgcatcaagttttcggggccatctatggcgcggcttttagcggagtctcctggacgatgaagattctcatcggcgtggtgattacatggatcgggatgaatagccggtctacctccctgagcgtctctctggtgcttgttggagtggtcaccctctacctgggcgtgatggttcaggccgactccgggtgtgtggtcagctggaaaaacaaggagctgaaatgcggatccggcattttcatcacagataatgtgcacacctggacagaacagtataagtttcagcctgagtctcccagcaagctcgcctccgctatccaaaaagcccacgaagaggggatttgtggcatcagatctgttacgcgcctggaaaaccttatgtggaagcagattaccccggagctgaatcatatcctcagcgagaacgaagtgaaactgacaattatgaccggagacatcaagggcatcatgcaggctgggaaacggtccctgagacctcagcccacagagcttaagtacagctggaaagcctggggaaaggcgaagatgctctctaccgaactgcacaatcatacgttcctgattgatggccctgagaccgccgaatgccccaacacaaatcgcgcttggaactccctcgaggtcgaggactatgggtttggagtgttcaccacaaatatctggctgaaacttaaggaacggcaagatgtgttttgtgacagcaaactgatgtctgccgctattaaggacaacagagccgtccacgcggatatgggctactggatcgagtccgccctcaacgacacctggaaaattgaaaaggctagcttcatcgaggttaagtcttgccactggcctaaaagccatacactgtggtccaatggcgtgctggagagcgaaatgatcattcccaagaacttcgccgggccggtgtctcagcacaattatcgccctggataccatacccagacggctggcccctggcaccttgggcggctcgagatggattttgacttctgtgaaggaacaaccgtcgtggttaccgaggattgcggcaacagagggccctccctgcggacaaccacggccagcggaaaactgatcacagaatggtgctgtcgctcctgcaccctccctccgctgagataccggggcgaggacggctgttggtatgggatggagattagaccccttaaggaaaaagaggaaaatctggtgaactctctcgtcacagccggacatggccagatcgataattttagcctgggggtgctgggaatggctcttttcctcgaggaaatgctgcgcacccgggttggcacaaagcacgcgattctgctcgtggccgtctcctttgtgaccctgatcacggggaacatgtctttcagagaccttggacgcgttatggtgatggtcggcgctaccatgacagatgacattggcatgggggtgacctacctggccctcctggccgcttttaaggtgagacctacatatgccgcgggactgcttctgcggaaactcaccagcaaggagctgatgatgacgacaatcggcatcgtcctcctgtcccaatctaccattcccgagacaatccttgaactgaccgatgctctcgccctggggatgatggttctgaaaattgtgcgcaatatggagaagtaccagcttgccgtgaccatcatggctattctgtgcgtccctaacgccgtgatcctccagaatgcgtggaaagttagctgtacaacgctggctatggtgtccgtcagccccctcctgcttacctcttcccaacagaaggccgactggatccctctggccctcacaattaagggactgaaccccaccgctatcttcctgacaacccttagcagaacgtctaaaaagcggtcctggccgctgaatgaagccattatggctgtgggcatggttagcatcctcgcctcttccctgctcaaaaacgatattcctatgacagggcccctggtggcgggaggccttctgaccgtctgctatgtgctgaccggccgcagcgccgacctcgagctggaaagagctgccgacgtccggtgggaggagcaggctgaaatctccgggagctctcctatccttagcattacaatctccgaggatggatctatgagcattaagaatgaagaggaggaacagaccctgacaatcctcattcgcacgggcctgctcgtgatctccgggctgtttcccgtttctattccgatcaccgccgccgcttggtacctttgggaggtgaaaaagcaaagagcgggagtcctgtgggacgtgccttctccccctcccgttggcaaagccgaactggaggatggggcttatcggatcaagcagaagggcattctcggctactcccagatcggcgccggggtgtacaaagaaggaacattccacaccatgtggcatgtcacacgcggcgccgtgctgatgcacaaggggaaaagaattgagccctcctgggctgacgtgaagaaagatcttatcagctatggaggcgggtggaagctggagggagaatggaaggagggcgaagaggttcaggtcctcgccctggaacctggcaaaaacccgcgggcggtgcaaaccaagcccgggctctttaaaacgaacaccggaacaattggcgctgtgtccctggacttcagccctgggacctctggatcccccatcgtcgataagaaaggcaaggtggttgggctttacggaaatggcgtggtcacaagaagcggcacctatgtgtctgccatcgcccagacagagaagtccattgaggacaaccctgaaatcgaggatgacatttttcgcaaaaagcggctgacgatcatggatctgcatcccggggctggaaaaaccaagagatacctccctgccattgttcgcgaagcgatcaaacggggcctgagaacacttatcctggctccgacccgcgtggtcgccgccgagatggaagaggctctccgggggctgcccattagatatcagacccctgccatccgcgctgagcacacaggacgggaaattgtggacctcatgtgtcatgccacgttcaccatgagactgcttagccccatccgggttcctaattacaacctgattatcatggatgaggcgcacttcacagaccccgcctccattgctgcccgcggctatatctctaccagagtggaaatgggggaggctgccggcatctttatgacagccaccccgcctggaagccgggaccccttcccccagtccaatgctcctattatggatgaggaacgcgagatccccgaaagaagctggaactctggccacgagtgggtcacggactttaaggggaagacagtgtggttcgtgccttccattaaagcgggaaatgatatcgccgcttgcctgcggaagaacggcaaaaaggtcattcaactcagcagaaaaacctttgactctgaatacatcaagacccgcacaaatgattgggacttcgttgtgaccacagatatcagcgagatgggggccaactttaaggccgagcgggtgattgacccgagacgctgtatgaaacccgtcatcctgaccgatggagaagaacgggtgattcttgctggccctatgcccgttacgcattcctctgccgcgcagagacgcgggcgggtgggcagaaatcctaagaacgaaaatgaccagtacatctatatgggagagcccctggaaaacgatgaggactgcgctcactggaaagaggccaagatgctcctggacaatattaacacaccggaaggcatcatccctagcatgttcgagcccgaacgcgagaaagtcgatgccattgacggggaatacagactgcggggagaggctcgcaagacctttgtggatctcatgagacggggcgaccttcctgtttggctggcctatcgcgtggcggccgaggggatcaactacgctgatagacggtggtgtttcgacggagtcaaaaataaccaaattctggaagagaatgtggaagtcgagatctggacaaaggagggcgaaagaaagaaactcaagccccgctggctggatgcccggatttattccgaccctcttgctctgaaagagtttaaggagttcgccgctgggagaaaatctctcaccctgaacctgatcacggagatgggccgcctccccaccttcatgacacagaaggcccggaatgcgcttgataacctggccgtgctgcataccgctgaagccggaggcagagcttacaatcacgccctcagcgagctgccggagacacttgaaaccctgctcctgctgacactccttgccaccgttacaggcgggatttttctgttcctgatgtccgggaaggggatcggaaaaatgacactcggcatgtgctgcatcattaccgctagcatcctgctttggtatgcgcagattcagcctcactggatcgccgcttctattatcctggagtttttcctcatcgtgctgctgattcccgaacccgagaagcaacggacccctcaggacaaccagctcacatacgtggtcatcgccattcttaccgttgtggccgctacaatggccaatgaaatgggctttctggagaaaacgaagaaagatttcgggctgggatccatcaccacacagcaaccggagagcaacattctcgacatcgatctgcgccccgcgtccgcctggaccctttacgctgtggccacaacctttatcacgcctatgctgagacattctattgaaaatagctccgtcaacgtgtctctcaccgctatcgccaatcaggcgacagttctgatgggcctggggaagggatggcccctcagcaagatggacattggcgtgcctcttctggccatcgggtgttattcccaggtcaaccccattaccctgacagctgccctcctgcttctggtggctcactacgccatcattggacctggcctccaggctaaagccacccgggaggcgcaaaagcgcgccgctgccggcatcatgaaaaatccgacggtcgacgggatcacagtgattgatctggaccccatcccttatgatcccaagttcgaaaaacagctgggacaggttatgctccttgtgctgtgcgtcacccaggtgctgatgatgagaacaacctgggctctctgtgaggccctgacccttgccacaggccctattagcacgctgtgggaagggaaccccggacggttttggaataccacaatcgcggtttctatggctaacattttccgcggctcctacctcgccggggctggactgctgtttagcatcatgaagaacaccgccaatacaagacggggcaccggcaacacgggggagacactcggagagaagtggaaacatcgccttaatgccctgggcaagtctgagttccaaatctataaaaagtccgggattcaggaggtggacagaaccctggctaaagaaggaatcaagcggggcgagaccgatcaccatgccgtcagcagagggtctgcgaaactccgctggtttgtggagcggaacctggtgacaccggaaggaaaggttgtcgaccttggctgcggcagagggggatggagctactattgtggcgggctgaagaatgtgaaagaggtgaagggactcaccaaaggcgggcctggacacgaagaacccattcccatgtccacatacggctggaacctggtccgcctgcagtctggcgttgatgtgttcttcacgcctcccgaaaagtgcgacaccctcctttgtgatatcggggagagctcccctaatccgacagtggaggccggacggaccctgagagtcctgaacctcgtggaaaattggctgaacaataacacacaattttgcattaaagttcttaatccctacatgcctagcgtgatcgagaagatggaagctctgcagcgcaagtatggcggggccctcgtccggaaccccctgtccagaaattctacccacgagatgtactgggtgagcaacgcttccggaaacatcgtttctagcgtgaatatgatttcccgcatgctgatcaaccggttcacgatgagacataaaaaggccacctatgaacctgacgtcgatctcggctctgggacacgcaatattggaatcgagagcgagacccccaaccttgacattatcggcaaacggatcgaaaagattaaacaggagcacgaaacatcctggcattacgatcaggaccacccgtataagacctgggcgtaccacggcagctatgagacaaagcaaaccgggtctgcctccagcatggtgaatggagtggtcagactgctgacgaaaccttgggacgttatccccatggtgacacagatggctatgaccgataccacaccttttggccagcagcgcgtgttcaaggaaaaagtcgacacgagaacccaagagcccaaggaggggaccaaaaagctcatgaagattaccgccgaatggctgtggaaagagcttggaaagaaaaagacacctcggatgtgtacccgcgaagagtttacaagaaaagtgcggtctaacgctgccctgggcgctatcttcaccgatgagaataagtggaaatccgccagagaagcggttgaggacagcgggttttgggaactcgtggataaggagcggaacctgcatctggaaggaaagtgcgagacgtgtgtctacaatatgatgggcaaacgcgagaagaaactcggcgagttcgggaaggccaaaggatctagagctatttggtacatgtggctgggcgcccggtttcttgagttcgaagctctggggtttctcaacgaggaccactggttctcccgcaagaatagcctgtccggagtggaaggcgaggggcttcataagctgggctatatcctcagagatgttagcaaaaaggagggaggcgccatgtacgccgacgataccgcggggtgggacacacggattaccctggaagatctgaaaaacgaggaaatggtgacaaatcacatggagggagaacataagaaactcgctgaggccatctttcgcctgacctatcagaacaaggtcgtgagagttcagcggcccacgccgcgcggcacagtgatggacatcatttctagacgggaccagcgcgggagcggacaagtcgtgacctacggccttaatacattcaccaacatggaggcccagctgatcagacagatggaaggggagggcgtcttcaagtccattcaacacctcacggctaccgaagagatcgccgtgaaaacatggctggttcgggtgggacgcgagagactttctcggatggctattagcggcgatgactgcgtcgtgaagcctctggatgacagatttgcctccgcgctcaccgccctgaacgatatggggaaagtgcgcaaggacatccagcagtgggaaccctctcggggatggaatgattggacacaggttcccttctgcagccaccattttcacgagctgatcatgaaagacggcagagtgctcgtcgtgccttgtcgcaaccaagatgaactgattgggcgggctagaatctcccagggagccggctggtctcttcgcgagaccgcttgcctgggaaagagctatgcccagatgtggtccctcatgtacttccatcggagagacctgcgccttgcggccaatgctatttgtagcgccgttccgtctcactgggtgcccacatcccggaccacgtggagcatccacgctacacatgaatggatgaccaccgaggatatgctgacagtctggaacagagtgtggattcaggagaatccttggatggaagacaagacccccgtcgagtcttgggaagagatcccttatctcggcaaacgcgaagatcaatggtgcggatccctgatcggcctgacaagccgggccacgtgggctaagaacattcagaccgccatcaatcaggtgagatccctcattgggaacgaggagtacacagactacatgccctctatgaaacggtttagacgcgaagaggaagaggcgggagttctgtggtga

SEQ ID NO: 19666 - RNA, 9876 nt, synthetic construct
  misc_feature 1..9876: note = derived and/or modified CDS sequence (opt5) from DENV-2__HQ999999__SS-prME
  source 1..9876: mol_type = other RNA
accgccggcgtgatcgttatgctgattcccacagctatggccttccacctcacgacccggaatggggagcctcatatgatcgttggacggcaggaaaagggcaagagcctgctttttaagacagaggacggggtgaatatgtgcaccctgatggccattgatctcggagaactgtgtgaggacacaatcacctacaaatgcccgcttctgcgccaaaatgaacccgaggatattgactgttggtgcaattccacatctacctgggtgacgtatggcacctgtacaaccacaggggagcacagacgggaaaagcgcagcgtggctctcgtgcctcatgttggaatgggcctggagaccagaacggaaacatggatgtcctctgagggcgcctggaaacacatccagcggatcgagacctggattctgcgccatcccgggttcacaatcatggccgctattctcgcctacaccatcggaaccacacactttcagagagctctgattttcatccttctgacggccgtggcgcctagcatgaccatgcggtgcattggcatctccaaccgcgattttgttgaaggggtgtctggaggcagctgggttgacatcgtgctcgagcacgggtcctgtgtcacaaccatggccaagaataagcccacactggatttcgaacttattaaaaccgaggctaagcagcctgccacgctgagaaaatattgcatcgaagctaagctcacaaacaccaccacagagagccggtgtccgacccaaggagagccctctctgaatgaagaacaggacaaacgctttatttgcaagcattccatggtggatagaggctggggcaacgggtgtggactgttcggcaaagggggaatcgtgacatgcgccatgtttacgtgcaaaaagaatatggaaggcaaagtcgttcagcctgagaacctcgaatacaccattgtgatcacaccccacagcggggaggagcatgcggtgggaaatgacaccggcaagcacggcaaagaaatcaagattacacctcagtcttccatcaccgaggccgaactgacggggtatggaaccgtcacaatggagtgtagcccccggaccggccttgatttcaacgaaatggtgctgctccaaatggaggacaaggcttggctggttcaccgccagtggtttcttgatctgccgctcccttggctgcccggggccgacacacagggatctaattggattcagaaggagaccctggtgacgttcaagaaccctcatgctaaaaagcaagacgtcgtggttctcggctcccaggaaggggccatgcacacagccctgaccggcgctacagagatccagatgagctccggaaatcttctgtttaccggccatctcaaatgcagactgcggatggataaacttcaactgaaagggatgtcttacagcatgtgtaccggaaagttcaagattgtgaaagaaatcgcggagacacagcacggcacgatcgtcattagagtgcagtatgagggggacggatccccctgcaagatccccttcgaaattaccgatctcgagaaacgccatgtcctgggccggctgatcacagtgaaccctattgttaccgaaaaggacagcccgatcaacattgaggccgaacccccttttggggattcttacatcatcattggcgtggagcccggacagctcaaactgaattggttcaagaagggctccagcatcgggcaaatgtttgagacaaccatgagaggagctaaacgcatggccattcttggcgacacggcctgggatttcgggtctctgggaggcgtctttacaagcatcgggaaggctctccaccaggtgttcggcgccatttacggagcggctttttccggcgtttcttggaccatgaaaatcctgatcggggtgattatcacctggattggaatgaacagccggtccacaagcctgtctgtctcccttgtgctcgtgggcgttgtcaccctgtatctgggggccatggtgcaggccgacagcggatgtgtggtctcttggaagaataaagaactcaagtgcggctccgggatcttcattacagataacgtgcacacgtggaccgagcagtacaagtttcaacctgaaagcccctccaaactggcttctgccatccagaaggctcatgaggaaggcatctgtggaattagaagcgttacacgccttgagaatctgatgtggaaacagatcaccccggagctcaaccacattctgtccgaaaatgaggtgaagctgacaatcatgaccggcgacattaaagggatcatgcaggccggaaagcggtctcttagacctcaacccacggaactcaaatatagctggaagacctggggcaaggcgaaaatgctgtccacagagagccataaccagaccttcctgatcgatgggcctgaaacagccgagtgccccaataccaaccgcgcttggaactctctcgaggtcgaagactacggatttggcgtgttcacaaccaacatttggctgaaacttaaagagaagcaggacgtcttttgtgattccaaactgatgagcgccgctatcaaggacaatcgggccgtgcacgcggatatgggctattggattgaatctgccctcaacgacacgtggaagatggagaaggctagcttcatcgaggtcaagagctgccactggcctaaatctcatacactgtggagcaatggggtgctggaatccgagatgattatccccaagaacttcgccggaccggttagccagcacaactacagacctggctatcatacccaaaccgctgggccctggcaccttggaaaactcgaaatggattttgacctgtgtgagggcacaaccgtggtcgtgacggaagattgcgggaatcgcggaccctctctgcggacaaccacagcctccggcaagctcattaccgagtggtgctgtagaagctgcacactgcctccgcttcggtaccgcggcgaggacgggtgttggtacggaatggaaatcagacccctgaaggagaaagaagagaacctcgtcaattccctggtcaccgccggccatgggcagatcgataacttctctctgggagttcttggcatggctctctttctggaagagatgctgcggacgagaattgggaccaagcacgcgatcctcctggtggccgtgagcttcgtcacacttattaccggaaatatgtcctttcgcgacctgggccgggtgatggttatggtgggcgctacaatgaccgatgacatcgggatgggagtcacgtatctcgccctgctggccgctttcaaagtgagacctacatttgccgcgggccttctgctccgcaagctgacctctaaagagctcatgatggctacaattgggatcgccctgcttagccagtccaccatccccgaaaccattctggagctcacagatgccctggctctgggaatgatggttcttaaggtggtcagaaacatggaaaagtaccaactggccgtgacgatcatggcgatttcttgcgttcctaatgctgtgatcctccagaacgcctggaaagtcagctgtaccattctggccgctgtgtccgtgagccccctcctgcttacatcttcccagcagaaggccgactggatccctctggctctcaccatcaaaggcctgaatcccacagccattttcctgaccacgcttagccggacatctaccaagcgctcctggccgctgaacgaggcgatcatggccgtcgggatggttagcattctcgcttcttccctgctcaaaaatgacatccctatgaccggacccctggtggccggcggccttctgacagtgtgctatgtcctgaccgggagaagcgctgatctcgaactggagcgggccgccgacgtgaagtgggaggatcaagctgaaatttccggaagctctcctatccttagcattacaatctccgaggacggctctatgagcatcaaaaacgaagaggaggaacagacgctgaccattctcatccgcacagggctgctcgttatttccggagtgtttcccgtctctatcccgattaccgcggccgcttggtacctgtgggaggtgaagaagcagagagccggcgttctttgggatgtgccttctccccctcccgtcgaaaaagccgagctggaagacggggcttatcggatcaagcagcgcggaatcctgggctactcccaaattggcgccggggtgtataaagagggaacattccacaccatgtggcatgtcacgagaggcgcggtgctcatgcaccgggggaagcgcatcgagccctcctgggctgatgttaaaaaggacctgattagctacggaggcgggtggaaacttgaaggagagtggaaagaaggcgaggaagtgcaggtcctggccctcgagcctggcaagaatccgagagccgtgcagaccaaacccgggatctttaagacaaacaccggaacaattggcgctgtttccctggatttcagccctgggacctctggatcccccatcgtggaccggaaaggcaaggtcgtggggctctacggaaatggcgtggttacaagaagcggcgcctatgtctctgcgatcgctcagacggagaagtccattgaagataaccctgagatcgaagacgatatttttcgcaaaaagcggctgaccatcatggaccttcatcccggggccggaaaaacaaagagatacctgcctgccattgtgcgcgaggctatcaaacggggcctgagaaccctcattctggccccgacccgcgtggtcgctgccgaaatggaggaggcgcttcgggggctgcccatcagatatcaaacccctgccatcaagacggaacacaccggacgcgagattgtggacctcatgtgtcatgctacattcaccatgcggctgctcagccccgttagagtgcctaactacaatctgatcattatggatgaagcccacttcacagaccccgcttccatcgccgcccggggctatatttctacccgcgtcgagatgggggaggctgcgggcatctttatgacggccacaccgcctggaagcagagatcccttcccccagtccaacgctcctatcatggacgaggaacgggaaattcccgagcgcagctggaactctggccacgaatgggtgaccgattttaaggggaaaaccgtttggttcgtgccttccatcaaggccggaaacgacattgccgcttgccttcgcaagaatggcaagaaagtcatccagctgagccggaagacatttgattctgagtacgtgaagaccagagccaacgactgggatttcgttgtgacaaccgacattagcgagatgggggcgaattttaaagctgaacgcgtcatcgatccgcggagatgtatgaagcccgtgatcctgacggacggagaggaacgcgtgattctcgccggccctatgcccgtcacacattcctctgccgctcaacggagagggcgcatcggccggaaccctaaaaatgagaacgaccagtatatttacatgggagaacccctggagaatgatgaggactgcgcccactggaaggaagcgaaaatgcttctggataacatcaataccccggagggcattatccctagcatgttcgaacccgagagagaaaaggttgacgccattgatggggagtaccgcctcagaggagaggctcggaaaacatttgtggacctgatgcgcagaggcgatctgcctgtgtggctcgcctataaggtcgctgccgaagggatcaactacgctgaccggcgctggtgtttcgatggaatcaagaataaccagattcttgaggaaaacatggaggtggagatctggaccaaagaaggcgagagaaagaaactgaagccccggtggctggacgccagaatttattccgatcctctcgcgctgaaagaatttaaggagttcgccgctgggcgcaagtctcttacgctgaatctcatcaccgaaatgggccggctgcccacattcatgacccagaaagccagaaacgctctggacaatctcgccgttcttcatacagccgaggctggaggccgcgcgtacaaccacgccctgagcgagctgccggaaaccctcgagacactgcttctgctcaccctgctggctacggtgacagggggaatttttctcttccttatgtccggcaaggggatcggaaaaatgaccctgggcatgtgctgcatcattaccgccagcatcctgctctggtatgcccaaattcagcctcactggatcgctgcctctattatcctggaatttttccttatcgtcctgctcattcccgagcccgaaaagcagcggacacctcaggataatcaactgacctacgtggttatcgcgattctgacagtggtcgccgctacgatggccaacgagatgggctttctcgagaaaaccaagaaggaccttgggctgggatccatcacaacccaggaaagcgagtccaatattctggacatcgatctcagaccggcttctgcctggacactgtatgcggtggccaccacgttccttacccccatgctgcggcatagcattgaaaactcctctgtcaatgtgagcctcacagctatcgccaaccaggctaccgttctgatgggcctggggaaaggatggcctctctccaagatggacatcggcgcgccccttctggctattgggtgttacagccaggtgaatcctatcacactgaccgccgcgctcctgcttctggtggcccactacgctattatcggacccggcctccaagccaaagctacgcgcgaggcccagaagagagccgcggctggcattatgaaaaaccctacagtcgatgggatcaccgttatcgacctggatccgattccctatgaccctaagtttgaaaagcagctgggacaggtgatgctccttatcctgtgcgtgacacaagtcctgatgatgcggaccacctgggccctctgtgaggctctgacacttgccacgggccccatttctaccctgtgggaggggaatcctggacgcttctggaacacaaccatcgccgtgtccatggctaatatttttagaggcagctacctcgccggggcgggactgctgttctctatcatgaaaaacacaacctccacgcggcgcggcacaggcaatatcggggaaaccctcggagagaagtggaaaagcagacttaacgccctgggcaagtctgaatttcagatttataaaaagagcgggatccaggaggttgatcggaccctggctaaagagggaattaagcgcggcgaaacagaccatcacgccgtgtccagagggtctgctaagctccggtggttcgtcgagagaaacatggtgacccccgaaggaaaagtcgtggatctgggctgcggccgcgggggatggagctactattgtggcgggcttaagaatgttcgggaggtgaaaggactgacaaagggcgggccgggacatgaggaacctatccccatgtccacgtacggctggaacctcgtcagactgcaaagcggcgtggacgtctttttcacaccccctgagaaatgcgataccctgctctgtgacattggggaatcctctcccaatcctaccatcgaggccggacgcacacttcgggtgctgaacctggtcgaaaattggctcaacaataacacccagttctgcatcaaggtgctgaatccgtatatgcccagcgtgattgagaagatggaagcgcttcagagaaaatacggcggggccctggttcgcaaccctctctccagaaattctacgcacgagatgtactgggtcagcaacgctaccggaaatatcgtgtcctctgtgaacatgattagcagaatgctgatcaatcgctttacaatgaagcacaaaaaggccacctatgagcccgatgtcgacctgggctccgggacacggaacattggaatcgaaagcgaggttcctaacctcgacattatcggcaaaagaatcgaaaagattaagcaggagcatgaaacctcttggcactacgatcaagaccatccctataaaacatgggcttaccacggctcctatgagaccaagcagacggggagcgcctcttccatggtgaatggagtggtccgccttctgacaaaaccgtgggatgtggttcctatggtgacccagatggctatgaccgacacaacgcccttcggccagcaacgggtctttaaggagaaagtggataccagaacacaggaacctaaggaggggaccaagaaactgatgaagatcacagccgaatggctctggaaagagctgggaaagaaaaagacacccagaatgtgtacaagagaggagttcacccggaaagttcgcagcaacgcggcccttggcgctatttttacggacgagaataagtggaagtctgccagagaagctgtggaggatgggcggttctgggaactggtcgacagagagcggaacctccacctggagggaaaatgcgaaacctgtgtgtacaatatgatgggcaagcgcgagaaaaagctgggcgaatttgggaaagccaagggatccagagccatctggtatatgtggctcggcgcgcggttcctggagtttgaagctcttgggttcctgaacgaggatcattggtttagccgcggaaattccctcagcggcgtggagggggaaggcctgcacagacttggatacattctgcgggaggtctctaagaaagaaggcggggccatgtacgccgacgatacagctggatgggacacccgcatcacactcgaggacctgaagaacgaagagatggttaccaatcatatgaaaggcgagcacaagaaactggccgaagctatcttcaagctcacgtatcagaacaaggtggtgagagtccagcggcctacaccccgcgggaccgtgatggatattatcagcagacgggaccaacgcggatccggccaggttgggacatacggcctgaatacctttacgaacatggaggcccagcttattagacaaatggaaggagagggcatcttcaaatctattcagcatctgaccgcgacagaggaaatcgccgtgcagaattggctcgctcgggtcgggcgcgagagactgagccggatggccatctccggagatgactgcgtggttaagccgattgatgacagattcgcttctgcccttaccgcgctgaacgatatgggcaaagtgcgcaaggacatccagcaatgggaacctagccgggggtggaatgattggacacaggtccccttttgctcccaccacttccatgagctcgtgatgaaagacggaagagttctggtggtcccctgtcgcaaccaggatgaactgattggccgggccagaatctctcagggggctggctggagcctcaaggagaccgcctgcctgggaaagtcctatgctcaaatgtggacacttatgtactttcaccgccgggacctgagactcgccgctaacgccatttgtagcgcggtgccttctcattgggtcccgacctcccgcacgacatggagcatccacgccaaacacgagtggatgaccaccgaagatatgctggctgtgtggaatcgggtttggattcaggagaacccctggatggaagacaagacacctgtggagtcttgggaagaggtcccctatcttggcaaaagagaggaccagtggtgcgggtccctgatcggactcaccagccgcgccacatgggccaagaatatccagacggctattaaccaagtgcggtccctgatcggcaatgaagagtacaccgattatatgccttctatgaaaagattccggagagaagaggaagaggccggggtgctgtggtga

SEQ ID NO: 19667 - RNA, 9876 nt, synthetic construct
  misc_feature 1..9876: note = derived and/or modified CDS sequence (opt5) from DENV-2__FJ898449__SS-prME
  source 1..9876: mol_type = other RNA
accgccggaatgatcattatgctgatccccacagtcatggctttccacctcacgacccggaacggggagcctcatatgattgtcagccggcaggaaaagggaaaatccctgctttttaagacaaaagacggcaccaatatgtgcacactgatggccatggatctcggggagctgtgtgaagacaccatcacatacaagtgcccgttccttaaacaaaacgagcccgaagatattgactgttggtgcaattctaccagcacgtgggttacctatggaacatgtaccacaaccggcgagcaccgccgggagaagcggtccgtggcgctggtgcctcatgtcgggatgggactcgaaacgcgcacagagacctggatgtctagcgaaggcgcttggaagcacgcccagcggatcgagacatggatcctgcggcatcccggctttaccattatggccgctatcctggcctacaccattgggacaacgcacttccagcgcgtgctcatctttattctgcttaccgctatcgccccttccatgacaatgagatgcattggaatctctaaccgggatttcgttgagggcgtgagcgggggatcctgggtcgacatcgtgctggaacacggcagctgtgttaccacaatggcgaaaaataagcccaccctcgattttgagctgattaaaacggaagccaagcagcctgctacacttcgcaaatattgcatcgaggccaagctgaccaacaccacaaccgactctagatgtccgacacaaggggaacccacgctcaatgaggagcaggataagcggttcgtgtgcaaacattccatggtcgaccgcggatggggcaacggctgtgggctgtttggaaagggcgggattgtgacctgcgctatgttcacatgcaaaaagaatatggaaggaaaaatcgtgcagcctgagaacctggaatacaccgtcgttattacaccccacagcggcgaggaacatgccgtggggaatgataccggaaagcacggcaaagaggtgaagatcacgcctcagtcttccatcaccgaggcggaactcacaggctatgggaccgtcacaatggagtgtagccccagaaccggactggactttaacgaaatggtgcttctgcaaatggaggataaggcctggctcgttcaccggcagtggttcctggaccttccgctgccttggctccccggcgctgacacgcaggggtctaattggattcagaaagaaacactggtgacctttaagaaccctcatgccaaaaagcaagatgtcgtggttctgggatcccaggagggcgctatgcacacagccctcaccggggccaccgagatccagatgagctccggcaatctgcttttcacaggacatctgaaatgccgcctcagaatggacaagctgcaacttaagggcatgtcttacagcatgtgtacggggaaattcaagattgtgaaagaaatcgctgagacccagcacggaacaattgtcatccgggtgcagtatgaaggcgatgggtccccctgcaagatcccctttgagattatggacctggagaaaagacatgtcctcggacgcctgatcaccgtgaaccctattgttacagaaaaggatagcccggtgaacatcgaggcggaaccccctttcggcgactcttacattatcattggggtcgagcccggccagctgaagctcgattggtttaaaaagggatccagcatcggccaaatgttcgaaaccacgatgagaggggccaaaagaatggctatcctgggagacacagcctgggattttggctctcttgggggagtgttcaccagcattggcaaggccctgcaccaggtttttggggctatctacggcgccgcgttctccggagtgtcttggaccatgaaaattctcatcggcgtcattatcacatggatcgggatgaatagccgctccaccagcctgtctgtgtccctggtgcttgttggaattgtcacactctatctgggcgtgatggtgcaggctgacagcgggtgtgtcgtgtcttggaagaacaaggagctgaaatgcggatccggcatctttgttacggataatgtgcacacctggacagagcagtacaagttccaacctgaaagcccctccaaactcgcctctgccattcagaaggctcatgaggaagggatctgtggcattcggagcgtcaccagactggagaaccttatgtggaaacagatcacatccgaactgaatcacatcctctctgagaacgaggtgaagctgaccattatgacgggagacatcaaaggcattatgcaggttgggaagcgcagcctgcggccgcaacctaccgaacttagatattcctggaagacatggggaaaagccaagatgctcagcaccgagctgcataatcagacatttctgatcgacggccccgaaaccgctgagtgccctaacacaaatcgcgcctggaactctctcgaagtggaggattacgggttcggagtctttaccacgaatatttggctgcggcttagagagaaacaggacgtgttctgtgattccaagctgatgagcgcggccatcaaagacaaccgcgctgttcacgccgatatgggctattggatcgaatctgctctcaatgacacatggaagattgagaaggcctccttcatcgaagtgaaaagctgccactggcccaagtctcataccctgtggagcaacggcgtcctggagtccgagatgattatccctaaaaattttgcggggcccgtgagccagcacaacaaccggccgggataccatacccaaacagccggcccttggcaccttgggaagctcgaaatggatttcgacttttgtgagggaaccacggtggtcgttacagaagagtgcggcaatagagggccctctctgcggaccacaaccgcttccggaaaactgattacagaatggtgctgtcgcagctgcaccctgccccctctgagatatcggggcgaggatggctgttggtacgggatggagatcagaccgcttaaggaaaaggaggaaaacctggtgtcctctctcgtgacggccggacatggccagattgacaatttcagcctggggatcctgggaatggctctttttctcgaggaaatgctgcgcacccgggtcggcacaaaacacgccatcctgctcgtggccgtttccttcgtgaccctgattacagggaacatgtcttttagagatcttggacgcgtcatggtgatggttggcgctaccatgacggacgatatcggcatgggggtgacatacctggcgctcctggccgctttcaaggtcagacccacctttgccgccggactgcttctgcggaaactcacaagcaaggagctgatgatgaccaccattggcatcgtgctcctgtcccagtctagcattcctgagacaatccttgaactgacggacgctctcgccctggggatgatggttctgaaaatggtgcgcaatatggagaagtatcaacttgcggtcaccatcatggctattctgtgcgtgcccaacgccgtgatcctccagaatgcctggaaggtctcctgtacaattctggctgttgtgagcgtgtctcctctcctgcttacctccagccagcagaaagccgactggatccccctggcgctcacaattaagggactgaaccctaccgctatcttcctgacgacactttctagaacctccaaaaagcggagctggcccctgaatgaagccatcatggccgtcggcatggtgtctattctcgcttccagcctgctcaaaaacgatatcccgatgaccgggcctctggttgccggaggccttctgacagtgtgctacgtcctgaccggccgctccgctgacctcgagctggaaagagccacagatgtgaagtgggacgatcaagcggagattagcgggtctagccccatcctttccattacgatctctgaggacggaagcatgtccattaaaaatgaagaggaggaacagaccctgacaatcctcatccggaccggcctgctcgttatttctgggctgtttcctgtgagcatccccattacagccgctgcctggtatctttgggaggtcaagaagcagcgcgctggagtgctgtgggatgtcccgtcccctccccctgtgggcaaagccgaactggaggacggggcctacagaatcaagcagaaaggcattctcggctattctcaaatcggcgctggggtttacaaggaaggaaccttccacacgatgtggcatgtgacccggggcgcggtcctgatgcacaaagggaagcgcatcgagcccagctgggccgatgtgaagaaagaccttatttcctatggaggcgggtggaagctggaaggagagtggaaagagggcgaagaggttcaggtgctcgctctggaacccggcaagaaccctagagccgtccagacaaaaccggggctctttcggaccaatacaggaaccatcggcgccgtgagcctggatttctctcccgggacatccggaagccctattgtggacaagaagggcaaagttgtcgggctttacggaaacggcgtggtgacgagatctggcgcttacgtctccgccatcgcgcagaccgaaaagagcattgaagataatcccgagatcgaggacgacatcttccgcaaacggagactgacaattatggatctgcatcctggggctggaaagaccaaaaagtatctccccgccatcgtgcgcgaagccattaagcggggcctgagaacccttatcctggctcctacacgcgttgtggccgcggagatggaagaggctctccgggggctgccgattagataccaaacgcccgccatccgcgccgaacacaccggacgggagattgtcgacctcatgtgtcatgctacatttaccatgagactgctttcccctatccgggtgcccaactataacctgatcattatggatgaggcccacttcacagaccctgcttctatcgccgcgcgcggctacattagcaccagagttgaaatgggggaggccgctggcatctttatgacggccacacccccgggatcccgggatcctttcccccagagcaatgctcccattatggacgaggaacgcgagatccctgaaagatcttggaactccggccacgagtgggtgaccgattttaaagggaagaccgtctggttcgtgcccagcatcaaaacaggaaatgacattgccgcctgcctgcggaagaacggcaaaagagttatccagctctctcgcaagacctttgatagcgaatatgtgaagacacggaccaatgactgggatttcgtcgtgacgacagacatttccgagatgggggctaactttaaagcggaaagagtgatcgaccctcgccggtgtatgaagccggtcattctgaccgatggagaggagagagttatccttgccggccccatgcctgtgacacattctagcgctgcccaacgccgggggagaatcggccgcaatcccagaaacgaaaatgaccagtacatttatatgggagagcctctggaaaacgatgaggactgcgcccactggaaagaagctaagatgctcctggataatatcaacacccccgagggcattatcccgtccatgttcgagcctgaacgggagaaagtggacgccattgatggggaataccgcctgagaggagaggcgcggaagacgtttgtcgacctcatgcgcagaggcgatcttcccgtgtggctggcttacaaagttgcctctgaagggatcaattatgccgaccggagatggtgtttcgatggaacccgcaacaatcagattctggaggagaacgtggaagtcgagatctggacaaaggaaggcgagcggaagaaactcaagcctagatggctggacgctcgcatctacagcgatccccttgccctgaaagagttcaaggaatttgcggccgggcggaaatccctcaccctgaacctgattacagagatgggcagactccctaccttcatgacacagaaggctcgggacgcccttgacaatctggctgtgctgcataccgccgaagctggaggcaaggcctataaccacgcgctcagcgagctgcccgaaacgcttgagacactgctcctgctgaccctccttgccaccgttacagggggaatctttctgttcctgatgtctggccgcgggattggaaaaatgaccctcggcatgtgctgcatcattacagcttccatcctgctttggtacgcccaaatccagccgcactggattgctgccagcatcattctggagtttttcctcatcgtgctgctgattcctgaacccgagaagcagagaacgccccaggataatcaactcacctatgtcatcatcgccattcttacagtggtcgctgcgaccatggccaacgaaatgggctttctggagaaaacaaagaaagacctggggctcggacatatcgctacccagcagcctgaatccaatattctggatatcgaccttcggccggcctctgcctggacgctgtacgctgtggccaccacattcattacccccatgctccgccacagcatcgagaactcctctgttaatgtgagcctgacagcgattgccaaccaggctaccgtgctgatgggcctcgggaagggatggcctctttccaagatggatatcggcgtccccctgctggccatcgggtgttatagccaagttaatcctattacgctcacagctgccctgcttctgctcgtggcgcattacgccatcattggacccggcctgcaggctaaagccaccagagaggctcagaagcgggccgctgccggcatcatgaaaaaccctacagtggacgggattaccgtcatcgatctggacccgatcccctacgatcctaagtttgaaaaacagctcggacaagtgatgcttctggttctgtgcgtgacccaggtcctcatgatgcgcacaacgtgggcgctgtgtgaggcccttaccctggctacaggccccgtgtctaccctctgggaagggaatcctggaagattctggaacacaaccattgccgtctccatggctaatatctttcggggcagctatctggccggggccggactcctcttctctattatgaagaacacgacatccacccgcagaggcaccggcaatatcggggagacacttggagaaaagtggaaaagccggctgaacgcgctgggcaagtctgagtttcagatttacaaaaagagcgggatccaagaggtggacagaaccctcgctaaagaaggaatcaagcgcggcgagacagatcaccatgccgtttcccgggggtctgctaaactgagatggttcgtggaacgcaatcttgtcacgcccgagggaaaggtggttgacctgggctgcggcagaggcgggtggagctattactgtggagggctcaagaacgtgagagaggtcaaagggctgaccaagggcgggccgggacacgaggaacctattcccatgtccacatatggctggaacctggtgcgcctccagagcggcgtggatgttttctttgtgccccctgaacggtgcgacacccttctgtgtgacatcggggagtcctctcccaatcctacagtggaagccggaagaaccctgcgcgtgctcaacctggtcgagaattggcttaacaataacacgcagttctgcgttaaagtgctgaatccgtacatgcccagcgtgattgagcggatggaaaccctccagagaaagtatggcggggccctggtccgcaaccctctgtccagaaattctacacacgagatgtactgggtgagcaacgcttccggaaatatcgtttctagcgtgaacatgatttccagaatgctcatcaatcgctttaccatgagacataaaaaggccacatacgaacccgatgtcgaccttggcagcgggacccggaacatcggaattgagtctgaaacacctaatctggatatcattggcaagcgcatcgagaaaattaagcaagagcacgaagcgtcctggcattatgaccaggatcacccctacaaaacctgggcctatcacggcagctacgagacgaagcagacagggtctgcttccagcatggtgaacggagttgtgagactgctcaccaaaccgtgggacgtcgtgcctatggtgacccagatggccatgacagatacgacccccttcggccaacagcgggtctttaaggaaaaggttgacacaagaacccaggagcctaaagaagggacaaagaaactgatgaagatcaccgctgagtggctttggaaagagctgggaaaggaaaagacaccccggatgtgtacccgcgaggagttcacgaaaaaggtgagatctaacgccgcgctcggcgccatttttaccgatgagaataaatggaagtccgctcgggaggccgtggaagacaaccgcttctgggagctggtcgataaagaaagaaatctgcatctcgaggggaagtgcgaaacatgtgtgtataacatgatgggaaaacgggagaagaagctgggcgagtttggcaaagctaaggggagccgcgccatctggtacatgtggcttggagctagattcctggaatttgaggccctcggcttcctgaatgaagaccactggttttcccgggagaacagcctttctggggttgaaggagagggcctgcataaactcgggtatatcctgcgcgaggtgagcaagaaagaaggcggagcgatgtacgccgacgataccgctggctgggacacaagaattaccatcgaggatctgaagaatgaagagatgattacgaaccacatggccggggaacataagaaactcgctgaggccatcttcaagctgacataccagaataaagtcgtgcgggttcaacgccctacccccagaggaacagtgatggacattatctcccggcgcgatcagagaggctctgggcaggtcggaacctatggccttaacacgttcaccaatatggaggcccaactgatccggcagatggaaggggagggcatttttaagagcatccagcacctcacagcgtccgaagagattgctgtgcaggactggctggttagagtgggacgcgagcggctttctagaatggccatcagcggcgatgactgcgtcgtgaaaccgctggatgaccgcttcgcccgggctctcaccgccctgaacgatatggggaaggtcagaaaggacattcaacagtgggaaccttcccgcggatggaatgattggacacaggtgcccttttgctctcaccatttccacgagctgatcatgaaagacggccggaccctcgttgtgccctgtagaaaccaggacgaactgatcgggcgcgctcggattagccaaggagccggctggtcccttagagagacagcgtgcctgggaaagagctacgcccagatgtggtctctcatgtattttcatcgccgggatctgagacttgctgccaatgctatctgttccgccgtccctagccactgggtgccgacctctcggacgacatggtccattcacgcgagccatgaatggatgaccaccgaggacatgctgacagtgtggaacagagtttggatcctcgagaacccctggatggaagataaaacccctgtggagtcctgggaagagattccctacctgggcaagcgcgaagaccagtggtgcggatctctgatcggcctcacaagccgggccacgtgggctaaaaatattcagaccgccatcaaccaagtcagatccctgatcgggaatgaggagtatacagattacatgcctagcatgaagcgcttcagacgggaagaggaagaggctggagtgctttggtga

SEQ ID NO: 19668 - RNA, 9876 nt, synthetic construct
  misc_feature 1..9876: note = derived and/or modified CDS sequence (opt5) from DENV-2__FJ906966__SS-prME
  source 1..9876: mol_type = other RNA
acagccggaatgatcattatgctgatccccacggtgatggctttccacctcacgacacggaacggggaacctcatatgattgtctcccggcaggaaaagggaaaatccctgctttttaagacagaggacggagttaatatgtgcaccctgatggccatggatctcggggaactgtgtgaggacacaatcacctacaaatgcccgttccttaagcaaaacgaacccgaggatattgactgttggtgcaattctacaagcacctgggtgacgtatggaacctgtacaaccacaggcgagcaccgcagagaaaaacggtccgtggcgctggtccctcatgtggggatgggactcgagacccgcacggaaacatggatgtctagcgagggcgcttggaagcacgcccagagaatcgagacctggatcctgcggcatcccggctttacaattatggccgctatcctggcctacaccattgggaccacacacttccagcgcgctctcatctttattctgcttacggccgttgcgccttccatgaccatgagatgcatcggaatttctaaccgggatttcgtggaaggcgtcagcgggggatcctgggtggacatcgttctggagcacggcagctgtgtgacaaccatggccaagaataaacccacactcgattttgaactgatcaagaccgaggctaaacagcctgccacgcttcgcaagtattgcattgaagctaaactgacaaacaccaccacagactctagatgtccgacccaaggggagccctccctcaatgaggaacaggataagcggttcgtctgcaagcatagcatggtggaccgcggatggggcaacggctgtgggctgtttggaaaaggcgggatcgtgacatgcgccatgttcacgtgcaagaaaaatatggagggaaaggtcgttcagcctgaaaacctggagtacaccattgtgatcacaccccactctggcgaagaacatgcggtggggaatgataccggaaaacacggcaaggagattaaaatcacacctcagtccagcatcaccgaagccgagctcacgggctatgggaccgtcacaatggaatgttctcccagaaccggactggactttaacgagatggtgcttctgcaaatggaaaataaggcttggctcgttcaccggcagtggttcctggatcttccgctgccttggctccccggcgccgacacacaggggctgaactggattcagaaggagaccctggtgacgtttaaaaatcctcatgctaagaaacaagacgtcgtggttctcggatcccaggagggcgccatgcacacagccctgaccggggctacagaaatccagatgagctccggcaaccttctgttcaccggacatctcaagtgccgcctgagaatggataaacttcaactgaagggcatgtcttacagcatgtgtaccgggaagttcaaagtggtcaaggagattgcggaaacacagcacggaacgatcgtgattcgggtccagtatgagggcgacgggtccccctgcaaaatcccctttgagatcatggatctcgaaaagagacatgtgctgggacgcctgattaccgttaaccctatcgtgacagagaaagacagcccggtcaatattgaagccgagccccctttcggcgattcttacatcattatcggggtggaacccggccagctcaagctgaactggtttaagaaaggatccagcattggccaaatgatcgagaccacaatgagaggggctaagagaatggccatccttggagacaccgcctgggatttcggctctctcggcggggtttttacgagcattgggaaagctctccaccaggtgttcggggccatctacggcgcggctttttccggagtctcttggattatgaagatcctgattggcgtgatcatcacatggattgggatgaatagccgctccaccagcctgtctgtgtcccttgttctcgtcggagtggtgaccctgtatctgggcgtcatggtgcaggccgacagcgggtgtgttgtgtcttggaaaaacaaggagctcaagtgcggatccggcatcttcattacagataatgtccacacctggacagaacagtacaaatttcaacctgagagcccctccaagctggcctctgctatccagaaagcccatgaagaggggatttgtggcatccggagcgtgacgagacttgaaaacctgatgtggaagcagatcaccccggagctcaatcacattctgtccgagaacgaagttaaactgacaatcatgaccggagacattaagggcatcatgcaggctgggaaacgctctcttcaacctcagcccacagagctcaagtatagctggaagacctggggaaaagccaagatgctgtccacggaaagccataatcagaccttcctgattgatggccctgagacagcggaatgccccaacaccaatcgggcctggaactctctcgaggtggaggactacgggtttggagtcttcacaaccaatatctggctgaaacttagagaaaagcaggacgtgttttgtgattccaaactgatgagcgctgccatcaaggacaaccgcgctgttcacgccgatatgggctattggattgagtctgcgctcaatgacacatggaagatcgaaaaagcctccttcattgaggtgaagtcctgccactggcctaaatctcataccctgtggagcaacggcgtcctggagtccgaaatgatcattcccaagaacttcgctgggccggtgagccaacacaattaccggcctggatatcatacgcagacagccggcccctggcaccttgggaaactcgagatggattttgacttctgtgaaggaaccaccgtggtcgttacagaggattgcggcaacagagggccctctctgcgcaccacgacagcttccggaaagctgatcaccgaatggtgctgtcggagctgcacactccctccgctgagataccggggcgaggacggctgttggtacgggatggagattcgcccccttaaggaaaaagaggaaaatctggtgaactccctcgtgaccgccggacatggccagatcgataatttttctctgggggtcctgggaatggcccttttcctcgaggaaatgctgagaacacgggtgggcaccaagcacgctatcctgctcgttgcggtgagctttgtcacgctgattaccgggaacatgtccttcagagaccttggacgcgtgatggttatggtgggcgccacaatgaccgatgacatcggcatgggggtcacatatctggctctcctggccgcctttaaagtgcggcctaccttcgctgccggactgcttctgagaaagctcacgtctaaagagctgatgatgacaaccattggcatcgttctcctgagccaatccacaattcccgagaccatccttgaactgaccgatgcgctcgctctggggatgatggtgctgaagatggtccgcaagatggagaaataccagcttgccgtgacaatcatggccattctgtgcgtgcctaatgctgtcatcctccagaacgcctggaaggtttcttgtacgattctggcggtggtgagcgtcagccccctgtttctgaccagctctcagcaaaaagctgactggatccctcttgccctgacaattaagggactcaatcccaccgccatcttcctgacaaccctgtccagaacgaacaaaaagcggagctggccgcttaatgaagctatcatggccgtgggcatggtttctattctggcttccagcctcctgaaaaacgacatccctatgacagggcccctcgtggccggaggcctgcttaccgtctgctatgtgctgaccggccgctctgcggatctggagctcgaaagagccgctgacgttaagtgggaggatcaggccgagatttccgggagctcccctatcctgagcattacaatctctgaagacggaagcatgtccattaagaatgaggaagaggagcagacccttacaatcctgatccggacgggcctcctggtgatttctgggctctttcccgtcagcatcccgattaccgctgccgcctggtacctgtgggaagtgaaaaagcagcgcgctggagtcctttgggatgtgccttctccccctcccgttggcaaagcggagctggaagacggggcctatagaatcaagcaaaaaggcattctgggctacagccagatcggcgctggggtgtataaggagggaacattccacaccatgtggcatgtcacacggggcgccgtgctcatgcacaaggggaaacgcatcgaacccagctgggccgatgttaagaaagacctgatttcctacggaggcgggtggaaacttgagggagagtggaaagaaggcgaggaagtgcaggtcctggctctcgagcctggcaagaacccgagagccgtgcagaccaagcccgggctgtttaaaacgaatgcgggaaccatcggcgctgtgtctctcgatttcagccctgggacatccggaagccccattatcgacaagaaaggcaaggttgtcgggctgtacggaaacggcgtggtgacccggtctggcgcctatgtctccgccattgctcaaacagaaaagagcatcgaggataaccctgagatcgaggacgatattttccgcaagagaaaacttaccatcatggacctgcatcccggggccggaaaaacaaagcggtacctgcctgcgattgtgagagaggctatcaaacgcggcctccggacgctgattcttgccccgaccagagttgtggccgctgaaatggaggaagccctgcgcgggctccccatccggtatcagacccctgctattagagccgagcacaccggacgcgagatcgtcgacctgatgtgtcatgcgacctttacaatgcggctcctgtctcccgtgagagttcctaattacaaccttatcattatggatgaagcccacttcacggaccccgcttccatcgccgctcgcggctatattagcacccgggtggagatgggggaagccgccggcatctttatgacagctaccccgcctggatccagagatcccttcccccagtctaatgcgcctattatggacgaggagcgggaaatccccgagcgcagctggtccagcggccacgaatgggtcacagattttaaggggaaaaccgtgtggttcgttccttctatcaaggccggaaacgacattgctgcctgcctgagaaagaatggcaaaaaggtgatccaactgtcccggaaaacgtttgatagcgagtacgtcaagacacgcaccaacgactgggatttcgtggtgaccacagacatttctgaaatgggggccaattttaaagctgagagagtcatcgatccgcggagatgtatgaagcccgttattctcaccgacggagaggaacgcgtgatcctggccggccctatgcccgtgacacatagctccgcggctcagcggagagggcgcatcggccggaaccctaaaaatgagaacgaccagtatatttacatgggagaaccccttgagaatgatgaagactgcgcccactggaaggaggccaagatgctgctcgataacatcaataccccggagggcattatcccttctatgttcgaacccgagagagaaaaagtcgacgctattgatggggagtaccgcctgcggggagaagccagaaagacgtttgtggacctgatgcgcagaggcgatctccctgtttggcttgcgtatcgggtggccgctgaggggatcaactacgccgaccgcagatggtgtttcgatggaattaaaaataaccagatcctggaggaaaacgtcgaggtggaaatctggacaaaggagggcgagcggaaaaagctgaagccccgctggctcgacgctagaatttatagcgatcctctggcccttaaagagttcaaggagtttgctgccgggcggaaatccctgaccctcaatctgatcacagaaatgggcagactgcccaccttcatgacgcaaaaggcgcgcgacgccctcgataaccttgctgttctgcataccgccgaggctggaggccgggcctacaatcacgccctgtctgaactcccggagacactggagacccttctgctcctgacactgctcgctaccgtgacagggggaatttttcttttcctgatgagcggcagagggatcggaaaaatgaccctgggcatgtgctgcattatcacggcgtccatcctcctgtggtatgcccagattcagcctcactggatcgctgccagcattatccttgaatttttcctgattgtcctcctgatccccgagcccgaaaagcagcgcacacctcaagacaaccagctgacctacgtggtcatcgccattctcaccgtggttgctgccacaatggcgaatgagatgggctttcttgaaaagaccaaaaaggacctggggctgggatctatcacaacgcagcagccggagtccaacattctcgatatcgacctgcggcccgccagcgcttggaccctttatgccgtggctacaaccttcgtgacacctatgctgagacattccattgaaaattctagcgtcaacgtttccctcaccgccatcgcgaatcaagccacggtgctgatgggcctggggaaaggatggcccctctctaagatggatattggcgtgcctcttctggctatcgggtgttacagccaggtcaaccccatcaccctgacagccgctctctttctgcttgtggcccactacgctattatcggacctggcctgcaggccaaagcgacccgggaagcccagaagcgcgctgccgctggcattatgaagaatccgacagttgacgggatcaccgtgattgatctcgaccccatcccttatgatcccaaattcgagaagcaactgggacaggtcatgctgctcgtgctttgcgtcacacaggtgctgatgatgagaacaacctgggccctgtgtgaagccctcacactggcgaccggccctatctccaccctttgggaggggaaccccggacggttttggaatacaacgattgctgttagcatggccaacatcttccgcggctcttacctggctggggccggactcctgttttccattatgaaaaataccacaaacaccagacggggcacaggcaatatcggggaaaccctgggagagaagtggaaaagccgcctcaacgcccttggcaagtctgagttccaaatttataaaaagtccgggatccaggaagtggacagaacgctggctaaggagggaatcaaacggggcgaaacagatcatcacgccgtcagccgcgggtctgcgaagctgagatggttcgtggagcggaacatggttaccccggagggaaaagtggtcgacctcggctgcggcagagggggatggagctactattgtggcgggctgaagaatgtgcgcgaagtgaaaggacttaccaagggcgggcctggacatgaggaacccattcccatgtccacatacggctggaacctggttcggctccagtctggcgtcgatgtgtttttcacccctcccgagaagtgcgacacactgctgtgtgatatcggggaaagctcccctaatccgacggtggaggccggaagaaccctccgcgtccttaacctggttgagaattggctgaacaataacacacagttttgcattaaagtgctcaatccctatatgcctagcgtgatcgaaaagatggaggctctgcaacggaaatacggcggggcccttgtcagaaaccccctgtcccgcaattctacccacgaaatgtactgggtgagcaacgcttccggaaatattgtttctagcgtgaacatgatctcccggatgctcatcaatagattcacaatgcgccacaagaaagccacctatgagcctgacgtcgacctgggctctgggacgcggaacattggaatcgaaagcgagattcccaacctggatatcattggcaagagaatcgagaagattaaacaggaacatgagacctcctggcactacgaccaggatcatccgtataagacatgggcgtaccacggcagctatgaaaccaaacagacagggtctgcctccagcatggtgaatggagttgtgcgcctccttaccaagccttgggacgtcgtgcccatggtgacacaaatggctatgaccgatacgacaccttttggccagcagcgggtcttcaaagagaaggttgacaccagaacccaggaacccaaggaggggaccaagaagctgatgaaaatcacggccgagtggctgtggaaggaactcggcaaaaagaaaacccctcgcatgtgtacaagacaagagtttacccggaaggtgcgctctaacgctgccctgggcgctatcttcacagatgaaaataagtggaaatccgccagagaggcggtggaggacagccggttttgggaacttgtcgataaggagagaaacctgcacctcgaagggaaatgcgagacctgtgtgtacaatatgatgggaaagcgggagaaaaagctgggcgagttcggcaaggccaaagggtctcgcgctatttggtatatgtggctgggagccagatttctcgagttcgaagctctgggctttcttaacgaggaccattggttctcccgggaaaatagcctgtccggggttgagggagaaggcctccacaagctggggtacatccttcgcgatgtgagcaaaaaggagggcggagccatgtacgccgacgacacagcgggctgggataccagaattacgctggaggacctcaaaaacgaagagatggtcaccaatcatatggaaggggagcacaagaagctggctgaagccatcttcaaactgacatatcagaacaaggtggttcgggtgcagcgccccaccccgagaggaacagtcatggatattatctctcggcgcgaccaaagaggcagcggacaggtgggaacctacggcctcaatacgtttacaaacatggaggcccagctgatccggcagatggagggggaaggcgttttcaaatccattcaacatcttaccgtgacagaggaaatcgctgtccagaattggctggcccgcgtgggaagagagcggctctctcgcatggctattagcggcgatgactgcgtcgtgaagcctctggatgacagatttgcctccgcgcttaccgccctgaacgatatggggaaagttcggaaggacatccagcagtgggagccctctagaggatggaatgattggacgcaagtgcccttctgcagccaccactttcatgaactcattatgaaggacggccgcgtcctggtggtgccttgtcggaaccaggatgagctgatcgggagagctcgcatctcccagggagccggctggtctctccgggaaaccgcttgcctggggaaaagctatgcccagatgtggtcccttatgtacttccacagacgcgacctgcggctcgcggccaacgctatttgtagcgccgttccgtctcattgggtgcccacatccagaaccacatggagcatccacgctaagcacgagtggatgaccacagaagacatgctgaccgtctggaatcgcgtgtggattcaagagaacccttggatggaggataaaacgcccgttgaatcttgggaggaaatcccttatcttggcaagcgggaggaccagtggtgcggatccctgattggcctcacaagcagagccacctgggctaaaaatatccagaccgccattaaccaggtgcgctccctgatcgggaatgaagagtacacagattatatgccctctatgaagcggtttagacgggaggaagaggaagcgggagtcctgtggtga

SEQ ID NO: 19669 - RNA, 9876 nt, synthetic construct
  misc_feature 1..9876: note = derived and/or modified CDS sequence (opt5) from DENV-2__FJ906968__SS-prME
  source 1..9876: mol_type = other RNA
accgccggcatgatcattatgctgatccccacagtgatggctttccacctcacgaccagaaacggggagcctcatatgattgtcagccggcaggaaaagggaaaatccctgctttttaagacagaggacggcgttaatatgtgcaccctgatggccatggatctcggggaactgtgtgaggacacaatcacctacaaatgcccgttccttaagcaaaacgaacccgaggatattgactgttggtgcaattctacaagcacctgggtgacgtatggaacctgtacaaccacaggcgagcaccgcagagaaaaacggtccgtggcgctggtccctcatgtggggatgggactcgagacccgcacggaaacatggatgtctagcgagggcgcttggaagcacgcccagagaatcgagacctggatcctgcggcatcccggctttacaattatggccgctatcctggcctacaccattgggaccacacacttccagcgcgctctcatctttattctgcttacggccgttgcgccttccatgaccatgagatgcatcggaatttctaaccgggatttcgtggaaggcgtcagcgggggatcctgggtggacatcgttctggagcacggcagctgtgtgacaaccatggccaagaataaacccacactcgattttgaactgatcaagaccgaggctaaacagcctgccacgcttcgcaagtattgcattgaagctaaactgacaaacaccaccacagactctagatgtccgacccaaggggagccctccctcaatgaggaacaggataagcggttcgtctgcaagcatagcatggtggaccgcggatggggcaacggctgtgggctgtttggaaaaggcgggatcgtgacatgcgccatgttcacgtgcaagaaaaatatgaagggaaaagtcgttcagcctgagaacctggaatacaccattgtgatcacaccccactctggcgaggaacatgcggtggggaatgataccggaaagcacggcaaagagattaagatcacacctcagtccagcatcaccgaggccgaactcacgggctatgggaccgtcacaatggagtgttctcccagaaccggactggactttaacgaaatggtgcttctgcaaatggagaataaggcttggctcgttcaccggcagtggttcctggatcttccgctgccttggctccccggcgccgacacacaggggtccaactggattcagaaagaaaccctggtgacgtttaagaatcctcatgctaaaaagcaagacgtcgtggttctgggaagccaggagggcgccatgcacacagccctcaccggggctacagagatccagatgtcctctggcaacctgcttttcaccggacatctgaaatgccgcctcagaatggataagctgcaacttaagggcatgagctactccatgtgtaccgggaaattcaaggtggtcaaagaaattgcggagacacagcacggaacgatcgtgattcgggtccagtatgaaggcgacgggagcccctgcaagatcccctttgagatcatggatctggagaaaagacatgtgctcggacgcctgattaccgttaaccctatcgtgacagaaaaggactctccggtcaatattgaggccgaaccccctttcggcgattcctacatcattatcggggtggagcccggccagctgaagctcaactggtttaaaaagggaagctctattggccaaatgatcgaaaccacaatgcggggggctaaaagaatggccatcctgggagacaccgcctgggatttcggcagccttgggggagtttttacgtccattggcaaggctctgcaccaggtgttcggggccatctacggcgcggctttttctggagtcagctggattatgaaaatcctcattggcgtgatcatcacatggattgggatgaattcccgcagcacctctctgtccgtgagcctggttcttgtcggagtggtgaccctctatctgggcgtcatggtgcaggccgactctgggtgtgttgtgtcctggaagaacaaggagctgaaatgcggaagcggcatcttcattacagataatgtccacacctggacagagcagtacaagtttcaacctgaatccccctctaaactcgccagcgctatccagaaggcccatgaggaagggatttgtggcatccggtccgtgacgagactggagaaccttatgtggaaacagatcaccccggaactgaatcacattctctctgagaacgaggttaagctgacaatcatgaccggagacattaaaggcatcatgcaggctgggaagcgcagcctgcaacctcagcccacagaacttaagtattcctggaaaacctggggaaaggccaaaatgctcagcacggagtctcataatcagaccttcctgattgatggccctgaaacagcggagtgccccaacaccaatcgggcctggaactccctggaagtggaggactacgggtttggagtcttcacaaccaatatctggctcaagctgagagagaaacaggacgtgttttgtgatagcaagcttatgtctgctgccatcaaggacaaccgcgctgttcacgccgatatgggctattggattgaatccgcgctgaatgacacatggaaaatcgagaaggccagcttcattgaagtgaaatcttgccactggcctaagagccataccctctggtccaacgaggtcctggagagcgaaatgatcattcccaaaaacttcgctggcccggtgtctcaacacaattaccggcctgggtatcatacgcagacagccggaccctggcacctgggcaagcttgagatggattttgacttctgtgaagggaccaccgtggtcgttacagaggattgcggaaacagaggcccctccctccgcaccacgacagctagcgggaagctgatcaccgaatggtgctgtcggtcctgcacactgcctccgctcagataccggggagaggacggctgttggtacggcatggagattcgccccctgaaagaaaaggaggaaaatcttgtgaactctctggtgaccgccgggcatggacagatcgataattttagcctcggcgtcctggggatggccctgttccttgaggaaatgctcagaacacgggtgggaaccaaacacgctatcctgctggttgcggtgtcctttgtcacgctcattaccggcaacatgtctttcagagacctggggcgcgtgatggttatggtgggagccacaatgaccgatgacatcggcatgggcgtcacatatcttgctctgctcgccgcctttaaggtgcggcctaccttcgctgccgggctgctgcttagaaaactgacgagcaaggagctcatgatgacaaccattggaatcgttctgctctcccaatctacaattcccgagaccatcctggaacttaccgatgcgctggctctcggcatgatggtgctgaagatggtccgcaaaatggagaagtaccagctggccgtgacaatcatggccattctttgcgtgcctaatgctgtcatcctgcagaacgcctggaaagttagctgtacgattctcgcggtggtgtccgtcagccccctgtttctcacctcttcccagcaaaaggctgactggatccctctggcccttacaattaaagggctgaatcccaccgccatcttcctcacaaccctgagcagaacgaacaagaaacggtcttggccgctgaatgaagctatcatggccgtgggaatggtttccattcttgctagctctctgctcaagaacgacatccctatgacaggccccctggtggccgggggactcctgaccgtctgctatgtgcttaccggccgctccgcggatctggagctggaaagagccgctgacgttaagtgggaggatcaggccgagattagcggctccagccctatcctctctattacaatcagcgaagacgggtccatgtctattaaaaatgaggaagaggagcagatcctgaccatccttattcggacaggactgctcgtgatcagcggcctgtttcccgtctccattccgatcacggctgccgcctggtgtctctgggaagtgaagaaacagcgcgctggggtcctgtgggatgtgccttctccccctcccgttggaaaggcggagcttgaagacggcgcctacagaattaaacaaaaggggatcctgggatatagccagatcggcgctggcgtgtacaaggaggggaccttccacacaatgtggcatgtcacccggggagccgtgctgatgcacaaaggcaagcgcattgaaccctcctgggccgatgttaaaaaggacctcatctcttatgggggaggctggaaactggagggggagtggaaggaaggagaggaagtgcaggtccttgctctggagcctggcaagaacccgagagccgtgcagacaaaacccggcctctttaagaccaatgcggggacgattggagctgtgagcctggatttctcccctggcaccagcgggtctcccatcattgacaaaaagggaaaagttgtcggcctctacgggaacggagtggtgacacggtccggcgcctacgtcagcgccatcgctcaaaccgaaaagtctatcgaggataaccctgagattgaagacgatatcttccgcaagagaaaactgacaattatggaccttcatcccggcgccgggaagaccaaacggtatctgcctgcgatcgtgagagaggctattaagcgcggactgcggacactcatcctggccccgacgagagttgtggccgctgaaatggaggaagcccttcgcggcctgcccattcggtaccagacccctgctatcagagccgagcacacagggcgcgagatcgtcgacctcatgtgccatgcgacctttaccatgcggctgctctcccccgtgagagttcctaattataacctgattatcatggatgaagcccacttcacagaccccgctagcattgccgctcgcggatacatctccacgcgggtggagatgggcgaagccgccgggatttttatgaccgctacaccgcctggctctagagatcccttcccccagagcaatgcgcctatcatggacgaggagcgggaaatccccgagcgctcctggagctctggacacgaatgggtcaccgattttaaaggcaagacagtgtggttcgttccttccattaaggccgggaacgacatcgctgcctgtcttagaaaaaatggaaagaaagtgattcaactgagccggaagacctttgattctgagtatgtcaaaacgcgcacaaacgactgggatttcgtggtgaccaccgacatcagcgaaatgggcgccaattttaaggctgagagagtcattgatccgcggagatgcatgaaacccgttatcctgacagacggggaggaacgcgtgatcctcgccggacctatgcccgtgacccattcctctgcggctcagcggagaggccgcattgggcggaaccctaagaatgagaacgaccagtacatctatatgggcgaacccctggagaatgatgaagactgtgcccactggaaggaggccaaaatgcttctggataacattaatacaccggagggaatcattcctagcatgttcgaacccgagagagaaaaggtcgacgctatcgatggcgagtaccgcctccggggggaagccagaaaaacctttgtggacctgatgcgcagaggagatctgcctgtttggctcgcgtaccgggtggccgctgagggcattaactatgccgaccgcagatggtgcttcgatgggatcaagaataaccagatccttgaggaaaacgtcgaggtggaaatttggacgaaagagggagagcggaagaagctgaaaccccgctggctggacgctagaatctactccgatcctctcgccctgaaggaattcaaagagtttgctgccggccggaagtctcttacactgaatctcattaccgaaatggggagactgcccacattcatgacccaaaaagcgcgcgacgccctggataacctcgctgttcttcatacggccgaggctggcggacgggcctataatcacgccctgagcgaactgccggagaccctcgagacactgcttctgctcaccctgctggctacagtgaccggcgggatctttctcttccttatgtccggaagaggcattgggaagatgacactgggaatgtgctgtatcatcaccgcgagcattctgctctggtacgcccagatccagcctcactggattgctgcctctatcattctggaatttttccttatcgtcctgctcatccccgagcccgaaaagcagcgcacgcctcaagacaaccagctgacatatgtggtcattgccatcctgaccgtggttgctgccaccatggcgaatgagatgggctttctcgaaaaaacaaagaaagaccttggcctggggtccattaccacacagcagccggagagcaacatcctggatattgacctccggcccgcctccgcttggacgctgtacgccgtggctaccacattcgtgacccctatgcttagacattctatcgagaatagctccgtcaacgtttctctgacagccattgcgaatcaagccaccgtgctcatgggactgggcaaggggtggcccctgagcaaaatggatatcggagtgcctctccttgctatcggctgctattcccaggtcaaccccattacgctgaccgccgctctgtttctcctggtggcccactacgctatcattgggcctggacttcaggccaaggcgacacgggaagcccagaagcgcgctgccgctggcatcatgaaaaatccgaccgttgacggcattacagtgatcgatctggaccccatcccttacgatcccaagttcgagaaacaactcgggcaggtcatgctgctggtgctctgtgtcacccaggtgcttatgatgagaacgacatgggccctgtgcgaagccctgaccctcgcgacaggacctattagcaccctgtgggagggcaaccccgggcggttttggaataccacaatcgctgtttctatggccaacattttccgcggatcctatcttgctggcgccgggctgctctttagcatcatgaagaatacgaccaacacaagacggggaaccggcaatattggcgaaacactgggggagaaatggaagtctcgcctgaacgccctcggaaaatccgagttccaaatctacaagaagagcggcatccaggaagtggacagaacccttgctaaagaggggattaagcggggagaaacggatcatcacgccgtctctcgcggcagcgcgaaactgagatggttcgtggagcggaacatggttacaccggaggggaaggtggtcgacctgggatgtggcagaggcgggtggtcctattactgcggaggcctcaaaaatgtgcgcgaagtgaaggggctgaccaagggaggccctgggcatgaggaacccatccccatgtctacctatggatggaaccttgttcggctgcagagcggcgtcgatgtgtttttcacacctcccgagaaatgtgacaccctcctgtgcgatattggcgaatccagccctaatccgacagtggaggccgggagaacgctgcgcgtcctcaaccttgttgagaattggctgaacaataacacccagttttgtatcaaggtgctgaatccctacatgccttccgtgattgaaaaaatggaggctctccaacggaagtatggaggcgccctggtcagaaaccccctttctcgcaatagcacacacgaaatgtactgggtgtccaacgcttctgggaatatcgttagctccgtgaacatgatctctcggatgctgattaatagattcaccatgcgccacaaaaaggccacatacgagcctgacgtcgacctcggaagcggcacccggaacatcgggattgaatccgagatccccaacctggatattatcggaaagagaattgagaaaatcaagcaggaacatgagacgagctggcactatgaccaggatcatccgtacaaaacctgggcgtatcacggctcttacgaaacaaagcagaccggctccgccagctctatggtgaatggggttgtgcgcctgctcacaaaaccttgggacgtcgtgcccatggtgacccaaatggctatgacagataccacgccttttggacagcagcgggtcttcaaggagaaggttgacacaagaacccaggaacccaaagagggcaccaagaaacttatgaagatcacagccgagtggctgtggaaagaactggggaagaaaaagacgcctcgcatgtgcaccagagaggaatttacacggaaggtgcgctccaacgctgccctcggagctattttcaccgatgagaataaatggaagagcgccagagaggcggtggaagactctcggttttgggagctggtcgataaagaaagaaaccttcacctggagggcaagtgtgaaacatgcgtgtataatatgatggggaaacgggagaagaagctcggagagttcggcaaagccaagggctcccgcgctatctggtacatgtggctgggggccagatttctggaattcgaggctctcggatttctgaacgaagaccattggttcagccgggagaattcccttagcggcgttgaaggggagggactgcacaaactcggctatattctgcgcgatgtgtctaagaaagaggggggcgccatgtacgccgacgacaccgcgggatgggatacaagaatcacccttgaagacctgaagaacgaggaaatggtcacgaatcatatggagggcgaacacaagaaactcgctgaggccattttcaagctgacctaccaaaacaaagtggttcgggtgcagcgccccacaccgagagggaccgtcatggatatcatcagccggcgcgaccagagaggatccggccaagtggggacatatggactgaatacctttacgaacatggaggcccagctcattcggcagatggaaggcgagggggttttcaagtctatccagcatctgacagtgaccgaagagattgctgtccaaaattggcttgcccgcgtgggcagagagcggctgagccgcatggctatctccggagatgactgcgtcgtgaaacctctcgatgacagatttgcctctgcgctgacagcccttaacgatatgggcaaggttcggaaggacattcagcagtgggaacccagcagagggtggaatgattggacccaggtgcccttctgttcccaccactttcatgagctgatcatgaaagacggacgcgtcctcgtggtgccttgccggaaccaagatgaactgatcggcagagctcgcatttctcagggggccggatggagcctgcgggagacggcttgtctcggcaagtcctacgcccagatgtggagcctgatgtatttccacagacgcgaccttcggctggcggccaacgctatctgctctgccgttccgtcccattgggtgcccaccagcagaacaacctggtctattcacgctaaacacgaatggatgacaaccgaggacatgctcacagtctggaatcgcgtgtggatccaggagaacccttggatggaagataagacccccgttgagtcctgggaagagattccttacctggggaaacgggaagaccaatggtgtggcagccttatcggactgacgtccagagccacatgggctaagaatattcagaccgccatcaaccaggtgcgctctctcatcggcaatgaggagtataccgattacatgcccagcatgaagcggtttagacgggaagaggaagaggcgggggtcctgtggtga

SEQ ID NO: 19670 - RNA, 9876 nt, synthetic construct
  misc_feature 1..9876: note = derived and/or modified CDS sequence (opt5) from DENV-2__FJ906969__SS-prME
  source 1..9876: mol_type = other RNA
accgccggcatgatcattatgctgatccccacagtgatggctttccacctcacgaccagaaacggggagcctcatatgattgtcagccggcaggaaaagggaaaatccctgctttttaagacagaggacggcgttaatatgtgcaccctgatggccatggatctcggggaactgtgtgaggacacaatcacctacaaatgcccgttccttaagcaaaacgaacccgaggatattgactgttggtgcaattctacaagcacctgggtgacgtatggaacctgtacaaccacaggcgagcaccgcagagaaaaacggtccgtggcgctggtccctcatgtggggatgggactcgagacccgcacggaaacatggatgtctagcgagggcgcttggaagcacgcccagagaatcgagacctggatcctgcggcatcccggctttacaattatggccgctatcctggcctacaccattgggaccacacacttccagcgcgctctcatctttattctgcttacggccgttgcgccttccatgaccatgagatgcatcggaatttctaaccgggatttcgtggaaggcgtcagcgggggatcctgggtggacatcgttctggagcacggcagctgtgtgacaaccatggccaagaataaacccacactcgattttgaactgatcaagaccgaggctaaacagcctgccacgcttcgcaagtattgcattgaagctaaactgacaaacaccaccacagactctagatgtccgacccaaggggagccctccctcaatgaggaacaggataagcggttcgtctgcaagcatagcatggtggaccgcggatggggcaacggctgtgggctgtttggaaaaggcgggatcgtgacatgcgccatgttcacgtgcaagaaaaatatgaagggaaaagtcgttcagcctgagaacctggaatacaccattgtgatcacaccccactctggcgaggaacatgcggtggggaatgataccggaaagcacggcaaagagattaagatcacacctcagtccagcatcaccgaggccgaactcacgggctatgggaccgtcacaatggagtgttctcccagaaccggactggactttaacgaaatggtgcttctgcaaatggagaataaggcttggctcgttcaccggcagtggttcctggatcttccgctgccttggctccccggcgccgacacacaggggtccaactggattcagaaagaaaccctggtgacgtttaagaatcctcatgctaaaaagcaagacgtcgtggttctgggaagccaggagggcgccatgcacacagccctcaccggggctacagagatccagatgtcctctggcaacctgcttttcaccggacatctgaaatgccgcctcagaatggataagctgcaacttaagggcatgagctactccatgtgtaccgggaaattcaaggtggtcaaagaaattgcggagacacagcacggaacgatcgtgattcgggtccagtatgaaggcgacgggagcccctgcaagatcccctttgagatcatggatctggagaaaagacatgtgctcggacgcctgattaccgttaaccctatcgtgacagaaaaggactctccggtcaatattgaggccgaaccccctttcggcgattcctacatcattatcggggtggagcccggccagctgaagctcaactggtttaaaaagggaagctctattggccaaatgttcgaaaccacaatgcggggggctaaaagaatggccatcctgggagacaccgcctgggattttggcagccttgggggagttttcacgtccatcggcaaggctctgcaccaggtgtttggggccatttacggcgcggctttctctggagtcagctggatcatgaaaattctcatcggcgtgattatcacatggatcgggatgaattcccgcagcacctctctgtccgtgagcctggttcttgtcggagtggtgaccctctatctgggcgtcatggtgcaggccgactctgggtgtgttgtgtcctggaagaacaaggagctgaaatgcggaagcggcatttttatcacagataatgtccacacctggacagagcagtacaagttccaacctgaatccccctctaaactcgccagcgctattcagaaggcccatgaggaagggatctgtggcattcggtccgtgacgagactggagaaccttatgtggaaacagatcaccccggaactgaatcacatcctctctgagaacgaggttaagctgacaattatgaccggagacatcaaaggcattatgcaggctgggaagcgcagcctgcaacctcagcccacagaacttaagtattcctggaaaacctggggaaaggccaaaatgctcagcacggagtctcataatcagacctttctgatcgatggccctgaaacagcggagtgccccaacaccaatcgggcctggaactccctggaagtggaggactacgggttcggagtctttacaaccaatatttggctcaagctgagagagaaacaggacgtgttctgtgatagcaagcttatgtctgctgccatcaaggacaaccgcgctgttcacgccgatatgggctattggatcgaatccgcgctgaatgacacatggaaaattgagaaggccagcttcatcgaagtgaaatcttgccactggcctaagagccataccctctggtccaacggcgtcctggagagcgagatgattatccccaaaaactttgctgggccggtgtctcaacacaattaccggcctggatatcatacgcagacagccggcccctggcacctggggaagcttgaaatggatttcgacttttgtgagggaaccaccgtggtcgttacagaagattgcggcaacagagggccctccctccgcaccacgacagctagcggaaagctgattaccgagtggtgctgtcggtcctgcacactgcctccgctcagataccggggcgaagacggctgttggtacgggatggagatccgccccctgaaagagaaggaagagaatcttgtgaactctctggtgaccgccggacatggccagattgataatttcagcctcggggtcctgggaatggccctgtttcttgaagagatgctcagaacacgggtgggcaccaaacacgctatcctgctggttgcggtgtccttcgtcacgctcatcaccgggaacatgtcttttagagacctgggacgcgtgatggttatggtgggcgccacaatgaccgatgacattggcatgggggtcacatatcttgctctgctcgccgccttcaaggtgcggcctacctttgctgccggactgctgcttagaaaactgacgagcaaggaactcatgatgacaaccatcggcattgttctgctctcccaatctacaatccccgagaccattctggagcttaccgatgcgctggctctcgggatgatggtgctgaagatggtccgcaaaatggaaaagtaccagctggccgtgacaatcatggccatcctttgcgtgcctaatgctgtcattctgcagaacgcctggaaagttagctgtacgatcctcgcggtggtgtccgtcagccccctgttcctcacctcttcccagcaaaaggctgactggattcctctggcccttacaatcaaaggactgaatcccaccgccatttttctcacaaccctgagcagaacgaacaagaaacggtcttggccgctgaatgaggctatcatggccgtgggcatggtttccatccttgctagctctctgctcaagaacgacattcctatgacagggcccctggtggccggaggcctcctgaccgtctgctatgtgcttaccggccgctccgcggatctggaactggagagagccgctgacgttaagtgggaagatcaggccgagatcagcgggtccagccctattctctctatcacaattagcgaggacggatccatgtctatcaaaaatgaagaggaagagcagattctgaccatccttatccggacaggcctgctcgtgattagcgggctgttccccgtctccatcccgattacggctgccgcctggtgtctctgggaggtgaagaaacagcgcgctggagtcctgtgggatgtgccttctccccctcccgttggcaaggcggaacttgaggacggggcctacagaatcaaacaaaagggaattctgggctatagccagatcggcgctggggtgtacaaggaaggaacctttcacacaatgtggcatgtcacccggggcgccgtgctgatgcacaaagggaagcgcatcgagccctcctgggccgatgttaaaaaggacctcatttcttatggaggcgggtggaaactggaaggagagtggaaggagggcgaagaggtgcaggtccttgctctggaacctggcaagaacccgagagccgtgcagacaaaacccgggctcttcaagaccaatgcgggaacgatcggcgctgtgagcctggatttctcccctgggaccagcggatctcccattatcgacaaaaagggcaaagttgtcgggctctacggaaacggcgtggtgacacggtccggcgcctacgtcagcgccattgctcaaaccgagaagtctatcgaagataaccctgagatcgaggacgatatttttcgcaagagaaaactgacaatcatggaccttcatcccggggccggaaagaccaaacggtatctgcctgcgattgtgagagaagctatcaagcgcggcctgcggacactcattctggccccgacgagagttgtggccgctgagatggaagaggcccttcgcgggctgcccatccggtaccagacccctgctattagagccgaacacacaggacgcgagatcgtcgacctcatgtgccatgcgaccttcaccatgcggctgctctcccccgtgagagttcctaattataacctgatcattatggatgaggcccactttacagaccccgctagcatcgccgctcgcggctacatttccacgcgggtggaaatgggggaggccgccggcatcttcatgaccgctacaccgcctggatctagagatccctttccccagagcaatgcgcctattatggacgaagagcgggagatccccgaacgctcctggagctctggccacgagtgggtcaccgatttcaaagggaagacagtgtggtttgttccttccatcaaggccggaaacgacattgctgcctgtcttagaaaaaatggcaagaaagtgatccaactgagccggaagaccttcgattctgaatatgtcaaaacgcgcacaaacgactgggattttgtggtgaccaccgacattagcgagatgggggccaatttcaaggctgaaagagtcatcgatccgcggagatgcatgaaacccgttattctgacagacggagaggagcgcgtgatcctcgccggccctatgcccgtgacccattcctctgcggctcagcggagagggcgcatcggccggaaccctaagaatgaaaacgaccagtacatttatatgggagagcccctggaaaatgatgaggactgtgcccactggaaggaagccaaaatgcttctggataacatcaatacaccggagggcattatccctagcatgtttgagcccgaaagagagaaggtcgacgctattgatggggaataccgcctccggggagaggccagaaaaaccttcgtggacctgatgcgcagaggcgatctgcctgtttggctcgcgtaccgggtggccgctgaagggatcaactatgccgaccgcagatggtgcttcgatggaattaagaataaccagatccttgaggagaacgtcgaagtggagatctggacgaaagaaggcgagcggaagaagctgaaaccccgctggctggacgctagaatttactccgatcctctcgccctgaaggagtttaaagaattcgctgccgggcggaagtctcttacactgaatctcatcaccgagatgggcagactgcccacatttatgacccaaaaagcgcgcgacgccctggataacctcgctgttcttcatacggccgaagctggaggccgggcctataatcacgccctgagcgagctgccggaaaccctcgagacactgcttctgctcaccctgctggctacagtgaccgggggaattttcctctttcttatgtccggcagagggatcggaaagatgacactgggcatgtgctgtattatcaccgcgagcatcctgctctggtacgcccagattcagcctcactggatcgctgcctctattatcctggagttctttcttattgtcctgctcatccccgaacccgagaagcagcgcacgcctcaagacaaccagctgacatatgtggtcatcgccattctgaccgtggttgctgccaccatggcgaatgaaatgggcttcctcgagaaaacaaagaaagaccttgggctgggatccatcaccacacagcagccggaaagcaacattctggatatcgacctccggcccgcctccgcttggacgctgtacgccgtggctaccacatttgtgacccctatgcttagacattctattgagaatagctccgtcaacgtttctctgacagccatcgcgaatcaagccaccgtgctcatgggcctggggaagggatggcccctgagcaaaatggatattggcgtgcctctccttgctatcgggtgctattcccaggtcaaccccatcacgctgaccgccgctctgttcctcctggtggcccactacgctattatcggacctggccttcaggccaaggcgacacgggaggcccagaagcgcgctgccgctggcattatgaaaaatccgaccgttgacgggatcacagtgattgatctggaccccatcccttacgatcccaagtttgaaaaacaactcggacaggtcatgctgctggtgctctgtgtcacccaggtgcttatgatgagaacgacatgggccctgtgcgaggccctgaccctcgcgacaggccctatcagcaccctgtgggaagggaaccccggacggttctggaataccacaattgctgtttctatggccaacatctttcgcggctcctatcttgctggggccggactgctcttcagcattatgaagaatacgaccaacacaagacggggcaccggcaatatcggggagacactgggagaaaaatggaagtctcgcctgaacgccctcggcaaatccgagttccaaatttacaagaagagcgggatccaggaggtggacagaacccttgctaaagaaggaatcaagcggggcgagacggatcatcacgccgtctctcgcgggagcgcgaaactgagatggtttgtggaacggaacatggttacaccggagggaaaggtggtcgacctgggctgtggcagagggggatggtcctattactgcggcgggctcaaaaatgtgcgcgaggtgaagggactgaccaagggcgggcctggacatgaagagcccattcccatgtctacctatggctggaaccttgttcggctgcagagcggcgtcgatgtgttctttacacctcccgaaaaatgtgacaccctcctgtgcgatatcggggagtccagccctaatccgacagtggaagccggaagaacgctgcgcgtcctcaaccttgttgagaattggctgaacaataacacccagttctgtattaaggtgctgaatccctacatgccttccgtgatcgagaaaatggaagctctccaacggaagtatggcggggccctggtcagaaaccccctttctcgcaatagcacacacgagatgtactgggtgtccaacgcttctggaaatattgttagctccgtgaacatgatctctcggatgctgatcaatagatttaccatgcgccacaaaaaggccacatacgaacctgacgtcgacctcggcagcgggacccggaacattggaatcgagtccgaaattcccaacctggatatcattggcaagagaatcgagaaaattaagcaggagcatgaaacgagctggcactatgaccaggatcatccgtacaaaacctgggcgtatcacggctcttacgagacaaagcagaccgggtccgccagctctatggtgaatggagttgtgcgcctgctcacaaaaccttgggacgtcgtgcccatggtgacccaaatggctatgacagataccacgcctttcggccagcagcgggtctttaaggaaaaggttgacacaagaacccaggagcccaaagaagggaccaagaaacttatgaagatcacagccgagtggctgtggaaagagctgggaaagaaaaagacgcctcgcatgtgcaccagagaagagttcacacggaaggtgcgctccaacgctgccctcggcgctatctttaccgatgaaaataaatggaagagcgccagagaggcggtggaggactctcggttctgggaactggtcgataaagagagaaaccttcacctggaagggaagtgtgagacatgcgtgtataatatgatgggaaaacgggaaaagaagctcggcgagtttggcaaagccaaggggtcccgcgctatttggtacatgtggctgggagccagattcctggagtttgaagctctcggcttcctgaacgaggaccattggttcagccgggaaaattcccttagcggggttgagggagaaggcctgcacaaactcgggtatatcctgcgcgatgtgtctaagaaagagggcggagccatgtacgccgacgacaccgcgggctgggatacaagaattacccttgaggacctgaagaacgaagagatggtcacgaatcatatggaaggggagcacaagaaactcgctgaagccatctttaagctgacctaccaaaacaaagtggttcgggtgcagcgccccacaccgagaggaaccgtcatggatattatcagccggcgcgaccagagaggctccgggcaagtgggaacatatggcctgaataccttcacgaacatggaggcccagctcatccggcagatggagggggaaggcgtttttaagtctattcagcatctgacagtgaccgaggaaatcgctgtccaaaattggcttgcccgcgtgggaagagagcggctgagccgcatggctatttccggcgatgactgcgtcgtgaaacctctcgatgacagattcgcctctgcgctgacagcccttaacgatatggggaaggttcggaaggacatccagcagtgggagcccagcagaggatggaatgattggacccaggtgcccttttgttcccaccacttccatgaactgattatgaaagacggccgcgtcctcgtggtgccttgccggaaccaagatgagctgatcgggagagctcgcatctctcagggagccggctggagcctgcgggaaacggcttgtctcgggaagtcctacgcccagatgtggagcctgatgtattttcacagacgcgaccttcggctggcggccaacgctatttgctctgccgttccgtcccattgggtgcccaccagcagaacaacctggtctatccacgctaaacacgagtggatgacaaccgaagacatgctcacagtctggaatcgcgtgtggattcaggagaacccttggatggaggataagacccccgttgaatcctgggaggaaatcccttacctgggcaaacgggaggaccaatggtgtggaagccttattggcctgacgtccagagccacatgggctaagaatatccagaccgccattaaccaggtgcgctctctcatcgggaatgaagagtataccgattacatgcccagcatgaagcggttcagacgggaggaagaggaagcgggagtcctgtggtga

SEQ ID NO: 19671 - RNA, 9876 nt, synthetic construct
  misc_feature 1..9876: note = derived and/or modified CDS sequence (opt5) from DENV-2__FJ898454__SS-prME
  source 1..9876: mol_type = other RNA
accgccggcgtgatcattatgctgatccccaccgctatggccttccacctcacgaccagaaatggggaacctcatatgattgtcagccggcaggaaaagggaaaatccctgctttttaagaccgaagacggcgttaatatgtgcaccctgatggcgatggatctcggggaactgtgtgaagacacgatcacctacaactgcccccttctgcgccaaaatgaacccgaagatattgactgttggtgcaactctacaagcacctgggtgacgtatggaacctgtacagctaccggcgaacacagacgggaaaaacgctccgtggccctcgtccctcatgtggggatgggactggagacaagaaccgaaacgtggatgtctagcgagggcgcctggaagcacgctcagcggatcgagacatggatcctgcgccatcccggcttcaccattatggccgctatcctcgcctacacaattgggaccacctattttcagagagttctgatcttcattcttctgacagcggtggccccttccatgacgatgcggtgcatcggaatttctaatcgcgattttgtcgaaggcgtgagcgggggatcctgggttgacatcgtgctcgagcacggcagctgtgtcaccacaatggctaaaaacaagcccaccctggatttcgaacttatcaagacagaggccaaacagcctgctaccctgagaaagtactgcattgaagccaaactcacgaatacaaccaccgcgtctcggtgtccgacacaaggggagccctccctgaacgaggaacaggacaagcgctttgtgtgcaaacacagcatggtggatagaggatggggcaatggctgtgggctgttcggaaagggcgggatcgtgacctgcgccatgtttacatgcaagaaaaacatggagggaaagattgttcagcctgaaaatctcgagtatacgatcgtggtgacaccccattctggcgaagagaacgctgtcgggaatgacacaggaaaacacggcaaggagattaaagtgacccctcagtccagcatcacagaagccgagctgaccggctacgggacggttaccatggaatgttctccccggacaggacttgatttcaacgagatggtgctgctccaaatggaaaataaggcttggctggtccatcgccagtggtttcttgacctgccgctcccttggctgcccggcgccgatacccaggggtccaactggatccagaaagagacactggtgaccttcaagaaccctcacgccaagaaacaagacgttgtggtcctcggaagccaggagggcgctatgcacacggcgctgacaggggccaccgaaattcagatgtcctctggcaatcttctgtttacaggacatctcaagtgcagactgcggatggacaaacttcaactgaagggcatgagctattccatgtgtaccgggaaattcaaggtggtcaaggagatcgctgaaacccagcacggaacaattgtggttagagtgcagtacgagggcgatgggagcccctgcaaaatccccttcgagattatggacctcgaaaagcgccatgtcctgggacggctgatcacggtgaaccctatcgttaccgagaaagattctccggtgaatattgaagccgagcccccttttggcgactcctacatcattatcggggtcgaacccggccagctcaagctgagctggttcaaaaagggatctagcattggccaaatgtttgagacaaccatgagaggggccaagcgcatggctatccttggagatacagcctgggacttcggctccctcggcggggtgtttacctctattgggaaagcgctccaccaggtgttcggggctatctatggcgccgcctttagcggagtttcctggacgatgaagatcctgattggcgtcgtgatcacatggattgggatgaacagccggtctacctccctgagcgtgtctcttgtcctcgtgggagttgtgaccctgtacctgggcgtcatggtgcaggctgattccgggtgtgttgtgagctggaaaaataaggagctcaaatgcggatccggcatcttcattacagacaacgtccatacctggacagaacagtataagtttcaacctgagtctcccagcaagctggcctccgctatccagaaagcctacgaagaggggatctgtggcattagatctgtgacgcgccttgaaaatctgatgtggaagcagatcaccccggagctcaaccacattctgagcgagaatgaagcgaaactgacaatcatgaccggagatattaagggcatcatgcaggccgggaaacggtcccttagacctcaacccacagagctcaagtatagctggaaaacctggggaaaggctaagatgctgtctacggaacctcacaaccagaccttcctgatcgacggccccgagacagccgaatgccctaataccaaccgcgcttggaactccctcgaggttgaggattacgggtttggagtgttcacaaccaacatttggctgaaacttaaggaacggcaggacgtcttttgtgacagcaaactgatgtctgccgcgatcaagaataacagagccgtgcatgctgatatgggctattggattgagtccgccctcaacgacacatggaaaatcgaaaaggctagcttcattgaggtgaagtcttgccactggcccaaaagccataccctgtggtccaatggcgtcctggagagcgaaatgatcatcccgaagaacttcgccgggcctgtttctcagcacaattaccgccccggataccacacgcaaacagccggcccctggcatcttgggaaactcgagatggattttgacttctgtgaaggaaccaccgtggtggtcacagaggattgcggcaaccgggggccttccctgagaaccacgacagctagcggaaagctgattaccgaatggtgctgtcggtcctgcacactcccgcccctgcgctatagaggcgaggacggctgttggtacgggatggagatccggcctcttaaagaaaaggaggaaaatctggtgaactctctcgttaccgcgggacacggccagattgataattttagcctgggggtgctgggaatggcccttttcctcgaggaaatgctgagaacacgcgtcggcaccaagcatgctgtgctgctcgttgccgtgtcctttatgacgctgatcaccgggaacatgtctttccgggaccttggaagagtcatggtgatggttggcgccgctattacagatgacatcggcatgggggtgacctatctggccctcctggcggcttttaaagtccgccccacattcgccgccggactgcttctgagaaagctcaccagcaaagagctgatgatgacgacaattggcatcgtgctcctgtcccagtctaccatccctgagacaattcttgaactgaccgatgctctcgccctggggatgatgatcctgaagattgtgcggaatatggagaaataccaacttgcggtcaccatcatggctacactgtgcgttcccaacgccgtgattctccagaatgcctggaaggtgagctgtacgatcctggctgtcgtgtccgttagccctctcctgcttacctcttcccagcagaaggccgactggatccccctggctctcacaattaaaggactgaacccgaccgccatctttctgacaacccttagccgcacgaataagaaaagatcttggcctctgaacgaagcgattatggccgtgggcatggtctccatcctcgctagctctctgctcaagaatgatattcccatgacagggcctctggtggccggaggccttctgaccgtttgctatgtgctgaccggccggtccgctgacctcgagctggaacgcgccgccgacgtcagatgggaggatcaagctgagatcagcgggtccagccccatcctttctattacaatcagcgaagacggatccatgtctattaaaaacgaggaagaggagcagaccctgacaatcctcattcggacgggcctgctcgtgatcagcgggctgttcccggtctccattcctatcaccgcggccgcttggtacctttgggaagtgaagaaacagcgcgccggagttctgtgggatgtgccctctcctccgcccgtcggcaaggccgagctggaagacggggcttatagaatcaagcagaaagggattctgggctacagccaaatcggcgccggggtgtacaaggagggaacatttcacaccatgtggcatgttacacggggcgcggtgctgatgcacaaagggaagcgcattgaaccttcctgggctgatgtcagaaaagaccttatctcttatggaggcgggtggaagctggagggagagtggaaggaaggcgaggaagtccaggtgctcgccctggagccgggcaaaaacccccgggccgttcagaccaagcctggactcttcaaaacgaataccggaacaattggcgctgtcagcctggatttttcccccgggaccagcggatctcctatcgtggacaagaaaggcaaggtggtcgggctttacggaaacggcgtggttacaagatccggcacctatgtgagcgccatcgcgcagacagaaaagtctattgaggataatcccgagatcgaagacgatattttccgcaaaaagcggctgacgatcatggacctgcaccctggggctggaaaaaccaagagatacctcccggccattgtccgcgaggccatcaaacggggcctgagaacacttatcctggctcccacccgcgtggttgccgctgaaatggaggaagccctccgggggctgcctattagatatcaaacccccgcgatccgcgccgagcatacaggacgggagattgtggatctcatgtgtcacgctacgttcaccatgagactgctttcccctgtccgggtgcccaactacaatctgatcattatggacgaagcccattttacagacccggctagcatcgccgcccgcggctatatttccaccagagttgagatgggggaagctgcgggcatcttcatgacagccacccctcccggatctcgggatccctttcctcagagcaacgctcccatcatggacgaggagcgcgaaattcctgagagatcctggaatagcggccacgaatgggtgacggatttcaaggggaagacagtctggtttgtgccgtctatcaaagccggaaacgacattgccgcttgcctgcggaagaatggcaaaaaggtgatccagctctccagaaaaaccttcgatagcgagtacattaagacccgcacaaacgactgggattttgtcgttaccacagacatctctgaaatgggggccaatttcaaggcggagcgggtgatcgatcccagacgctgtatgaaacctgtgattctgaccgacggagaggaacgggtcatccttgctggccccatgcctgtgacgcatagctccgccgcccaaagacgcgggcggattggcagaaaccccaagaatgagaacgatcagtacatctatatgggagaaccgctggagaatgacgaagactgcgctcactggaaagaggccaagatgctcctggataacattaacacacctgagggcatcatcccctctatgtttgaacctgagcgcgaaaaagttgacgcgattgatggggagtacagactgcggggagaagcccgcaagaccttcgtggacctcatgagacggggcgatcttcccgtctggctggcttatcgcgtggccgctgaggggatcaattacgccgacagacggtggtgttttgatggaattaaaaacaatcagatcctggaggaaaacgttgaggtggaaatttggacaaaggagggcgagagaaagaaactcaagcctcgctggctggacgctcggatctatagcgatccccttgccctgaaagagttcaaggagttcgcggccgggagaaaatccctcaccctgaatctgattacggaaatgggccgcctcccgacctttatgacacagaaggctcggaacgcccttgacaatctggctgtcctgcacaccgccgaggccggaggcagagcttacaaccatgcgctctctgaactgcctgagacacttgagaccctgctcctgctgacactccttgccaccgtgacagggggaatcttcctgtttctgatgagcggcaaggggatcggaaaaatgacactcggcatgtgctgcattatcaccgcttccattctgctttggtatgcccaaatccagccccactggattgccgctagcatcatcctggagttctttctcattgtcctgctgatccccgagcctgaaaagcagcggaccccgcaggataatcaactcacatacgtggttattgccatccttaccgtggtggcggccacaatggctaacgagatgggcttcctggagaaaacgaagcgcgactttgggctgggatctattgccacccagcagcccgagtccaatatcctcgatatcgacctgagacctgctagcgcctggacactttacgcggtcgccaccacattcattacccccatgctgcggcattccatcgagaactctagcgttaatgtgtccctcacggctattgccaaccaggctaccgtgctgatgggcctggggaaaggatggcctctctctaagatggacatcggcgtcccccttctggccattgggtgttatagccaagtgaatcctatcacactgaccgctgccctcctgcttctggttgcgcactacgccattatcggaccgggcctccaggctaaggccacacgcgaagctcagaaaagagccgccgcgggcatcatgaagaaccccaccgtggatgggattacggtcatcgacctggatcctattccctatgaccctaaatttgagaagcagctgggacaagtgatgctccttgtcctgtgcgtgacacaggttctgatgatgcggaccacatgggctctctgtgaagccctgacccttgctaccggccccatctccacactgtgggaggggaatccgggacgcttctggaacacgaccattgccgtgagcatggccaacatctttagaggctcttacctcgctggggccggactgctgttctccatcatgaaaaatacaaccaacacacggcgcggcaccggcaatacgggggaaacactcggagagaagtggaagaacagacttaatagcctgggcaaatctgagtttcagatttataagcggtccgggatccaagaagtcgatagaaccctggcgaaagagggaattaagcgcggcgaaaccgaccaccatgccgtgagccgggggtctgctaaactcagatggttcgttgagcgcaacctggtgacacctgagggaaaggtcgtggatcttggctgcggcagagggggatggagctactattgtggcgggctgaaaaatgtgcgggaagttaagggactcaccaagggcgggcccggacacgaggaacccatccctatgtccacatacggctggaacctggtccgcctgcagtctggcgtggacgtgttctttacgccccctgagaaatgcgataccctcctttgtgacattggggaaagctccccgaatcccacagtcgaggccggacggaccctgagagttctgaacctcgtggagaattggctgaacaataacacacagttctgcatcaaggtgcttaatccttacatgcccagcgtcatcgagaaaatggagaccctgcagcgcaagtatggcggggctctcgtgcggaaccctctgtccagaaactctacgcatgaaatgtactgggttagcaatgcctccggaaacattgtgtctagcgtcaatatgatctcccgcatgctgattaaccggtttaccatgagacacaaaaaggcgacatatgagcccgatgtggacctcggctctgggacccgcaatatcggaattgaaagcgagacaccgaaccttgatatcatcggcaagagaattgagaaaatcaagcaagaacatgagacctcctggcactacgaccaggaccacccttataaaacatgggcctaccatggcagctatgaaaccaagcagacggggtctgcttccagcatggttaatggagtggtccggctgctgacaaaaccctgggatgtgattcctatggtgacccagatggccatgaccgacacaacgcccttcggccaacagcgcgtctttaaggagaaggttgataccagaacacaggaacctaaagaggggaccaagaaactcatgaagatcacagctgagtggctgtggaaagaacttggaaagaagaaaacaccccggatgtgtacaagagaggagttcacccggaaggtgcgctctaacgccgctctgggcgccatttttacggacgagaataaatggaagtccgcgagagaggccgtggaagatagccggttctgggagctcgtcgacaaagaacgcaacctgcacctggaggggaagtgcgaaacctgtgtgtacaatatgatgggaaaaagagagaagaagatcggcgagtttggcaaagctaaggggtctcgggccatttggtacatgtggctcggagctcgcttcctggaatttgaggcccttggcttcctgaacgaagatcattggttttccagagagaatagcctctccggggttgaaggagagggcctgcacaaacttgggtatatcctgcgggaggtgagcaagaaagaaggcggagccatgtacgcggacgatacagctggctgggacacccgcatcacactcgaggatctgaagaacgaagagatggtcaccaatcacatggaaggggagcataagaaactggccgaggccattttcaagctcacgtatcagaacaaagtggttagagtgcaacggccgacacctcgcggaaccgtcatggacatcatttctagacgggaccagcgcggcagcggacaggtgggaacatacggcctgaacaccttcacgaatatgggggctcaacttatcagacagatggaaggcgagggagtttttaagggcattcagcacctgaccgccacagaagaggtggctgtccaggattggctcgcccgggtggggagagagcgcctgtcccggatggcgatctctggagacgattgcgtcgtgaaaccccttgacgatagattcgccagcgctctgaccgccctcaacgacatgggcaagatccgcaaggatattcaacagtgggaaccctcccgggggtggaatgactggacacaggttcctttttgctctcatcacttccatgagctgatcatgaaagatggaagagtgctggtcgtgccgtgtcgcaaccaggacgaactcattggccgggctagaatcagccaaggggccggctggtccctgcgcgagaccgcgtgccttggaaagtcttatgcccagatgtggagcctgatgtactttcaccggagagatctccgcctggctgccaatgctatttgttccgccgtgcccagccactgggttcctacatctcggaccacgtggtccatccatgctagacacgaatggatgacaaccgaggacatgcttaccgtgtggaaccgggtctggatccaggagaatccctggatggaagataaaacacctgtggagagctgggaagagattccctatctgggcaagagagaagaccagtggtgcgggtctctcatcggactgacctcccgcgccacatgggcgaaaaacattcaaacggccatcaatcaggttcggagcctgattggctccgaggagtacaccgactacatgccttctatgaagagattccgcagagaagaggaagaggctggggtgctctggtga

SEQ ID NO: 19672 - RNA, 9876 nt, synthetic construct
  misc_feature 1..9876: note = derived and/or modified CDS sequence (opt5) from DENV-2__JQ922551__SS-prME
  source 1..9876: mol_type = other RNA
acagtgggcatgatcattatgctgatccccacggccatggctttccacctcacgacccggaacggggagcctcatatgattgtcagccggcaggaaaaggggaaatccctgctttttaagacagaggacggcgttaatatgtgcaccctgatggccatggatctcggggaactgtgtgaggacacaatcacctacaactgcccgcttctgaaacaaaatgaacccgaggatattgactgttggtgcaactctacaagcacctgggtgacgtatggaacctgtacagcgaccggcgagcaccgcagagaaaagcggtccgtggctctcgtccctcatgtggggatgggactggagacacgcaccgaaacgtggatgtctagcgagggcgcctgcaaacacgcccagagaatcgagacatggatcctgcggcatccctccttcaccattatggctgccatcctcgcttacacaattggcaccacctattttcagcgcgttgtgttcctgatggtccttacagccgtggcgctgtctatgacgatgagatgtatcgggattagcaatcgggattttgttgaaggagtgtccggcgggagctgggtcgacatcgtgctcgagcacggatcttgcgtgaccacaatggccaagaacaagcctaccctggatttcgaacttattaaaacagaggctaagcagcccgccaccctgcgcaaatactgtatcgaagctaagctcacgaatacaaccaccgcctccagatgccctacacaaggcgagccgagcctgaacgaggaacaggacaaacggtttgtccgcaagcactctatggttgatagagggtggggaaatggctgtggcctgttcgggaagggaggcatcgtgacctgcgcgatgtttacatgcaaaaagaacatggaggggaaaattgtgcagcccgaaaatctcgagtatacgctggtcatcacccctcattccggagaagagaacgccgtgggcaatgacacagggaaccacggaaaggagattaaagttacaccccagagctctatcacagaagctgcccttaccggctacggcacggtgaccatggagtgttcccctcggacagggctgaatttccatgaaatggtcagcctccccatggagaacaaggcttggatggtgcaccgccaatggtttctggatcttccgctgccttggctccccggagccgacacccagggctccaactggattcagaaagaaacactggttaccttcaagaatcctcacgccaagaaacaggatgtggtcgtgctggggtctcaagagggagctatgcatacggcgctcacaggcgccaccgagatccagatgagctccgggaacctgctttttacaggccacctgaagtgcagactccggatggacaaactgcagcttaagggaatgagctattctatgtgtaccggcaaattcaaggtcgtgtgggggatcgctagaacccaacatggaacaattgttcaccgcgtgcagtacgaaggcgacgggtccccctgcaagatccccctgaatattatgggactcgagaaacggcatgtcctgggcagacctatcacggtgaacccgattgttaccgggaaggatagccccgtgaatatcgaagccgagcctcccctgggcgactcttacatcattatcggagtcgagcctggccaggtgaaactcacatgtagccagaaggggtcctctattggacaaatgttcgaaaccacaatgcgcggcgccaaacggatggctatcctgggggataccgcctgggactttggaagccttggcggggtgttcacgtccattggcaaggcgctgcaccaggtttttggagctatctatggcgccgccttcagcggggtctcttggacaatgaagattctcatcggagtggtgatcacctggattggcatgaactccagaagcacctctctgtccgtcagcctggtgcttgttggggtggtcacactctacctgggagtgatggttcaggctgattccggctgcgtggtctcttggaaaaataaggagctgaaatgtgggagcggcatctttgtgaccgacaacgttcacacatggacggaacagtataagttccaacccgagtccccgtctaaactcgccagcgctattcagaaggcccatgaagagggaatctgcggcattcgctccgtgacccggctggagaatcttatgtggaagcagatcacacctgaactgaaccacatcctcagcgagaatgaagtcaaactgaccattatgacaggggatatcaagggaattatgcaggcgggcaaaagatctctgcgcccccaacctaccgagcttaagtactcctggaaaacgtgggggaaggccaaaatgctcagcaccgaaccccataaccagacatttctgatcgacggacctgagaccgctgagtgtccctctacaaatcgggcctggaactccctgaagggcggcgattatgggttcggagtgtttaccacaaatatttggctcaagctgaaagaaagacaggacgtgagctgcgattctaaacttatgagcgctgccatcaaagacaaccgcgcggtccacgccgacatgggctactggatcgagtccgctctgaacgatacctggaagattgaaaaagccagcttcatcgaggttaagtcttgtcactggccgaagtcccatacgctctggagcaatggggtgctggaatccgagatgattatccctaaaaacctggctggacccgtgtctcagcacaattatcggcccggctaccatacacaaaccgccgggccttggcaccttggaaagctcgagatggactttgatctgtgcgaaggcaccacagtcgtggttaccgaggactgcggcaacagagggccgagcctgcggacgacaaccgcctccggaaaactcattacagaatggtgttgccgctcttgtaccctgccccctcttagataccggggcgaggatgggtgctggtatggaatggagatcagacccctgaaggaaaaagaggaaaatctcgtgaacagcctggtcacagctgagcatgaacagatcgacaatttctccctgggcgtgcttgggatggcgctctttctggaggagatgctgcgcacccgggttggaacgaagcacgccgtgctcctggtcgctgtgtctttcatgacccttattacaggcaacatgagcttcagagatctgggccgcgttatggtgatggtcggggccgccatgaccgacgatatcggaatgggcgtgacatacctcgctctgctggccgcgtttaaggtgagacctaccttcgctgccgggcttctgctccggaaactgacgtccaaggaactcatgatgacaaccattggaatcgtcctgcttagccagtctacaattcccgagaccatcctggaactcaccgacgccctggctctgggcatgatgattcttaaaatcgttcgcaatatggagaagtatcaactggccgtgacaatcatggcgattctctgtgtgcctaacgctatgatcctgcagaatgcctggaaagtctcctgcacgattctcgccgtggttagcgtgtctcccctgcttctgacctccagccagcagaaggctgattggatcccgctcgccctgacaattaaggggctgaaccctaccgctatctttcttacaaccctgtctagaacgaataaaaagcggtcctggcccctcaacgaagccatcatggcggtcggaatggtgagcattctggcctccagcctcctgaaaaatgacatccctatgacaggcccccttgttgctggcgggctgctgaccgtgtgttacctcctgccgggacgctctgccgatcttgagctggagagagctgccgacctccggtgggaagaccaagccgagattagcggctcctctcctatcctgagcattaccatctccgaagatgggtctatgagcatcaagaaccaggaggaaaaacagacactcaccattctgatcaagacaggacttctggtcatttccgagctgttccccgtgcagatccctattacggctgcggcctggtatctctgggaggtcaaaaagcaacgcgctggcgtgctgtgggacgttccctctccccctccggtggggaaggccgaacttgaggatggagcctacggcatcaaacagaagggcattctggggtatagccagatcggagctggcgtctacaaagaagggacctttcacacaatgtggcatgtgaccagaggagccgttctcatgcacaagggcaaacggatcgagccctcctgggcggacgtgcgcaaggatctgattagctacgggggaggctggaagctcgagggcgaatggaaagagggggaagaggtccaggtgctggctcttgaacctggaaagaaccccagagccgtgcaaacacggcctggcctgttcaaaaccaatacggggaccatcggagccgtttctctggacttttcccccggcacaagcgggtctcctattgtcgataagaaaggaaaggtggtgggcctctatggcaacggggtcgtgaccagatccggaacatacgttagcgctatcgcccagaccgagaagtccattgaggacaatccggaaatcgaggatgacatcttccgcaaaaagcggctgacaattatggatcttcatcccggcgcggggaaaacgaagagatatctgcctgctatcgtgcgcgaagccattaaacggggactcagaaccctgatcctcgcccccacacgcgtcgtggctgccgagatggaagaggctctgcggggccttcctattagataccagacccccgccatccgcgcggagcacaccgggcgggaaatcgttgacctgatgtgccatgccacatttacgatgagactgctctctccggtgcgggtccctaactataatctgattatcatggatgaggctcacttcaccgaccccgccagcattgctgcccgcggctacatctccacaagagtggaaatgggagaggccgctggcatttttatgaccgcgacaccccctgggagccgggaccccttccctcaatctaacgccccgatcatggatgaagaacgcgagattcccgaaagatcctggaatagcggacacgagtgggttaccgactttaagggcaagacggtgtggttcgtcccttctatcaaagctgggaacgatatcgccgcctgtcttcggaagaatggcaagaaggtgattcagctgagcagaaaaacattcgactccgaatatatcaagacccgcaccaacgattgggactttgtggtcacaaccgatatttctgagatgggcgctaatttcaaggccgagcgggttatcgaccccagacgctgcatgaaacctgtgattctcacagatggggaggaacgggtgatcctggcgggccccatgccggtcacccatagctccgctgcccagagacgcggacggatcggcagaaaccctaagaatgaaaacgaccagtacatttacatgggggagcccctggaaaatgatgaggactgtgcccactggaaagaggctaagatgctccttgacaacatcaacacgcctgaaggaattatcccctctatgtttgagcctgaacgcgagaaagtggatgccattgacggcgaatatagactgagaggggaagcgcgcaagacattcgttgatctgatgagacggggagacctccccgtgtggctggcctaccgcgtcgctgccgagggcatcaattatgctgatagacggtggtgctttgacgggatcaaaaacaatcaaattcttgaagagaacgtggaagttgagatctggaccaaggaaggcgagaagaaaaagctgaaaccgagatggctcgatgcccgcatttacagcgaccctctggctctgaaggagttcaaagaatttgccgcgggacggaagtccctcacacttaatctgatcaccgagatgggcagactgcccacgttcatgacccagaaggcccgcaacgctctcgataatctggccgtgcttcatacagctgaagccgggggacgggcctataaccacgctctgagcgagctccccgagaccctggaaacactgctccttctgaccctgctcgcgacagtcaccggcgggatttttctgttccttatgtctggaaaaggcatcggcaagatgacgctggggatgtgctgtattatcacagcctccatcctcctgtggtacgctcagattcagcctcactggatcgccgccagcattatcctggagtttttcctcattgtgcttctgatcccggaacccgagaaacaaagaacccctcaggacaatcagctgacctatgtcgtgatcgctattctcacagccgttgcggccaccatggctaacgaaatgggattcctggagaagaccaagaaggattttggccttgggtccatcgccacgcagccccctgagtctaatattctggacatcgatctccggcccgctagcgcctggaccctgtacgcggtggccacaaccttcattacatccatgctgcgccattctatcgaaaacagctccgtgaatgtcagcctcaccgctatcgccaaccaagctacggttcttatgggactgggcaaggggtggcctctgtctaaaatggacattggagtgccgctcctggccatcggctgctactcccaggtgaatcccattacccttacagctgccctgctcctgctggtcgcgcactatgccatcattggccctgggctccaggctaaggccaccagagaggctcagaaacgggccgccgcgggaatcatgaagaaccccacagtggacggcattaccgttatcgatcttgaccctatcccctacgatccgaaatttgaaaagcaactgggacaggtgatgctgctcgtcctgtgtgtgacgcaggtccttatgatgcgcacaacctgggctctgtgcgaggccctcacactggctaccggacctattagcaccctgtgggaaggcaatcccgggagattctggaacacaacgatcgccgtgtctatggccaacatttttcggggatcctatctcgctggcgccggccttctgttcagcatcatgaagaataccacaaacacccgcagagggacaggaaataccggcgagacgctgggggagaaatggaagaaccggctcaatgcgctgggaaaatctgaatttcaaatttacaagaaaagcggcatccaggaggttgaccgcacacttgccaaggaagggatcaaaagaggagagaccgatcatcacgctgtgtcccggggctctgccaagctgagatggttcgtcgaacgcaacctcgtgacccccgagggcaaggttgtggacctggggtgtggacggggcgggtggagctattactgcggaggcctgaaaaatgtcagagaggtgaaggggctcacaaaaggaggccctggccatgaggagcccattcctatgtccacctatgggtggaaccttgtgcgcctgcagagcggagttgatgtctttttcacaccgcccgaaaagtgtgacacgctgctctgcgatatcggcgagtcctctcctaatcccaccgtggaggctgggcggacactgagagtgcttaacctggtcgaaaattggctcaacaataacacccagttttgtgttaaagtgctgaatccttacatgcccagcgtgattgagaagatggaaacactgcaacgcaagtacggaggcgccctcgtccggaacccgctttccagaaactctacccacgagatgtattgggtgagcaatgcgtccgggaacatcgtttctagcgtgaatatgatttcccgcatgctgatcaaccggttcacgatgagacacaaaaaggccacctacgaacctgacgtcgatctgggaagcggcacacgcaatatcggcattgagtctgagacccccaacctcgacatcattgggaaacggatcgaaaagattaaacaggagcatgaaacatcctggcactatgatcaggaccatccttacaagacctgggcttatcacggaagctacgagacaaagcagaccggctctgcctccagcatggtgaatggggttgtgagactgcttacgaaaccctgggacgtcatccctatggtgacacaaatggctatgaccgataccacaccctttggacagcagcgcgtgttcaaggaaaaatctgacacgagaacccaggagccgaaggagggcaccaaaaagctgatgaagatcacccctaaatggctctggaaggaactggggaaaaagaaaacaccccggatgtgcacccgcgaggagttcacaagaaaggtccggtccaacgccgctctgggagccatttttaccgatgagaataaatggaaaagcgcgagagaagccgttgaggactcccggttctgggagctcgtggataaggaacgcaacctgcaccttgagggcaaatgtgaaacgtgcgtgtataatatgatgggcaagagagagaaaaagctgggggagtttggaaaagctaagggcagccgggccatctggtacatgtggctcggggctcgcttcctggaatttgaggcccttggattcctgaacgaagaccattggttttctagagagaatagcctctccggcgtcgaaggggagggcctgcacaagctgggatacattctccgggatgtgtctaaaaaggagggcggggccatgtatgcggacgataccgctggatgggacacacgcatcaccctggaagatcttaaaaacgaggaaatgggcgccaatcatctggagggggaacccaagaaactctacgaggccattttcaagctgacatatcaaaacaagggagttagagtgcagcggcctaccccgcgcggcccccttatggacatcattctgagacgggaccaagggggaagcggacaggtcggcacgtacgggctcaacacatttaccaatatgggagctcagctgatccgccagatggagggcgaaggggtgttcaaaggaatccagcacctgattgccacagaggaaatcgctgttcaagattggctcgccagagtgggccgggagcgcttttccagaatggcgatttctggggacgattgcgtcgtgaagcctctggacgatcggttcgccagcgctcttaccgccctgaacgacatgggcaaagaaagaaaggttctccagcagtgggagccctcccgcgagtggaatgattggacacaggtgcctttttgttctcatcacttccacgaactgatcatgaaagacggacgggtccttgtggtcccctgcagaaaccaagatgagctgattggccgcgctcggatcagccagggggccggatggtccctcagagaaaccgcgtgtctgggcaagagctatgcccagatgtggtctcagatgtacttccatcgccgggacctgagactcgctgccaatgctatctgctccgccgtgcctagccactgggttcccacatctcgcaccacatggtccattcatgctcggcacgagtggatgaccacagaggatatgctgaccgtgtggaacagagtctggatccaagaaaatccgtggatggaggacaagacgcctgtggaaagctgggaggaaattccctatcttgggaaacgcgaggatcagtggtgtggatccctgatcggcctcacatctcgggccacctgggcgaagaacattcagaccgccatcaatcaggtgagaagcctgatcgggaacgaggaatacacagactacatgccttccatgaaacggtttagacgcgaggaagaggaagctggcgttctttggtga

SEQ ID NO: 19673 - RNA, 9876 nt, synthetic construct
  misc_feature 1..9876: note = derived and/or modified CDS sequence (opt5) from DENV-2__JQ922550__SS-prME
  source 1..9876: mol_type = other RNA
accgtgggaatgatcattatgctgatccccaccgtcatggccagccacctcacgacccggaacgggggacctcatatgattgttatcggccagcaaaagcggaagacgtccttctttaagaccaaaaaggggcacgacatgtgcacactgatggctatggccttcggagagttttgtgaaaataccattacatacaaatgcccgttccttaagcagaacgagcccgaagatatcgactgttggtgcaattctaccagcacgtgggtgacctatggcacatgtaccacaaccggggagcatcgcagagaaaagcggtccgtggcgctggtccctcacgtgggaatgggcctcgagacgcgcacagagacctggatgtctagcgaaggcgcttggaaacatgcccagagaatcgagacatggattctgcggcaccccgggtttaccatcatggccgctattcttgcctacaccatcggaacaacgcacttccagcgcgttctgatttttatcctcctgaccgctattgccccttccatgacaatgagatgcatcggcatctctaaccgggatttcgtggaaggggtcagcggaggctcctgggtggacattgttctggagcatgggagctgtgtgaccacaatggcgaagaataaacccaccctcgattttgagctgatcaagacggaagccaaacaacctgctacacttcgcaagtattgcattgaggccaagctgaccaacaccacaaccgactctagatgtccgacacagggagaacccacgctcaatgaggaacaggataaacggttcgtctgcaagcactccatggtggaccgcggctggggcaacgggtgtggactgtttggcaaagggggaatcgtgacctgcgctatgttcacatgcaagaaaaatatgaagggcaaaattgtccagcctgagaaccttgagtacaccgttgtgatcacaccccatagcggggaagaacacgccgtgggaaatgataccggcaagcacggcaaggaagtcaaaatcacgcctcaatcttccattaccgaggcggaactgacagggtatggaaccgtgacaatggagtgtagccccagaaccggcctcgactttaacgagatggttctgctgcagatggaagataaggcctggctcgtgcatcggcagtggttcctggaccttccgctgccttggctccccggggctgatacgcagggatctaattggatccaaaaagagacactggtcaccttcaagaaccctcacgccaaaaagcaggacgtggttgtgcttggctcccaggaaggggctatgcatacagccctgaccggcgccaccgagattcaaatgagctccggaaatctcctgtttacaggccacctgaagtgccgcctcagaatggacaaactgcagcttaaggggatgtcttacagcatgtgtacgggaaaattcaaggtcgtgaaagaaatcgctgagacccagcatggcacaattgtcatccgggtgcagtatgagggggatggatccccctgcaagatcccctttgaaattaaggacctggagaaaagacacgttctcggccgcctgatcaccgtgaaccctattgtcacagaaaaggatagcccggtgaacatcgaggcggagccccctcttggggactcttacattatcattggcgttgaacccggacaactgaaactcgattggttcaagaaaggctccagcatcgggcagatgtttgagaataccatgcggggagccaagagaatggctatcctgggcgacacggcctgggatttcgggtctctgggaggcgtgtttacaagcattgggaaggccctccaccaggtcttcggcgctatctacggagccgcgttttccggcgtgtcttggaccatgaaaattctgatcggggtgattatcacctggatcggaatgaacagccgctccacaagcctttctgtttccctggtcctcgtgggcattgtgaccctgtatctgggggtcatggtgcaggctgacagcggatgtggcgggtgcgaacggaagacaaaaacgaagtgtggctctggaatcttcgttaccgataatgtgcatacatggaccgagcaatacaaatttcagcctgaatcccccagcaaacttgcctccgccattcagaaagctcacgaggagggcatctgcgggattagatctgtcacacgcctcgaaaacctgatgtggaagcagatcaccccggagctgaatcatatcctcagcgaaaacgaggtgaagctgacgattatgaccggagacatcaaaggcattatgcaagccgggaagcggtcccttagacctcagcccacagaactgcgctattcttggaaaacctggggaaaggctaaaatgctcagcacagagctgcacaatcagaccttcctgatcgatggccctgagacagccgaatgtcccaacaccaatcgggcgtggaactcccttgaggttgaagactacggctttggggtgttcacgacaaatatttggctcagactgcgcgagaagcaggacgtcttctgcgatagcaagctgatgtctgccgctatcaaagacaaccgggccgtgcacgctgatatgggatattggatcgaatccgccctcaatgacacctggaagattgagaaagcgagctttatcgaggttaagtcttgtcattggcctaaatcccacaccctgtggggcaacggggtgcttgaaagcgagatggtcattcccaagaatttcgccggaccggtgtctcaacataacaacagacctggctactatacacagaccgctgggccctggcacctgggaaagctcgaaatggattttgacttctgcgagggcacgacagtggtcgttaccgaggattgcggcaatcgggggcccagcctgcgcacaaccacagcctccggaaaactgatcaccgaatggtgttgcagaagctgtacgcttcctccgcccaagtaccggggcgaggacgggtgctggtacggaatggaaattagacctctcaaagagaaggaagagaacctggtgtcttccctggtgaccgctggccatgggcagatcgataattttagcctcggcattctgggcatggcccttttcctggaggaaatgctccgcacacgggtcggcaccaaacacgccatcctgctggtggctgtttcctttgtgacacttatcaccgggaacatgtctttcagagacctcggacgcgtcatggtgatggttggcgcgacgatgacagatgacattgggatgggagtgacctatctggccctgctcgctgcctttaaggtcagacccacattcgccgctggcctgcttctgcggaagctcaccagcaaagagctgatgatgaccacaatcgggattgtgctgtcctctcaaagctccatccctgaaacgattcttgagctgaccgatgccctcgcgctgggaatgatggttctcaagatggtgcgcaatatggaaaaataccagctggctgtcacaatcatggccatcctttgtgtgcccaacgccgtgattctgcagaatgcttggaaggtctcttgcaccatcctcgccgttgtgagcgtgtcccctctgctgcttacaagctctcagcaaaaagcggactggattcccctggctctcaccatcaagggcctgaacccgacggccatttttctcacaaccctgtccggcaccagcaaaagacggtcttggcctcttaatgaggccatcatggctgtcgggatggtgtccatcctggccagctctctcctgaagaacgacattcccatgacaggacctctggttgctggcgggcttctgaccgtgtgttatgtcctcacaggacgctccgccgatctggagctcgaaagagcgacggacgtgaagtgggatgaccaggccgagatcagcggctccagccccattctgtctatcaccattagcgaagatgggtccatgtctatcaaaaatgaggaagaggagcagacacttaccattctgatccggacaggactgctcgttatcagcggcctgttcccggtgtccattcctatcaccgctgccgcttggtacctttgggaagtcaagaaacagcgcgccggcgtgctgtgggacgtcccctctcctcccctcgtggggaaggccgagctggaagatggagcttatagaattaaacaaaagggcatcctcgggtacagccagattggagcgggcgtttataaggaggggacgtttcacaccatgtggcatgtgacacggggagccgtcctgatgcacaaaggcaagcgcatcgagccctcctgggctgacgtgaaaaaggatcttatctcttacggcgggggatggaaactggaaggcgagtggaaggaaggggaggaagttcaggtgctggccctcgagcctggaaagaacccgagagccgtccagaccaaacccggcctgttccggacaaataccgggacaattggagctgtgagccttgacttctcccctggcacgagcggctctcccatcgtggataagaaagggaaggttgtcggactgtacggcaacggggtggtgaccagatccggagcctatgtcagcgcgattgctcaaacagagaaatctatcgaagacaatcctgagattgaagatgacatctttcgcaagcggagactcaccatcatggacctgcatcccggcgccgggaagaccaaacgctacctccctgccattgtgcgggaggctatcaagagaggcctgcgcacacttattctggccccgacgcgggttgtggcggctgaaatggaggaggccctgagaggactccccatccgctatcagacccctgccattcgggctgaacacacaggcagagagatcgtcgatctgatgtgccatgccaccttcacaatgcggcttctgtcccccattcgcgtgcctaactacaacctcatcatcatggacgaagctcactttaccgatcccgccagcattgcggccagagggtatatctccacgcgggttgagatgggagaagctgccggcattttcatgacagctaccccgcctgggtctcgcgacccctttccccagagcaatgcccctatcatggatgaggagagagaaattcccgagcggtcctggaacagcggacacgaatgggtgaccgacttcaaaggcaagacagtctggtttgtgccttctatcaaaaccgggaatgatatcgccgcttgtctgagaaagaacggcaagcgcgttattcaactctcccggaaaacattcgacagcgagtacgtgaagaccagaacgaatgattgggactttgtcgtgacaaccgatatctctgagatgggagcgaacttcaaagccgaacgcgtgattgacccgcggagatgcatgaagcccgtcatcctgacagacggcgaggaacgcgttattcttgctgggcctatgcccgtgacccatagctccgccgcccagcggagaggacgcatcggcagaaatcctaaaaacgagaatgatcagtatatctacatgggggaacccctggagaacgacgaggattgtgctcactggaaggaagccaaaatgctgctcgacaatattaacacgccggagggaatcattccttctatgtttgaacccgagcgggaaaaggtggatgcgatcgacggcgagtaccgcctgagaggggaggctcggaagacccttctggaactcattcgcggcggacctatccccgtctatctgggctacaaatggcctggggagggaattaattatgccgatagcagactgtgcgtgggccggacacagaacaatcaaatcctcgaagagaacgttgaagtggagatctggaccaaggaggggaaaggaaagaaacttaagcccagatggctggacgcccgcatttactccgatccgctggctctcaaggagttcaaagagttcgccgcgggccggaagtctctgacacttaacctgatcaccgaaatgggcagactccctacatttatgacccagaaagcccgcgacgctctggataatctggccgtcctccatacggctgaggccgggggaaaggcttataaccacgcccttagcgagctgcccgaaacactggagaccctcctgcttctgaccctcctggcgacagtgaccggcgggattttcctgtttctcatgtccggacggggcatcgggaaaatgacacttggaatgtgctgtattatcacggccagcatcctgctgtggtacgctcagattcagccccactggatcgccgcttctattatcctcgagttctttctgattgttcttctgatccctgagccggaaaagcaaagaacaccccaggacaatcagctcacatatgtgatcattgccatcctgaccgtcgtggccgctacaatggcgaacgagatgggcttcctggagaagaccaaaaaggatctcggccttgggaatattgccacgcagcaacctgaatccaacatcctggacattgacctgcggcccgctagcgcctggaccctctacgccgtcgctacaacctttatcacacctatgctgcgccattccattgaaaattctagcgtgaacgtttcccttaccgccatcgcgaatcaggccacggtgctgatgggactcggcaaagggtggcccctgtctaagatggatatcggagtgcctctgctcgctattggctgctacagccaggtcaacccgatcacacttaccgccgctctgctgctcctggttgcccactatgcgattatcgggcccggacttcaggccaaagctacaagagaagcccaaaagcgggctgccgctggcattatgaagaatcctaccgtggacggcatcaccgtgatcgatctggaccccattccttacgatcccaaattcgagaagcagctcgggcaggtcatgctgctggtgctctgtgttacacaagtgcttatgatgcgcacgacctgggccctgtgcgaagcgctgacactcgccaccggaccggtctccacactgtgggagggcaaccctgggagattttggaataccacgatccttattcagatggctaacatcctgcggggaagctatctcgccggcgctgggcccctgttctctattatggagaatacaaccggaccccgcagacggaccggccagctgggccgcgaactccttagacggtggaaatccagactgaacgccctgggaaagagcgagtttcagatctacaaaaagtctggaatccaagaagtggaccgcacactcgccaaagagggcattaagagaggggaaaccgatcatcacgcggtctccagaggaagcgctaagctgcgctggttcgtggagcggaatcttgttacacctgagggcaaagtggtcgacctggggtgtggaagaggcggctggtcttattactgcgggggactcaagaacgtgcgcgaagttaaaggcctgacgaaaggcgggcccgggcatgaggaacctatcccgatgagcacctatgggtggaacctggtgcggctccagtccggagtcgatgtgtttttcattccccctgagagatgtgacacacttctgtgcgatatcggcgagtctagccccaatcctaccgtggaagccggccgcacactgcgggttctcaacctggtcgagaattggcttaacaataacacccagttctgtattaaagtgctgaatccctacatgccgtccgtgatcgaaaagatggagacgctccagagaaagtacgggggagctctggtccgcaaccctctgagcagaaattccacccacgaaatgtattgggtttctaacgccagcggcaatatcgtgtcctctgtgaacatgattagcagaatgctcatcaatcgctttacaatgagacacaaaaaggccacctacgagcccgacgtcgatcttgggtccggaacacggaacattggcatcgagtctgaaattcctaatctggacatcattgggaaacgcatcgagaagatcaaacaagaacatgagaccagctggcactatgaccaggatcatccctacaagacatgggcttatcacggatcctacgaaaccaagcagacgggcagcgcctcttccatggtgaacggcgttgtgagactgctcacaaaaccttgggacgtcgtgcccatggttacccagatggcgatgaccgatacaacgccgttcgggcaacagcgggtgtttaaggagaaagtcgacacccggattcaggagcctaaggaaggaaccaagaagctgatgaagatcatggccgagtggctttggaaagaactgggcaagaaaaagacaccccggatgtgcacacgcgaggagttcaccaaaaaggtgagaagcaacgctgccctcggggctatttttacagatgagaataaatggaagtctgcccgggaggcggtggaagacggacgcttctgggagctggtcgatagagaacggaacctgcacctcgagggcaagtgtgagacctgcgtttataatatgatggggaaacgcgaaaagaaactgggcgagtttggaaaggccaaaggctccagagctatctggtacatgtggcttggggcccggttcctggaatttgaggctctcggattcctgaacgaagaccattggtttagccgcgaaaattctctttccggcgtggagggggaaggactgcacaagctcggctacattctgagagaggtgagcaagaaagaagggggcgccatgtatgctgatgacacggccggatgggatacccggatcacactgggcgcgctcaagaacgagcgcaaatgcaccgaacatatggagggggagcccagaaagcctggacggggccacttcaaatggcgcaatcaaaacagagtcgtgggggttcagggaccgacacccggcgggaccgtgatggacatcatttcccggaagaatcagagaggcagcggacaggtcggcacgtacgggctgaacacatttaccaatatggaagcccaacttatccgccagatggagggagaaggcttcttcattgagcatcagcacctgacagcttctgaagagaacgccgtgcaggactggctcgctcgggttgggagagagaaggtgagccgcatgcctatctccggagatgactgtgtcgtgaaacccctggatgaccggtttgccagagcccttaccgcgctgaatgatatgggcaaggttcgcaaagacattcaacagtgggaaccttctcgggggtggaacgattggacacaggtgcccttctgcagccaccattttcacgagctcatcatgaaggacggcagaaccctggtcgtgccttgtcgcaatcaggatgaactgatcggacgggctagaatttcccaaggcgccgggtggtctttcggagagacagcctgcctcggcaaaagctatgctcagatgtggtccctgatcaactttcgcattcccgaccttcggctggccgctaacgtcatctgttctgtggttccgagccattgggtgcctacctccagaacaacctggagcattcacgccaatcacgagtggatgacaaccgaagatatgctcacggtctggaaccgggtgtggatcctggagaatccctggatggaagacaagacacctgtggagtcttgggaagagattccctaccttgagaagagagaagatcagtggtgcgggtccctgatcggactcaccccgcagcctccctgggcgaaaaacatcgagaccgccattaatcaagttcgcagcctgatcggcaacgaagagtatattgactacctgccctctatgaagcggttcagaatcgaagaggaggaatccggctttctctggtga

SEQ ID NO: 19674 - RNA, 9876 nt, synthetic construct
  misc_feature 1..9876: note = derived and/or modified CDS sequence (opt5) from DENV-2__JQ922553__SS-prME
  source 1..9876: mol_type = other RNA
accgccggcatgatcattatgctgatccccaccgtgatggctttccacctcacgacccggaatgtggagcctccgatgatttttagccggcaggaaaaggggaaatctttcctgtttaagacaaaagacggacatgatatgtgcaccttcatggccatggaccttggcgagctgtgtgaagatacaatcacctacaagtgcccctttctcaaacaaaatgagcctgaagacattgattgttggtgcaacagcacaagcacctgggttacgtatgggacctgtacaaccacaggggagcaccgccgggagaagcggtccgtggcgctggtgccccatgtcggcatggggcttgaaacccgcacggagacatggatgtctagcgaaggagcttggaagcacgtgcagagaatcgagacctggatcctgcggcatcctggcttcacaattatggccgccatcctcgcttacaccattggcaccacacactttcagcgcgttctgatcttcattctgctcacgggggtggccccctccatgagaatgcggtgcatcggaatttctaatcgcgactttgtcgagggcgtgagcgggggatcctgggttgatatcgtgctggaacacggcagctgtgtcaccacaatggctaaaaacaagcctacccttgacctggagctcatcaaaacagaagccaagcagccggccaccctgagaaaatattgcattgaggccaaacttacgaatacaaccaccgattctcggtgtcccacacaaggggaacctaccctgaacgaggagcaggacaagcgcttcgtgtgcaaacattccatggtggatagaggatggggcaatggctgtgggctctttggaaagggcgctatcgtcacatgcgccatgttcacgtgcaaaaagagcatgaaagggaagattgttcagcccgaaaacctggagtacaccgtggtgatcacacctcactctggagaagagtatgctgtcggcaatgacaccgggaaacatggaaaggaagtgaagattacaccccagtccagcatcaccgaggccgagctgacgggctacggcaccgttacaatggaatgttctccgcggaccgggctcgattttaacgagatggtgctgcttcaaatggaagacaaagcgtggctggtccaccgccagtggttcctcgacctgcctcttccctggctgcctggagccgatacacagggctccaattggatccagaaggagaccctcgtgacgttcaaaaacccccacgctaagaaacaagacgttgtggtcctggggagccaggaaggagccatgcatacagctctgaccggcgccacagagattcagatgtcctctgggaatctcctgtttaccggccaccttaagtgcagactgcggatggataagctccaactgaaaggaatgagctattccatgtgtaccggcaagttcaaagtggtcaaggagatcgccgaaacacagcatgggacgattgtgatcagagttcagtacgagggagacggcagcccctgcaaaattccttttgaaatcatggatcttgagaagcgccacgtgctggggcggctcatcaccgtcaacccgattgtgacagagaaggactctcccgttaatatcgaagctgagcctcccttcggagattcctacattatcattggcgtggaacctgggcagctgaaactggactggtttaagaaaggcagctctatcggacaaatgctcgagaccacaatgagaggcgcgaagcgcatggccattctgggggataccgcttgggacttcggaagccttggcggggtctttacgtccatcggaaaagccctgcatcaggtgttcggcgccatctatggggctgccttttctggcgtgagctggacaatgaagattctcatcggagttattatcacctggattggcatgaactcccggagcacctctctgtccgtcagcctggtgcttgtggggatcgtcacactctacctgggagtgatggttcaggcggattctggctgtgtggtctcctggaagaacaaagaactgaagtgcgggagcggaatcttcgtgaccgacaatgttcacacatggacggagcagtataaatttcaacccgagtccccgtctaagctcgctagcgccattcagaaagcccacgaagagggcatctgtgggattagatccgtgacccgcctggaaaaccttatgtggaagcagatcacactggagctcaatcatattctgtctgaaaacgaggtcaaactgaccatcatgacaggcgacatcaagggaattatgcaagtgggcaagcggagccttagacctcaacccaccgagctccgctactcctggaaaacgtgggggaaggctaaaatgctgagcaccgaactgcacaatcagacattcctcatcgatggacctgagaccgccgaatgccccaacgctaatcgggcctggaactctctggaggttgaagactatggctttagaaagtacaaaacaaagatttggcctacccttaaggagtggcgcaaagtgttctgtgattccaagctgatgagcgcggccatcaaagacaatcgggctgtccatgccgatatggggtattggattgagtctgctctcaacgacacatggaagatcgaaaaagcctccttcatcgaggtgaagtcttgccactggcccaagtctcacaccctgtggggaaatggcgtgcaggaaagcgagatggtcattccgaaaaactttgcgggccctgtttcccagcataataacagacccgggtactacacgcaaacagccggaccctggcacctgggcaaacttgagatggatttcgacttttgtgaagggaccaccgtggtggtcacagaggattgcggaaatcggggccctagcctccgcaccacgacagcttctgggaaactgatcaccgaatggtgctgtagatcctgcacactgccgcccctccggtatagaggagaggccggctgttggtactggatggacattcgccctctgaaggaaaaagagaagaaccttgtgagctccctggttaccgctggccatgggcagatcgataacttctctctccggattctgggaatggccctgtttcttgagaagatgctcatgacaagactgggcaccaaacacgccatcctgctcgtggctgtcagcttcgtgacgctgattacccgcaatatgtcctttaaggaccttgggagagttatggtgatggtcggagcgacaatgaccgatgacatgcggatgggcgtgacatatctggccctcctgcccgctttcaaagttcgccctacctttgccacggggctgcttctgagaaagctcacatctaaagaactgatgatgaccacaatcggaatcgtcctcttcagccagtcctctattcccgagaccatcctggaacttaccgacgccctggctctcggcatgatggtcctgaagatggtgcggaacatggagaaataccaactggccgtgacaattatggcgatcctttgcgtccctaatgctgttattctgcagaacgcctggcgcgtgagctgtacgatcctcgccgtggtctccgtgagccccctgtttctcacctcttccagacagaaggctgattggatcccgctggcccttacaattaagggcctgaatcctaccgcgatcttcctcacaaccctgagccggacgtctaaaaagcgctcctggcccctgaacgaagctattatggccgttgggatggtgagcatccttgcctcttccctgctcaaaaatgacattcctatgacaggacccctggtcgctggcgggctcctgaccgtgtgctatgttcttaccggaagaagcgccgatctggagctggagcgggctgccgacgtgaagtgggatgaccaggcggaaatctccggcagctctccgatcctcagcattacaatctccgaggatgggtctatgagcattaaaaacgaagaggaagaacagaccctgacaatccttattcgcacgggactgctcgtcatctccggcctgtttcctgtgtctattcccatcaccgccgctgcctggtacctctgggaggtcaagaagcagagagctggcgtgctgtgggacgttccttccccgccccctgtggggaaagccgaacttgaggatggagcctatcggatccagcagaagggcattttcgggtactcccaaatcggagctggcgtctacaaagaagggacattcccgaccatgtggcatgtgacaagaggagcggttctgatgcacaagggcaaacgcattgagccctcttgggccgacgtgaagaaggatctgatcagctatggcgggggatggaaactcgagggcgaatggaaggagggggaagaggtccaggtgctggctcttgaacctggcaagaatccccgggccgtgcagaccaagcctggcctgtttaaaacgaacaccgggacaattggagccgtttccctcgacttcagccccggcacctctggctcccctatcgtcgataagaaggggaaagtggtgggactgtacggcaatggggtcgtgacaagaagcggagcttatgtttctgccatcgcgcagaccgagaagtccattgaggactacccggaagtggagatggacatctttcgcaaaaagcggctcacaattatggatttccaccccggcgctgggagacaaaaacgctattttcctgccatcgtccgggaagccattaagagaggactgcgcacgcttatcctggctcccacccgggtggttgccgcggagatggaagaggctctgagaggcctccctatccggtaccagacacccgccattcgcgccgagcataccggcagagaaatcgtggacctgatgtgtcacgctaccttcacaatgcggcttctgagcccgattcgcgtccctaactataatctcatcattatggatgaggcccattttacggaccccgcttccatcgccgcgagagggtacatttctacccgggtggaaatgggagaggccgctggcatcttcatgacagccacaccccctgggagcagagatccctttcctcagtccaacgctccgatcatggacgaagaacgcgagattcccgaacggagctggaactctggacacgagtgggttacagatttcaagggcaaaatcgtgtggtttgtcccttccctgaagaccgggaaatacattgccgcctgcctcagaaagaacggcaaacgcgtgatccaactgagccggaagacgttcgactctgaatatgtgaaaacaagaaccaacgattgggacttcgtcgttaccacagatattagcgagatgggagctaattttaaggcggagcgcgtgatcgacccccggagatgtatgaagcctgtgatccttaccgacggcgaagaacgcgtcattctggccgggcccatgccggtgacacattcctctgctgcccagagacggggacgcatcggcagaaaccctaaaaatgaaaacgatcagtacatttatatgggggagcccctggaaaatgacgaggattgcgcccactggaaggaggctaaaatgctcctggacaacatcaatacccctgaaggaattatccccagcatgttcgagcctgaacgggagaaggttgatgccatcgacggcgaataccgccttagaggggaggcgcggaaaacgctgctcgagctgattagaggcggacccatcccggtgtatctgggctacaagtggcctggggaaggaattaactatgctgattcccgcctctgttttgacggcatcaagaataaccagattcttgaggaaaatgtcgaggtggaaatctggacaaaagagggggagcggaaggaactgaaacccagatggctggatgcccgcatttactctgaccccctcgccctgaaggagttcaaagaatttgctgccggaagaaagagccttaccctgaacctcatcacagagatgggcagactgcctaccttcatgacgcaaaaggcgagaggggccctggcttccctcatggttcttcacaccgccgaggctggcggacgcgcctacaatcatgctctgagcgaactgccggagacactcgaaaccctgcttctgctcacactgctggccaccgtgacaggcgggatctttctcttccttatgtctggaagaggcattgggaaaatgaccctgggaatgtgctgcatcattacggcgtccatcctgctctggtatgcccagattcagccccactggatcgctgccagcatcattctggagtttttccttacagtcctgctcatccctgaacccgagaagcagcggacccctcaagataaccagctgacctacgtgattatcgctattctgacagtcgtggccgccaccatggctaatgagatgggctttctcgagaagaccaagaaagaccttggcctggggaacatcgcgacgcagcagtcctgtaagaagatcctggatatttatctcggacccgccctgccttggaaactttacgctggcgggaccacattcatcaccccgatgctgcgccattctattgagaacagctccgttaatgtgtctctcacagccatcgccaaccaagctaccgtgctgatgggactgggcaaggggtggcccctcagcaaaatggacattggagtccctcttctggccatcggctgctattcccaggttaatcccattacgctgaccgcggccctctttctgcttgtggctcactacgccatcatcggccctgggctgcaggctaagcccacaagagaagcccagaaacgggcggccgctggaattatgaagaacccgaccgtggacggcatcacagtcattgatctcgaccctatcccctatgatcccaaattcgagaagcaactgggacaggtgatgctgctcgttctttgtgtgacccaggtcctgatgatgcgcacgacatgggccctgtgcgaagctctcaccctggccacagggcctgtgagcaccctttgggagggcaatcccgggagattctggaacaccacaattgctgtctctatggccaatatctttcggggatcctacctggcgggcgccggcctcctgttcagcatcatgaagaacacgacctctacacgcagagggaccggaaatattggcgagacactgggggaaaaatggaagtcccggctcaacgctcttggaaaaagcgagtttcaaatctacaagaaatctggcattcaggaagtggacagaaccctggccaaggaggggatcaagcgcggagaaacggatcaccatgctgttagccggggctccgccaaactgagatggttcgacgagcgcaatctcgtgacacctgagggcaaggtcgtggatctggggtgtggacggggcgggtggagctttttctgcggaggccttaaaaacgttagagaagtgaaggccctgaccattgggggaccgggccacgaggaacccatcctcatgagcacctatggccgcaatctggtccggtcccagagcggggtggtggtttttcatacacctcccgagaaatgtgacacctccctgagagatatcggagagtctagccctaaccccacagtcgaagcgggccgcacgctccgggtgcttaatctggtggagaactggctgaataacaacacccagttctgcattaaggtcctcaatccgtacatgccttccgttatcgaaaagatggaggctctgcaaagaaaatatgggggagcccttgtgcgcaaccccctgtctcggaatagcacacacgaaatgtactgggtgtccaacgcttctggcaatattgtcagctccgtgaacatgatcagcagaatgctcattaatcgctttaccatgagacataagaaagccacatatgagcctgacgttgatctggggtctggaacccggaacatcggcatcgagtccgaaacgcccaatctggacattatcggcaagcgcattgagaaaatcaagcaggaacacgagaccagctggcactacgatcaggaccatccttataagacatgggggtctcacggatcctacgaaaccaaacagacaggcagcgcctcttccatggtgaacggggtcgtgagactccttaccaagccctgggacgttgtgccgatggtcacacaaatggctatgaccgatacgacacctttcggacagcagcgggtgtttaaagagaaggtggacaccagaacccaggagcccaaagaaggcacaaagaaactgatgaagattacggccgagtggctgtggaaggaactcgggaaaaagaaaacaccccggatgtgtacacgcgaggagttcatcaagaaagtcagaagcaatgcggccctgggagctatttttaccgatgagaacaagtggaagtccgcccgggaggctgttgaagacggccgcttctgggagcttgtggataaagaaagaaatctgcatctcgagggcaagtgcgagacatgtgtgtacaacatgatggggaaacgggaaaagaaactgggagagttcggcaaggccaaggggagccgcgcgatctggtatatgtggctgggagccagatttctcgagttcgaggctctgggctttcttaatgaagaccactggttctctcgggagaacagcctgtccggggtcgagggcgaaggactccacaaactgggctacatccttcgcgaggtgtctaagaaagaagggggagccatgtatgctgatgacaccgccggctgggatacaagaattaccctggaggacctcaagaacgaggaacggaaaacgaatcatatgggaggggagcaccgcaagctggctagaggcatctttaagatgaacctgaccaataaagttgtgcgggtccaacgccctacacccgggggaaccctcatggatattatcagcagaaagacacagcggggatccgaacaggtgggcacctacgggctgacgacacttaccaacctggaggcgccccctattagacaaatggaaggaaaaggcgttttcaaggggcatcagcaccgcacagcgtctgaggaaaatgccgtgcaggactggctcgctcgggtcggaggcgagagactgagccgccttgccatctccggggacgattgcgtggttaaacccctggacgatcggtttgctagagccctcaccgccctgaacgacatgggcaaggtgcgcaaggatatccagcaatgggagccttctcggggatggaatgactggacgcaggtccccttctgcagccatcactttcacgaactgattatgaaagatggcagaaccctcgtggtcccttgtcgcaaccaggacgagctgatcgggcgggcgagaatttcccagggagctggctggagccttcgcgaaacagcctgcctggggaagttctatgcccaacggtggtctctcatgtactttcatagacgggatctgagacttgctcccaatgccatctgttccgctgtgcgcacccactgggttccgacaagccggaaaacctggcctattcatgcctctcacgactggatgacaaccgaggtgatgctgacggtctggaacaagctctggttccaggagaatccctggatggaagataaaacacctgtgggattttgggaggaaatccccttcctggagaagggcaaagaccagtggggaggctccctgatcggactcaccagcagaccgccttgggcgaagaacttccagcccgccattaatcaagtgcgctccctgctttgcaacgaagagtctgctgattttatgcccagcatgaagagattccggcgcgaggaagaggaagccggcgttctgtggtga

SEQ ID NO: 19675 - RNA, 9876 nt, synthetic construct
  misc_feature 1..9876: note = derived and/or modified CDS sequence (opt5) from DENV-2__JQ922549__SS-prME
  source 1..9876: mol_type = other RNA
accgccggcgtgatcattatgctgatccccacagctatggccttccacctcacgaccagaaacggggagcctcatatgattgtcagccggcaggaaaagggaaaatccctgctttttaagacagaggacggcgttaatatgtgcaccctgatggcgatggatctcggggaactgtgtgaggacacaatcacctacaactgcccgcttctgcgccaaaatgaacccgaggatattgactgttggtgcaactctacaagcacctgggtgacgtatggaacctgtacagctcctggcgatcacagacgggagaaacgctccgtggccctcgtcccccatgtggggatgggactggaaaccagaacagagacctggatgtctagcgaaggcgcctggaagcacgctcagcggatcgagacgtggatcctgcgccatcctggcttcacaattatggccgctatcctcgcctacaccattgggacaacctattttcagagagttctgatccttattctgctcaccgcggtggccccctccatgacaatgcggtgcatcggaatttctaatcgcgacttcgtcgagggcgtgagcgggggatcctgggttgatatcgtgctggaacacggcagctgtgtcacgaccatggctaaaaacaagcctacacttgactttgagctgatcaagaccgaagccaaacagccggctacactcaccaagtactgcattgaggccaaactgacgaatacaaccaccgcgtctagatgtcccacacaaggggaaccttccctgaacgaggagcagcacaagcggttcgtgtgcaaacatagcatggtggatcgcggatggggcaatggctgtgggctctttggaaagggcgggatcgtcacctgcgccatgttcacatgcaagaaaaacatgaagggaaaaattgttcagcccgaaaatctggagtatacgatcgtggtgacccctcactctggcgaagagaacgctgtcgggaatgacacaggaaagcatggcaaagaaattaaggtgagaccccagtccagcatcaccgaggccgagcttacaggctacgggaccgttacgatggaatgttctccgcggaccggatttgctttcaacgagatggtgctgctccaaatggaaaataaagcctggctggtccaccgccagtggtttcttgatctgcctctcccctggctgcctggcgccgacacacaggggtccaactggatccagaaggagaccctggtgacattcaagaacccccacgctaaaaagcaagatgttgtggtcctcggaagccaggaaggcgcgatgcataccgccctgacgggggctacagagattcagatgtcctctggcaatcttctgtttaccggacacctcaaatgcagactgcggatggacaagcttcaactgaaaggcatgagctattccatgtgtacagggaagttcaaggtggtcaaagagatcgccgaaacccagcatggaaccattgtgatcagagttcagtacgagggcgacgggagcccctgcaagattcctttcgaaatcatggatctcgagaaacgcctggtgctgggacggctcatcacagtcaacccgattgtgacggagaaggactctcccgttaatatcgaagccgagcctccctttggcgattcctacattatcattggggtggaacctggccagctgaaacccagctggttcaagaagggatctagcatcagacaaatgtttgagaccacaatgcgcggcgctaaacggatggccattcttggggacaccgcgtgggatttcggatccctgggcggggtctttacatctatcggaaaggctctccaccaggtgttcggcgccatctatggggccgcttttagcggcgtgtcctggaccatgaaaattctgatcggagttgtcattacgtggatcggcacaaacagcagatctacctccctgagcgtgtctcttgtgctcgtcggggtggttaccctgtacctgggagtgatggtccaggccgactccggctgtgtggttagctggaagaataaagaactcaagtgcgggtccggaattttcatcacagataacgtgcatacctggacagagcagtataagtttcaaccggagtctcctagcaaactggcttccgccatccagaaggcgcacgaagagggcatttgtgggatccgctctgtcacgcggcttgaaaatctgatgtggaaacagattacccccgagctcaaccacatcctgagcgaaaatgaggtgaagctgacaattatgaccggcgacatcaaaggaatcatgcaggccggcaagagatcccttcgccctcaacccacagagctcaaatacagctggaagacctgggggaaggctaaaatgctgtctacggaacctcataaccagaccttcctgattggaggccccgagacagccgaatgcccgaataccaaccgggcttggaattccctcgaggttgaagattatgggtttggagtgttcacaaccaacatctggctgaagcttaaagagagacaggacgtcttttgtgatagcaagctgatgtctgccgcgattaaagacaatcgcgccgtgcacgctgacatgggctactggatcgagtccgccctcaacgatacatggaagattgaaaaggctagcttcatcgaggtgaaatcttgccattggcctaagagccacaccctgtggtccaacggcgtcctggaaagcgagatgatcattcccaaaaatttcgccgggcccgtttctcagcacaactatcggcctggataccatacgcaaacagccggcccgtggcaccttgggaagctcgagatggactttcatttctgtgaaggaaccaccgtggtggtcacagaggattgcggcaatagagggccctccctgcggaccacgacagctagcggaaaactgatcaccgaatggtgctgtcgctcctgcacactccctcccctgagataccggggcgaggacggctgttggtatgggatggaaattagacctcttgagggagaggaaggcgatctggtgcactctctcgttaccgcggggcatggacagatcgacaactttagcctgggcgtgctggggatggcccttttcctcgaggaaatgctgcgcacacgggtcggaaccaagcacgctgtgctgctcgttgccgtgtcctttatgacgctgattaccggcaatatgtctttcagagatcttggccgcgtcatggtgatggttggggccgctatgacagacgatatcggaatgggcgtgacctacctggccctcctggcggcttttaaggtcagacccacattcgccgccgggctgcttctgcggaaactcaccagcaaggagctgatgatgacgacaattggaatcgtgctcctgtcccagtctaccatccctgaaacaattcttgagctgaccgacgctctcgccctgggccgcatgatcctgaaaattgtgagaaacatggagaagtatcaacttgcggtcaccatcatggctattctgtgcgttcccaatgccgtgatcctccagaacgcctggaaagtgagctgtacaatcctggctgtcgtgtccgttagcccgctcctgcttacgtcttcccagcagaaggccgattggattcctctggctctcaccatcaaggggctgaatcccacagccatttttctgaccacacttagccggaccaacaaaaagcgctcttggcctctgaatgaagcgatcatggccgtgggaatggtctccattctcgctagctctctgctcgagaacgacatccccatgacgggcccgctggtggccggcgggcttctgacagtttgctacgtgctgaccggaagatccgctgatctcgaactggagcgggccgccgacgtccgctgggaagaccaagctgagatcagcggctccagccctattctttctatcaccattagcgaggatgggtccatgtctatcaaatatgaagaggaagagcccacactgaccattctcatcagaacaggactgctcgtgattagcggcctgttccctgtctccatccccatcacggcggccgcttggtacctttgggaggtgaagaaacagcgggccggggttctgtgggacgtgccctctcctccgcccgtcggaaaggccgaactggaggatggcgcttatcgcattaaacagaagggcatcctcgggagctcccagattggagccagagtgtacaaggaaggcacctttcacacaatgtggcatgttacccggggggcggtgctgatgcacaaaggaaagagaatcgagccttcttgggctgacgtccgcaaagatcttattagctacggcgggggatggaagctggaaggcgagtggaaagagggcgaagaggtgcaagtgctcgccctggaacccgggaagaatcctcgggccgttcagacaaagcccggactcttcaaaaccaacacgggcaccatcgggacagtctccctggactttagccctggaacctctgagtccccgatcgtggataagaaaggcaaggtggtcgggctttatggaaatggcgtggttacaagaagcggcacctacgtgtctgctattgcccagacagaaaaatccatcgaggacaaccccgagattgaagatgacatcttccgcaagaagcggctgacgattatggatctgcatcctggggcgggaaaaaccaagagatatctccccgctatcgtccgcgaggccatcaaacggggcctgagaacacttattctggcccctacccgcgtggttgctgccgaaatggaggaagctctccgggggctgcccatcagataccagaccccggccattcgggcggagcacacaggacgcgagatcgtggacctcatgtgtcatgccacgttcaccatgagactgcttagccctgtccgggtgcccaactataatctgattatcatggatgaagctcactttacagaccccgcctccattgctgcccgcggctacatctctaccagagttgagatgggggaagccgctggcatcttcatgacagcgacccctcccggaagccgggacccttttccgcaatccaacgcccccattatggatgaggagagagaaatccctgagcgcagctggaattctggccacgaatgggtgacggacttcaaggggaaaacagtctggtttgtgccctccattaaggctggaaacgatatcgccgcctgcctgcggaagaatggcaaaaaggtgattcagctcagcagaaaaaccttcgactctgagtatatcaagacccgcacaaacgattgggactttgtcgttaccacagatatcagcgaaatgggggctaatttcaaagccgagcgggtgattgaccctagacgctgtatgaagcccgtgatcctgaccgatggagaggaacgggtcattcttgcgggcccgatgcctgtgacgcattcctctgctgcccagagacgcgggagaatcggccggaaccccaagaatgagaacgaccaatacatttacatgggagaacctctggagaatgatgaagactgcgcccactggaaagaggctaagatgctcctggacaacatcaatacacccgagggcatcattcctagcatgtttgaacccgagcgcgaaaaagttgatgccatcgacggggagtatagactgcggggagaagcgcgcaagaccttcgtggatctcatgagacggggcgaccttccggtctggctggcctacagagtggctgccgaggggattaactatgctgatcgccggtggtgttttgacggaatcaaaaataaccagattctggaggaaaacgttgaggtggaaatctggacaaaggagggcgagagaaaaaagctcaagcctcgctggctggatgcccggatttactccgacccccttgctctgaaagaattcaaggagttcgccgcggggagaaaatctctcaccctgaatctgatcacggaaatgggccggctccccacctttatgacacagaaggcccgcaacgctcttgataatctggccgtcctgcataccgctgaggccggaggcagagcctataaccacgctctcagcgaactgcctgagacacttgagaccctgctcctgctgacactccttgcgaccgtgacggggggaatcttcctgtttctgatgtccggcaaagggattggaaagatgacactcggcatgtgctgcatcattaccgccagcatcctgctttggtacgctcagattcaaccgcactggatcgccgcctctatcattctggaattctttctcatcgtcctgctgattcccgagcctgaaaagcagcggaccccccaggacaatcagctcacatatgtggttatcgctattcttaccgtggtggccgcgacaatggccaacgagatgggcttcctggaaaaaacgaagaaagattttgggctgggatccatcgctacccaacagcctgagagcaatatcctcgacattgatctgcgccccgcctccgcttggacactttacgccgtcgcgaccacattcatcacccctatgctgagacattctattgagaacagcccggttaatgtgtccctcacggccatcgctaaccaggccaccgtgctgatgggcctggggaagggatggcccctctctaaaatggacattggcgtccctccccttgctatcgggtgttacagccaggtgaatcctattacactgaccgccgctctgctcctgcttgttgcccactatgcgatcatcggacccggcctgcaagtgaaggccacacgggaagctcagaagcgcgccgctgccggcattatgaaaaacccgaccgtcgacgggatcacggtgattgatctcgaccctatcccctacgatcccaagtttgagaaacagctgggacagattatgctgagagtcctctgcgtgacacaagttcttatgatgcggaccacatgggccctgtgtgaagcgctgaccctcgctaccggccctatctccacactgtgggaggggaatcccggacgccttggcaacacgaccatcgccgtgagcatggctaatattttcagagggtcttatctggccggagccggcctcctgttttccatcatgaagaacacaaccaatacacggagaggcaccagcaacctgggggaaacgctcggagagaaatggaagaaccgccttaattctctgggcaagtccgagttccagatttacaaaaagagcgggatccaggaagtcgaccggacactggctaaagagggaattaagaaaggcgaaaccgatcatcacgccgtgtctagagggagcgcgaagctccgctggtttgttgagcggaacctggtgacccctgagggaaaagtcgtggaccttggctgcggcagagggggatggtcctattactgtggcgggctgaagaatgtgcgcgaagttaagggactcacaaaaggcgggccgggacatgaggaacccatccctatgtctacctatggctggaacctggtccggctgcaaagcggcgaggatgtgttcttcacaccccctgaaaagtgcgacacgctcctttgtgatatcggggagtccagccccaatccgaccgtggaggccggaagaacactgcgcgtcctgaacatggttgaaaattggctcaacaataacacccagttttgcattaaagtgctgaatccttacatgccctccgtgatcgagaagatggaagctcttcagcggaaatacggcggggccctggtcagaaaccctctctctcgcaatagcacacacgagatgtattgggtgtccaacgcttctggaaatattgttagctccgtgaacatgatctctcggatgctgattaacagattcaccatgcgccacaagaaggccacgtacgaacccgacgtcgatctgggcagcgggaccagaaatatcggaatcgagtccgagacacctaacctcgacattatcggcaaacggattgaaaagatcaaacaggagcatgaaaccagctggcactatgatcaagaccatccctacaagacatgggcgtatcacggctcttacgagaccaaacagacagggtccgccagctctcttgtgaatggagttgtgcgcctgctgaccaagccgtgggacgtcattcctatggtgacgcagatggctatgacagataccaccccctttggccagcaaagagtgttcaaggaaaaagtcgacacacggacgcaggagcccaaggaggggaccaaaaagctcatgaaaatcacagccgaatggctgtggaaggagcttggaaagaaaaagacccctagaatgtgtacacgggaagagttttcccgcaaagttagaagcaacgctgccctgggcgctattttcaccgatgagaataagtggaaatctgcccgggaagcggtggaggacgggcgcttttgggaactcgtggataaggagagaatcctgcacctggaaggaaaatgcgagacatgtgtctataacatgatgggcaagcgggagaagaaaatcggcgaattcgggaaggccaaaggatcccgcgctatttggtacatgtggctcggcgccagatttctggagttcgaagctcttgggtttctgaatgaggaccattggttcagccgggaaaactccctcagcggagtggagggcgaggggctgcacaagcttggctacatcctgcgcgaagtttctaaaaaggagggaggcgccatgtatgccgatgacaccgcggggtgggatacgagaattaccctcgaagacctgaagaatgaggaaatggtgacaaaccatatggagggagagcacaaaaagctggctgaagccatctttaaactcacctaccagaataaggtcgtgcgggttcagcgcccgacacccagaggcaccgtgatggatattatcagccggcgcgaccaaagagggtccggacaggtcggcacgtatgggctgaacacattcaccaatatgggcgcccagcttatccggcaaatggagggagaaggcgtgttcaaagggattcagcatctgacagctaccgaggagatcgccgttcaggactggctcgctagagtgggacgcgaacggctgtctagaatggccattagcggcgatgactgcgtcgtgaagcctcttgatgaccgctttgcgtccgccctgacggctctcaacgatatggggaaggtccggaaagacatccagcaatgggagccctctagaggatggaatgattggacccaggtgcctttctgcagccaccactttcatgaactgattatgaaggacggccgcgttctggtggtcccctgtcggaaccaggatgagctcatcgggagagcccgcatctcccagggcgctggatggtctctgcgggaaacagcctgccttggcaaaagctacgcgcaaatgtggtccctgatgtatttccacagacgcgacctccggctggccgctaacgccatttgtagcgctgtgccttctcattgggtgcccacctccagaacaacccggagcatccacgccagacaggagtggatgacaaccgaggttatgcttacggtgtggaatcgcgtctggattcaggaaaacccgtggatggaggataagacacctgtggaatcttgggaggaaatcccctacctggggaaacgggaggaccagtggtgcggatccctcattggcctgaccagcagagctacctgggccaagaatatccaaacagcgattaaccaggttcgctccctgatcgggtctgaggaatataccgattacatgcctagcatgaagagatttcggcgcgaggaagaggaagccggagtgctctggtga

SEQ ID NO: 19676 - RNA, 9876 nt, synthetic construct
  misc_feature 1..9876: note = derived and/or modified CDS sequence (opt5) from DENV-2__JQ922552__SS-prME
  source 1..9876: mol_type = other RNA
accgccggcatgatcattatgctgatccccacagtgatggctttccacctcacgaccagaaacggggagcctccgatgattgtcagccggcaggaaaagggaaaatccctgctttttaagacagaggacggcgttaatatgtgcgccctgatggcgatggatctcggggaacgctgtgaggacaccatcacatacaactgccccctgcttaatcaaaacgaacctgaggatattgactgttggtgcaattctaccagcacatgggtgacctatggaacgtgtaccacaaccggcgagctgagacgggaaaaaatctccgtggctctcgtcccccatgtggggatgggactggagacacgcaccgaaacgtggatgtctagcgagggcgcctggaagcacgcccagagaatcgagatttggatcctgcggcatcctggcttcacaattatggctgccatcctcgcttacaccattgggacatcccactttcagcgcgttctgatcttcattcttctgaccgccatcgcgccctctatgaccatgagatgcatcggaattagcaaccgggattttgtggaaggcgtctccgggggaagctgggtggacatcgttctcgagcatggctcttgtgtgacaacgatggccaaaaataagcctaccctggatttcgaacttattaagacagaggctaaacagccggccaccctgcgcaagtattgcatcgaagctaaactcacaaacaccacgacagactccagatgtcccacccaaggggagcctaccctgaatgaggaacaggataagcggtttgtctgcaaacacagcatggtggaccgcggatggggcaacggctgtgggctgttcggaaagggcgggattgtgacatgcgccatgtttacctgcaagaaaatcatgaagggaaaaatcgtccagcccgagaatctcgaatacacagttgtgattacgcctcactctggcgaggaacatgcggtggggaacgataccggaaagcacggcaaagaggtcaagatcacaccccagtccagcattaccgaggccgaactgacaggctatgggaccgtgacgatggagtgttctccgagaaccggacttgacttcaatgaaatggttctgctccaaatggaggataaagcttggctggtgcatcggcagtggtttcttgacctgcctctcccctggctgcctggcgccgacacacaggggtccaactggatccagaaggaaaccctggtcacattcaagaatccccacgctaaaaagcaagatgtggttgtgctcggaagccaggagggcgccatgcacaccgccctgacgggggctacagagattcagatgtcctctggcaaccttctgtttaccggacatctcaaatgccgcctgagaatggacaagcttcaactgaaaggcatgagctactccatgtgtacagggaagttcaaggtcgtgaaagaaatcgcggagacccagcacggaaccatcgtcattcgggtgcagtatgaaggcgatgggagcccctgcaagatccctttcgagattatggacctcgagaaaagacatgttctgggacgcctgatcacagtgaacccgattgtcacggaaaaggattctcccgtgaatatcgaggccgaacctccctttggcgactcctacattatcatcggggttgagcctggccagctcaaactgaactggttcaagaagggaagctctattggccaaatgcttgaaaccacaatgcggggggctaaaagaatggccatcctgggagataccgcctgggactttggcagcctcgggggagtgttcacatccattggcaaggctctgcaccaggtctttggggccatctacggcgcggctttctctggagtgagctggaccatgaaaattctgacgggcgtgatcatcacatggattgggatgaattcccgcagcacctctctttccgttagcctcgtcctggtgggaatcgtgaccctgtatctcggcgtcatggtgcaggccgattctgggtgtgttgtgtcctggaagaacaaagagctgaagtgcggaagcggcatttttgtcacagacaatgtgcatacctggacagagcagtacatgttccaacccgaatccccgtctaagcttgccagcgctatccagaaagcccacgaggaagggatttgtggcatccggtccgttacgagactggagaacctcatgtggaagcagatcacccctgaactgaatcacattctgtctgagaacgaggtgaaacttacaatcatgaccggagatattaagggcatcatgcaggtcgggaaacgcagcctccggccccaacctacagaactgagatattcctggaagacctggggacagcccaaaatgctgagccctgagctccatcaccagacgtttctgattgacggccccgaaaccgctgagtgcccgaatacaaaccgcacctgggactctcttgaagtggaggattacgggttcggagtttttacaaccaagatctggctgcggctcagagagaagcaggacgtgttctgtgattccaaactgatgagcgccgcgatcaaggacaatcgcgccgtccatgctgatatgggctattggattgaatctgccctgaacgacacatggaaaatcgagaaggcttcctttattgaagtgaaaagctgccactggcctaagtctcacaccctttggagcatgggcgtgctcgagtccgagatggtcatccccaagaatttcgccgggcccgttagccaacataaccaccggcctggaattccgacgcagacagcgggcccctggcatctggggaaactggaaatggatttcgacttttgtgagggaaccaccgtggtggtcacagaagattgcggcaatagagggccttctctccggacctccacggccagcggaaagctgatcacagagtggtgctgtcgctcctgcacccttccccctctgagataccggggcgaagacggctgttggtatgggatggagattagacccctcaaagagaaggaagagaacctggtgtctagcctggttacagctggacacggccagatcgataacttctcccttgggatcctcggaatggccctgtttctggaagagatgctccgcacccgggtgggcacaaaacatgctattctgcttgtcgccgtgtctttcgttaccctgatcacggggaatatgagcggaagagacctcggccgcgtgatggtcatggtgggcgccaccatgacagatgacattgggatgggagttacctacctggctctgcttgcggcctttaaggtgagacctacattcgctgccggcctgctcctgcggaagctcacctccaaagaactgatgatgacgacaatcgggattgtccttctgtctcaaagctccatccccgagaccatcctcgagctgacagacgccctggctcttggaatgatggtgctgaagatggtgcgcaacatggaaaaataccagctcgccgtcaccattatggcgatcctgtgcgttccgaatgctgtgattctccagaacgcctggaaggtgagctgtaccatcctggcccttgtctctgtgtcccctctgtttctcacaagctctcagcaaaaagctgattggattcccctggccctgacgatcaagggccttaatcctaccgcgatcttcctgacaaccctctccagaacaagcaagaaacggtcttggcccctgaacgaggctattatggccgttgggatggtgtccatcctcgccagctccctgcttaagaatgacattccgatgaccggacctctggtcgctggcggcctgctcacggtgtgctatgttctgacagggcgcagcgccgatcttgaactggagagagctgccgacgtgaaatgggatgaccaggcggaaatctctggaagctcccccattctctctatcaccattagcgaggatggctccatgtctatcaagaacgaggaagaggaacagaccctgacaatcctcattcggaccgagctgcttgtcatcagcgggctgtttcctatttccatccccattacagccgctgcctggtacctgtgggaggtgaaaaagcagcgcgctggagtcctctgggacgtgccctctcctccgcccgttggcaaagccgaactggaggatggggcctatagaatcaagcaaaagggaatccttggctacagccagattggcgctggggtgtataaagaaggaacgttccacaccatgtggcacgtcacacggggcgcggtgctgatgcataaggggaaacgcatcgagccttcctgggccgacgttaagaaagatctcattagctacggaggcgggtggaagctggaaggagagtggaaggagggcgaagaggtgcaggtcctcgctctggaacccggcaaaaatcctagagccgtgcagaccaagcccgggctttttaaaacaaacaccggaacgatcggcgccgtgtctctggacttctcccctgggaccagcggatctccgattgttgataagaaaggcaaggtcgtggggctgtatggaaatggcgtggtcacacggtccggcgcttacgtgagcgccatcgcgcaaaccgagaagtccatcgaagacaaccccgagattgaggacgatatctttagacgcaaaaagctcacaattatggacctgcaccctggggctggaaaaaccaagcggtaccttcccgccatcgttagagaagccattaaacgcggcctgcggacactcatcctggctcctacgagagtggtcgccgcggagatggaagaggctctccgcgggctgcccattcggtatcagaccccggccatcagagccgaacatacaggacgcgagatcgtggatcttatgtgtcacgctaccttcaccatgcggctgctgtctcctattagagttcccaattacaacctcatcattatggacgaggcccatttcacagatcccgctagcatcgccgcgcggggctatatttccacgcgcgtggaaatgggggaggccgctggcatctttatgaccgccacacctcccggaagcagagaccctttcccgcagtctaatgctcccatcatggatgaagagcgggagattcctgaacgctcctggaacagcggccacgagtgggtcaccgactttaaggggaagacagtgtggttcgttccctctatcaaaaccggaaacgatattgccgcctgcctgagaaagaatggcaaacgggtgatccaacttagcagaaagacgtttgactccgaatacgtcaaaacacgcaccaacgattgggacttcgtggtgaccacagacatttctgagatgggggctaattttaaggcggaacgggtcatcgatcctagacgctgtatgaagcccgttatcctgaccgacggagaggagcgggtgattctcgccggcccgatgcctgtgacacacagctccgctgcccagagacgcgggcggatcggcagaaaccccaaaaatgaaaacgatcagtatatttacatgggagagcctctggaaaatgacgaggattgcgcccattggaaggaagctaaaatgctgctcgacaacatcaatacccccgagggcattatcccttctatgttcgagcccgaacgcgagaaggtcgatgccattgacggggaatatagacttcggggagaggcgcgcaaaacgtttgtggatctgatgagacggggcgacctgccggtttggctcgcttaccgcgggcctgccgaaggaatcaactacgccgatagacggtggtgtttcgacggcatcaagaatagccagtttctggaggagaacgtggaagtcgagatttggccctccgggggcgaaagaaaagagcttaagccccgctggctggatgctcggatctatagcgaccctctcgccctgaaggagttcaaagaattcgcggccggaagaaagtctctgacactcaatcttattaccgagatgggccgcctgccgacatttatgacccaaaaagctcggaacgccctggacaatctcgctgtgctgcacacggccgaagctgggggaagagcctacaaccatgcgctttccgagctgcccgaaaccctcgagacactgctgctccttaccctgctggccacagttaccggcgggatcttcctctttctgatgagcggacggggcattggcaagatgacacttgggatgtgctgcatcatcaccgcttccattctgctctggtatgcccagatccagcctcactggattgctgcctctatcattctggagttctttctgatcgtgctccttatccccgaacctgagaaacagcgcacgccccaagataaccagctgacatacgtcattatcgccattctgaccgtggtcgctgcgaccatggccaatgaaatgggattcctcgagaagacaaagaaagacctgggccttgggaacatcgtgacccagcagcctgaaagcaatattctggatatcgacctcagaccggcttccgcctggacactgtatgccgctgccacgacctttattacacccatgctgcggcactctatcgagaacagctccgttaatatgagcctcaccgcgatcgccaaccaagctacagtgcttatgggactgggcaaggggtggcctctgtctaaaatggatattggagtgcccctcctggccatcggctgttactcccaggtcaatcctattacccttacggctgccctgttcctcctggttgcgcattatgccatcaagggccccgggctgcaggctaaagccacccgcgaggctcagaagagagccgctgccggaattatgaagaacccgacagtggacggcatcaccgtgatcgatctcgaccctattccctacgatcccaaatttgaaaagcaacttgggcaggtcatgctgctggtgctctgcgttacacaggtgctgatgatgcggaccacgtgggcgctttgtgaggccctgacactcgctaccggacctgtcagcacactgtgggaaggcaatcccgggcgcttctggaacaccaccatcgccgtgtctatggctaatatttttagaggatcctacctggccggcagctctcaagtctggcctagcatcaacaatctcaaaggcgggcggcgcggaacaggcgcccagggggagacgcttggagaaaagtggaaaagacagctgaaccagctgtccaagtctgagttcaatacctataagcggagcggcattatggaggtggacagatccgaagcgaaagaggggctcaagcgcggagaaacaaccaaacacgctgttagccggggcacagccaagctgagatggtttgtggagcgcaaccttgtcaaaccggagggcaaggtgatcgatctggggtgcggacggggcgggtggtcctactattgtgctggactcaaaaaggttaccgaagtgaagggctacacgaaagggggacccggccatgaggaacctatccccatggccacatatggctggaatctggtcaagctgcactctgggaaagacgtgttcttcacccctcccgagaagtgcgataccctcctttgtgacattggagaaagctccccgaaccctacagtggaggccggcagaaccctgcgcgttctgaacctcgtcgagaattggctgaacaataacacacaattttgcatcaaagtgcttaatccctacatgccttctgtgattgaaaagatggagacgctgcagcggaagtatgggggagctctcgtcagaaaccccctgagccgcaattccacccatgaaatgtactgggtttctaacgccagcggcaatatcgtgtccagcgtgaacatgatttctcggatgctgatcaatagattcacaatgcgccacaaaaaggcgacctacgagcctgacgtcgatctcgggtccggaacacggaacatcggcattgaaagcgagacccccaatcttgacatcattggcaaaagaatcgagaagattaaacaggaacacgagacgtcttggcattatgatcaggaccacccgtacaagacctgggcctatcatgggtcctacgaaacaaagcaaaccggaagcgcttcttccatggtgaacggcgttgtgcgcctgctgacaaaaccttgggatgtcgtgcccatggttacccagatggccatgacagacaccacgccctttgggcagcagagagtgttcaaggagaaagtcgatacacggacccaagaacctaaggagggaaccaaaaagctcatgaagatcacagctgagtggctgtggaaagaacttggcaagaaaaagacgccgcgcatgtgtcccagagaggaatttaccaaaaaggtgcggagcaatgccgcgctgggggccattttcacagacgctaccaaatggaagtccgccagagaggctgtggaggatggacggttttgggaactcgtcgacaaggagcgcaacctgcacctggaaggcaaatgcgagacatgtgtttataacatgatgggcaagagagaaaaaaagctcggggagttcggaaaagccaagggcagccgggctatctggtacatgtggctgggggcccgctttcttgagttcgaagcgctgggatttctcaatgaggatcactggttctctagagaaaacagcctgtccggcgtggagggggaaggccttcataagctgggatatatcctccgggaggtgcgcaaaaaggagggcggggccatgtacgctgacgactctgccggatgggataccagaattacactggaagacctgaaaaatgaggaacggatcaccaaccacatggaggtcgaacataagaaactcgctgtgggccactttattctgacgtaccctaataaggttgtgcgcgtccagagacccacccctgtggggacagttatggatatcattagccggaagtcccagcgcggatctggccaagtggggacctatggccttaacacattcaccaatctggagggacccagaatccggcagatggagggcgaagagagcttcaaatcccatcagctccagacggccacagaacgcaacgccgtccaagactggctggcgagagtggggcgggagagactttctcgcatggctatcagcggagatgactgcgttgtgaagcctctggatgaccggtttgccagagccctcaccgctctgaatgatatgggcaaagtccgcaaggacattcagcagtgggagccctcccgggggtggaacgattggacacaggtgccgttctgcagccaccactttcatgaactgatcatgaaagacggaagaaccctcgtcgtgccttgtcgcaatcaagatgagctgattggccgggccagaatctctcagggggctggctggtcccttcgcgaaacggcctgcctgggaaagagctacgcgcagatgtggtctctcatgtatttccaccggagagacctgcgccttgccgctaacgccatttgttccgctgttcccagccattgggtgcctacctcccggacaacctggtctatccacgccagccacgagtgggtcgcgacagaagacatgctgaccgtgtggaatagagtgtggatccaggagaacccctggatggaggataagacaccggttgaatcctgggaggaaattccttacctcggcaaacgggaggaccaatggtgcgggagcctgatcggactgacctctagagccacgtgggctaagaatattcagacagccatcaaccaggtgcgctccctcattggcaacgaagagtataccgattacatgcccagcatgaaacggtttagacgcgaggaagaggaagctggggtcctgtggtga

SEQ ID NO: 19677 - RNA, 9876 nt, synthetic construct
  misc_feature 1..9876: note = derived and/or modified CDS sequence (opt5) from DENV-2__GU131896__SS-prME
  source 1..9876: mol_type = other RNA
agcgccggaatgatcattatgctgatccccaccgtgatggctttccacctcacaacgagaaacggggagcctcatatgattgtcggaatccaggaaaagggcaaaagcctgctttttaagaccgaggacggggttaatatgtgcacactgatggccatggatctcggagaactgtgtgaggacaccattacatacaaatgcccgcttctgcggcaaaacgaacccgaggatatcgactgttggtgcaattctaccagcacatgggtgacctatggcacgtgtaccacaaccggggagcacagaagagaaaagcggtccgtggcgctcgtccctcatgtgggaatgggcctggagacacgcaccgaaacgtggatgtctagcgagggcgcttggaaacacgcccagagaatcgagacatggattctgcggcatcccgggttcaccatcatggccgctattctcgcctacacaatcggaaccacccactttcagcgcgctctgattttcatccttctgacagccgttgcgccttccatgacgatgagatgcattggcatctctaaccgggattttgtggaaggggtcagcggaggctcctgggtggacatcgttctcgagcacgggagctgtgtgaccacaatggccaagaataagcccaccctggatttcgaacttattaaaacagaggctaagcagcctgccaccctgcgcaaatattgcatcgaagctaagctcacgaacacaaccaccgagtctagatgtccgacacaaggagagccctccctgaaagaagaacaagacaagcggtttgtctgcaagcatagcatggtggatcgcggctggggcaatgggtgtggactgttcggcaaagggggaattgtgacctgcgccatgtttacatgcaagaaaaacatggaaggcaagatcgtccagcctgagaatctcgaatacacgattgttgtgacaccccactctggggaggagcatgcggtgggaaacgacacaggcaaacacggcaaggaaatcaaagtcacccctcagtccagcatcacagaggccgaactgaccgggtatggaacggtgaccatggagtgttctcccagaacaggccttgatttcaatgaaatggttctgctccaaatggagaacaaggcttggctggtgcaccggcagtggtttcttgacctgccgctcccttggctgcccggggccgataagcagggatccaattggattcagaaagagaccctggtcacattcaagaaccctcatgctaaaaagcaagacgtggttgtgctcggcagccaggaaggggccatgcacaccgccctgacgggcgctacagagatccagatgtcctctggaaatcttctgtttaccggccatctcaaatgccgcctgagaatggacaaacttcaactgaaggggatgagctactccatgtgtacaggaaaattcaaggtcgtgaaagaaattgcggagacccagcacggcaccatcgtcattcggctccagtatgagggggatggaagcccctgcaagatccccttcgaaatcatggacctggagaaaagatacgtgctgggccgcctcattacagttaaccctatcgtgacggaaaaggattctccggtcaacattgaggccgaacccccttttggggactcctacatcattatcggcgtggagcccggacagctgaaacttaattggttcaaaaagggcagctctattgggcaaatgtttgagaccacaatgcggggagctaaaagaatggccatcctgggcgataccgcctgggacttcgggagcctcggaggcgtttttacatccgtggggaaggctctgcatcagatcttcggcgccatttatggagcggctttttctggcgtcagctggaccatgaaaatcctgattggggtgatcattacgtggatcggaatgaactcccgcagcacatctctttccgtgagcctcgttctggtcggcatcgtgaccctgtacctcggggtgatggtccaggccgattctggatgtgtggtttcctggaagaataaggaactgaaatgcggcagcgggattttcatcaccgacaacgtgcacacatggaccgagcagtataagtttcaacctgaatccccctctaaacttgccagcgctattcagaaggcccaggaggaaggcatctgtggcattcggtccgtcacaagactggagaatctcatgtggaaacagatcacgccggagctgaaccacatcctggctgaaaatgaggtgaaacttaccattatgacaggcgatatcaaagggattatgcaagccggaaagcgctctctccggcctcagcccaccgaactgaagtacagctggaaaacatggggcaaggcgaaaatgctgtccaccgagagccataaccagacgttcctcatcgacgggcctgaaaccgccgagtgccccaatacaaacagagcttggaactctctggaggttgaagattatggatttggcgtgttcaccacaaacatttggcttaagctgaaagagaagcaggacgccttttgtgactccaagctcatgagcgctgccatcaaagataatcgcgcggtccacgccgacatgggctactggatcgaatctgctctgaacgatacctggaagattgagaaagcctccttcatcgaggtgaagaattgccattggcctaaaagccacacactgtggtctaacggggttcttgaaagcgagatgattatccccaagaacctcgctggaccggtgtcccaacacaattatcggcctggctaccatacccagacggccgggccctggcacctgggaaagctggaaatggacttcgatttttgtgacggcacaaccgtcattgtgaccgaggattgcgggaacagaggacccagcctccgcacaaccacggcctctggcaaactgatcacagaatggtgctgtcggtcctgcacccttcctccgctgagataccggggcgaggacgggtgttggtatggaatggagattcgccccctcaaggaaaaagaggaaaatctggtgaacagcctggtcacagctggccatgggcaggttgataatttctcccttggagtgctcggcatggcgctgtttctggaggaaatgctcagaacccgggtggggacaaagcacgccatcctgcttgtcgctgtgtctttcgttaccctgatcacgggaaacatgagctttaaagacctcggcagagtggtcgtgatggttggcgccaccatgacagatgacattgggatgggagtgacctacctggccctgcttgctgccttcaaggtccgccctacatttgcggctggcctgctcctgcggaagctcacctccaaagagctgatgatgacgacaatcgggattgtgcttctgtctcaaagcaccatccccgagacaattctcgaactgaccgatgccctggcccttggaatgatggttctgaagatcgtgagagacatggagaaatatcagctcgctgtcaccatcatggccattctgtgcgtgcctaatgcggtgatcctccagaacgcttggaaggtctcctgtacaattctggccgttgtgtctgtgagcccccttctgctcacgtccagccagcagaagaccgactggatccctctggccctgacaattaagggccttaatcccaccgctatcttcctgacaaccctctctcgcacgaacaaaaagagatcctggccgctgaatgaagccatcatggctgtcgggatggtgagcattctcgcctcttccctgcttaagaacgatatccctatgacaggacccctggttgcgggcggcctgctcaccgtgtgctacgtcctgaccgggcggagcgccgaccttgagctggaacgcgctacagatgtgaaatgggaggaccaggccgagatttctggatccagccctatcctctccattaccatcagcgaagatggctctatgagcattaagaatgaggaagaggagcagacactgacgatcctcatcagaaccgggctgcttgttatttccggactgtttcccgtgtctatcccgattacagctgccgcctggtatctgtgggaagtcaaaaagcagcgggctggcgtgctctgggacgtcccttctccccctcccatggggaaagcggagctggaagatggagcctaccgcatcaagcaaaagggcattcttggctattcccagatcggggctggagtgtacaaagagggcaccttccatacaatgtggcacgttaccagaggggccgtgctgatgcacaagggaaaacggatcgaaccctcctgggccgacgtcaagaaagatctcattagctacggcgggggatggaagctggagggcgagtggaaggaaggcgaggaagtgcaggttctcgctctggagcctgggaaaaacccgcgcgccgtgcagacgaagcccggactttttaaaaccaatacaggcaccatcggggcggtctccctggacttctctcctggaacaagcggctcccccattatcgataagaaagggaaggtggtgggactgtatggcaacggcgttgtcaccagaagcggggcttacgtgtctgccattgcccaaacagaaaagtccatcgaggacaaccctgagatcgaagatgacatttttcggaaacgcagactcacgatcatggacctgcatcccggagctggcaagaccaaacggtatcttcctgccattgtgagagaggcgatcaagcgcgggctgcggacactcattctggctccgaccagagtcgtggccgccgaaatggaggaagctctccgcggactgcccatccggtaccagacccctgccattagagctgagcacacaggccgcgagatcgttgatcttatgtgtcatgccacgttcaccatgcggctgctgagccccgtgagagtccctaattataacctcatcattatggacgaagcgcacttcacagatcccgcctctatcgctgcccgcgggtacatttccacccgggtggagatgggcgaagctgccggaatctttatgacagccaccccgcctggcagcagagaccccttcccccagtccaatgctcctattatcgatgaggagcgggaaatccccgagcgctcttggaacagcgggcatgaatgggttacggactttaaaggaaagacagtgtggttcgtcccttccattaaggcgggcaatgatatcgccgcttgcctgcgcaagaatgggaagaaagtgattcaacttagccggaagacctttgactctgagtatgttaaaacccgcacaaatgattgggacttcgtggtcaccacagatatctccgaaatgggagccaactttaaggccgacagagtgattgacccgcggagatgtatgaaacccgtgatcctgaccgatggcgaggagcgcgtcatcctcgctgggcctatgcccgttacgcacagctctgccgcgcagcggagaggccgcattggacggaatcctaagaacgaaaatgaccagtacatctacatgggcgagcccctggaaaacgatgaggactgcgctcactggaaggaagccaaaatgctgctcgataatattaacacaccggaggggatcattcctagcatgttcgagcccgaaagagagaaggtggacgccatcgatggagaatatcgccttcggggcgaggctagaaaaacctttgtggacctgatgcgcagaggggatctgcctgtctggctcgcctacaaggtggcggccgaaggaattaattatgctgaccggcgctggtgtttcgatggcatcaaaaacaaccagatcctggaggagaatgttgaagtggagatttggacaaaggaaggggagagaaagaaacttaagccccggtggctggacgcccgcatctactccgatcctctcgctctgaaagagtttaaggagttcgccgctggcagaaaatctctgaccctcaaccttattacggagatgggacggctgcccaccttcatgacacaaaagaccagagacgccctggacaatctcgcggtcctgcatacagccgaagctggcgggcgcgcctataaccacgctcttagcgagctgccggaaaccctcgagacactgctgctccttaccctgctggccacggtgacaggaggcatctttctcttcctgatgtccgggcggggaattggcaagatgacccttggcatgtgctgcatcatcaccgcctctattctgctctggtacgctcagatccagcctcattggattgcggccagcatcattctggagtttttcctgatcgttctccttatccccgaacccgagaaacagagaacacctcaagataatcagctgacctatgtggtcattgctatcctgacagtggtcgccgccacgatggctaacgaaatggggtttctcgagaagaccaaaaaggacctgggacttggctccattgccacacagcagccggaaagcaatatcctggatattgacctccgccccgcgtctgcctggaccctgtacgctgtggccacaaccttcgttacgcctatgctgcggcactccatcgagaacagctccgtgaatgtgtctctcaccgctattgccaaccaagcgacagtccttatggggctgggaaaaggctggcccctgagcaagatggatatcggggttcctctcctggccatcggatgttactcccaggtgaatcccattacccttacagctgccctgctcctgctggtggctcactatgccatcattggccctggcctccaggctaaggccaccagagaggcgcagaaacgggccgctgccgggatcatgaagaacccgacggtcgacggaattacagtgatcgatcttgaccccatcccttacgatcccaaatttgaaaagcaactgggccaggttatgctgctcattctgtgcgtgacccaggtccttatgatgcgcacaacctgggctctgtgtgaggccctcaccctggccacagggcctatctctacgctgtgggaaggaaatcccggcagattctggaacaccacaattgcggtgagcatggctaatatctttcgggggtcctatctcgccggagctggccttctgttcagcattatgaaaaacaccacaaatacccgcagaggcacggggaacatcggagagacactgggcgaaaagtggaaatctcggctcaacgccctggggaagtccgagtttcaaacctacaagaaaagcggaatccaggaggtcgaccgcacccttgccaaggaaggcattaaaagaggggagacagatcatcacgctgtgtctcggggatccgccaagctgcgctggttcgttgaaagaaatatggtgaccccggagggcaaagtcgtggacctcggctgcgggcggggaggctggagctattactgtgggggactgaagaacgttagagaggtgaagggcctgacaaaagggggacctggccatgaggaacccatccccatgtctacgtatggctggaatctcgtccgccttcagagcggggtggatgtgtttttcattcctcccgaaaagtgcgacaccctgctgtgtgacatcggagagtcctctcctaacccgacagttgaagcgggccggaccctcagagtcctgaatcttgtggagaactggctgaataacaatacacagttctgcattaaagtgctcaacccctacatgcctagcgtcatcgagaagatggaagccctgcaacgcaaatacgggggagctctggttcggaatcccctctccagaaacagcacccacgagatgtattgggtgtccaatgcctctggcaacatcgtgagctccgtcaatatgatttctcgcatgcttatcaaccggtttacgatgagacataagaaggctacctacgaacctgatgtggacctggggagcggaacacgcaacattggcatcgagtccgaaattcccaatctggatatcattggcaaacggatcgagaagatcaaacaggagcacgaaacctcttggcactatgaccaggatcatccgtacaagacatgggcctatcacgggagctacgagaccaaacagacaggatccgcgagctctatggttaacggcgtggtcagactcctgaccaagccttgggacgtgcttcccacggttacacaaatggccatgaccgataccacacctttcgggcagcagcgcgtgtttaaggaaaaagtcgacacgcggacccaggagcccaaggaaggaaccaagaagctgatgaaaattaccgctgagtggctctggaaggagctgggcaaaaagaagacacctagaatgtgtacccgcgaagagttcacaagaaaagtgcggtccaatgccgctctgggggccatctttaccgatgaaaacaagtggaaaagcgctcgcgaggccgtggaggactctagattctgggaactcgtcgataaggagcggaatctgcatcttgaaggaaaatgcgagacgtgtgtttataacatgatgggcaagagagaaaagaaactgggcgagtttgggaaggcgaaaggatcccgggccatttggtacatgtggctcggcgctcgcttcctggagtttgaagcccttgggttcctgaatgaggaccactggtttagcagagaaaactctctctccggagtggagggcgaagggctgcacaagctgggctacatcctccgggacgtgagcaaaaaggagggaggcgctatgtatgccgatgacaccgccgggtgggatacacgcattaccctggaggaccttaagaatgaagagatggtcacaaaccatatggaaggagagcacaaaaagctggcggaagctatcttcaaactcacctaccaaaataaggtggttagagtgcagcggcccacgccgcgcggcacagtcatggatatcatttccagacgggaccagcgcgggagcggacaagtgggcacctatgggctgaacacatttaccaatatggaggcccagcttatcagacagatggagggcgaaggagttttcaaaaacattcagcatctgacggccaccgaggaagtggctgtccaaaattggctcgcccgggtgggccgcgagagactgtctcggatggctatcagcggggatgactgcgttgtgaagcctctggatgaccgcttcgccaacgcgctcacagccctgaacgatatgggaaagattagaaaagacatccagcagtgggagccctccaagggctggaatgattggacccaggtccccttttgctctcaccatttccacgaacttatcatgaaagacgggcgggtgctggtcgtgccttgtagaaaccaagacgagctcattggacgcgctcggatcagccagggcgccgggtggtccctgagagaaacagcttgccttggcaagtcttacgcccagatgtggagcctgatgtattttcaccgccgggatctcagactggcggccaatgctatttgttccgccgttccgtctcattgggtgcccaccagccgcacaacctggtccatccacgctaaacatgagtggatgacgacagaagacatgctgaccgtctggaaccgggtgtggattagagagaatccttggatggaggataagacccccgtggaaagctgggaggaaatcccttacctcggaaagcgcgaggaccagtggtgcggctctctgattgggcttacatcccgggccacctgggctaaaaacatccaagccgcgatcaatcaggttagaagcctgattggaaacgaagagtatacagattacatgccctctatgaagcgcttccggagagaggaagaggaagccggcgtgctctggtga

SEQ ID NO: 19678 - RNA, 9876 nt, synthetic construct
  misc_feature 1..9876: note = derived and/or modified CDS sequence (opt5) from DENV-2__GU131897__SS-prME
  source 1..9876: mol_type = other RNA
agcgccggcatgatcattatgctgatccccaccgtgatggctttccacctgacaacgcggaatggggagcctcatatgattgttggaatccaggaaaagggcaagagcctgctttttaagaccgaggacggggttaatatgtgcacactgatggccatggatctcggagaactgtgtgaggacaccattacatacaaatgcccgcttctgcggcaaaacgaacccgaggatatcgactgttggtgcaattctaccagcacatgggtgacctatggcacgtgtaccacaaccggggagcaccgcagagaaaagcggtccgtggcgctcgtccctcatgtgggaatgggcctggagacacgcaccgaaacgtggatgtctagcgagggcgcttggaaacacgcccagagaatcgagacatggattctgcggcatcccgggttcaccatcatggccgctattctcgcctacacaatcggaaccacccactttcagcgcgttctgattttcatccttctgacagctgtggccccttccatgacgatgagatgcattggcatctctaaccgggattttgtcgaaggggtgagcggaggctcctgggttgacatcgtgctcgagcacgggagctgtgtcaccacaatggcgaagaataagcccaccctggatttcgaacttattaaaacagaggccaagcagcctgctaccctgcgcaaatattgcatcgaagccaagctcacgaacacaaccaccgagtctagatgtccgacacaaggagagccctccctgaaagaggaacaagacaagcggtttgtgtgcaagcatagcatggtggatcgcggctggggcaatgggtgtggactgttcggcaaagggggaattgttacctgcgctatgtttacatgcaagaaaaacatggaaggcaagatcgtccagcctgagaatctcgaatacacgattgtggtgacaccccactctggggaggagcatgccgtcggaaacgacacaggcaaacacggcatggaaatcaaggtgacccctcagtccagcatcacagaggcggaactgaccgggtatggaacggttaccatggagtgttctcccagaacaggccttgatttcaatgaaatggtgctgctccaaatggagaacaaagcctggctggtccaccggcagtggtttcttgacctgccgctcccttggctgcccggggctgataagcaggagtccaattggattcagaaggaaaccctggtgacattcaaaaaccctcatgccaagaaacaagacgttgtggtcctcggaagccaggagggcgctatgcacaccgccctgacgggggccacagaaatccagatgtcctctggcaatcttctgtttaccggacatctcaagtgccgcctgagaatggacaaacttcaactgaagggcatgagctactccatgtgtacagggaagttcaaagtggtcaaggagattgctgagacccagcacggaaccatcgtgattcgggttcagtatgaaggcgatgggagcccctgcaaaatccccttcgagatcatggacctcgaaaagagatacgtgctgggacgcctgattacagtcaaccctatcgtgacggagaaagattctccggttaacattgaagcggagcccccttttggcgactcctacatcattatcggggtggagcccggccagctcaagctgaattggttcaagaaaggaagctctattggccaaatgtttgaaaccacaatgagaggggccaagagaatggctatccttggagataccgcctgggacttcggcagcctcgggggagtctttacatccatcggcaaagccctccatcaggtgttcggggctatttatggcgccgcgttttctggagtgagctggaccatgaagatcctgattggcgttatcattacgtggatcgggatgaactcccgcagcacatctctgtccgtcagccttgtgctcgtgggaatcgtcaccctgtacctgggcgtgatggttcaggctgattctgggtgtgtggtctcctggaaaaataaggagctcaagtgcggaagcggcattttcatcaccgacaacgtgcacacatggaccgaacagtataaatttcaacctgagtccccctctaagctggccagcgccattcagaaagctcaggaagaggggatctgtggcattcggtccgttacaagacttgagaatctgatgtggaagcagatcacgccggaactcaaccacatcctggccgagaatgaagtgaaactgaccattatgacaggagatatcaagggcattatgcaagctgggaaacgctctcttcggcctcagcccaccgagctcaagtacagctggaagacatggggaaaagccaagatgctgtccaccgaaagctataaccagacgttcctgatcgacggccctgagaccgcggagtgccccaatacaaacagagcctggaactctctcgaagtcgaggattacgggtttggagtgttcaccacaaacatttggctgaaacttaaggaaaaacaggacgctttttgtgactccaagctgatgagcgccgctatcaaggataatcgcgccgttcatgcggacatgggctattggatcgagtctgccctcaacgatacctggaaaattgagaaggcttccttcatcgaagtgaaaaattgccactggcctaagagccatacactgtggtctaacggcgtcctggagagcgaaatgattatccccaaaaaccttgccgggccggtgtcccaacacaattaccggcctggataccacacccagattgctggcccctggcatctcgggaagctggagatggacttcgatttttgtgacggaacgacagtgatcgtcaccgaagattgcggcaacagagggcccagcctgcgcaccacaaccgcctctggaaagctcattacggagtggtgctgtcggtcctgcacactgcctccgcttagatatcggggcgaggacggctgttggtacgggatggaaatccgccccctgaaagagaaggaagagaatctcatcaacagcctggttaccgccggacacggccaggtggataatttctccctgggggtgcttggaatggctctctttctggaagagatgctgagaacacgggtcggcaccaaacatgcgattctcctggtggccgtttctttcgtgacacttatcaccgggaacatgagctttaaggacctgggaagagtcgtggttatggtgggcgctacgatggccgatgacattggcatgggggtcacctatctcgccctgctggctgccttcaaagtgcgccctacatttgcggctggacttctgctccggaagctgacctccaaggagctcatgatgacaaccatcggcattgttctgctttctcaaagcacgatccccgaaacagtgctggagctcaccgatgccctggccctggggatgatggtccttaaaatcgtgagaaatatggaaaagtaccagctggctgtgacaattatggccatcctctgcgtccctaacgcggttattctgcagaatgcttggaaagtgtcctgtaccatcctcgccgtggtctctgtgagccccctgcttctgacctccagccagcaaaagacagactggattcctctcgccctgacgatcaaaggactgaaccccaccgctatcttccttacaaccctgtctcgcacaaataagaaaagatcctggccgctcaacgaggccattatggctgttggcatggtgagcatcctggcctcttccctcctgaagaatgacattcctatgaccgggccccttgtcgcgggaggcctgctgacggtgtgctatgttctcacaggccggagcgccgatctggaacttgagcgcgctaccgacgtgaagtgggaggatcaggccgaaatctctgggtccagccctattctgtccatcaccattagcgaggacggatctatgagcatcaaaaacgaagaggaggaacagacactcaccatcctgattagaacaggcctcctggtcatctccgggctttttcccatttctatcccgattacggctgccgcctggtacctgtgggaggtgaagaaacagcgggctggagtcctgtgggatgtgccttctccccctcccatgggcaaggcggaactcgaggacggggcctatcgcatcaaacaaaagggaatcctgggctactcccagattggcgctggggtttacaaggaaggaaccttccacacaatgtggcatgtgaccagaggcgccgtccttatgcacaaagggaagcggatcgagccctcctgggccgatgtgaaaaaggacctgattagctatggaggcgggtggaaactcgagggagaatggaaggagggcgaagaggttcaggtgctggctctcgaacctggcaagaatccgcgcgccgtccagacaaaacccgggctgtttaagaccaacacgggaaccatcggcgcggtgtcccttgatttctctcctgggacaagcggatcccccattatcgacaaaaagggcaaagtggttgggctgtacggaaacggcgtcgtgaccagaagcggcgcttatgtgtctgccatcgcccaaacagagaagtccattgaggataatcctgaaatcgaggacgatatttttcggaagcgcagactgaccatcatggacctccaccccggggctggaaaaacaaagcggtacctgcctgccattgtcagagaagcgatcaaacgcggccttcggacgctgattctcgctccgaccagagtggttgccgccgagatggaagaggctctgcgcgggctccccatccggtatcagacccctgccatcagagctgagcataccggacgcgaaattgtggacctgatgtgtcacgccaccttcacaatgcggcttctgagccccgtcagagtgcctaactacaatctgatcattatggatgaggcgcatttcacggaccccgcctctatcgctgcccgcggctatatttccacccgggttgaaatgggggaggctgccggcatctttatgacagccaccccgcctggaagcagagatcccttcccccagtccaacgctcctatcattgacgaggaacgggagatccccgaacgctcttggaatagcggccacgagtgggtgatggattttaaggggaaaacagtctggttcgtgccttccattaaggcgggaaacgacatcgccgcttgcctcagaaagaatggcaaaaaggttattcaactgagccggaaaacctttgattctgaatacgtgaagacgcgcacaaacgactgggatttcgtcgtgaccaccgacatctccgagatgggggccaattttaaagccgagagagtgatcgatccgcggagatgtatgaagcccgtcattcttacagacggagaggaacgcgttatcctggctggccctatgcccgtgacccatagctctgccgcgcagcggagagggcgcattggccggaaccctaaaaatgaaaacgaccagtacatctatatgggagagcccctcgaaaatgatgaggactgcgctcactggaaggaggccaagatgctgctggataacattaatacaccggaaggcatcattcctagcatgttcgagcccgaaagagagaaagtggacgccatcgatggggaataccgcctccggggagaggctagaaagacctttgtcgaccttatgcgcagaggcgatctgcctgtgtggctggcctataaagttgcggccgaggggatcaactacgctgaccggcgctggtgtttcgatggaattaagaacaatcagatcctcgaagagaacgtggaagtcgagatttggacgaaagagggcgaaagaaagaagctgaaaccccggtggcttgacgcccgcatctattccgatcctctggctctcaaggagtttaaagagttcgccgctgggagaaagtctctgacactgaatctcattaccgagatgggccggcttcccacattcatgacccagaagacgagagacgccctggataacctggcggtgctccacaccgccgaagctggaggccgcgcctacaatcatgctctgagcgagcttccggagacactggaaaccctcctgctgctcacacttctggccaccgttacagggggaatctttctgttcctcatgtccggccgggggatcggaaagatgaccctgggcatgtgctgcattatcacggcctctattcttctgtggtatgctcagatccagcctcactggattgcggccagcatcatcctcgagtttttcctgattgtgctgctcatccccgaacccgagaagcagagaacacctcaagacaaccagcttacctacgtcgtgattgctatcctgaccgtcgtggccgccacaatggctaatgaaatgggctttctggagaaaaccaagaaagacctcgggctgggatccattgccacacagcagccggagagcaacatccttgatattgacctgcgccccgcgtctgcctggacgctctacgctgttgccaccacattcgtgacccctatgctgcggcattccatcgaaaatagctccgtgaacgtctctctgacagctatcgccaatcaagcgaccgttctcatgggccttgggaagggatggcccctgagcaaaatggatattggcgtgcctctgctcgccatcgggtgttattcccaggtgaaccccattacgctgaccgctgcccttctgctcctggtcgctcactacgccatcattggacctggcctgcaggctaaggccacaagagaggcgcagaagcgggccgctgccggcatcatgaaaaatccgaccgtggacgggatcacagttattgatctcgaccccatcccttatgatcccaagtttgaaaaacaacttggacaggtgatgctgctgattctctgcgtcacccaggtgctgatgatgcgcacgacatgggctctttgtgaggccctgaccctcgccacaggccctatctctaccctgtgggaagggaaccccggaagattctggaataccacaattgcggtcagcatggctaacatctttcggggctcctacctggccggggctggactccttttcagcatcatgaagaatacgaccaacacacgcagaggcaccggcaacattggggagacactgggagagaaatggaagtctcggctgaatgccctcggcaaatccgaatttcaaatctataaaaagagcgggattcaggaggtggaccgcaccctggccaaagaaggaatcaagagaggcgagacggatcaccatgctgtttctcgggggtccgccaaacttcgctggttcgtggagagaaacatggtcacaccggaaggaaaggtggttgacctgggctgcggcagagggggatggagctactattgtggcgggctcaaaaatgtgcgggaggtcaagggactgaccaagggcgggcctggacacgaagaacccattcccatgtctacctacggctggaacctggtgcgcctccagagcggcgtggatgtctttttcatccctcccgaaaaatgcgacacacttctgtgtgatatcggggagtcctctcctaatccgaccgtcgaggcgggacggacactgagagtgctcaacctggtggaaaattggcttaacaataacacgcagttctgcattaaggtcctgaatccctacatgcctagcgttatcgagaaaatggaagccctccaacgcaagtatggcggggctctggtgcggaaccccctgtccagaaatagcacccatgagatgtactgggtgtccaacgcctctggaaatattgtcagctccgtgaacatgatctctcgcatgctcattaaccggtttacaatgagacacaaaaaggctacctatgaacctgacgttgaccttggcagcgggacacgcaatatcggaattgagtccgagatccccaacctggatatcattggcaagcggatcgagaagattaaggaggaacatgagacctcttggcactacgaccaggatcacccgtataaaacgtgggcctaccatggcagctatgaaaccaagcagacagggtccgcgagctctatggtgaatggagtcgtgagactgctcaccaaaccttgggacgttctgcccacagtgacccagatggccatgacagataccacgcctttcggccaacagcgcgtctttaaggagaaggtggacacacggacccaggagcccaaagaagggaccaagaaacttatgaagatcacagctgagtggctgtggaaagaactcggaaagaaaaagacgcctagaatgtgtacccgcgaggagttcacaagaaaggtgcggtccaacgccgctctgggcgccatttttaccgatgaaaataaatggaaaagcgctcgcgaggccgtcgaagactctagattctgggagctggttgataaagaacggaacctccacctggaggggaagtgcgagacatgtgtgtacaatatgatgggaaaaagagaaaagaaacttggcgagtttggcaaagcgaaggggtcccgggccatctggtacatgtggctgggagctcgcttcctcgaatttgaggccctgggcttccttaacgaagaccattggtttagcagagaaaattctctgtccggggtggagggagaaggcctccacaaactggggtatatcctgcgggatgtcagcaagaaagagggcggagctatgtacgccgacgacaccgccggctgggatacacgcattaccctcgaagacctgaagaacgaggaaatggtgacgaatcacatggagggggagcataagaaacttgcggaagctatcttcaagctgacctatcagaacaaagttgtgagagtccaacggcccacaccgcgcggaaccgtgatggatattatctccagacgggaccagcgcggcagcgggcaggttggaacatacggcctcaatacctttacgaacatggaggcccaactgattagacagatggaaggggagggcgtgttcaagaatatccagcaccttacagtcaccgaggaagccgctgtgcagaactggctggcccgggttggacgcgagagactctctcggatggctatcagcggcgatgactgcgtggtcaaacctctggatgaccgcttcgccaacgcgctgacagccctcaatgatatggggaagattagaaaggacatccaacagtgggaaccctccaaaggatggaacgattggacccaggtgcccttttgctctcatcacttccatgagctgattatgaaggacggccgggtccttgtggttccttgtagaaatcaggatgaactgatcgggcgcgctcggattagccaaggagccggctggtccctcagagagacggcttgcctggggaaatcttatgcccagatgtggagccttatgtactttcaccgccgggacctgagactcgcggccaacgctatctgttccgccgtgccgtctcactgggtccccaccagccgcacaacctggtccattcatgctaagcacgagtggatgacaaccgaagacatgctgacagtgtggaatcgggtgtggatcagagagaacccttggatggaagataaaacccccgttgagagctgggaagagatcccttatctgggcaagcgcgaggaccagtggtgcggatctctcattggcctgacgtcccgggccacatgggctaagaatatccaggccgcgattaaccaagtgagaagccttatcgggaatgaagagtacaccgattacatgccctctatgaaacgcttccggagagaagaggaagaggccggagtcctgtggtga

SEQ ID NO: 19679 - RNA, 9876 nt, synthetic construct
  misc_feature 1..9876: note = derived and/or modified CDS sequence (opt5) from DENV-2__GQ868631__SS-prME
  source 1..9876: mol_type = other RNA
agcgccggaatgatcattatgctgatccccaccgtgatggctttccacctgacaacgagaaatggggagcctcatatgattgtcggaatccaggaaaagggcaaaagcctgctttttaagaccgaggacggggttaatatgtgcacactgatggccatggatctcggagaactgtgtgaggacaccattacatacaaatgcccgcttctgcggcaaaacgaacccgaggatatcgactgttggtgcaattctaccagcacatgggtgacctatggcacgtgtaccacaaagggggagcacagaagagaaaaacggtccgtggcgctcgtccctcatgtgggaatgggcctggagacccgcacagaaacctggatgtctagcgagggcgcttggaagcacgcccagagaatcgagacgtggattctgcggcatcccgggttcacaatcatggccgctattctcgcctacaccatcggaacaacccactttcagcgcgttctgattttcatccttctgaccgctgtggccccttccatgacaatgagatgcattggcatctctaaccgggattttgtcgaaggggtgagcggaggctcctgggttgacatcgtgctcgagcacgggagctgtgtcacgaccatggcgaagaataaacccacactggatttcgaacttattaagaccgaggccaaacagcctgctacactgcgcaagtattgcatcgaagccaaactcaccaacacgacaaccgagtctagatgtccgacccaaggagagccctccctgaaggaggaacaagacaagcggtttgtgtgcaaacatagcatggtggatcgcggctggggcaatgggtgtggactgttcggcaaaggcgggattgtcacatgcgctatgtttacctgcaaaaagaacatggaagggaaaatcgttcagcctgagaatctcgaatacacaattgtggtgacgccccactctggggaggagcatgccgtcggaaacgacaccggcaagcacggcatggaaatcaaagtgacacctcagtccagcatcaccgaggcggaactgacagggtatggaaccgttacgatggagtgttctcccagaaccggccttgatttcaatgaaatggtgctgctccaaatggagaacaaggcctggctggtccaccggcagtggtttcttgacctgccgctcccttggctgcccggggctgataagcaggagtccaattggattcagaaagaaacactggtgaccttcaagaaccctcatgccaaaaagcaagacgttgtggtcctcggaagccaggagggcgctatgcacacagccctgaccggggccacggaaatccagatgtcctctggcaatcttctgtttacaggacatctcaaatgccgcctgagaatggacaaacttcaactgaagggcatgagctactccatgtgtaccgggaaattcaaggtggtcaaagagattgctgagacacagcacggaaccatcgtgattcgggttcagtatgaaggcgatgggagcccctgcaagatccccttcgagatcatggacctcgagaagcggtacgtgctgggacgcctgattaccgtcaaccctatcgtgacagagaaggattctccggttaacattgaagcggagcccccttttggcgactcctacatcattatcggggtggagcccggccagctcaagctgaattggttcaaaaagggaagctctattggccaaatgtttgaaacgaccatgagaggggctaaaagaatggctatccttggagatacagcctgggacttcggcagcctcgggggagtctttacctccatcggcaaggccctccatcaggtgttcggggctatttatggcgtggccttttctggagttagctggacaatgaaaatcctgattggcgtcatcattacctggatcgggatgaactcccgcagcacgtctctgtccgtgagccttgtgctcgtcggaatcgtgacactgtacctgggcgttatggtgcaggcggattctgggtgtgtcgtgtcctggaagaataaggagctcaaatgcggaagcggcattttcatcaccgacaacgttcacacctggacagaacagtataagtttcaacctgagtccccctctaaactggctagcgccattcagaaggcccaggaagaggggatctgtggcattcggtccgtgaccagacttgagaatctgatgtggaaacagatcacaccggaactcaaccacatcctggctgagaatgaagtcaagctgacgattatgaccggagatatcaaaggcattatgcaagccgggaagcgctctcttcggcctcagcccacagagctcaagtacagctggaaaacctggggaaaggctaaaatgctgtccacagaaagctataaccagaccttcctgatcgacggccctgagacggccgagtgccccaataccaacagagcgtggaactctctcgaagtggaggattacgggtttggagttttcacaaccaacatttggctgaaacttaaagaaaagcaggacgccttttgtgactccaagctgatgagcgctgccatcaaagataatcgcgctgtgcatgccgacatgggctattggatcgagtctgcgctcaacgatacatggaagattgagaaagcctccttcatcgaagtcaagaattgccactggcctaaaagccataccctgtggtctaacggcgtgctggagagcgaaatgattatccccaagaaccttgctgggccggtgtcccaacacaattaccggcctggataccacacacagattgccggcccctggcatctcgggaagctggagatggacttcgatttttgtgacggaaccacggtcatcgttacagaagattgcggcaacagagggcccagcctgcgcaccaccacagcttctggaaaactcattaccgagtggtgctgtcggtcctgcacgctgcctccgcttagatatcggggcgaggacggctgttggtacgggatggaaatccgccccctgaaggagaaagaagagaatctcgtgaacagcctggtgacagccggacacggccaggtcgataatttctccctgggggtgcttggaatggccctctttctggaagagatgctgagaacccgggttggcacaaagcatgctatcctcctggtggcggtctctttcgtgacccttattacagggaacatgagctttaaagacctgggaagagttgtggtcatggtgggcgccaccatggctgatgacatcggcatgggggttacgtatctcgccctgctggccgctttcaaggtgcgccctacctttgccgcgggacttctgctccggaagctgacatccaaagagctcatgatggctaccattggcatcgtcctgctttctcaaagcacaattcccgaaaccgtgctggagctcacggatgccctggccctggggatgatggctcttaagatcgtgagaaatatggaaaaataccagctggccgtcacaatcatggcgattctctgcgttcctaacgctgtgatcctgcagaatgcctggaaggtgtcctgtaccattctcgccgtcgtgtctgttagccccctgcttctgacatccagccagcagaagacagactggatccctctcgctctgaccattaagggactgaaccccacagccatcttccttacgaccctgtctcgcacaaataaaaagagatcctggccgctcaacgaggctatcatggccgtgggcatggtcagcattctggcgtcttccctcctgaagaatgacatccctatgaccgggccccttgtggccggaggcctgctgacagtttgctatgtgctcaccggccggagcgctgatctggaacttgagcgcgccacggacgtcaaatgggaggatcaggctgaaatttctgggtccagccctatcctgtccattacaatcagcgaggacggatctatgagcattaagaacgaagaggaggaacagaccctcaccatcctgatcagaacaggcctcctggtgatttccgggctttttcccatctctattccgatcaccgccgccgcttggtacctgtgggaggtcaaaaagcagcgggcgggagtgctgtgggatgttccttctccccctcccatgggcaaagccgaactcgaggacggggcttatcgcattaagcaaaagggaatcctgggctactcccagatcggcgccggggtgtacaaagaaggaacattccacacgatgtggcatgtcaccagaggcgccgtgcttatgcacaaggggaaacggattgagccctcctgggctgatgttaagaaagacctgatcagctatggaggcgggtggaagctcgagggagaatggaaggagggcgaagaggtgcaggtcctggccctcgaacctggcaaaaatccgcgcgcggtgcagacaaagcccgggctgtttaaaaccaacacaggaaccattggcgctgtgtcccttgatttctctcctgggacgagcggatcccccatcattgacaagaaaggcaaggttgtcgggctgtacggaaacggcgtggtgaccagaagcggcgcctatgtctctgccatcgctcaaacagagaagtccatcgaggataatcctgaaattgaggacgatatctttcggaaacgcagactgaccattatggacctccaccccggggccggaaagacaaaacggtacctgcctgcgatcgtgagagaagctattaagcgcggccttcggaccctgatcctcgccccgacaagagttgtggccgctgagatggaagaggccctgcgcgggctccccattcggtatcagacgcctgctatcagagccgagcataccggacgcgaaatcgtcgacctgatgtgtcacgcgacattcaccatgcggcttctgagccccgtgagagttcctaactacaatctgattatcatggatgaggcccatttcaccgaccccgcttctattgccgctcgcggctatatctccacacgggtggaaatgggggaggccgccggcatttttatgacggctaccccgcctggaagcagagatcccttcccccagtccaacgcgcctatcatcgacgaggaacgggagattcccgaacgctcttggaatagcggccacgagtgggtcacagattttaaagggaagaccgtgtggttcgttccttccatcaaggccggaaacgacattgctgcctgcctccgcaaaaatggcaagaaagtgatccaactgagccggaagacatttgattctgaatacgtcaaaacccgcacgaacgactgggatttcgtggtgacaaccgacatttccgagatgggggccaattttaaggctgagagagtcatcgatccgcggagatgtatgaaacccgttatccttaccgacggagaggaacgcgtgattctggccggccctatgcccgtgacacatagctctgcggctcagcggagagggcgcatcggccggaaccctaagaatgaaaacgaccagtacatttatatgggagagcccctcgaaaatgatgaggactgcgcccactggaaggaggccaaaatgctgctggataacatcaataccccggaaggcattatccctagcatgttcgagcccgaaagagagaaggtcgacgctattgatggggaataccgcctccggggagaggccagaaaaacatttgtggaccttatgcgcagaggcgatctgcctgtttggctggcgtataaggtggccgctgaggggatcaactacgccgaccggcgctggtgtttcgatggaatcaaaaacaatcagattctcgaagagaacgtcgaagtggagatctggaccaaggagggcgaaagaaagaaactgaagccccggtggcttgacgctcgcatttattccgatcctctggccctcaaagagtttaaggagttcgctgccgggagaaaatctctgacgctgaatctcatcacagagatgggccggcttcccaccttcatgacacaaaagaccagagacgcgctggataacctggccgttctccacacggctgaagccggaggccgcgcttacaatcatgccctgagcgagcttccggagaccctggaaacactcctgctgctcacccttctggccacagtgaccgggggaatttttctgttcctcatgtccggccgggggatcggaaagatgacactgggcatgtgctgcatcattaccgcttctatccttctgtggtatgcgcagattcagcctcactggatcgccgctagcattatcctcgagtttttcctgatcgtcctgctcattcccgaacccgagaaacagagaacgcctcaagacaaccagcttacatacgtggtcatcgccattctgaccgtggttgccgctaccatggccaatgaaatgggctttctggagaagaccaagaaggacctcgggctgggatccatcgcgacccagcagccggagagcaacattcttgatatcgacctgcgccccgcctctgcttggacactctacgccgtggctacgaccttcgtgacacctatgctgcggcattccattgaaaatagctccgtcaacgtttctctgaccgccatcgcgaatcaagccacagtgctcatgggccttgggaaaggatggcccctgagcaagatggatatcggcgtgcctctgctcgctattgggtgttattcccaggtcaaccccatcaccctgacggccgcccttctgctcctggtggcccactacgctattatcggacctggcctgcaggccaaggcgaccagagaggcccagaaacgggctgccgctggcattatgaagaatccgacagttgacgggatcaccgtgatcgatctcgaccccattccttatgatcccaaatttgaaaagcaacttggacaggtcatgctgctgatcctctgcgtgacacaggtcctgatgatgcgcaccacgtgggccctttgtgaggccctgacactcgcgaccggccctatttctacactgtgggaagggaaccccggaagattctggaataccaccatcgctgtgagcatggccaacatttttcggggctcctacctggctggggccggactccttttcagcatcatgaaaaatacaacgaacacccgcagaggcacaggcaacatcggggagaccctgggagagaagtggaaatctcggctgaatgccctcggcaagtccgaatttcaaatttataagaaaagcgggatccaggaggttgaccgcacactggctaaggaaggaattaaaagaggcgagaccgatcaccatgccgtgtctcgggggtccgcgaaacttcgctggttcgtcgagagaaacatggtgacgccggaaggaaaagttgtggacctgggctgcggcagagggggatggagctactattgtggcgggctcaagaatgtccgggaggtgaagggactgacaaaaggcgggcctggacacgaagaacccatccccatgtctacctacggctggaacctggtgcgcctccagagcggcgttgatgtctttttcattcctcccgaaaagtgcgacacccttctgtgtgatatcggggagtcctctcctaatccgacagtggaggccggacggaccctgagagtgctcaacctggtcgaaaattggcttaacaataacacacagttctgcatcaaagttctgaatccctacatgcctagcgtgattgagaagatggaagctatgcaacgcaaatatggcggggccctcgtgcggaaccccctgtccagaaatagcacgcatgagatgtactgggtctccaacgcttctggaaatatcgtgagctccgttaacatgatttctcgcatgctgatcaaccggtttaccatgagacacaagaaggccacatatgaacctgacgtggacctcggcagcgggacccgcaatattggaatcgagtccgagattcccaaccttgatatcatcggcaaacggattgaaaagatcaaagaggaacatgagacatcttggcactacgaccaggatcacccgtataagacctgggcgtaccatggcagctatgaaacgaaacagaccgggtccgccagctctatggtcaatggagtggttagactgctgacaaagccttgggacgtgctccccaccgtcacacagatggctatgaccgatacaacccctttcggccaacagcgcgtgtttaaggagaaagtggacacgcggacacaggagcccaaggaagggaccaaaaagctgatgaaaattaccgccgagtggctttggaaggaactgggcaagaagaagacacctagaatgtgtacgcgcgaggagttcaccagaaaagtccggtccaacgctgccctcggcgctatctttacagatgaaaataagtggaaaagcgcccgcgaggcggttgaagactctagattctgggagctggtggataaggaacggaacctgcacctcgaggggaaatgcgagacctgtgtgtacaatatgatgggaaagagagaaaagaaactgggcgagtttggcaaggccaaagggtcccgggctatttggtacatgtggcttggagcccgcttcctggaatttgaggctctcggcttcctgaacgaagaccattggtttagcagagaaaattctctttccggggtcgagggagaaggcctgcacaagctcgggtatatcctgcgggatgtgagcaaaaaggagggcggagccatgtacgccgacgacacagcgggctgggatacccgcatcacactggaagacctcaagaacgaggaaatggttaccaatcacatggagggggagcataaaaagctggctgaagccattttcaaacttacgtatcagaacaaggtggtcagagtgcaacggcccaccccgcgcggaacagttatggatatcatttccagacgggaccagcgcggcagcggacaggtgggaacctacggcctgaatacatttaccaacatggaggcccaactcatcagacagatggaaggggagggcgtcttcaaaaatattcagcacctgacggtgacagaggaagctgccgttcagaactggcttgctcgggtgggacgcgagagactgtctcggatggccatcagcggcgatgactgcgtcgtgaagcctctcgatgaccgcttcgcgaacgccctgaccgctctgaatgatatggggaagatcagaaaagacattcaacagtgggaaccctccaagggatggaacgattggacacaggtccccttttgctctcatcacttccatgagctcatcatgaaagacggccgggtgctggttgtgccttgtagaaatcaggatgaacttattgggcgcgcccggatcagccaaggagctggctggtccctgagagagaccgcctgcctcgggaagtcttatgcgcagatgtggagcctgatgtactttcaccgccgggaccttagactggccgctaacgccatttgttccgctgtcccgtctcactgggtgcccacgagccgcaccacatggtccatccatgccaaacacgagtggatgaccacagaagacatgctcaccgtgtggaatcgggtttggattagagagaacccttggatggaagataagacacccgtggagagctgggaagagatcccttatctgggcaagcgcgaggaccagtggtgcggatctctgatcggcctcacctcccgggctacgtgggccaaaaatattcaggcggccatcaaccaagtcagaagcctgattgggaatgaagagtacacagattacatgccctctatgaagcgcttccggagagaagaggaagaggctggagtgctttggtga

SEQ ID NO: 19680 - RNA, 9876 nt, synthetic construct
  misc_feature 1..9876: note = derived and/or modified CDS sequence (opt5) from DENV-2__GU131899__SS-prME
  source 1..9876: mol_type = other RNA
agcgccggcatgatcattatgctgatccccacagtgatggctttccacctgacgacgagaaatggggaacctcatatgattgtcggaatccaggaaaagggcaaatccctgctttttaagaccgaggacggggttaatatgtgcacactgatggccatggatctcggagaactgtgtgaggacaccattacatacaaatgcccgcttctgcggcaaaacgaacccgaggatatcgactgttggtgcaattctaccagcacatgggtgacctatggcacgtgtaccacaaccggggagcacagaagagaaaagcggtccgtggcgctcgtccctcatgtgggaatgggcctggagacacgcaccgaaacgtggatgtctagcgagggcgcttggaaacacgcccagagaatcgagacatggattctgcggcatcccgggttcaccatcatggccgctattctcgcctacacaatcggaaccacccactttcagcgcgttctgattttcatccttctgacagctgtggccccttccatgacgatgagatgcattggcatctctaaccgggattttgtcgaaggggtgagcggaggctcctgggttgacatcgtgctcgagcacgggagctgtgtcaccacaatggcgaagaataagcccaccctggatttcgaacttattaaaacagaggccaagcagcctgctaccctgcgcaaatattgcatcgaagccaagctcacgaacacaaccaccgagtctagatgtccgacacaaggagagccctccctgaaagaagaacaagacaagcggtttgtgtgcaagcatagcatggtggatcgcggctggggcaatgggtgtggactgttcggcaaagggggaattgtcacatgcgctatgtttacatgcaagaaaaacatggaaggcaagatcgttcagcctgagaatctcgaatacacgattgtggtgacaccccactctggggaggagcatgccgtcggaaacgacacaggcaaacacggcaaggaaatcaaagtgacccctcagtccagcatcacagaggcggaactgaccgggtatggaacggttaccatggagtgttctcccagaacaggccttgatttcaatgaaatggtgctgctccaaatggagaacaaggcctggctggtccaccggcagtggtttcttgacctgccgctcccttggctgcccggggctgataagcaggagtccaattggattcagaaagaaaccctggtgacattcaagaaccctcatgccaaaaagcaagacgttgtggtcctcggaagccaggagggcgctatgcacaccgccctgacgggggccacagaaatccagatgtcctctggcaatcttctgtttaccggacatctcaaatgccgcctgagaatggacaaacttcaactgaagggcatgagctactccatgtgtacagggaaattcaaggtggtcaaagagattgctgagacccagcacggaaccatcgtgattcgggttcagtatgaaggcgatgggagcccctgcaagatccccttcgagatcatggacctcgagaagcggtacgtgctgggacgcctgattacagtcaaccctatcgtgacggagaaggattctccggttaacattgaagcggagcccccttttggcgactcctacatcattatcggggtggagcccggccagctcaagctgaattggttcaaaaagggaagctctattggccaaatgtttgaaaccacaatgagaggggccaaaagaatggctatccttggagataccgcctgggacttcggcagcctcgggggagtctttacatccatcggcaaggccctccatcaggtgttcggggctatttatggcgccgcgttttctggagtgagctggaccatgaaaatcctgattggcgttatcattacgtggatcgggatgaactcccgcagcacatctctgtccgtcagccttgtgctcgtgggaatcgtcaccctgtacctgggcgtgatggttcaggctgattctgggtgtgtggtctcctggaagaataaggagctcaaatgcggaagcggcattttcatcaccgacaacgtgcacacatggaccgaacagtataagtttcaacctgagtccccctctaaactggccagcgccattcagaaggctcaggaagaggggatctgtggcattcggtccgttacaagacttgagaatctgatgtggaaacagatcacgccggaactcaaccacatcctggccgagaatgaagtgaagctgaccattatgacaggagatatcaaaggcattatgcaagctgggaagcgctctcttcggcctcagcccaccgagctcaagtacagctggaaaacatggggaaaggccaaaatgctgtccaccgaaagctataaccagacgttcctgatcgacggccctgagaccgcggagtgccccaatacaaacagagcctggaactctctcgaagtcgaggattacgggtttggagtgttcaccacaaacatttggctgaaacttaaagaaaagcaggacgctttttgtgactccaagctgatgagcgccgctatcaaagataatcgcgccgttcatgcggacatgggctattggatcgagtctgccctcaacgatacctggaagattgagaaggctagcttcatcgaagtgaagaattgccactggcctaaaagccatacactgtggtctaacggcgtcctggagagcgaaatgattatccccaagaaccttgccgggccggtgtcccaacacaattaccggcctggataccacacccagattgctggcccctggcatctcgggaagctggagatggacttcgatttttgtgacggaacgacagtgatcgtcaccgaagattgcggcaacagagggcccagcctgcgcaccacaaccgcctctggaaaactcattacggagtggtgctgtcggtcctgcacactgcctccgcttagatatcggggcgaggacggctgttggtacgggatggaaatccgccccctgaaggagaaagaagagaatctcgttaacagcctggtgaccgccggacacggccaggtggataatttctccctgggggtccttggaatggctctctttctggaagagatgctgagaacacgggtgggcaccaagcatgcgatcctcctggttgccgtgtctttcgtcacacttattaccgggaacatgagctttaaagacctgggaagagtggttgtgatggtcggcgctacgatggccgatgacatcggcatgggggtgacctatctcgccctgctggctgccttcaaggttcgccctacatttgcggctggacttctgctccggaagctgacctccaaagagctcatgatgacaaccattggcatcgtgctgctttctcaaagcacgattcccgaaacagtcctggagctcaccgatgccctggccctggggatgatggtgcttaagatcgtgagaaatatggaaaaataccagctggctgtcacaatcatggccattctctgcgttcctaacgcggtgatcctgcagaatgcttggaaggtgtcctgtaccattctcgccgtcgtgtctgttagccccctgcttctgacctccagccagcagaagaccgactggatccctctcgccctgacgattaagggactgaaccccaccgctatcttccttacaaccctgtctcgcacaaataaaaagagatcctggccgctcaacgaggccatcatggctgtgggcatggtcagcattctggcctcttccctcctgaagaatgacatccctatgaccgggccccttgtggcgggaggcctgctgacggtttgctatgtgctcacaggccggagcgccgatctggaacttgagcgcgctaccgacgtcaaatgggaggatcaggccgaaatttctgggtccagccctatcctgtccattaccatcagcgaggacggatctatgagcattaagaacgaagaggaggaacagacactcaccatcctgatcagaacaggcctcctggtgatttccgggctttttcccatctctattccggtcacggctgccgcctggtacctgtgggaggtgaaaaagcagcgggctggagttctgtgggatgtgccttctccccctcccatgggcaaagcggaactcgaggacggggcctatcgcatcaagcaaaagggcattctgggatactcccagatcggcgctggggtctacaaagaaggaaccttccacacaatgtggcatgtgaccagaggcgccgttcttatgcacaaggggaaacggatcgagccctcctgggccgatgtgaagaaagacctgattagctatggaggcgggtggaagctcgagggagaatggaaggagggcgaagaggtccaggtgctggctctcgaacctggcaaaaatccgcgcgccgtgcagacaaagcccgggctgtttaaaaccaacacgggaaccatcggcgcggtttcccttgatttctctcctgggacaagcggatcccccattatcgacaagaaaggcaaggtcgtggggctgtacggaaacggcgtggtcaccagaagcggcgcttatgtgtctgccattgcccaaacagagaagtccatcgaggataatcctgaaatcgaggacgatatttttcggaaacgcagactgaccatcatggacctccaccccggggctggaaagacaaaacggtacctgcctgccattgttagagaagcgatcaagcgcggccttcggacgctgattctcgctccgaccagagtggtcgccgccgagatggaagaggctctgcgcgggctccccatccggtatcagacccctgccattagagctgagcataccggacgcgaaatcgtggacctgatgtgtcacgccaccttcacaatgcggcttctgagccccgttagagtgcctaactacaatctgatcattatggatgaggcgcatttcacggaccccgcctctatcgctgcccgcggctatatttccacccgggtcgaaatgggggaggctgccggcatctttatgacagccaccccgcctggaagcagagatcccttcccccagtccaacgctcctattatcgacgaggaacgggagatccccgaacgctcttggaatagcggccacgagtgggtgacagattttaaagggaagaccgtttggttcgtgccttccattaaggcgggaaacgacatcgccgcttgcctccgcaaaaatggcaagaaagtcattcaactgagccggaagacgtttgattctgaatacgtgaaaacacgcaccaacgactgggatttcgtggtcaccacagacatctccgagatgggggccaattttaaggccgagagagttattgatccgcggagatgtatgaaacccgtgatccttaccgacggagaggaacgcgtgatcctggctggccctatgcccgtcacacatagctctgccgcgcagcggagagggcgcattggccggaaccctaagaatgaaaacgaccagtacatctatatgggagagcccctcgaaaatgatgaggactgcgctcactggaaggaggccaaaatgctgctggataacattaataccccggaaggcatcattcctagcatgttcgagcccgaaagagagaaggtggacgccatcgatggggaataccgcctccggggagaggctagaaaaacgtttgttgaccttatgcgcagaggcgatctgcctgtgtggctggcctataaggtcgcggccgaggggattaactacgctgaccggcgctggtgtttcgatggaatcaaaaacaatcagatcctcgaagagaacatggaagtggagatttggacaaaggagggcgaaagaaagaaactgaagccccggtggcttgacgcccgcatctattccgatcctctggctctcaaagagtttaaggagttcgccgctgggagaaaatctctgaccctgaatctcattacagagatgggccggcttcccaccttcatgacgcaaaagaccagagacgccctggataacctggcggttctccacacagccgaagctggaggccgcgcctacaatcatgctctgagcgagcttccggagaccctggaaacactcctgctgctcacccttctggccacagtgaccgggggaatctttctgttcctcatgtccggccgggggattggaaagatgacgctgggcatgtgctgcatcatcacagcctctattcttctgtggtatgctcagatccagcctcactggattgcggccagcatcattctcgagtttttcctgatcgtcctgctcatccccgaacccgagaaacagagaacccctcaagacaaccagcttacctacgtggtcattgctatcctgacagtggttgccgccaccatggctaatgaaatgggctttctggagaagaccaagaaggacctcgggctgggatccattgccacgcagcagccggagagcaacatccttgatattgacctgcgccccgcgtctgcctggaccctctacgctgtggccacaaccttcgtgacacctatgctgcggcattccatcgaaaatagctccgtcaacgtttctctgaccgctattgccaatcaagcgacggtgctcatgggccttgggaaaggatggcccctgagcaagatggatatcggcgtgcctctgctcgccatcgggtgttattcccaggtcaaccccattaccctgacagctgcccttctgctcctggtggctcactacgccatcattggacctggcctgcaggctaaggccaccagagaggcgcagaaacgggccgctgccggcatcatgaagaatccgacagttgacgggattaccgtgatcgatctcgaccccatcccttatgatcccaaatttgaaaagcaacttggacaggtcatgctgctgattctctgcgtgacgcaggtcctgatgatgcgcacaacctgggctctttgtgaggccctgacactcgccaccggccctatctctaccctgtgggaagggaaccccggaagattctggaatacaacgattgcggtgagcatggctaacatctttcggggctcctacctggccggggctggactccttttcagcattatgaaaaataccacaaacacccgcagaggcacaggcaacatgggggagaccctgggagagaagtggaaatctcggctgaatgccctcggcaagtccgaatttcaaatctataagcgcagcgggatccaggaggttgacagaacgctggccaaagaaggaattaagcggggcgagacagatcaccatgctgtgtctcgcgggtccgccaaacttagatggttcgtcgagcggaacatggtgaccccggaaggaaaggttgtggacctgggctgcggcagagggggatggagctactattgtggcgggctcaaaaatgtccgcgaggtgaagggactgaccaagggcgggcctggacacgaagaacccatccccatgtctacatacggctggaacctggtgcggctccagagcggcgttgatgtctttttcattcctcccgaaaaatgcgacacccttctgtgtgatatcggggagtcctctcctaatccgacagtggaggcgggaagaacgctgcgcgtgctcaacctggtcgaaaattggcttaacaataacacccagttctgcattaaggttctgaatccctacatgcctagcgtgatcgagaaaatggaagccctccaacggaagtatggcggggctctggtgagaaaccccctgtcccgcaatagcacacatgagatgtactgggtctccaacgcctctggaaatatcgtgagctccgttaacatgatttctcggatgctcatcaacagatttaccatgcgccacaaaaaggctacatatgaacctgacgtggaccttggcagcgggacccggaatattggaatcgagtccgagattcccaacctggatatcattggcaagagaatcgagaagatcaagcaggagcatgaaacgtcttggcactacgaccaggatcacccgtataaaacctgggcctaccatggcagctatgagacaaagcagaccgggtccgcgagctctatggtcaatggagtggttcgcctgctcacaaaaccttgggacgtgctgcccaccgtcacacaaatggccatgaccgatacgacacctttcggccagcagcgggtgtttaaggaaaaggtggacaccagaacccaggagcccaaagaggggacaaagaaacttatgaagattacggctgaatggctgtggaaagagctcggaaagaaaaagacccctcgcatgtgtacaagagaagagttcacccggaaggtccgctccaacgccgctctgggcgccatctttacagatgagaataaatggaaaagcgctagagaagccgttgaggactctcggttctgggaactggtggataaagagagaaacctccacctggaagggaagtgcgagacctgtgtgtacaatatgatgggaaaacgggagaagaaacttggcgaatttggcaaagcgaaggggtcccgcgccatttggtacatgtggctgggagctagattcctcgagtttgaagccctgggcttccttaacgaggaccattggtttagccgggaaaattctctgtccggggtcgagggagagggcctccacaaactggggtatatcctgcgcgatgtgagcaagaaagaaggcggagctatgtacgccgacgacacagccggctgggataccagaattacgctcgaggacctgaagaacgaagagatggttaccaatcacatgaagggggaacataagaaacttgcggaggctatcttcaaactgacatatcaaaacaaagtggtccgggtgcagcgccccaccccgagaggaacagttatggatatcatttcccggcgcgaccagagaggcagcgggcaagtgggaacctacggcctcaatacgtttacaaacatggaggcccagctgatccggcagatggaaggggagggcgtcttcaaaaatattcagcaccttaccgtgacagaagaggttgccgtgcaaaactggctggctcgcgtcggaagagagcggctctctcgcatggccatcagcggcgatgactgcgtggtcaagcctctggatgacagattcgctaacgccctgaccgcgctcaatgatatggggaagattcggaaagacatccagcagtgggaaccctccaagggatggaacgattggacacaggtgcccttttgctctcatcacttccatgagctgatcatgaaagacggcagagttcttgtggtcccttgtcgcaatcaagatgaactgattgggcgggccagaatcagccagggagctggctggtccctccgcgagaccgcctgcctggggaagtcttatgctcagatgtggagccttatgtactttcaccggagagacctgcgcctcgccgcgaacgccatttgttccgctgtgccgtctcactgggtgcccacaagccggaccacatggtccatccatgccaaacacgaatggatgaccacagaggacatgctgaccgtttggaatagagtgtggattcgcgagaacccttggatggaagataagacgcccgtcgagagctgggaagagatcccttatctgggcaagcgggaagaccagtggtgcggatctctcattggcctgacatccagagctacctgggccaaaaatatccaagctgccatcaaccaggtgcgcagccttattgggaatgaggagtacaccgattacatgccctctatgaagcggttcagacgggaagaggaagaggcgggagttctgtggtga

SEQ ID NO: 19681 - RNA, 9876 nt, synthetic construct
  misc_feature 1..9876: note = derived and/or modified CDS sequence (opt5) from DENV-2__GU131900__SS-prME
  source 1..9876: mol_type = other RNA
agcgccggcatgatcattatgctgatccccaccgtgatggctttccacctgacaacgcggaatggggagcctcatatgattgtcggaatccaggaaaagggcaagagcctgctttttaagaccgaggacggggttaatatgtgcacactgatggccatggatctcggagaactgtgtgaggacaccattacatacaaatgcccgcttctgcggcaaaacgaacccgaggatatcgactgttggtgcaattctaccagcacatgggtgacctatggcacgtgtaccacaaccggggagcaccgcagagaaaagcggtccgtggcgctcgtccctcatgtgggaatgggcctggagacacgcaccgaaacgtggatgtctagcgagggcgcttggaaacacgcccagagaatcgagacatggattctgcggcatcccgggttcaccatcatggccgctattctcgcctacacaatcggaaccacccactttcagcgcgttctgattttcatccttctgacagctgtggccccttccatgacgatgagatgcattggcatctctaaccgggattttgtcgaaggggtgagcggaggctcctgggttgacatcgtgctcgagcacgggagctgtgtcaccacaatggcgaagaataagcccaccctggatttcgaacttattaaaacagaggccaagcagcctgctaccctgcgcaaatattgcatcgaagccaagctcacgaacacaaccaccgagtctagatgtccgacacaaggagagccctccctgaaagaagaacaagacaagcggtttgtgtgcaagcatagcatggtggatcgcggctggggcaatgggtgtggactgttcggcaaagggggaattgtgacctgcgctatgtttacatgcaagaaaaacatggaaggcaagatcgttcagcctgagaatctcgaatacacgattgtggtgacaccccactctggggaggagcatgccgtcggaaacgacacaggcaaacacggcatggaaatcaaggtgacccctcagtccagcatcacagaggcggaactgaccgggtatggaacggttaccatggagtgttctcccagaacaggccttgatttcaatgaaatggtgctgctccaaatggagaacaaagcctggctggtccaccggcagtggtttcttgacctgccgctcccttggctgcccggggctgataagcaggagtccaattggattcagaaggaaaccctggtgacattcaaaaaccctcatgccaagaaacaagacgttgtggtcctcggaagccaggagggcgctatgcacaccgccctgacgggggccacagaaatccagatgtcctctggcaatcttctgtttaccggacatctcaagtgccgcctgagaatggacaaacttcaactgaagggcatgagctactccatgtgtacagggaagttcaaagtggtcaaggagattgctgagacccagcacggaaccatcgtgattcgggttcagtatgaaggcgatgggagcccctgcaaaatccccttcgagatcatggacctcgaaaagagatacgtgctgggacgcctgattacagtcaaccctatcgtgacggagaaagattctccggttaacattgaagcggagcccccttttggcgactcctacatcattatcggggtggagcccggccagctcaagctgaattggttcaagaaaggaagctctattggccaaatgtttgaaaccacaatgagaggggccaagagaatggctatccttggagataccgcctgggacttcggcagcctcgggggagtctttacatccatcggcaaagccctccatcaggtgttcggggctatttatggcgccgcgttttctggagtgagctggaccatgaagatcctgattggcgttatcattacgtggatcgggatgaactcccgcagcacatctctgtccgtcagccttgtgctcgtgggaatcgtcaccctgtacctgggcgtgatggttcaggctgattctgggtgtgtggtctcctggaaaaataaggagctcaagtgcggaagcggcattttcatcaccgacaacgtgcacacatggaccgaacagtataaatttcaacctgagtccccctctaagctggccagcgccattcagaaagctcaggaagaggggatctgtggcattcggtccgttacaagacttgagaatctgatgtggaagcagatcacgccggaactcaaccacatcctggccgagaatgaagtgaaactgaccattatgacaggagatatcaagggcattatgcaagctgggaaacgctctcttcggcctcagcccaccgagctcaagtacagctggaagacatggggaaaagccaagatgctgtccaccgaaagctataaccagacgttcctgatcgacggccctgagaccgcggagtgccccaatacaaacagagcctggaactctctcgaagtcgaggattacgggtttggagtgttcaccacaaacatttggctgaaacttaaggaaaaacaggacgctttttgtgactccaagctgatgagcgccgctatcaaggataatcgcgccgttcatgcggacatgggctattggatcgagtctgccctcaacgatacctggaaaattgagaaggcttccttcatcgaagtgaaaaattgccactggcctaagagccatacactgtggtctaacggcgtcctggagagcgaaatgattatccccaaaaaccttgccgggccggtgtcccaacacaattaccggcctggataccacacccagattgctggcccctggcatctcgggaagctggagatggacttcgatttttgtgacggaacgacagtgatcgtcaccgaagattgcggcaacagagggcccagcctgcgcaccacaaccgcctctggaaagctcattacggagtggtgctgtcggtcctgcacactgcctccgcttagatatcggggcgaggacggctgttggtacgggatggaaatccgccccctgaaagagaaggaagagaatctcgttaacagcctggtgaccgccggacacggccaggtggataatttctccctgggggtccttggaatggctctctttctggaagagatgctgagaacacgggtgggcaccaaacatgcgatcctcctggttgccgtgtctttcgtcacacttattaccgggaacatgagctttaaggacctgggaagagtggttgtgatggtcggcgctacgatggccgatgacatcggcatgggggtgacctatctcgccctgctggctgccttcaaagttcgccctacatttgcggctggacttctgctccggaagctgacctccaaggagctcatgatgacaaccattggcatcgtgctgctttctcaaagcacgattcccgaaacagtcctggagctcaccgatgccctggccctggggatgatggtgcttaaaatcgtgagaaatatggaaaagtaccagctggctgtcacaatcatggccattctctgcgttcctaacgcggtgatcctgcagaatgcttggaaagtgtcctgtaccattctcgccgtcgtgtctgttagccccctgcttctgacctccagccagcaaaagacagactggatccctctcgccctgacgattaaaggactgaaccccaccgctatcttccttacaaccctgtctcgcacaaataagaaaagatcctggccgctcaacgaggccatcatggctgtgggcatggtcagcattctggcctcttccctcctgaaggacgatatccctatgaccgggccccttgtggcgggaggcctgctgacggtttgctatgtgctcacaggccggagcgccgacctggaacttgagcgcgctaccgatgtcaagtgggaggaccaggccgaaatttctgggtccagccctatcctgtccattaccatcagcgaggatggatctatgagcattaaaaatgaagaggaggaacagacactcaccatcctgatcagaacaggcctcctggtgatttccgggctttttcccatctctattccgatcacggctgccgcctggtacctgtgggaggtcaagaaacagcgggctggagtgctgtgggacgttccttctccccctcccatgggcaaggcggaactcgaggatggggcctatcgcattaaacaaaagggaatcctgggctactcccagatcggcgctggggtgtacaaggaaggaaccttccacacaatgtggcatgtcaccagaggcgccgtgcttatgcacaaagggaagcggattgagccctcctgggccgacgttaaaaaggatctgatcagctatggaggcgggtggaaactcgagggagaatggaaggagggcgaagaggtgcaggtcctggctctcgaacctggcaagaacccgcgcgccgtgcagacaaaacccgggctgtttaagaccaatacgggaaccattggcgcggtgtcccttgacttctctcctgggacaagcggatcccccatcattgataaaaagggcaaagttgtcgggctgtacggaaacggcgtggtgaccagaagcggcgcttatgtctctgccatcgcccaaacagagaagtccatcgaggacaaccctgaaattgaggatgacatctttcggaagcgcagactgaccattatggacctccaccccggggctggaaaaacaaagcggtacctgcctgccatcgtgagagaagcgattaaacgcggccttcggacgctgatcctcgctccgaccagagttgtggccgccgagatggaagaggctctgcgcgggctccccattcggtatcagacccctgccatcagagctgagcataccggacgcgaaatcgtcgatctgatgtgtcacgccaccttcacaatgcggcttctgagccccgtgagagttcctaattacaacctgattatcatggacgaggcgcatttcacggatcccgcctctattgctgcccgcggctatatctccacccgggtggaaatgggggaggctgccggcatttttatgacagccaccccgcctggaagcagagaccccttcccccagtccaatgctcctatcatcgatgaggaacgggagattcccgaacgctcttggaacagcggccacgagtgggtcacagactttaaggggaaaaccgtgtggttcgttccttccatcaaggcgggaaatgatattgccgcttgcctcagaaagaacggcaaaaaggtgatccaactgagccggaaaacgtttgactctgaatacgtcaagacacgcaccaatgattgggacttcgtggtgaccacagatatttccgagatgggggccaactttaaagccgagagagtcatcgacccgcggagatgtatgaagcccgttatccttaccgacggagaggaacgcgtgattctggctggccctatgcccgtgacacatagctctgccgcgcagcggagagggcgcatcggccggaatcctaaaaacgaaaatgatcagtacatttatatgggagagcccctcgaaaacgacgaggattgcgctcactggaaggaggccaagatgctgctggacaatatcaacaccccggaaggcattatccctagcatgttcgagcccgaaagagagaaagtcgatgccattgacggggaataccgcctccggggagaggctagaaagacgtttgtggatcttatgcgcagaggcgacctgcctgtttggctggcctataaagtggcggccgaggggatcaattacgctgatcggcgctggtgtttcgacggaatcaagaacaaccagattctcgaagagaatgtcgaagtggagatctggacaaaagagggcgaaagaaagaagctgaaaccccggtggcttgatgcccgcatttattccgaccctctggctctcaaggagtttaaagagttcgccgctgggagaaagtctctgaccctgaacctcatcacagagatgggccggcttcccaccttcatgacgcagaagaccagagatgccctggacaatctggcggttctccacacagccgaagctggaggccgcgcctacaaccatgctctgagcgagcttccggagaccctggaaacactcctgctgctcacccttctggccacagtgaccgggggaatttttctgttcctcatgtccggccgggggatcggaaagatgacgctgggcatgtgctgcatcattacagcctctatccttctgtggtatgctcagattcagcctcactggatcgcggccagcattatcctcgagtttttcctgatcgtcctgctcattcccgaacccgagaagcagagaacccctcaagacaatcagcttacctacgtggtcatcgctattctgacagtggttgccgccaccatggctaacgaaatgggctttctggagaaaacaaagaaagatctcgggctgggatccatcgccacgcagcagccggagagcaatattcttgacatcgatctgcgccccgcgtctgcctggaccctctacgctgtggccacaaccttcgtgacacctatgctgcggcattccattgaaaacagctccgtcaatgtttctctgaccgctatcgccaaccaagcgacggtgctcatgggccttgggaagggatggcccctgagcaaaatggacatcggcgtgcctctgctcgccattgggtgttattcccaggtcaatcccatcaccctgacagctgcccttctgctcctggtggctcactacgccattatcggacctggcctgcaggctaaggccaccagagaggcgcagaagcgggccgctgccggcattatgaaaaacccgacagttgatgggatcaccgtgatcgacctcgatcccattccttatgaccccaagtttgaaaaacaacttggacaggtcatgctgctgatcctctgcgtgacgcaggtcctgatgatgcgcacaacctgggctctttgtgaggccctgacactcgccaccggccctatttctaccctgtgggaagggaatcccggaagattctggaacacaacgatcgcggtgagcatggctaatatttttcggggctcctacctggccggggctggactccttttcagcatcatgaagaacaccacaaatacccgcagaggcacaggcaacatcggggagaccctgggagagaaatggaagtctcggctgaacgccctcggcaaatccgaatttcaaatttataaaaagagcgggatccaggaggttgatcgcacgctggccaaagaaggaattaagagaggcgagacagaccaccatgctgtgtctcgggggtccgccaaacttcgctggttcgtcgagagaaatatggtgaccccggaaggaaaggttgtggatctgggctgcggcagagggggatggagctactattgtggcgggctcaaaaacgtccgggaggtgaagggactgaccaagggcgggcctggacacgaagaacccatccccatgtctacatacggctggaatctggtgcgcctccagagcggcgttgacgtctttttcattcctcccgaaaaatgcgatacccttctgtgtgacatcggggagtcctctcctaacccgacagtggaggcgggacggacgctgagagtgctcaatctggtcgaaaactggcttaataacaatacccagttctgcatcaaggttctgaacccctacatgcctagcgtgattgagaaaatggaagccctccaacgcaagtatggcggggctctggtgcggaatcccctgtccagaaacagcacacatgagatgtactgggtctccaatgcctctggaaacatcgtgagctccgttaatatgatttctcgcatgctcatcaaccggtttaccatgagacacaaaaaggctacatatgaacctgacgtggatcttggcagcgggacccgcaacattggaatcgagtccgagattcccaatctggacatcatcggcaagcggattgagaagatcaaggaggaacatgagacgtcttggcactacgatcaggaccacccgtataaaacctgggcctaccatggcagctatgaaacaaagcagaccgggtccgcgagctctatggtcaacggagtggttagactgctcacaaaaccttgggatgtgctgcccaccgtcacacagatggccatgaccgacacgacacctttcggccaacagcgcgtgtttaaggagaaggtggatacccggacccaggagcccaaagaagggacaaagaaacttatgaagattacggctgagtggctgtggaaagaactcggaaagaaaaagacccctagaatgtgtacacgcgaggagttcaccagaaaggtccggtccaatgccgctctgggcgccatctttacagacgaaaacaaatggaaaagcgctcgcgaggccgttgaagattctagattctgggagctggtggacaaagaacggaatctccacctggaggggaagtgcgagacctgtgtgtacaacatgatgggaaaaagagaaaagaaacttggcgagtttggcaaagcgaaggggtcccgggccatttggtacatgtggctgggagctcgcttcctcgaatttgaggccctgggcttccttaatgaagatcattggtttagcagagagaactctctgtccggggtcgagggagaaggcctccacaaactggggtatatcctgcgggacgtgagcaagaaagagggcggagctatgtacgccgacgatacagccggctgggacacccgcatcacgctcgaagatctgaagaatgaggaaatggttaccaaccacatggagggggagcataagaaacttgcggaagctattttcaagctgacatatcagaataaagtggtcagagtgcaacggcccaccccgcgcggaacagttatggacatcatttccagacgggatcagcgcggcagcgggcaggtcggaacctacggcctcaacacgtttacaaatatggaggcccaactgatcagacagatggaaggggagggcgtcttcaagaacattcagcaccttaccgtgacagaggaagccgctgttcagaattggctggcccgggtgggacgcgagagactctctcggatggctatcagcggcgacgattgcgtcgtgaaacctctggacgatcgcttcgccaacgcgctgaccgccctcaacgacatggggaagatcagaaaggatattcaacagtgggaaccctccaaaggatggaatgactggacgcaggtccccttttgctctcatcacttccatgagctgatcatgaaggatggccgggtgcttgttgtgccttgtagaaaccaggacgaactgattgggcgcgctcggatcagccaaggagccggctggtccctcagagagaccgcttgcctggggaaatcttatgcccagatgtggagccttatgtactttcaccgccgggacctgagactcgcggccaatgctatttgttccgccgtcccgtctcactgggtgcccacaagccgcaccacatggtccatccatgctaagcacgagtggatgaccacagaagatatgctgaccgtgtggaaccgggtttggattagagagaatccttggatggaagacaaaacgcccgtggagagctgggaagagatcccttatctgggcaagcgcgaggatcagtggtgcggatctctcatcggcctgacatcccgggccacctgggctaagaacattcaggccgcgatcaatcaagtcagaagccttattgggaacgaagagtacaccgactacatgccctctatgaaacgcttccggagagaagaggaagaggccggagtgctgtggtga

SEQ ID NO: 19682 - RNA, 9876 nt, synthetic construct
  misc_feature 1..9876: note = derived and/or modified CDS sequence (opt5) from DENV-2__GU131901__SS-prME
  source 1..9876: mol_type = other RNA
agcgccggcatgatcattatgctgatccccaccgtgatggctttccacctgacaacgcggaatggggagcctcatatgattgtcggaatccaggaaaagggcaagagcctgctttttaagaccgaggacggggttaatatgtgcacactgatggccatggatctcggagaactgtgtgaggacaccattacatacaaatgcccgcttctgcggcaaaacgaacccgaggatatcgactgttggtgcaattctaccagcacatgggtgacctatggcacgtgtaccacaaccggggagcaccgcagagaaaagcggtccgtggcgctcgtccctcatgtgggaatgggcctggagacacgcaccgaaacgtggatgtctagcgagggcgcttggaaacacgcccagagaatcgagacatggattctgcggcatcccgggttcaccatcatggccgctattctcgcctacacaatcggaaccacccactttcagcgcgttctgattttcatccttctgacagctgtggccccttccatgacgatgagatgcattggcatctctaaccgggattttgtcgaaggggtgagcggaggctcctgggttgacatcgtgctcgagcacgggagctgtgtcaccacaatggcgaagaataagcccaccctggatttcgaacttattaaaacagaggccaagcagcctgctaccctgcgcaaatattgcatcgaagccaagctcacgaacacaaccaccgagtctagatgtccgacacaaggagagccctccctgaaagaggaacaagacaagcggtttgtgtgcaagcatagcatggtggatcgcggctggggcaatgggtgtggactgttcggcaaagggggaattgtgacctgcgctatgtttacatgcaagaaaaacatggaaggcaagatcgttcagcctgagaatctcgaatacacgattgtggtgacaccccactctggggaggagcatgccgtcggaaacgacacaggcaaacacggcatggaaatcaaggtgacccctcagtccagcatcacagaggcggaactgaccgggtatggaacggttaccatggagtgttctcccagaacaggccttgatttcaatgaaatggtgctgctccaaatggagaacaaagcctggctggtccaccggcagtggtttcttgacctgccgctcccttggctgcccggggctgataagcaggagtccaattggattcagaaggaaaccctggtgacattcaaaaaccctcatgccaagaaacaagacgttgtggtcctcggaagccaggagggcgctatgcacaccgccctgacgggggccacagaaatccagatgtcctctggcaatcttctgtttaccggacatctcaagtgccgcctgagaatggacaaacttcaactgaagggcatgagctactccatgtgtacagggaagttcaaagtggtcaaggagattgctgagacccagcacggaaccatcgtgattcgggttcagtatgaaggcgatgggagcccctgcaaaatccccttcgagatcatggacctcgaaaagagatacgtgctgggacgcctgattacagtcaaccctatcgtgacggagaaagattctccggttaacattgaagcggagcccccttttggcgactcctacatcattatcggggtggagcccggccagctcaagctgaattggttcaagaaaggaagctctattggccaaatgtttgaaaccacaatgagaggggccaagagaatggctatccttggagataccgcctgggacttcggcagcctcgggggagtctttacatccatcggcaaagccctccatcaggtgttcggggctatttatggcgccgcgttttctggagtgagctggaccatgaagatcctgattggcgttatcattacgtggatcgggatgaactcccgcagcacatctctgtccgtcagccttgtgctcgtgggaatcgtcaccctgtacctgggcgtgatggttcaggctgattctgggtgtgtggtctcctggaaaaataaggagctcaagtgcggaagcggcattttcatcaccgacaacgtgcacacatggaccgaacagtataaatttcaacctgagtccccctctaagctggccagcgccattcagaaagctcaggaagaggggatctgtggcattcggtccgttacaagacttgagaatctgatgtggaagcagatcacgccggaactcaaccacatcctggccgagaatgaagtgaaactgaccattatgacaggagatatcaagggcattatgcaagctgggaaacgctctcttcggcctcagcccaccgagctcaagtacagctggaagacatggggaaaagccaagatgctgtccaccgaaagctataaccagacgttcctgatcgacggccctgagaccgcggagtgccccaatacaaacagagcctggaactctctcgaagtcgaggattacgggtttggagtgttcaccacaaacatttggctgaaacttaaggaaaaacaggacgctttttgtgactccaagctgatgagcgccgctatcaaggataatcgcgccgttcatgcggacatgggctattggatcgagtctgccctcaacgatacctggaaaattgagaaggcttccttcatcgaagtgaaaaattgccactggcctaagagccatacactgtggtctaacggcgtcctggagagcgaaatgattatccccaaaaaccttgccgggccggtgtcccaacacaattaccggcctggataccacacccagattgctggcccctggcatctcgggaagctggagatggacttcgatttttgtgacggaacgacagtgatcgtcaccgaagattgcggcaacagagggcccagcctgcgcaccacaaccgcctctggaaagctcattacggagtggtgctgtcggtcctgcacactgcctccgcttagatatcggggcgaggacggctgttggtacgggatggaaatccgccccctgaaagagaaggaagagaatctcgttaacagcctggtgaccgccggacacggccaggtggataatttctccctgggggtccttggaatggctctctttctggaagagatgctgagaacacgggtgggcaccaaacatgcgatcctcctggttgccgtgtctttcgtcacacttattaccgggaacatgagctttaaggacctgggaagagtggttgtgatggtcggcgctacgatggccgatgacatcggcatgggggtgacctatctcgccctgctggctgccttcaaagttcgccctacatttgcggctggacttctgctccggaagctgacctccaaggagctcatgatgacaaccattggcatcgtgctgctttctcaaagcacgattcccgaaacagtcctggagctcaccgatgccctggccctggggatgatggtgcttaaaatcgtgagaaatatggaaaagtaccagctggctgtcacaatcatggccattctctgcgttcctaacgcggtgatcctgcagaatgcttggaaagtgtcctgtaccattctcgccgtcgtgtctgttagccccctgcttctgacctccagccagcaaaagacagactggatccctctcgccctgacgattaaaggactgaaccccaccgctatcttccttacaaccctgtctcgcacaaataagaaaagatcctggccgctcaacgaggccatcatggctgtgggcatggtcagcattctggcctcttccctcctgaagaatgacatccctatgaccgggccccttgtggcgggaggcctgctgacggtttgctatgtgctcacaggccggagcgccgatctggaacttgagcgcgctaccgacgtcaagtgggaggatcaggccgaaatttctgggtccagccctatcctgtccattaccatcagcgaggacggatctatgagcattaaaaacgaagaggaggaacagacactcaccatcctgatcagaacaggcctcctggtgatttccgggctttttcccatctctattccgatcacggctgccgcctggtacctgtgggaggtcaagaaacagcgggctggagtgctgtgggatgttccttctccccctcccatgggcaaggcggaactcgaggacggggcctatcgcattaaacaaaagggaatcctgggctactcccagatcggcgctggggtgtacaaggaaggaaccttccacacaatgtggcatgtcaccagaggcgccgtgcttatgcacaaagggaagcggattgagccctcctgggccgatgttaaaaaggacctgatcagctatggaggcgggtggaaactcgagggagaatggaaggagggcgaagaggtgcaggtcctggctctcgaacctggcaagaatccgcgcgccgtgcagacaaaacccgggctgtttaagaccaacacgggaaccattggcgcggtgtcccttgatttctctcctgggacaagcggatcccccatcattgacaaaaagggcaaagttgtcgggctgtacggaaacggcgtggtgaccagaagcggcgcttatgtctctgccatcgcccaaacagagaagtccatcgaggataatcctgaaattgaggacgatatctttcggaagcgcagactgaccattatggacctccaccccggggctggaaaaacaaagcggtacctgcctgccatcgtgagagaagcgattaaacgcggccttcggacgctgatcctcgctccgaccagagttgtggccgccgagatggaagaggctctgcgcgggctccccattcggtatcagacccctgccatcagagctgagcataccggacgcgaaatcgtcgacctgatgtgtcacgccaccttcacaatgcggcttctgagccccgtgagagttcctaactacaatctgattatcatggatgaggcgcatttcacggaccccgcctctattgctgcccgcggctatatctccacccgggtggaaatgggggaggctgccggcatttttatgacagccaccccgcctggaagcagagatcccttcccccagtccaacgctcctatcatcgacgaggaacgggagattcccgaacgctcttggaatagcggccacgagtgggtcacagattttaaggggaaaaccgtgtggttcgttccttccatcaaggcgggaaacgacattgccgcttgcctcagaaagaatggcaaaaaggtgatccaactgagccggaaaacgtttgattctgaatacgtcaagacacgcaccaacgactgggatttcgtggtgaccacagacatttccgagatgggggccaattttaaagccgagagagtcatcgatccgcggagatgtatgaagcccgttatccttaccgacggagaggaacgcgtgattctggctggccctatgcccgtgacacatagctctgccgcgcagcggagagggcgcatcggccggaaccctaaaaatgaaaacgaccagtacatttatatgggagagcccctcgaaaatgatgaggactgcgctcactggaaggaggccaagatgctgctggataacatcaataccccggaaggcattatccctagcatgttcgagcccgaaagagagaaagtcgacgccattgatggggaataccgcctccggggagaggctagaaagacgtttgtggaccttatgcgcagaggcgatctgcctgtttggctggcctataaagtggcggccgaggggatcaactacgctgaccggcgctggtgtttcgatggaatcaagaacaatcagattctcgaagagaacgtcgaagtggagatctggacaaaagagggcgaaagaaagaagctgaaaccccggtggcttgacgcccgcatttattccgatcctctggctctcaaggagtttaaagagttcgccgctgggagaaagtctctgaccctgaatctcatcacagagatgggccggcttcccaccttcatgacgcagaagaccagagacgccctggataacctggcggttctccacacagccgaagctggaggccgcgcctacaatcatgctctgagcgagcttccggagaccctggaaacactcctgctgctcacccttctggccacagtgaccgggggaatttttctgttcctcatgtccggccgggggatcggaaagatgacgctgggcatgtgctgcatcattacagcctctatccttctgtggtatgctcagattcagcctcactggatcgcggccagcattatcctcgagtttttcctgatcgtcctgctcattcccgaacccgagaagcagagaacccctcaagacaaccagcttacctacgtggtcatcgctattctgacagtggttgccgccaccatggctaatgaaatgggctttctggagaaaacaaagaaagacctcgggctgggatccatcgccacgcagcagccggagagcaacattcttgatatcgacctgcgccccgcgtctgcctggaccctctacgctgtggccacaaccttcgtgacacctatgctgcggcattccattgaaaatagctccgtcaacgtttctctgaccgctatcgccaatcaagcgacggtgctcatgggccttgggaagggatggcccctgagcaaaatggatatcggcgtgcctctgctcgccattgggtgttattcccaggtcaaccccatcaccctgacagctgcccttctgctcctggtggctcactacgccattatcggacctggcctgcaggctaaggccaccagagaggcgcagaagcgggccgctgccggcattatgaaaaatccgacagttgacgggatcaccgtgatcgatctcgaccccattccttatgatcccaagtttgaaaaacaacttggacaggtcatgctgctgatcctctgcgtgacgcaggtcctgatgatgcgcacaacctgggctctttgtgaggccctgacactcgccaccggccctatttctaccctgtgggaagggaaccccggaagattctggaatacaacgatcgcggtgagcatggctaacatttttcggggctcctacctggccggggctggactccttttcagcatcatgaagaataccacaaacacccgcagaggcacaggcaacgttggggagaccctgggagagaaatggaagtctcggctgaatgccctcggcaaatccgaatttcaaatctataaaaagagcgggattcaggaggtggaccgcacgctggccaaagaaggaatcaagagaggcgagacagatcaccatgctgtctctcgggggtccgccaaacttcgctggttcgtggagagaaacatggttaccccggaaggaaaggtggtcgacctgggctgcggcagagggggatggagctactattgtggcgggctcaaaaatgtgcgggaggtgaagggactgaccaagggcgggcctggacacgaagaacccattcccatgtctacatacggctggaacctggttcgcctccagagcggcgtcgatgtgtttttcatccctcccgaaaaatgcgacacccttctgtgtgatattggggagtcctctcctaatccgacagtggaggcgggacggacgctgagagtcctcaacctggttgaaaattggcttaacaataacacccagttctgcatcaaggtgctgaatccctacatgcctagcgtgatcgagaaaatggaagccctccaacgcaagtatggcggggctctggtccggaaccccctgtccagaaatagcacacatgagatgtactgggtgtccaacgcctctggaaatattgttagctccgtgaacatgatctctcgcatgctcattaaccggtttaccatgagacacaaaaaggctacatatgaacctgacgtcgaccttggcagcgggacccgcaatatcggaattgagtccgagatccccaacctggatattatcggcaagcggatcgagaagattaaggaggaacatgagacgtcttggcactacgaccaggatcacccgtataaaacctgggcctaccatggcagctatgaaacaaagcagaccgggtccgcgagctctatggtgaatggagttgtgagactgctcacaaaaccttgggacgtcctgcccaccgtgacacagatggccatgaccgatacgacacctttcggccaacagcgcgtgtttaaggagaaggtcgacacccggacccaggagcccaaagaagggacaaagaaacttatgaagatcacggctgagtggctgtggaaagaactcggaaagaaaaagacccctagaatgtgtacacgcgaggagttcaccagaaaggttcggtccaacgccgctctgggcgccatttttacagatgaaaataaatggaaaagcgctcgcgaggccgtggaagactctagattctgggagctggtggataaagaacggaacctccacctggaggggaagtgcgagacctgtgtctacaatatgatgggaaaaagagaaaagaaacttggcgagtttggcaaagcgaaggggtcccgggccatctggtacatgtggctgggagctcgcttcctcgaatttgaggccctgggcttccttaacgaagaccattggtttagcagagaaaattctctgtccggggtggagggagaaggcctccacaaactggggtatattctgcgggatgttagcaagaaagagggcggagctatgtacgccgacgacacagccggctgggatacccgcatcacgctcgaagacctgaagaacgaggaaatggtgaccaatcacatggagggggagcataagaaacttgcggaagctatcttcaagctgacatatcagaacaaagtcgtgagagttcaacggcccaccccgcgcggaacagtgatggatattatctccagacgggaccagcgcggcagcgggcaggtcggaacctacggcctcaatacgtttacaaacatggaggcccaactgattagacagatggaaggggagggcgtgttcaagaatatccagcaccttaccgttacagaggaagccgctgtgcagaactggctggcccgggtcggacgcgagagactctctcggatggctattagcggcgatgactgcgtggtcaaacctctggatgaccgcttcgccaacgcgctgaccgccctcaatgatatggggaagatcagaaaggacatccaacagtgggaaccctccaaaggatggaacgattggacgcaggtccccttttgctctcatcacttccatgagctgattatgaaggacggccgggttcttgtggtcccttgtagaaatcaggatgaactgatcgggcgcgctcggattagccaaggagccggctggtccctcagagagaccgcttgcctggggaaatcttatgcccagatgtggagccttatgtactttcaccgccgggacctgagactcgcggccaacgctatctgttccgccgtgccgtctcactgggtgcccacaagccgcaccacatggtccattcatgctaagcacgagtggatgaccacagaagacatgctgaccgtttggaatcgggtgtggatcagagagaacccttggatggaagataaaacgcccgtcgagagctgggaagagattccttatctgggcaagcgcgaggaccagtggtgcggatctctcatcggcctgacatcccgggccacctgggctaagaatatccaggccgcgattaaccaagtgagaagccttatcgggaatgaagagtacaccgattacatgccctctatgaaacgcttccggagagaagaggaagaggccggagttctgtggtga

SEQ ID NO: 19683 - RNA, 9876 nt, synthetic construct
  misc_feature 1..9876: note = derived and/or modified CDS sequence (opt5) from DENV-2__GU131902__SS-prME
  source 1..9876: mol_type = other RNA
agcgccggcatgatcattatgctgatccccaccgtgatggctttccacctgaccacgcggaatggggagcctcatatgattgtcggaatccaggaaaagggcaagagcctgctttttaagaccgaggacggggttaatatgtgcacactgatggccatggatctcggagaactgtgtgaggacaccattacatacaaatgcccgcttctgcggcaaaacgaacccgaggatatcgactgttggtgcaattctaccagcacatgggtgacctatggcacgtgtaccacaaccggggagcaccgcagagaaaagcggtccgtggcgctcgtccctcatgtgggaatgggcctggagacacgcaccgaaacgtggatgtctagcgagggcgcttggaaacacgcccagagaatcgagacatggattctgcggcatcccgggttcaccatcatggccgctattctcgcctacacaatcggaaccacccactttcagcgcgttctgattttcatccttctgacagctgtggccccttccatgacgatgagatgcattggcatctctaaccgggattttgtcgaaggggtgagcggaggctcctgggttgacatcgtgctcgagcacgggagctgtgtcaccacaatggcgaagaataagcccaccctggatttcgaacttattaaaacagaggccaagcagcctgctaccctgcgcaaatattgcatcgaagccaagctcacgaacacaaccaccgagtctagatgtccgacacaaggagagccctccctgaaagaggaacaagacaagcggtttgtgtgcaagcatagcatggtggatcgcggctggggcaatgggtgtggactgttcggcaaagggggaattgtgacctgcgctatgtttacatgcaagaaaaacatggaaggcaagatcgttcagcctgagaatctcgaatacacgattgtggtgacaccccactctggggaggagcatgccgtcggaaacgacacaggcaaacacggcatggaaatcaaggtgacccctcagtccagcatcacagaggcggaactgaccgggtatggaacggttaccatggagtgttctcccagaacaggccttgatttcaatgaaatggtgctgctccaaatggagaacaaagcctggctggtccaccggcagtggtttcttgacctgccgctcccttggctgcccggggctgataagcaggagtccaattggattcagaaggaaaccctggtgacattcaaaaaccctcatgccaagaaacaagacgttgtggtcctcggaagccaggagggcgctatgcacaccgccctgacgggggccacagaaatccagatgtcctctggcaatcttctgtttaccggacatctcaagtgccgcctgagaatggacaaacttcaactgaagggcatgagctactccatgtgtacagggaagttcaaagtggtcaaggagattgctgagacccagcacggaaccatcgtgattcgggttcagtatgaaggcgatgggagcccctgcaaaatccccttcgagatcatggacctcgaaaagagatacgtgctgggacgcctgattacagtcaaccctatcgtgacggagaaagattctccggttaacattgaagcggagcccccttttggcgactcctacatcattatcggggtggagcccggccagctcaagctgaattggttcaagaaaggaagctctattggccaaatgtttgaaaccacaatgagaggggctaagagaatggctatccttggagataccgcctgggacttcggcagcctcgggggagtctttacatccatcggcaaagccctccatcaggtgttcggggctatttatggcgccgcgttttctggagtgagctggaccatgaagatcctgattggcgttatcattacgtggatcgggatgaactcccgcagcacatctctgtccgtcagccttgtgctcgtgggaatcgtcaccctgtacctgggcgtgatggttcaggctgattctgggtgtgtggtctcctggaaaaataaggagctcaagtgcggaagcggcattttcatcaccgacaacgtgcacacatggaccgaacagtataaatttcaacctgagtccccctctaagctggccagcgccattcagaaagctcaggaagaggggatctgtggcattcggtccgttacaagacttgagaatctgatgtggaagcagatcacgccggaactcaaccacatcctggccgagaatgaagtgaaactgaccattatgacaggagatatcaagggcattatgcaagctgggaaacgctctcttcggcctcagcccaccgagctcaagtacagctggaagacatggggaaaagccaagatgctgtccaccgaaagctataaccagacgttcctgatcgacggccctgagaccgcggagtgccccaatacaaacagagcctggaactctctcgaagtcgaggattacgggtttggagtgttcaccacaaacatttggctgaaacttaaggaaaaacaggacgctttttgtgactccaagctgatgagcgccgctatcaaggataatcgcgccgttcatgcggacatgggctattggatcgagtctgccctcaacgatacctggaaaattgagaaggcttccttcatcgaagtgaaaaattgccactggcctaagagccatacactgtggtctaacggcgtcctggagagcgaaatgattatccccaaaaaccttgccgggccggtgtcccaacacaattaccggcctggataccacacccagattgctggcccctggcatctcgggaagctggagatggacttcgatttttgtgacggaacgacagtgatcgtcaccgaagattgcggcaacagagggcccagcctgcgcaccacaaccgcctctggaaagctcattgccgagtggtgctgtcggtcctgcacgctgcctccgcttagatatcggggcgaggacggctgttggtacgggatggaaatccgccccctgaaagagaaggaagagaatctcgttaacagcctggtgacagctggacacggccaggtggataatttctccctgggggtccttggaatggcgctctttctggaagagatgctgagaacccgggtgggcacaaaacatgccatcctcctggttgctgtgtctttcgtcacccttattacagggaacatgagctttaaggacctgggaagagtggttgtgatggtcggcgccaccatggccgatgacatcggcatgggggtgacgtatctcgctctgctggccgcgttcaaagttcgccctacctttgctgccggacttctgctccggaagctgacatccaaggagctcatgatgaccacaattggcatcgtgctgctttctcaaagcaccattcccgaaacggtcctggagctcacagatgccctggctctggggatgatggtgcttaaaatcgtgagaaatatggaaaagtaccagctggccgtcaccatcatggcgattctctgcgttcctaacgctgtgatcctgcagaatgcctggaaagtgtcctgtacaattctcgccgtcgtgtctgttagccccctgcttctgacctccagccagcaaaagaccgactggatccctctcgctctgacaattaaaggactgaaccccacggccatcttccttaccacactgtctcgcaccaataagaaaagatcctggccgctcaacgaggctatcatggccgtgggcatggtcagcattctggcgtcttccctcctgaagaatgacatccctatgacagggccccttgtggccggaggcctgctgaccgtttgctatgtgctcacgggccggagcgctgatctggaacttgagcgcgccacagacgtcaagtgggaggatcaggctgaaatttctgggtccagccctatcctgtccattaccatcagcgaggacggatctatgagcattaaaaacgaagaggaggaacagaccctcacaatcctgatcagaaccggcctcctggtgatttccgggctttttcccatctctattccgatcacagccgccgcttggtacctgtgggaggtcaagaaacagcgggcgggagtgctgtgggatgttccttctccccctcccatgggcaaggccgaactcgaggacggggcttatcgcattaaacaaaagggaatcctgggctactcccagatcggcgccggggtgtacaaggaaggaacgttccacaccatgtggcatgtcacaagaggcgccgtgcttatgcacaaagggaagcggattgagccctcctgggctgatgttaaaaaggacctgatcagctatggaggcgggtggaaactcgagggagaatggaaggagggcgaagaggtgcaggtcctggccctcgaacctggcaagaatccgcgcgcggtgcagaccaaacccgggctgtttaagacaaacaccggaacgattggcgctgtgtcccttgatttctctcctgggaccagcggatcccccatcattgacaaaaagggcaaagttgtcgggctgtacggaaacggcgtggtgacaagaagcggcgcctatgtctctgccatcgctcaaaccgagaagtccatcgaggataatcctgaaattgaggacgatatctttcggaagcgcagactgacaattatggacctccaccccggggccggaaaaaccaagcggtacctgcctgcgatcgtgagagaagctattaaacgcggccttcggacactgatcctcgccccgacgagagttgtggccgctgagatggaagaggccctgcgcgggctccccattcggtatcagacccctgctatcagagccgagcatacaggacgcgaaatcgtcgacctgatgtgtcacgcgaccttcaccatgcggcttctgagccccgtgagagttcctaactacaatctgattatcatggatgaggcccatttcacagaccccgcttctattgccgctcgcggctatatctccacgcgggtggaaatgggggaggccgccggcatttttatgaccgctacaccgcctggaagcagagatcccttcccccagtccaacgcgcctatcatcgacgaggaacgggagattcccgaacgctcttggaatagcggccacgagtgggtcaccgattttaaggggaaaacagtgtggttcgttccttccatcaaggccggaaacgacattgctgcctgcctcagaaagaatggcaaaaaggtgatccaactgagccggaaaacctttgattctgaatacgtcaagacgcgcacaaacgactgggatttcgtggtgaccaccgacatttccgagatgggggccaattttaaagctgagagagtcatcgatccgcggagatgtatgaagcccgttatccttacagacggagaggaacgcgtgattctggccggccctatgcccgtgacccatagctctgcggctcagcggagagggcgcatcggccggaaccctaaaaatgaaaacgaccagtacatttatatgggagagcccctcgaaaatgatgaggactgcgcccactggaaggaggccaagatgctgctggataacatcaatacaccggaaggcattatccctagcatgttcgagcccgaaagagagaaagtcgacgctattgatggggaataccgcctccggggagaggccagaaagacctttgtggaccttatgcgcagaggcgatctgcctgtttggctggcgtataaagtggccgctgaggggatcaactacgccgaccggcgctggtgtttcgatggaatcaagaacaatcagattctcgaagagaacgtcgaagtggagatctggacgaaagagggcgaaagaaagaagctgaaaccccggtggcttgacgctcgcatttattccgatcctctggccctcaaggagtttaaagagttcgctgccgggagaaagtctctgacactgaatctcatcaccgagatgggccggcttcccacattcatgacccagaagacgagagacgcgctggataacctggccgttctccacaccgctgaagccggaggccgcgcttacaatcatgccctgagcgagcttccggagacactggaaaccctcctgctgctcacacttctggccaccgtgacagggggaatttttctgttcctcatgtccggccgggggatcggaaagatgaccctgggcatgtgctgcatcattacggcttctatccttctgtggtatgcgcagattcagcctcactggatcgccgctagcattatcctcgagtttttcctgatcgtcctgctcattcccgaacccgagaagcagagaacacctcaagacaaccagcttacctacgtggtcatcgccattctgaccgtggttgccgctacaatggccaatgaaatgggctttctggagaaaaccaagaaagacctcgggctgggatccatcgcgacacagcagccggagagcaacattcttgatatcgacctgcgccccgcctctgcttggacgctctacgccgtggctaccacattcgtgacccctatgctgcggcattccattgaaaatagctccgtcaacgtttctctgacagccatcgcgaatcaagccaccgtgctcatgggccttgggaagggatggcccctgagcaaaatggatatcggcgtgcctctgctcgctattgggtgttattcccaggtcaaccccatcacgctgaccgccgcccttctgctcctggtggcccactacgctattatcggacctggcctgcaggccaaggcgacaagagaggcccagaagcgggctgccgctggcattatgaaaaatccgaccgttgacgggatcacagtgatcgatctcgaccccattccttatgatcccaagtttgaaaaacaacttggacaggtcatgctgctgatcctctgcgtgacccaggtcctgatgatgcgcacgacatgggccctttgtgaggccctgaccctcgcgacaggccctatttctaccctgtgggaagggaaccccggaagattctggaataccacaatcgctgtgagcatggccaacatttttcggggctcctacctggctggggccggactccttttcagcatcatgaagaatacgaccaacacacgcagaggcaccggcaacatcggggagacactgggagagaaatggaagtctcggctgaatgccctcggcaaatccgaatttcaaatttataaaaagagcgggatccaggaggttgaccgcaccctggctaaagaaggaattaagagaggcgagacggatcaccatgccgtgtctcgggggtccgcgaaacttcgctggttcgtcgagagaaacatggtgacaccggaaggaaaggttgtggacctgggctgcggcagagggggatggagctactattgtggcgggctcaaaaatgtccgggaggtgaagggactgaccaagggcgggcctggacacgaagaacccatccccatgtctacctacggctggaacctggtgcgcctccagagcggcgttgatgtctttttcattcctcccgaaaaatgcgacacacttctgtgtgatatcggggagtcctctcctaatccgaccgtggaggccggacggacactgagagtgctcaacctggtcgaaaattggcttaacaataacacgcagttctgcatcaaggttctgaatccctacatgcctagcgtgattgagaaaatggaagctctccaacgcaagtatggcggggccctggtgcggaaccccctgtccagaaatagcacccatgagatgtactgggtctccaacgcttctggaaatatcgtgagctccgttaacatgatttctcgcatgctcatcaaccggtttacaatgagacacaaaaaggccacctatgaacctgacgtggaccttggcagcgggacacgcaatattggaatcgagtccgagattcccaacctggatatcatcggcaagcggattgagaagatcaaggaggaacatgagacctcttggcactacgaccaggatcacccgtataaaacgtgggcgtaccatggcagctatgaaaccaagcagacagggtccgccagctctatggtcaatggagtggttagactgctcaccaaaccttgggacgtgctgcccacagtcacccagatggctatgacagataccacgcctttcggccaacagcgcgtgtttaaggagaaggtggacacacggacccaggagcccaaagaagggaccaagaaacttatgaagattacagccgagtggctgtggaaagaactcggaaagaaaaagacgcctagaatgtgtacccgcgaggagttcacaagaaaggtccggtccaacgctgccctgggcgctatctttaccgatgaaaataaatggaaaagcgcccgcgaggcggttgaagactctagattctgggagctggtggataaagaacggaacctccacctggaggggaagtgcgagacatgtgtgtacaatatgatgggaaaaagagaaaagaaacttggcgagtttggcaaagccaaggggtcccgggctatttggtacatgtggctgggagcccgcttcctcgaatttgaggctctgggcttccttaacgaagaccattggtttagcagagaaaattctctgtccggggtcgagggagaaggcctccacaaactggggtatatcctgcgggatgtgagcaagaaagagggcggagccatgtacgccgacgacaccgcgggctgggatacacgcatcaccctcgaagacctgaagaacgaggaaatggttacgaatcacatggagggggagcataagaaacttgctgaagccattttcaagctgacctatcagaacaaagtggtcagagtgcaacggcccacaccgcgcggaaccgttatggatatcatttccagacgggaccagcgcggcagcgggcaggtcggaacatacggcctcaatacctttacgaacatggaggcccaactgatcagacagatggaaggggagggcgtcttcaagaatattcagcaccttacagtgaccgaggaagctgccgttcagaactggctggctcgggtgggacgcgagagactctctcggatggccatcagcggcgatgactgcgtcgtgaaacctctggatgaccgcttcgcgaacgccctgacagctctcaatgatatggggaagatcagaaaggacattcaacagtgggaaccctccaaaggatggaacgattggacccaggtccccttttgctctcatcacttccatgagctgatcatgaaggacggccgggtgcttgttgtgccttgtagaaatcaggatgaactgattgggcgcgcccggatcagccaaggagctggctggtccctcagagagacggcctgcctggggaaatcttatgcgcagatgtggagccttatgtactttcaccgccgggacctgagactcgccgctaacgccatttgttccgctgtcccgtctcactgggtgcccaccagccgcacaacctggtccatccatgccaagcacgagtggatgacaaccgaagacatgctgacagtgtggaatcgggtttggattagagagaacccttggatggaagataaaacccccgtggagagctgggaagagatcccttatctgggcaagcgcgaggaccagtggtgcggatctctcatcggcctgacgtcccgggctacatgggccaagaatattcaggcggccatcaaccaagtcagaagccttattgggaatgaagagtacaccgattacatgccctctatgaaacgcttccggagagaagaggaagaggctggagtgctgtggtga

SEQ ID NO: 19684 - RNA, 9876 nt, synthetic construct
  misc_feature 1..9876: note = derived and/or modified CDS sequence (opt5) from DENV-2__GU131924__SS-prME
  source 1..9876: mol_type = other RNA
agcgccggaatgatcattatgctgatccccaccgtgatggctttccacctgacaacgcggaatggggagcctcatatgattgtcggaatccaggaaaagggcaaaagcctgctttttaagaccgaggacggggttaatatgtgcacactgatggccatggatctcggagaactgtgtgaggacaccattacatacaaatgcccgcttctgcggcaaaacgaacccgaggatatcgactgttggtgcaattctaccagcacatgggtgacctatggcacgtgtaccacaaccggggagcaccgcagagaaaagcggtccgtggcgctcgtccctcatgtgggaatgggcctggagacacgcaccgaaacgtggatgtctagcgagggcgcttggaaacacgcccagagaatcgagacatggattctgcggcatcccgggttcaccatcatggccgctattctcgcctacacaatcggaaccacccactttcagcgcgttctgattttcatccttctgacagctgtggccccttccatgacgatgagatgcattggcatctctaaccgggattttgtcgaaggggtgagcggaggctcctgggttgacatcgtgctcgagcacgggagctgtgtcaccacaatggcgaagaataagcccaccctggatttcgaacttattaaaacagaggccaagcagcctgctaccctgcgcaaatattgcatcgaagccaagctcacgaacacaaccaccgagtctagatgtccgacacaaggagagccctccctgaaagaggaacaagacaagcggtttgtgtgcaagcatagcatggtggatcgcggctggggcaatgggtgtggactgttcggcaaagggggaattgtcacatgcgctatgtttacatgcaagaaaaacatggaaggcaagatcgttcagcctgagaatctcgaatacacgattgtggtgacaccccactctggggaggagcatgccgtcggaaacgacacaggcaaacacggcatggaaatcaaggtgacccctcagtccagcatcacagaggcggaactgaccgggtatggaacggttaccatggagtgttctcccagaacaggccttgatttcaatgaaatggtgctgctccaaatggagaacaaagcctggctggtccaccggcagtggtttcttgacctgccgctcccttggctgcccggggctgataagcaggagtccaattggattcagaaggaaaccctggtgacattcaaaaaccctcatgccaagaaacaagacgttgtggtcctcggaagccaggagggcgctatgcacaccgccctgacgggggccacagaaatccagatgtcctctggcaatcttctgtttaccggacatctcaagtgccgcctgagaatggacaaacttcaactgaagggcatgagctactccatgtgtacagggaagttcaaagtggtcaaggagattgctgagacccagcacggaaccatcgtgattcgggttcagtatgaaggcgatgggagcccctgcaaaatccccttcgagatcatggacctcgaaaagagatacgtgctgggacgcctgattacagtcaaccctatcgtgacggagaaagattctccggttaacattgaagcggagcccccttttggcgactcctacatcattatcggggtggagcccggccagctcaagctgaattggttcaagaaaggaagctctattggccaaatgtttgaaaccacaatgagaggggccaagagaatggctatccttggagataccgcctgggacttcggcagcctcggcggggtctttacatccatcgggaaagccctccatcaggtgttcggggctatttatggcgccgcgttttctggagtgagctggaccatgaagatcctgattggcgttatcattacgtggatcgggatgaactcccgcagcacatctctgtccgtcagccttgtgctcgtgggaatcgtcaccctgtacctgggcgtgatggttcaggctgattctgggtgtgtggtctcctggaaaaataaggagctcaagtgcggaagcggcattttcatcaccgacaacgtgcacacatggaccgaacagtataaatttcaacctgagtccccctctaagctggccagcgccattcagaaagctcaggaagaggggatctgtggcattcggtccgttacaagacttgagaatctgatgtggaagcagatcacgccggaactcaaccacatcctggccgagaatgaagtgaaactgaccattatgacaggagatatcaagggcattatgcaagctgggaaacgctctcttcggcctcagcccaccgagctcaagtacagctggaagacatggggaaaagccaagatgctgtccaccgaaagctataaccagacgttcctgatcgacggccctgagaccgcggagtgccccaatacaaacagagcctggaactctctcgaagtcgaggattacgggtttggagtgttcaccacaaacatttggctgaaacttaaggaaaaacaggacgctttttgtgactccaagctgatgagcgccgctatcaaggataatcgcgccgttcatgcggacatgggctattggatcgagtctgccctcaacgatacctggaaaattgagaaggcttccttcatcgaagtgaaaaattgccactggcctaagagccatacactgtggtctaacggcgtcctggagagcgaaatgattatccccaaaaaccttgccgggccggtgtcccaacacaattaccggcctggataccacacccagattgctggcccctggcatctcgggaagctggagatggacttcgatttttgtgacggaacgacagtgatcgtcaccgaagattgcggcaacagagggcccagcctgcgcaccacaaccgcctctggaaagctcattacggagtggtgctgtcggtcctgcacactgcctccgcttagatatcggggcgaggacggctgttggtacgggatggaaatccgccccctgaaagagaaggaagagaatctcgttaacagcctggtgaccgccggacacggccaggtggataatttctccctgggggtccttggaatggctctctttctggaagagatgctgagaacacgggtgggcaccaaacatgcgatcctcctggttgccgtgtctttcgtcacacttattaccgggaacatgagctttaaggacctgggaagagtggttgtgatggtcggcgctacgatggccgatgacatcggcatgggggtgacctatctcgccctgctggctgccttcaaagttcgccctacatttgcggctggacttctgctccggaagctgacctccaaggagctcatgatgacaaccattggcatcgtgctgctttctcaaagcacgattcccgaaacagtcctggagctcaccgatgccctggccctggggatgatggtgcttaaaatcgtgagaaatatggaaaagtaccagctggctgtcacaatcatggccattctctgcgttcctaacgcggtgatcctgcagaatgcttggaaagtgtcctgtaccattctcgccgtcgtgtctgttagccccctgcttctgacctccagccagcaaaagacagactggatccctctcgccctgacgattaaaggactgaaccccaccgctatcttccttacaaccctgtctcgcacaaataagaaaagatcctggccgctcaacgaggccatcatggctgtgggcatggtcagcattctggcctcttccctcctgaagaatgacatccctatgaccgggccccttgtggcgggaggcctgctgacggtttgctatgtgctcacaggccggagcgccgatctggaacttgagcgcgctaccgacgtcaagtgggaggatcaggccgaaatttctgggtccagccctatcctgtccattaccatcagcgaggacggatctatgagcattaaaaacgaagaggaggaacagacactcaccatcctgatcagaacaggcctcctggtgatttccgggctttttcccatctctattccgatcacggctgccgcctggtacctgtgggaggtcaagaaacagcgggctggagtgctgtgggatgttccttctccccctcccatgggcaaggcggaactcgaggacggggcctatcgcattaaacaaaagggaatcctgggctactcccagatcggcgctggggtgtacaaggaaggaaccttccacacaatgtggcatgtcaccagaggcgccgtgcttatgcacaaagggaagcggattgagccctcctgggccgatgttaaaaaggacctgatcagctatggaggcgggtggaaactcgagggagaatggaaggagggcgaagaggtgcaggtcctggctctcgaacctggcaagaatccgcgcgccgtgcagacaaaacccgggctgtttaagaccaacacgggaaccattggcgcggtgtcccttgatttctctcctgggacaagcggatcccccatcattgacaaaaagggcaaagttgtcgggctgtacggaaacggcgtggtgaccagaagcggcgcttatgtctctgccatcgcccaaacagagaagtccatcgaggataatcctgaaattgaggacgatatctttcggaagcgcagactgaccattatggacctccaccccggggctggaaaaacaaagcggtacctgcctgccatcgtgagagaagcgattaaacgcggccttcggacgctgatcctcgctccgaccagagttgtggccgccgagatggaagaggctctgcgcgggctccccattcggtatcagacccctgccatcagagctgagcataccggacgcgaaatcgtcgacctgatgtgtcacgccaccttcacaatgcggcttctgagccccgtgagagttcctaactacaatctgattatcatggatgaggcgcatttcacggaccccgcctctattgctgcccgcggctatatctccacccgggtggaaatgggggaggctgccggcatttttatgacagccaccccgcctggaagcagagatcccttcccccagtccaacgctcctatcatcgacgaggaacgggagattcccgaacgctcttggaatagcggccacgagtgggtcacagattttaaggggaaaaccgtgtggttcgttccttccatcaaggcgggaaacgacattgccgcttgcctcagaaagaatggcaaaaaggtgatccaactgagccggaaaacgtttgattctgaatacgtcaagacacgcaccaacgactgggatttcgtggtgaccacagacatttccgagatgggggccaattttaaagccgagagagtcatcgatccgcggagatgtatgaagcccgttatccttaccgacggagaggaacgcgtgattctggctggccctatgcccgtgacacatagctctgccgcgcagcggagagggcgcatcggccggaaccctaaaaatgaaaacgaccagtacatttatatgggagagcccctcgaaaatgatgaggactgcgctcactggaaggaggccaagatgctgctggataacatcaataccccggaaggcattatccctagcatgttcgagcccgaaagagagaaagtcgacgccattgatggggaataccgcctccggggagaggctagaaagacgtttgtggaccttatgcgcagaggcgatctgcctgtttggctggcctataaagtggcggccgaggggatcaactacgctgaccggcgctggtgtttcgatggaatcaagaacaatcagattctcgaagagaacgtcgaagtggagatctggacaaaagagggcgaaagaaagaagctgaaaccccggtggcttgacgcccgcatttattccgatcctctggctctcaaggagtttaaagagttcgccgctgggagaaagtctctgaccctgaatctcatcacagagatgggccggcttcccaccttcatgacgcagaagaccagagacgccctggataacctggcggttctccacacagccgaagctggaggccgcgcctacaatcatgctctgagcgagcttccggagaccctggaaacactcctgctgctcacccttctggccacagtgaccgggggaatttttctgttcctcatgtccggccgggggatcggaaagatgacgctgggcatgtgctgcatcattacagcctctatccttctgtggtatgctcagattcagcctcactggatcgcggccagcattatcctcgagtttttcctgatcgtcctgctcattcccgaacccgagaagcagagaacccctcaagacaaccagcttacctacgtggtcatcgctattctgacagtggttgccgccaccatggctaatgaaatgggctttctggagaaaacaaagaaagacctcgggctgggatccatcgccacgcagcagccggagagcaacattcttgatatcgacctgcgccccgcgtctgcctggaccctctacgctgtggccacaaccttcgtgacacctatgctgcggcattccattgaaaatagctccgtcaacgtttctctgaccgctatcgccaatcaagcgacggtgctcatgggccttgggaagggatggcccctgagcaaaatggatatcggcgtgcctctgctcgccattgggtgttattcccaggtcaaccccatcaccctgacagctgcccttctgctcctggtggctcactacgccattatcggacctggcctgcaggctaaggccaccagagaggcgcagaagcgggccgctgccggcattatgaaaaatccgacagttgacgggatcaccgtgatcgatctcgaccccattccttatgatcccaagtttgaaaaacaacttggacaggtcatgctgctgatcctctgcgtgacgcaggtcctgatgatgcgcacaacctgggctctttgtgaggccctgacactcgccaccggccctatttctaccctgtgggaagggaaccccggaagattctggaatacaacgatcgcggtgagcatggctaacatttttcggggctcctacctggccggggctggactccttttcagcatcaagaaaaataccacaaacacccgcagaggcacaggcaacatcggggagaccctgggagagaagtggaaatctcggctgaatgccctcggcaagtccgaatttcaaatttataagaaaagcgggatccaggaggttgaccgcacgctggccaaggaaggaattaaaagaggcgagacagatcaccatgctgtgtctcgggggtccgccaaacttcgctggttcgtcgagagaaacatggtgaccccggaaggaaaagttgtggacctgggctgcggcagagggggatggagctactattgtggcgggctcaagaatgtccgggaggtgaagggactgaccaaaggcgggcctggacacgaggaacccatccccatgtctacatacggctggaacctggtgcgcctccagagcggcgttgatgtctttttcattcctcccgaaaagtgcgacacccttctgtgtgatatcggggagtcctctcctaatccgacagtggaggcgggacggacgctgagagtgctcaacctggtcgaaaattggcttaacaataacacccagttctgcatcaaagttctgaatccctacatgcctagcgtgattgagaagatggaagccctccaacgcaaatatggcggggctctggtgcggaaccccctgtccagaaatagcacacatgagatgtactgggtctccaacgcctctggaaatatcgtgagctccgttaacatgatttctcgcatgctcatcaaccggtttaccatgagacacaagaaggctacatatgaacctgacgtggaccttggcagcgggacccgcaatattggaatcgagtccgagattcccaacctggatatcatcggcaaacggattgaaaagatcaaagaggaacatgagacgtcttggcactacgaccaggatcacccgtataagacctgggcctaccatggcagctatgaaacaaaacagaccgggtccgcgagctctatggtcaatggagtggttagactgctcacaaagccttgggacgtgctgcccaccgtcacacagatggccatgaccgatacgacacctttcggccaacagcgcgtgtttaaggagaaagtggacacccggacccaggagcccaaggaagggaccaagaaacttatgaaaattacggctgagtggctgtggaaggaactcggcaagaagaagacccctagaatgtgtacacgcgaggagttcaccagaaaagtccggtccaacgccgctctgggcgccatctttacagatgaaaataagtggaaaagcgctcgcgaggccgttgaagactctagattctgggagctggtggataaggaacggaacctccacctggaggggaaatgcgagacctgtgtgtacaatatgatgggaaagagagaaaagaaacttggcgagtttggcaaggcgaaagggtcccgggccatttggtacatgtggctgggagctcgcttcctcgaatttgaggccctgggcttccttaacgaagaccattggtttagcagagaaaattctctgtccggggtcgagggagaaggcctccacaagctggggtatatcctgcgggatgtgagcaaaaaggagggcggagctatgtacgccgacgacacagccggctgggatacccgcatcacgctcgaagacctgaagaacgaggaaattgttaccaatcacatggagggggagcataagaaacttgcggaagctatcttcaaactgacatatcagaacaaagtggtcagagtgcaacggcccaccccgcgcggaacagttatggatattatctccagacgggaccagcgcggcagcggacaggtgggaacctacggcctcaatacgtttacaaacatggaggcccaactgattagacagatggaaggggagggcgtcttcaaaaatatccagcaccttaccgtgacagaggaagccgctgttcagaactggctggcccgggtgggacgcgagagactctctcggatggctatcagcggcgatgactgcgtcgtgaagcctctggatgaccgcttcgccaacgcgctgaccgccctcaatgatatggggaagattagaaaagacatccaacagtgggaaccctccaagggatggaacgattggacgcaggtccccttttgctctcatcacttccatgagctgattatgaaagacggccgggtgcttgttgtgccttgtagaaatcaggatgaactgatcgggcgcgctcggattagccaaggagccggctggtccctcagagagaccgcttgcctggggaagtcttatgcccagatgtggagccttatgtactttcaccgccgggacctgagactcgcggccaacgctatctgttccgccgtcccgtctcactgggtgcccacaagccgcaccacatggtccattcatgctaaacacgagtggatgaccacagaagacatgctgaccgtgtggaatcgggtttggatcagagagaacccttggatggaagataagacgcccgtggagagctgggaagagatcccttatctgggcaagcgcgaggaccagtggtgcggatctctcattggcctgacatcccgggccacctgggctaaaaatatccaggccgcgattaaccaagtcagaagccttatcgggaatgaagagtacaccgattacatgccctctatgaagcgcttccggagagaagaggaagaggccggagtgctgtggtga

SEQ ID NO: 19685 - RNA, 9876 nt, synthetic construct
  misc_feature 1..9876: note = derived and/or modified CDS sequence (opt5) from DENV-2__GQ868638__SS-prME
  source 1..9876: mol_type = other RNA
agcgccggaatgatcattatgctgatccccaccgtgatggctttccacctcaccacgagaaacggggagcctcatatgattgtcggaatccaggaaaagggcaagagcctgctttttaagaccgaggacggggttaatatgtgcacactgatggccatggatctcggagaactgtgtgaggacaccattacatacaaatgcccgcttctgcggcaaaacgaacccgaggatatcgactgttggtgcaattctaccagcacatgggtgacctatggcacgtgtaccacaaccggggagcacagaagagaaaagcggtccgtggcgctcgtccctcatgtgggaatgggcctggagacacgcaccgaaacgtggatgtctagcgagggcgcttggaaacacgcccagagaatcgagacatggattctgcggcatcccgggttcaccatcatggccgctattctcgcctacacaatcggaaccacccactttcagcgcgctctgattttcatccttctgacagccgttgcgccttccatgacgatgagatgcattggcatctctaaccgggattttgtggaaggggtcagcggaggctcctgggtggacatcgttctcgagcacgggagctgtgtgaccacaatggccaagaataagcccaccctggatttcgaacttattaaaacagaggctaagcagcctgccaccctgcgcaaatattgcatcgaagctaagctcacgaacacaaccaccgagtctagatgtccgacacaaggagagccctccctgaaagaagaacaagacaagcggtttgtctgcaagcatagcatggtggatcgcggctggggcaatgggtgtggactgttcggcaaagggggaattgtgacctgcgccatgtttacatgcaagaaaaacatggaaggcaagatcgtccagcctgagaatctcgaatacacgattgttgtgacaccccactctggggaggagcatgcggtgggaaacgacacaggcaaacacggcaaggaaatcaaagtcacccctcagtccagcatcacagaggccgaactgaccgggtatggaacggtgaccatggagtgttctcccagaacaggccttgatttcaatgaaatggttctgctccaaatggagaacaaggcttggctggtgcaccggcagtggtttcttgacctgccgctcccttggctgcccggggccgataagcagggatccaattggattcagaaagagaccctggtcacattcaagaaccctcatgctaaaaagcaagacgtggttgtgctcggcagccaggaaggggccatgcacaccgccctgacgggcgctacagagatccagatgtcctctggaaatcttctgtttaccggccatctcaaatgccgcctgagaatggacaaacttcaactgaaggggatgagctactccatgtgtacaggaaaattcaaggtcgtgaaagaaattgcggagacccagcacggcaccatcgtcattcggctccagtatgagggggatggaagcccctgcaagatccccttcgaaatcatggacctggagaaaagatacgtgctgggccgcctcattacagttaaccctatcgtgacggaaaaggattctccggtcaacattgaggccgaacccccttttggggactcctacatcattatcggcgtggagcccggacagctgaaacttaattggttcaaaaagggcagctctattgggcaaatgtttgagaccacaatgcggggagctaaaagaatggccatcctgggcgataccgcctgggacttcgggagcctcggaggcgtttttacatccgtggggaaggctctgcatcagatcttcggcgccatttatggagcggctttttctggcgtcagctggaccatgaaaatcctgattggggtgatcattacgtggatcggaatgaactcccgcagcacatctctttccgtgagcctcgttctggtcggcatcgtgaccctgtacctcggggtgatggtccaggccgattctggatgtgtggtttcctggaagaataaggaactgaaatgcggcagcgggattttcatcaccgacaacgtgcacacatggaccgagcagtataagtttcaacctgaatccccctctaaacttgccagcgctattcagaaggcccaggaggaaggcatctgtggcattcggtccgtcacaagactggagaatctcatgtggaaacagatcacgccggagctgaaccacatcctggctgaaaatgaggtgaaacttaccattatgacaggcgatatcaaagggattatgcaagccggaaagcgctctctccggcctcagcccaccgaactgaagtacagctggaaaacatggggcaaggcgaaaatgctgtccaccgagagccataaccagacgttcctcatcgacgggcctgaaaccgccgagtgccccaatacaaacagagcttggaactctctggaggttgaagattatggatttggcgtgttcaccacaaacatttggcttaagctgaaagagaagcaggacgccttttgtgactccaagctcatgagcgctgccatcaaagataatcgcgcggtccacgccgacatgggctactggatcgaatctgctctgaacgatacctggaagattgagaaagcctccttcatcgaggtgaagaattgccattggcctaaaagccacacactgtggtctaacggggttcttgaaagcgagatgattatccccaagaacctcgctggaccggtgtcccaacacaattatcggcctggctaccatacccagacggccgggccctggcacctgggaaagctggaaatggacttcgatttttgtgacggcacaaccgtcattgtgaccgaggattgcgggaacagaggacccagcctccgcacaaccacggcctctggcaaactgatcacagaatggtgctgtcggtcctgcacccttcctccgctgagataccggggcgaggacgggtgttggtatggaatggagattcgccccctcaaggaaaaagaggaaaatctggtgaacagcctggtcacagctggccatgggcaggttgataatttctcccttggagtgctcggcatggcgctgtttctggaggaaatgctcagaacccgggtggggacaaagcacgccatcctgcttgtcgctgtgtctttcgttaccctgatcacgggaaacatgagctttaaagacctcggcagagtggtcgtgatggttggcgccaccatgacagatgacattgggatgggagtgacctacctggccctgcttgctgccttcaaggtccgccctacatttgcggctggcctgctcctgcggaagctcacctccaaagagctgatgatgacgacaatcgggattgtgcttctgtctcaaagcaccatccccgagacaattctcgaactgaccgatgccctggcccttggaatgatggttctgaagatcgtgagagacatggagaaatatcagctcgctgtcaccatcatggccattctgtgcgtgcctaatgcggtgatcctccagaacgcttggaaggtctcctgtacaattctggccgttgtgtctgtgagcccccttctgctcacgtccagccagcagaagaccgactggatccctctggccctgacaattaagggccttaatcccaccgctatcttcctgacaaccctctctcgcacgaacaaaaagagatcctggccgctgaatgaagccatcatggctgtcgggatggtgagcattctcgcctcttccctgcttaagaacgatatccctatgacaggacccctggttgcgggcggcctgctcaccgtgtgctacgtcctgaccgggcggagcgccgaccttgagctggaacgcgctacagatgtgaaatgggaggaccaggccgagatttctggatccagccctatcctctccattaccatcagcgaagatggctctatgagcattaagaatgaggaagaggagcagacactgacgatcctcatcagaaccgggctgcttgttatttccggactgtttcccgtgtctatcccgattacagctgccgcctggtatctgtgggaagtcaaaaagcagcgggctggcgtgctctgggacgtcccttctccccctcccatggggaaagcggagctggaagatggagcctaccgcatcaagcaaaagggcattcttggctattcccagatcggggctggagtgtacaaagagggcaccttccatacaatgtggcacgttaccagaggggccgtgctgatgcacaagggaaaacggatcgaaccctcctgggccgacgtcaagaaagatctcattagctacggcgggggatggaagctggagggcgagtggaaggaaggcgaggaagtgcaggttctcgctctggagcctgggaaaaacccgcgcgccgtgcagacgaagcccggactttttaaaaccaatacaggcaccatcggggcggtctccctggacttctctcctggaacaagcggctcccccattatcgataagaaagggaaggtggtgggactgtatggcaacggcgttgtcaccagaagcggggcttacgtgtctgccattgcccaaacagaaaagtccatcgaggacaaccctgagatcgaagatgacatttttcggaaacgcagactcacgatcatggacctgcatcccggagctggcaagaccaaacggtatcttcctgccattgtgagagaggcgatcaagcgcgggctgcggacactcattctggctccgaccagagtcgtggccgccgaaatggaggaagctctccgcggactgcccatccggtaccagacccctgccattagagctgagcacacaggccgcgagatcgttgatcttatgtgtcatgccacgttcaccatgcggctgctgagccccgtgagagtccctaattataacctcatcattatggacgaagcgcacttcacagatcccgcctctatcgctgcccgcgggtacatttccacccgggtggagatgggcgaagctgccggaatctttatgacagccaccccgcctggcagcagagaccccttcccccagtccaatgctcctattatcgatgaggagcgggaaatccccgagcgctcttggaacagcgggcatgaatgggttacggactttaaaggaaagacagtgtggttcgtcccttccattaaggcgggcaatgatatcgccgcttgcctgcgcaagaatgggaagaaagtgattcaacttagccggaagacctttgactctgagtatgttaaaacccgcacaaatgattgggacttcgtggtcaccacagatatctccgaaatgggagccaactttaaggccgacagagtgattgacccgcggagatgtatgaaacccgtgatcctgaccgatggcgaggagcgcgtcatcctcgctgggcctatgcccgttacgcacagctctgccgcgcagcggagaggccgcattggacggaatcctaagaacgaaaatgaccagtacatctacatgggcgagcccctggaaaacgatgaggactgcgctcactggaaggaagccaaaatgctgctcgataatattaacacaccggaggggatcattcctagcatgttcgagcccgaaagagagaaggtggacgccatcgatggagaatatcgccttcggggcgaggctagaaaaacctttgtggacctgatgcgcagaggggatctgcctgtctggctcgcctacaaggtggcggccgaaggaattaattatgctgaccggcgctggtgtttcgatggcatcaaaaacaaccagatcctggaggagaatgttgaagtggagatttggacaaaggaaggggagagaaagaaacttaagccccggtggctggacgcccgcatctactccgatcctctcgctctgaaagagtttaaggagttcgccgctggcagaaaatctctgaccctcaaccttattacggagatgggacggctgcccaccttcatgacacaaaagaccagagacgccctggacaatctcgcggtcctgcatacagccgaagctggcgggcgcgcctataaccacgctcttagcgagctgccggaaaccctcgagacactgctgctccttaccctgctggccacggtgacaggaggcatctttctcttcctgatgtccgggcggggaattggcaagatgacccttggcatgtgctgcatcatcaccgcctctattctgctctggtacgctcagatccagcctcattggattgcggccagcatcattctggagtttttcctgatcgttctccttatccccgaacccgagaaacagagaacacctcaagataatcagctgacctatgtggtcattgctatcctgacagtggtcgccgccacgatggctaacgaaatggggtttctcgagaagaccaaaaaggacctgggacttggctccattgccacacagcagccggaaagcaatatcctggatattgacctccgccccgcgtctgcctggaccctgtacgctgtggccacaaccttcgttacgcctatgctgcggcactccatcgagaacagctccgtgaatgtgtctctcaccgctattgccaaccaagcgacagtccttatggggctgggaaaaggctggcccctgagcaagatggatatcggggttcctctcctggccatcggatgttactcccaggtgaatcccattacccttacagctgccctgctcctgctggtggctcactatgccatcattggccctggcctccaggctaaggccaccagagaggcgcagaaacgggccgctgccgggatcatgaagaacccgacggtcgacggaattacagtgatcgatcttgaccccatcccttacgatcccaaatttgaaaagcaactgggccaggttatgctgctcattctgtgcgtgacccaggtccttatgatgcgcacaacctgggctctgtgtgaggccctcaccctggccacagggcctatctctacgctgtgggaaggaaatcccggcagattctggaacaccacaattgcggtgagcatggctaatatctttcgggggtcctatctcgccggagctggccttctgttcagcattatgaaaaacaccacaaatacccgcagaggcacggggaacatcggagagacactgggcgaaaagtggaaatctcggctcaacgccctggggaagtccgagtttcaaacctacaagaaaagcggaatccaggaggtcgaccgcacccttgccaaggaaggcattaaaagaggggagacagatcatcacgctgtgtctcggggatccgccaagctgcgctggttcgttgaaagaaatatggtgaccccggagggcaaagtcgtggacctcggctgcgggcggggaggctggagctattactgtgggggactgaagaacgttagagaggtgaagggcctgacaaaagggggacctggccatgaggaacccatccccatgtctacgtatggctggaatctcgtccgccttcagagcggggtggatgtgtttttcattcctcccgaaaagtgcgacaccctgctgtgtgacatcggagagtcctctcctaacccgacagttgaagcgggccggaccctcagagtcctgaatcttgtggagaactggctgaataacaatacacagttctgcattaaagtgctcaacccctacatgcctagcgtcatcgagaagatggaagccctgcaacgcaaatacgggggagctctggttcggaatcccctctccagaaacagcacccacgagatgtattgggtgtccaatgcctctggcaacatcgtgagctccgtcaatatgatttctcgcatgcttatcaaccggtttacgatgagacataagaaggctacctacgaacctgatgtggacctggggagcggaacacgcaacattggcatcgagtccgaaattcccaatctggatatcattggcaaacggatcgagaagatcaaacaggagcacgaaacctcttggcactatgaccaggatcatccgtacaagacatgggcctatcacgggagctacgagaccaaacagacaggatccgcgagctctatggttaacggcgtggtcagactcctgaccaagccttgggacgtgcttcccacggttacacaaatggccatgaccgataccacacctttcgggcagcagcgcgtgtttaaggaaaaagtcgacacgcgggctcaggagcccaaggaaggaaccaaaaagctgatgaaaattacagccgagtggctctggaaggagctgggcaaaaagaagacccctagaatgtgtacacgcgaagagttcaccagaaaagtgcggtccaatgctgccctgggggctatctttacagatgaaaacaagtggaaaagcgcccgcgaggcggtggaggactctagattctgggaactcgtcgataaggagcggaatctgcatcttgaaggaaaatgcgagacctgtgtttataacatgatgggcaagagagaaaagaaactgggcgagtttgggaaggccaaaggatcccgggctatttggtacatgtggctcggcgcccgcttcctggagtttgaagctcttgggttcctgaatgaggaccactggtttagcagagaaaactctctctccggagtggagggcgaagggctgcacaagctgggctacatcctccgggacgtgagcaaaaaggagggaggcgccatgtatgccgatgacacggcggggtgggatacccgcattacactggaggaccttaagaatgaagagatggtcaccaaccatatggaaggagagcacaaaaagctggctgaagccatcttcaaactcacataccaaaataaggtggttagagtgcagcggcccaccccgcgcggcacggtcatggatatcatttccagacgggaccagcgcgggagcggacaagtgggcacatatgggctgaacacctttacaaatatggaggcccagcttatcagacagatggagggcgaaggagttttccggaacattcagcatctgaccgctacggaggaagtggccgtccaaaattggctcgctcgcgtgggcagagagcggctgtctcgcatggccatcagcggggatgactgcgttgtgaaacctctggatgacagattcgcgaacgccctcaccgctctgaacgatatgggaaagattcggaaggacatccagcagtgggagccctccaaaggctggaatgattggacacaggtccccttttgctctcaccatttccacgaacttatcatgaaggacgggagagtgctggtcgtgccttgtcgcaaccaagacgagctcattggacgggccagaatcagccagggcgctgggtggtccctgcgcgaaaccgcctgccttggcaaatcttacgcgcagatgtggagcctgatgtattttcaccggagagatctccgcctggccgctaatgccatttgttccgctgttccgtctcattgggtgcccacaagccggaccacatggtccatccacgccaagcatgagtggatgaccacggaagacatgctgacagtctggaacagagtgtggattcgcgagaatccttggatggaggataaaacccccgtggaaagctgggaggaaatcccttacctcggaaagcgggaggaccagtggtgcggctctctgattgggcttacctccagagctacatgggccaagaacatccaagcggccatcaatcaggttcgcagcctgattggaaacgaagagtataccgattacatgccctctatgaaacggttcagacgggaggaagaggaagctggcgtgctctggtga

SEQ ID NO: 19686 - RNA, 9876 nt, synthetic construct
  misc_feature 1..9876: note = derived and/or modified CDS sequence (opt5) from DENV-2__GU131927__SS-prME
  source 1..9876: mol_type = other RNA
tccgctggaatgatcattatgctgatccccaccgtgatggctttccacctgacaacgagaaatggggaacctcatatgattgtcggaatccaggaaaagggcaaatccctgctttttaagaccgaggacggggttaatatgtgcacactgatggccatggatctcggagaactgtgtgaggacaccattacatacaaatgcccgcttctgcggcaaaacgaacccgaggatatcgactgttggtgcaattctaccagcacatgggtgacctatggcacgtgtaccacaaccggggagcaccgcagagaaaagcggtccgtggcgctcgtccctcatgtgggaatgggcctggagacacgcaccgaaacgtggatgtcttccgagggcgcttggaaacacgcccagagaatcgagacatggattctgcggcatcccgggttcaccatcatggccgctattctcgcctacacaatcggaaccacccactttcagcgcgctctgattttcatccttctgacagccgttgcgccttccatgacgatgagatgcattggcatctctaaccgggattttgtggaaggggtcagcggaggctcctgggtggacatcgttctcgagcacgggagctgtgtgaccacaatggcccgcaataagcccaccctggatttcgaacttattaagacagaggctaaacagcctgccaccctgagaaagtattgcatcgaagctaaactcacgaacacaaccaccgagtctcggtgtccgacacaaggagagccctccctgaaggaagaacaagacaaacgctttgtctgcaagcatagcatggtggatagaggctggggcaatgggtgtggactgttcggcaaagggggaattgtgacctgcgccatgtttacatgcaaaaagaacatggaaggcaaaatcgtccagcctgagaatctcgaatacacgattgttgtgacaccccactctggggaggagcatgcggtgggaaacgacacaggcaagcacggcaaagaaatcaaggtcacccctcagtccagcatcacagaggccgaactgaccgggtatggaacggtgaccatggagtgttctccccggacaggccttgatttcaatgaaatggttctgctccaaatggagaacaaggcttggctggtgcaccgccagtggtttcttgacctgccgctcccttggctgcccggggccgataagcaggagtccaattggattcagaaggaaaccctggtcacattcaaaaaccctcatgctaagaaacaagacgtggttgtgctcggaagccaggagggcgccatgcacaccgccctgacgggggctacagaaatccagatgtcctctggcaatcttctgtttaccggacatctcaagtgcagactgcggatggacaaacttcaactgaagggcatgagctactccatgtgtacagggaagttcaaagtcgtgaaggagattgcggagacccagcacggaaccatcgtcattagagtgcagtatgaaggcgatgggagcccctgcaaaatccccttcgagatcatggacctcgaaaagcgctacgttctgggacggctgattacagtgaaccctatcgtcacggagaaagattctccggtgaacattgaagccgagcccccttttggcgactcctacatcattatcggggttgagcccggccagctcaagctgaattggttcaagaaaggaagctctattggccaaatgtttgaaaccacaatgagaggggctaagcgcatggccatccttggagataccgcctgggacttcggcagcctcgggggagtgtttacatccgtcggcaaagctctccatcaggtgttcggggccatctatggcgcggctttttctggagtgagctggaccatgaagattctgatcggcgttattatcacgtggattgggatgaactcccggagcacatctctgtccgtcagccttgtgctcgtgggaatcgtcaccctgtacctgggcgtgatggttcaggccgattctgggtgtgtggtctcctggaaaaataaggagctcaagtgcggaagcggcatcttcattaccgacaacgtgcacacatggaccgaacagtataaatttcaacctgagtccccctctaagctggccagcgctatccagaaagcccaggaagaggggatttgtggcatcagatccgttacacgccttgagaatctgatgtggaagcagattacgccggaactcaaccacatcctggctgagaatgaagtgaaactgaccatcatgacaggagatattaagggcatcatgcaagccgggcggagatctcttcgccctcagcccaccgagctcaaatacagctggaagacatggggaaaggcgaaaatgctgtccaccgaaagctataaccagacgttcctgattgacggccctgagaccacagagtgccccaatgccaaccgggcttggaactctctcgaagtcgaggattacgggtttggagtgttcaccacaaacatctggctgaaacttaaagaaaagcaggacgccttttgtgactccaaactgatgagcgctgccattaaggataatagagcggttcatgccgacatgggctattggatcgagtctgctctcaacgatacctggaagatcgagaaagcctccttcattgaagtgaagaattgccactggcctaaaagccatacactgtggtctaacggcgtcctggagagcgaaatgatcattcccaagtcccttgctgggccggtgagccaacacaactaccgccctggataccacacccagatcgccggcccctggcatctcgggaaactggagatggacttcgatttttgtgacggaacgacagtgattgtcaccgaagattgcggcaatcgggggccctctctgagaaccacaaccgcctccggaaagctcatcacggagtggtgctgtcggagctgcacactgcctccgcttcgctatagaggcgaggacggctgttggtacgggatggaaattcggcccctgaaggagaaagaagagaacctcgttaattccctggtgaccgctggacacggccaggtggataacttctctctgggggtccttggaatggcgctctttctggaagagatgctgagaacacgcgtgggcaccaagcatgccatcctcctggttgctgtgagcttcgtcacacttatcaccgggaatatgtcctttaaagacctgggacgggtggttgtgatggtcggcgccacgatggccgatgacattggcatgggggtgacctatctcgctctgctggccgcgttcaaggttagacctacatttgctgccggacttctgctccgcaaactgacctctaaggagctcatgatgacaaccatcggcattgtgctgcttagccaatccacgatccccgaaacaattctggagctcaccgatgccctggctctggggatgatggtccttaagatcgtgagaaacatggaaaaataccagctggccgtgacaatcatggcgattctctgcgtccctaatgctgttatcctgcagaacgcctggaaggtgtcttgtaccattctcgccgtggtcagcgtgagccccctgcttctgaccagctctcagcagaagacggactggatccctctcgctctgacgattaagggactgaatcccaccgccatcttccttacaaccctgtcccggacaaacaaaaagcgcagctggccgctcaatgaggctatcatggccgttggcatggtgtctattctggcgtccagcctcctgaaaaacgacatccctatgaccgggccccttgtcgccggaggcctgctgacggtgtgctatgttctcacaggcagatctgctgatctggaacttgagcgggccaccgacgtgaagtgggaggaacaggctgagatttccgggagctcccctatcctgagcattaccatctctgaagatggaagcatgtccattaagaatgaggaggaggaacagacactcaccatcctgatccgcacaggcctcctggtcatttctgggctttttcccatcagcattccgatcacggccgccgcttggtacctgtgggaagtgaaaaagcagagagcgggagtcctgtgggacgtgccttctccccctcccatgggcaaagccgagctcgaagatggggcttatcggattaagcaaaaaggaatcctgggctacagccagatcggcgccggggtttacaaggagggaaccttccacacaatgtggcatgtgacccgcggcgccgtccttatgcacaaggggaaaagaattgagcccagctgggctgacgtgaagaaagatctgatctcctatggaggcgggtggaagctcgaaggagagtggaaagaaggcgaggaagttcaggtgctggccctcgagcctggcaagaacccgcgggcggtccagacaaagcccgggctgtttaaaaccaatacgggaaccattggcgctgtgtctcttgacttcagccctgggacatccggaagccccatcattgataagaaaggcaaggtggttgggctgtacggaaacggcgtcgtgacccgctctggcgcctatgtgtccgccatcgctcaaacagagaaaagcaccgaagacaaccctgagatcgaagatgacatttttagaaagcggagactgacaatcatggatctccaccccggggccggaaagacgaaacgctacctgcctgcgattgtccgggaggctatcaagagaggccttcgcaccctgattctcgccccgacacgggtggttgccgctgaaatggaggaggccctgagagggctccccatccgctatcagacccctgctattcgggccgaacataccggaagagagatcgtggacctgatgtgtcacgcgacattcacgatgcgccttctgtctcccgtccgggtgcctaattacaacctgatcattatggacgaagcccatttcaccgatcccgcttccatcgccgctagaggctatattagcacacgggttgagatgggggaggccgccggcatctttatgaccgctacaccgcctggatcccgcgaccccttcccccagtctaatgcgcctattatcgatgaagagagagaaatccccgagcggagctggaactccggccacgaatgggtgaccgactttaaagggaagacggtctggttcgtgcctagcattaaagccggaaatgatatcgctgcctgcctccgcaagaacggcaagaaagttattcaactgtctagaaagacatttgactccgagtacgtgaaaacccggaccaatgattgggacttcgtcgtgacaaccgatatcagcgagatgggggccaactttaaggctgaaagagtgattgacccgcgccggtgtatgaaacccgtcatccttacagatggagaggaaagagttatcctggccggccctatgcccgtgacccattctagcgcggctcagcgccgggggagaattggccgcaatcctaagaacgagaatgaccagtacatctatatgggagaacccctcgagaacgacgaggattgcgcccactggaaagaagccaagatgctgctggacaatattaacacgccggagggcatcattccttccatgttcgaacccgagcgggaaaaggtggatgctatcgacggggagtacagactccgcggagaggccagaaaaacatttgtcgatcttatgcggcgcggcgacctgcctgtgtggctggcgtataaggttgccgctgaagggattaattacgccgatagacggtggtgtttcgacggaatcaaaaacaaccagatcctcgaggaaaatgtggaggtcgagatttggaccaaggaaggcgagcgcaaaaagctgaagcccagatggcttgatgctcggatctattctgaccctctggccctcaaagaatttaaggagttcgctgccgggagaaaaagcctgacactgaacctcattaccgaaatgggccgccttcccacgttcatgacccaaaagacacgggatgcgctggacaatctggccgtgctccacaccgctgaggccggaggcagagcttacaaccatgccctgtccgagcttccggaaacactggagaccctcctgctgctcacacttctggccaccgttacagggggaatctttctgttcctcatgtctggccgcgggattggaaaaatgacactgggcatgtgctgcatcatcaccgctagcattcttctgtggtatgcgcagatccagcctcactggattgccgcttccatcattctcgaatttttcctgatcgtgctgctcatccccgagcccgaaaagcagcggacccctcaagataatcagcttacatacgtcgtgattgccatcctgaccgtcgtggccgctacaatggccaacgagatgggctttctggagaagacgaaaaaggacctcgggctgggaagcattgcgacccagcagccggaatctaatatccttgacattgatctgagacccgcctccgcttggacactctacgccgttgctaccacattcatcacccctatgctgcggcatagcattgagaactcctctgtgaatacgagcctgaccgccatcgcgaaccaagccacagtgctcatgggccttgggaaaggatggcccctgtccaagatggacatcggcgtccctctgctcgctattgggtgttattctcaggttaatcccatcaccctgacagccgcccttctgctcctggtggcccactacgctattatcggacctggcctgcaggccaaagcgacccgcgaagcccagaagagagctgccgctggcattatgaagaacccgacggtggatgggatcacagtcatcgacctcgatcccattccttatgaccccaaatttgagaagcaacttggacaggtgatgctgctgatcctctgcgttacccaggtgctgatgatgcggacaacctgggccctttgtgaagccctgaccctcgcgacaggccctattagcacgctgtgggaggggaatcccggacgcttctggaacaccacaatcgctgtctccatggccaatatttttagaggcagctacctggctggggccggactccttttctctatcatgaaaaacaccacaaatacccggcgcggcacgggcaacatcggggagacactgggagaaaagtggaaatccagactgaacgccctcggcaagagcgagtttcaaatttataaaaagtctgggatccaggaagtggatcggaccctggctaaggagggaattaaacgcggcgagaccgaccaccatgccgtctccagagggagcgcgaaacttcggtggttcgtggaaagaaatatggttacaccggagggaaaagtggtcgatctgggctgcggccgcgggggatggtcttactattgtggcgggctcaagaacgtgaaagaagttaagggactgaccaagggcgggcctggacacgaggaacccatccccatgagcacatacggctggaatctggtgcggctccagtccggcgtcgacgtgtttttcattcctcccgagaaatgcgatacgcttctgtgtgacatcggggagtctagccctaacccgaccgtggaagccggaagaacactgcgcgttctcaatctggtcgagaactggcttaataacaatacccagttctgcatcaaggtgctgaacccctacatgccttccgtgattgagaagatggaggctctccaacggaagtatggcggggccctggtcagaaatcccctgagccgcaactccacacatgaaatgtactgggtttctaatgctagcggaaacatcgtgtcctctgtgaatatgattagccggatgctcatcaacagatttaccatgcgccacaaaaaggccacgtatgagcctgatgtcgaccttggctccgggacccggaacattggaatcgagtctgaagtgcccaatctggacattatcggcaagagaatcgagaaaattaagcaggaacatgagacaagctggcactacgatcaggaccacccgtataaaacctgggcgtaccatggctcctatgaaacaacccagacagggagcgcctcttccatggttaacggagtggtccgcctgctcaccaagccttgggatgtgctgcccacggttacacaaatggctatgaccgacaccacacctttcggccagcagcgggtgtttaaagagaaggtcgatacgagaacccaggagcccaaggaagggaccaagaaacttatgaaaatcaccgccgagtggctgtggaaggaactcggcaagaagaaaacacctcgcatgtgtaccagagaggagttcacacggaaggtgcgcagcaatgctgccctgggcgctatttttaccgacgaaaacaagtggaaatctgccagagaggcggtggaagattcccggttctgggagctggtcgacaaggaaagaaatctccacctggaggggaaatgcgagacgtgtgtttacaacatgatgggaaagcgggagaagaaacttggcgagtttggcaaagccaaagggagccgcgctatctggtacatgtggctgggagccagattcctcgaatttgaggctctgggcttccttaatgaagatcattggttttctcgggagaactccctgagcggggtggagggagaaggcctccacaagctggggtatattctgcgcgacgtgtccaaaaaggagggcggagccatgtacgccgatgacaccgcgggctgggacacaagaatcaccctcgaagatctgaaaaatgaggaaatggtcacaaaccacatgaagggggagcataagaaacttgctgaggccatcttcaagctgacctatcaaaataaagtggttcgggtgcagcgccccacgccgagaggaacagtcatggacattatcagccggcgcgatcagagaggctctgggcaagtgggaacctacggcctcaacacatttaccaatatggaagcccagctgattcggcagatggagggggaaggcgttttcaagaacatccagcaccttacggtgaccgaggaggtcgctgtgcaaaattggctggcccgcgttggaagagaacggctcagccgcatggctatttccggcgacgattgcgtggtcaaacctctggacgatagattcgccaacgcgctgacagccctcaacgacatggggaagatccggaaggatatccagcagtgggagccctctaaaggatggaatgactggacccaggtgcccttttgcagccatcacttccatgaactgattatgaaggatggcagagtccttgtggttccttgtcgcaaccaagacgagctgatcgggcgggctagaatttcccagggagccggctggtctctccgcgaaacagcttgcctggggaaaagctatgcccagatgtggtcccttatgtactttcaccggagagatctgcgcctcgcggccaatgctatctgttctgccgtgccgagccactgggtccccacctcccggacaacctggagcattcatgctaagcacgagtggatgacgacagaggacatgctgaccgtgtggaacagagtgtggatccgcgaaaatccttggatggaggacaaaacccccgttgaatcttgggaggaaattccttatctgggcaagcgggaggatcagtggtgcggatccctcatcggcctgacaagcagagccacctgggctaagaacatccaagccgcgattaatcaggtgcgctctcttatcgggaacgaggaatacacagactacatgccctccatgaaacggttcagacgggaggaagaggaagccggagtcctgtggtga

SEQ ID NO: 19687 - RNA, 9876 nt, synthetic construct
  misc_feature 1..9876: note = derived and/or modified CDS sequence (opt5) from DENV-2__GU131928__SS-prME
  source 1..9876: mol_type = other RNA
agcgccggcatgatcattatgctgatccccaccgtgatggctttccacctgacaacgcggaatggggagcctcatatgattgtcggaatccaggaaaagggcaagagcctgctttttaagaccgaggacggggttaatatgtgcacactgatggccatggatctcggagaactgtgtgaggacaccattacatacaaatgcccgcttctgcggcaaaacgaacccgaggatatcgactgttggtgcaattctaccagcacatgggtgacctatggcacgtgtaccacaaccggggagcaccgcagagaaaagcggtccgtggcgctcgtccctcatgtgggaatgggcctggagacacgcaccgaaacgtggatgtctagcgagggcgcttggaaacacgcccagagaatcgagacatggattctgcggcatcccgggttcaccatcatggccgctattctcgcctacacaatcggaaccacccactttcagcgcgttctgattttcatccttctgacagctgtggccccttccatgacgatgagatgcattggcatctctaaccgggattttgtcgaaggggtgagcggaggctcctgggttgacatcgtgctcgagcacgggagctgtgtcaccacaatggcgaagaataagcccaccctggatttcgaacttattaaaacagaggccaagcagcctgctaccctgcgcaaatattgcatcgaagccaagctcacgaacacaaccaccgagtctagatgtccgacacaaggagagccctccctgaaagaggaacaagacaagcggtttgtgtgcaagcatagcatggtggatcgcggctggggcaatgggtgtggactgttcggcaaagggggaattgtgacctgcgctatgtttacatgcaagaaaaacatggaaggcaagatcgttcagcctgagaatctcgaatacacgattgtggtgacaccccactctggggaggagcatgccgtcggaaacgacacaggcaaacacggcatggaaatcaaggtgacccctcagtccagcatcacagaggcggaactgaccgggtatggaacggttaccatggagtgttctcccagaacaggccttgatttcaatgaaatggtgctgctccaaatggagaacaaagcctggctggtccaccggcagtggtttcttgacctgccgctcccttggctgcccggggctgataagcaggagtccaattggattcagaaggaaaccctggtgacattcaaaaaccctcatgccaagaaacaagacgttgtggtcctcggaagccaggagggcgctatgcacaccgccctgacgggggccacagaaatccagatgtcctctggcaatcttctgtttaccggacatctcaagtgccgcctgagaatggacaaacttcaactgaagggcatgagctactccatgtgtacagggaagttcaaagtggtcaaggagattgctgagacccagcacggaaccatcgtgattcgggttcagtatgaaggcgatgggagcccctgcaaaatccccttcgagatcatggacctcgaaaagagatacgtgctgggacgcctgattacagtcaaccctatcgtgacggagaaagattctccggttaacattgaagcggagcccccttttggcgactcctacatcattatcggggtggagcccggccagctcaagctgaattggttcaagaaaggaagctctattggccaaatgtttgaaaccacaatgagaggggctaagagaatggctatccttggagataccgcctgggacttcggcagcctcgggggagtctttacatccatcggcaaagccctccatcaggtgttcggggctatttatggcgtggccttttctggagttagctggaccatgaagatcctgattggcgtcatcattacgtggatcgggatgaactcccgcagcacatctctgtccgtgagccttgtgctcgtcggaatcgtgaccctgtacctgggcgttatggtgcaggcggattctgggtgtgtcgtgtcctggaaaaataaggagctcaagtgcggaagcggcattttcatcaccgacaacgttcacacatggaccgaacagtataaatttcaacctgagtccccctctaagctggctagcgccattcagaaagcccaggaagaggggatctgtggcattcggtccgtgacaagacttgagaatctgatgtggaagcagatcacgccggaactcaaccacatcctggctgagaatgaagtcaaactgaccattatgacaggagatatcaagggcattatgcaagccgggaaacgctctcttcggcctcagcccaccgagctcaagtacagctggaagacatggggaaaagctaagatgctgtccaccgaaagctataaccagacgttcctgatcgacggccctgagaccgccgagtgccccaatacaaacagagcgtggaactctctcgaagtggaggattacgggtttggagttttcaccacaaacatttggctgaaacttaaggaaaaacaggacgccttttgtgactccaagctgatgagcgctgccatcaaggataatcgcgctgtgcatgccgacatgggctattggatcgagtctgcgctcaacgatacctggaaaattgagaaggcctccttcatcgaagtcaaaaattgccactggcctaagagccatacactgtggtctaacggcgtgctggagagcgaaatgattatccccaaaaaccttgctgggccggtgtcccaacacaattaccggcctggataccacacccagattgccggcccctggcatctcgggaagctggagatggacttcgatttttgtgacggaacgacagtcatcgttaccgaagattgcggcaacagagggcccagcctgcgcaccacaaccgcttctggaaagctcattacggagtggtgctgtcggtcctgcacactgcctccgcttagatatcggggcgaggacggctgttggtacgggatggaaatccgccccctgaaagagaaggaagagaatctcgtgaacagcctggtgaccgccggacacggccaggtcgataatttctccctgggggtgcttggaatggccctctttctggaagagatgctgagaacacgggttggcaccaaacatgctatcctcctggtggcggtctctttcgtgacacttattaccgggaacatgagctttaaggacctgggaagagttgtggtcatggtgggcgccacgatggctgatgacatcggcatgggggttacctatctcgccctgctggccgctttcaaagtgcgccctacatttgccgcgggacttctgctccggaagctgacctccaaggagctcatgatgacaaccattggcatcgtcctgctttctcaaagcacgattcccgaaacagtgctggagctcaccgatgctctggccctggggatgatggtgcttaaaatcgtcagaaatatggaaaagtaccagctggccgttacaatcatggctattctctgcgtgcctaacgccgtgatcctgcagaatgcgtggaaagtctcctgtaccattctcgctgtggtttctgtgagccccctgcttctgacctccagccagcaaaagacagactggatccctctcgccctgacgattaaaggactgaaccccaccgccatcttccttacaaccctgtctcgcacaaataagaaaagatcctggccgctcaacgaggctatcatggccgtcggcatggtgagcattctggcttcttccctcctgaagaatgacatccctatgaccgggccccttgttgccggaggcctgctgacggtgtgctatgtcctcacaggccggagcgcggatctggaacttgagcgcgccaccgacgtgaagtgggaggatcaggctgaaatttctgggtccagccctatcctgtccattaccatcagcgaggacggatctatgagcattaaaaacgaagaggaggaacagacactcaccatcctgatcagaacaggcctcctggtcatttccgggctttttcccatctctattccgatcacggccgctgcctggtacctgtgggaggtgaagaaacagcgggccggagttctgtgggatgtgccttctccccctcccatgggcaaggctgaactcgaggacggggcgtatcgcattaaacaaaagggaatcctgggctactcccagatcggcgccggggtctacaaggaaggaaccttccacacaatgtggcatgtgaccagaggcgctgttcttatgcacaaagggaagcggattgagccctcctgggccgatgtgaaaaaggacctgatcagctatggaggcgggtggaaactcgagggagaatggaaggagggcgaagaggtccaggtgctggccctcgaacctggcaagaatccgcgcgctgtgcagacaaaacccgggctgtttaagaccaacacgggaaccattggcgccgtttcccttgatttctctcctgggacaagcggatcccccatcattgacaaaaagggcaaagtcgtggggctgtacggaaacggcgtggtcaccagaagcggcgcgtatgtgtctgctatcgcccaaacagagaagtccatcgaggataatcctgaaattgaggacgatatctttcggaagcgcagactgaccattatggacctccaccccggggccggaaaaacaaagcggtacctgcctgctatcgttagagaagccattaaacgcggccttcggacgctgatcctcgcgccgaccagagtggtcgctgccgagatggaagaggccctgcgcgggctccccattcggtatcagacccctgctatcagagccgagcataccggacgcgaaatcgtggacctgatgtgtcacgctaccttcacaatgcggcttctgagccccgttagagtgcctaactacaatctgattatcatggatgaggcccatttcacggaccccgcgtctattgccgctcgcggctatatctccacccgggtcgaaatgggggaggccgctggcatttttatgacagccaccccgcctggaagcagagatcccttcccccagtccaacgcccctatcatcgacgaggaacgggagattcccgaacgctcttggaatagcggccacgagtgggtgacagattttaaggggaaaaccgtttggttcgtgccttccatcaaggctggaaacgacattgcggcctgcctcagaaagaatggcaaaaaggtcatccaactgagccggaaaacgtttgattctgaatacgtgaagacacgcaccaacgactgggatttcgtggtcaccacagacatttccgagatgggggctaattttaaagccgagagagttatcgatccgcggagatgtatgaagcccgtgatccttaccgacggagaggaacgcgtgattctggccggccctatgcccgtcacacatagctctgctgcccagcggagagggcgcatcggccggaaccctaaaaatgaaaacgaccagtacatttatatgggagagcccctcgaaaatgatgaggactgcgcgcactggaaggaggctaagatgctgctggataacatcaataccccggaaggcattatccctagcatgttcgagcccgaaagagagaaagtggacgccattgatggggaataccgcctccggggagaggccagaaagacgtttgttgaccttatgcgcagaggcgatctgcctgtgtggctggcttataaagtcgccgcggaggggatcaactacgccgaccggcgctggtgtttcgatggaatcaagaacaatcagattctcgaagagaacgtggaagttgagatctggacaaaagagggcgaaagaaagaagctgaaaccccggtggcttgacgctcgcatttattccgatcctctggccctcaaggagtttaaagagttcgctgccgggagaaagtctctgaccctgaatctcatcacagagatgggccggcttcccaccttcatgacgcagaagaccagagacgctctggataacctggccgtgctccacacagcggaagccggaggccgcgcttacaatcatgccctgagcgagcttccggagaccctggaaacactcctgctgctcacccttctggctacagtcaccgggggaatttttctgttcctcatgtccggccgggggatcggaaagatgacgctgggcatgtgctgcatcattacagcctctatccttctgtggtatgcccagattcagcctcactggatcgctgcgagcattatcctcgagtttttcctgatcgtgctgctcattcccgaacccgagaagcagagaacccctcaagacaaccagcttacctacgtcgtgatcgccattctgacagttgtggctgccaccatggccaatgaaatgggctttctggagaaaacaaagaaagacctcgggctgggatccatcgctacgcagcagccggagagcaacattcttgatatcgacctgcgccccgcctctgcgtggaccctctacgccgtggctacaaccttcgtcacacctatgctgcggcattccattgaaaatagctccgttaacgtgtctctgaccgccatcgctaatcaagccacggtgctcatgggccttgggaagggatggcccctgagcaaaatggatatcggcgtccctctgctcgcgattgggtgttattcccaggtgaaccccatcaccctgacagccgcccttctgctcctggttgcccactacgctattatcggacctggcctgcaggccaaggctaccagagaggcccagaagcgggcggccgctggcattatgaaaaatccgacagtggacgggatcaccgtcatcgatctcgaccccattccttatgatcccaagtttgaaaaacaacttggacaggtgatgctgctgatcctctgcgtcacgcaggtcctgatgatgcgcacaacctgggccctttgtgaggctctgacactcgccaccggccctatttctaccctgtgggaagggaaccccggaagattctggaatacaacgatcgccgttagcatggcgaacatttttcggggctcctacctggctggggccggactccttttcagcatcatgaagaataccacaaacacccgcagaggcacaggcaacatcggggagaccctgggagagaaatggaagtctcggctgaatgctctcggcaaatccgaatttcaaatttataaaaagagcgggatccaggaggtggaccgcacgctggccaaagaaggaattaagagaggcgagacagatcaccatgccgtctctcgggggtccgctaaacttcgctggttcgtggagagaaacatggttaccccggaaggaaaggtggtcgacctgggctgcggcagagggggatggagctactattgtggcgggctcaaaaatgtgcgggaggtgaagggactgaccaagggcgggcctggacacgaagaacccatccccatgtctacatacggctggaacctggttcgcctccagagcggcgtcgatgtgtttttcattcctcccgaaaaatgcgacacccttctgtgtgatatcggggagtcctctcctaatccgacagtggaggccggacggacgctgagagtcctcaacctggttgaaaattggcttaacaataacacccagttctgcatcaaggtgctgaatccctacatgcctagcgtgattgagaaaatggaagcgctccaacgcaagtatggcggggccctggtccggaaccccctgtccagaaatagcacacatgagatgtactgggtgtccaacgcttctggaaatatcgttagctccgtgaacatgatttctcgcatgctcatcaaccggtttaccatgagacacaaaaaggccacatatgaacctgacgtcgaccttggcagcgggacccgcaatattggaatcgagtccgagacgcccaacctggatattatcggcaagcggatcgagaagattaaggaggaacatgagacctcttggcactacgaccaggatcacccgtataaaacatgggcttaccatggcagctatgaaaccaagcagacagggtccgccagctctatggtgaatggagttgtgagactgctcaccaaaccttgggacgtcctgcccacagtgacccagatggcgatgacggatacaacccctttcggccaacagcgcgtgtttaaggagaaggtcgacacccggacacaggagcccaaagaagggacgaagaaacttatgaagatcaccgccgagtggctgtggaaagaactcggaaagaaaaagacacctagaatgtgtacccgcgaggagttcacaagaaaggttcggtccaacgctgccctgggcgctatttttaccgatgaaaataaatggaaaagcgcccgcgaggctgtggaagactctagattctgggagctggtggataaagaacggaacctccacctggaggggaagtgcgagacatgtgtctacaatatgatgggaaaaagagaaaagaaacttggcgagtttggcaaagccaaggggtcccgggcgatctggtacatgtggctgggagcccgcttcctcgaatttgaggctctgggcttccttaacgaagaccattggtttagcagagaaaattctctgtccggggtggagggagaaggcctccacaaactggggtatattctgcgggatgttagcaagaaagagggcggagccatgtacgctgacgacaccgccggctgggatacgcgcatcaccctcgaagacctgaagaacgaggaaatggtgacaaatcacatggagggggagcataagaaacttgccgaagcgatcttcaagctgacctatcagaacaaagtcgtgagagttcaacggcccacaccgcgcggaaccgtgatggatattatctccagacgggaccagcgcggcagcgggcaggtcggaacgtacggcctcaatacatttaccaacatggaggctcaactgattagacagatggaaggggagggcgtgttcaagaatatccagcaccttacagttaccgaggaagccgccgtgcagaactggctggctcgggtcggacgcgagagactctctcggatggccattagcggcgatgactgcgtggtcaaacctctggatgaccgcttcgctaacgccctgacggcgctcaatgatatggggaagatcagaaaggacatccaacagtgggaaccctccaaaggatggaacgattggacccaggtgcccttttgctctcatcacttccatgagctgattatgaaggacggccgggttcttgtggtcccttgtagaaatcaggatgaactgatcgggcgcgcccggattagccaaggagctggctggtccctcagagagacagcctgcctggggaaatcttatgctcagatgtggagccttatgtactttcaccgccgggacctgagactcgccgcgaacgccatctgttccgctgtgccgtctcactgggtgcccaccagccgcacaacctggtccattcatgccaagcacgagtggatgacaaccgaagacatgctgacggtttggaatcgggtgtggatcagagagaacccttggatggaagataaaacacccgtcgagagctgggaagagattccttatctgggcaagcgcgaggaccagtggtgcggatctctcatcggcctgacctcccgggctacctgggccaagaatatccaggctgccattaaccaagtgagaagccttatcgggaatgaagagtacacagattacatgccctctatgaaacgcttccggagagaagaggaagaggcgggagttctgtggtga

SEQ ID NO: 19688 - RNA, 9876 nt, synthetic construct
  misc_feature 1..9876: note = derived and/or modified CDS sequence (opt5) from DENV-2__GU131929__SS-prME
  source 1..9876: mol_type = other RNA
agcgccggcatgatcattatgctgatccccaccgtgatggctttccacctgacaacgcggaatggggaacctcatatgattgtcggaatccaggaaaagggcaaatccctgctttttaagaccgaagacggggttaatatgtgcacactgatggccatggatcttggagaactgtgtgaggacaccattacatacaaatgcccgcttctgcggcaaaacgaacccgaggatatcgactgttggtgcaattctaccagcacatgggtgacctatggcacgtgtaccacaaccggggagcaccgcagagaaaagcggtccgtggcgctcgtccctcatgtgggaatgggcctggagacacgcaccgaaacgtggatgtctagcgagggcgcttggaaacacgcccagcggatcgagacatggattctgcggcatcccgggttcaccatcatggccgctattctcgcctacacaatcggaaccacccactttcagcgcgttctgattttcatccttctgacagctgtggccccttccatgacgattagatgcatcggcatctctaaccgggattttgtcgaaggggtgagcggaggctcctgggttgacattgtgctcgagcacgggagctgtgtcaccacaatggcgaagaataagcccaccctggatttcgaacttatcaaaacagaggccaagcagcctgctaccctgcgcaaatattgcattgaagccaagctcacgaacacaaccaccgagtctagatgtccgacacaaggagagccctccctgaaagaagaacaagacaagcggtttgtgtgcaagcatagcatggtggatcgcggctggggcaatgggtgtggactgttcggcaaagggggaatcgtgacctgcgctatgtttacatgcaagaaaaacatggaaggcaagattgttcagcctgagaatctcgaatacacgatcgtggtgacaccccactctggggaggagcatgccgtcggaaacgacacaggcaaacacggcatggaaatcaaggtgacccctcagtccagcattacagaggcggaactgaccgggtatggaacggttaccatggagtgttctcccagaacaggccttgatttcaatgaaatggtgctgctccaaatggagaacaaagcctggctggtccaccggcagtggtttcttgacctgccgctcccttggctgcccggggctgataagcaggagtccaattggatccagaaggaaaccctggtgacattcaaaaaccctcatgccaagaaacaagacgttgtggtcctcggaagccaggagggcgctatgcacaccgccctgacgggggccacagaaattcagatgtcctctggcaatcttctgtttaccggacatctcaagtgccgcctgagaatggacaaacttcaactgaagggcatgagctactccatgtgtacagggaagttcaaagtggtcaaggagatcgctgagacccagcacggaaccattgtgatccgggttcagtatgaaggcgatgggagcccctgcaaaatccccttcgagattatggacctcgaaaagagatacgtgctgggacgcctgatcacagtcaaccctattgtgacggagaaagattctccggttaacatcgaagcggagcccccttttggcgactcctacattatcattggggtggagcccggccagctcaagctgaattggttcaagaaaggaagctctatcggccaaatgtttgaaaccacaatgagaggggctaagagaatggctatccttggagataccgcctgggacttcggcagcctcgggggagtctttacatccattggcaaagccctccatcaggtgttcggggctatctatggcgtggccttttctggagttagctggaccatgaagattctgatcggcgtcattatcacgtggatcgggatgaactcccgcagcacatctctgtccgtgagccttgtgctcgtcggaattgtgaccctgtacctgggcgttatggtgcaggcggattctgggtgtgtcgtgtcctggaaaaataaggagctcaagtgcggaagcggcatcttcattaccgacaacgttcacacatggaccgaacagtataaatttcaacctgagtccccctctaagctggctagcgccatccagaaagcccaggaagaggggatttgtggcatccggtccgtgacaagacttgagaatctgatgtggaagcagatcacgccggaactcaaccacattctggctgagaatgaagtcaaactgaccatcatgacaggagatattaagggcatcatgcaagccgggaaacgctctcttcggcctcagcccaccgagctcaagtacagctggaagacatggggaaaagctaagatgctgttcaccgaatcctataaccagacgtttctgattgacggccctgagaccgccgagtgccccaatacaaacagagcgtggaatagcctcgaagtggaggattacgggttcggagtttttaccacaaacatctggctgaaacttaaggaaaaacaggacgccttctgtgactctaagctgatgtccgctgccatcaaggataatcgcgctgtgcatgccgacatgggctattggattgagagcgcgctcaacgatacctggaaaatcgagaaggcctctttcattgaagtcaaaaattgccactggcctaagtcccatacactgtggagcaacggcgtgctggagtctgaaatgatcattcccaaaaaccttgctgggccggtgagccaacacaattaccggcctggataccacacccagatcgccggcccctggcatctcgggaagctggagatggactttgatttctgtgacggaacgacagtcattgttaccgaagattgcggcaacagagggccctccctgcgcaccacaaccgctagcggaaagctcatcacggagtggtgctgtcggtcttgcacactgcctccgcttagatatcggggcgaggacggctgttggtacgggatggaaatccgccccctgaaagagaaggaagagaatctcgtgaactccctggtgaccgccggacacggccaggtcgataattttagcctgggggtgcttggaatggccctcttcctggaagagatgctgagaacacgggttggcaccaaacatgctattctcctggtggcggtctcctttgtgacacttatcaccgggaacatgtctttcaaggacctgggaagagttgtggtcatggtgggcgccacgatggctgatgacattggcatgggggttacctatctcgccctgctggccgcttttaaagtgcgccctacattcgccgcgggacttctgctccggaagctgaccagcaaggagctcatgatgacaaccatcggcattgtcctgctttcccaatctacgatccccgaaacagtgctggagctcaccgatgctctggccctggggatgatggtgcttaaaatcgtcagaaatatggaaaagtaccagctggccgttacaattatggctatcctctgcgtgcctaacgccgtgattctgcagaatgcgtggaaagtcagctgtaccatcctcgctgtggtttccgtgtctcccctgcttctgaccagctcccagcaaaagacagactggattcctctcgccctgacgatcaaaggactgaaccccaccgccatctttcttacaaccctgagccgcacaaataagaaaagatcttggccgctcaacgaggctattatggccgtcggcatggtgtccatcctggctagctctctcctgaagaatgacattcctatgaccgggccccttgttgccggaggcctgctgacggtgtgctatgtcctcacaggccggtccgcggatctggaacttgagcgcgccaccgacgtgaagtgggaggatcaggctgaaatcagcgggtcttcccctattctgagcatcaccatttccgaggacggaagcatgtctatcaaaaacgaagaggaggaacagacactcaccatcctgattagaacaggcctcctggtcatcagcgggcttttccccatttccatcccgattacggccgctgcctggtacctgtgggaggtgaagaaacagcgggccggagttctgtgggatgtgccttctccccctcccatgggcaaggctgaactcgaggacggggcgtatcgcatcaaacaaaagggaatcctgggctacagccagattggcgccggggtctacaaggaaggaacctttcacacaatgtggcatgtgaccagaggcgctgttcttatgcacaaagggaagcggatcgagccctcctgggccgatgtgaaaaaggacctgatttcttatggaggcgggtggaaactcgagggagaatggaaggagggcgaagaggtccaggtgctggccctcgaacctggcaagaatccgcgcgctgtgcagacaaaacccgggctgttcaagaccaacacgggaaccatcggcgccgttagccttgatttttcccctgggacatctggaagccccattatcgacaaaaagggcaaagtcgtggggctgtacggaaacggcgtggtcaccagatccggcgcgtatgtgagcgctatcgcccaaacagagaagtctattgaggataatcctgaaatcgaggacgatattttccggaagcgcagactgaccatcatggacctccaccccggggccggaaaaacaaagcggtacctgcctgctattgttagagaagccatcaaacgcggccttcggacgctgattctcgcgccgaccagagtggtcgctgccgagatggaagaggccctgcgcgggctccccatccggtatcagacccctgctatcagagccgagcataccggacgcgaaattgtggacctgatgtgtcacgctaccttcacaatgcggcttctgtcccccgttagagtgcctaactacaatctgatcattatggatgaggcccattttacggaccccgcgagcatcgccgctcgcggctatatttctacccgggtcgaaatgggggaggccgctggcatcttcatgacagccaccccgcctggatccagagatccctttccccagagcaacgcccctatcattgacgaggaacgggagatccccgaacgctcctggaactctggccacgagtgggtgacagatttcaaggggaaaaccgtttggtttgtgcctagcattaaggctggaaacgacatcgcggcctgcctcagaaagaatggcaaaaaggtcattcaactgtcccggaaaacgttcgatagcgaatacgtgaagacacgcaccaacgactgggattttgtggtcaccacagacatctctgagatgggggctaatttcaaagccgagagagttatcgatccgcggagatgtatgaagcccgtgattcttaccgacggagaggaacgcgtgatcctggccggccctatgcccgtcacacattccagcgctgcccagcggagagggcgcattggccggaaccctaaaaatgaaaacgaccagtacatctatatgggagagcccctcgaaaatgatgaggactgcgcgcactggaaggaggctaagatgctgctggataacattaataccccggaaggcatcattccttctatgtttgagcccgaaagagagaaagtggacgccatcgatggggaataccgcctccggggagaggccagaaagacgttcgttgaccttatgcgcagaggcgatctgcctgtgtggctggcttataaagtcgccgcggaggggatcaactacgccgaccggcgctggtgttttgatggaattaagaacaatcagatcctcgaagagaacgtggaagttgagatttggacaaaagagggcgaaagaaagaagctgaaaccccggtggcttgacgctcgcatctatagcgatcctctggccctcaaggagttcaaagagttcgctgccgggagaaagtccctgaccctgaatctcattacagagatgggccggcttcccacctttatgacgcagaagaccagagacgctctggataacctggccgtgctccacacagcggaagccggaggccgcgcttacaatcatgccctgtctgagcttccggagaccctggaaacactcctgctgctcacccttctggctacagtcaccgggggaatcttcctgtttctcatgagcggccgggggatcggaaagatgacgctgggcatgtgctgcattatcacagcctccattcttctgtggtatgcccagatccagcctcactggattgctgcgtctatcatcctcgagttctttctgattgtgctgctcatccccgaacccgagaagcagagaacccctcaagacaaccagcttacctacgtcgtgattgccatcctgacagttgtggctgccaccatggccaatgaaatgggcttcctggagaaaacaaagaaagacctcgggctgggaagcattgctacgcagcagccggagtccaacatccttgatattgacctgcgccccgccagcgcgtggaccctctacgccgtggctacaacctttgtcacacctatgctgcggcattctatcgaaaattccagcgttaacgtgtccctgaccgccatcgctaatcaagccacggtgctcatgggccttgggaagggatggcccctgtctaaaatggatattggcgtccctctgctcgcgatcgggtgttatagccaggtgaaccccattaccctgacagccgcccttctgctcctggttgcccactacgctatcattggacctggcctgcaggccaaggctaccagagaggcccagaagcgggcggccgctggcatcatgaaaaatccgacagtggacgggatcaccgtcattgatctcgaccccatcccttatgatcccaagttcgaaaaacaacttggacaggtgatgctgctgattctctgcgtcacgcaggtcctgatgatgcgcacaacctgggccctttgtgaggctctgacactcgccaccggccctatctccaccctgtgggaagggaaccccggaagattttggaatacaacgattgccgtttctatggcgaacatcttccggggcagctacctggctggggccggactcctcttttccatcatgaagaataccacaaacacccgcagaggcacaggcaacattggggagaccctgggagagaaatggaaaagccggctgaatgctctcggcaaatctgagttccaaatctataagaagtccgggattcaggaggtggaccgcacgctggccaaagaaggaatcaagagaggcgagacagatcaccatgccgtcagccgggggtctgctaaacttcgctggtttgtggagagaaacatggttaccccggaaggaaaggtggtcgacctgggctgcggcagagggggatggtcctactattgtggcgggctcaaaaatgtgagagaggtgaagggactgaccaagggcgggcctggacacgaagaacccattcccatgagcacatacggctggaacctggttcgcctccagtctggcgtcgatgtgttcttcatccctcccgaaaaatgcgacacccttctgtgtgatatcggggagagctcccctaatccgacagtggaggccggacggacgctgagagtcctcaacctggttgaaaattggcttaacaataacacccagttttgcattaaggtgctgaatccctacatgccttctgtgatcgagaaaatggaagcgctccaacgcaagtatggcggggccctggtccggaaccccctgagcagaaattccacacatgagatgtactgggtgagcaacgcttccggaaatattgtttctagcgtgaacatgatctcccgcatgctcattaaccggttcaccatgagacacaaaaaggccacatatgaacctgacgtcgaccttggctctgggacccgcaatatcggaattgagagcgagacgcccaacctggatatcatcggcaagcggattgagaagatcaaggaggaacatgagacctcctggcactacgaccaggatcacccgtataaaacatgggcttaccatggctcttatgaaaccaagcagacagggagcgcctccagcatggtgaatggagttgtgagactgctcaccaaaccttgggacgtcctgcccacagtgacccagatggcgatgacggatacaaccccttttggccaacagcgcgtgttcaaggagaaggtcgacacccggacacaggagcccaaagaagggacgaagaaacttatgaagattaccgccgagtggctgtggaaagaactcggaaagaaaaagacacctagaatgtgtacccgcgaggagtttacaagaaaggttcggtctaacgctgccctgggcgctatcttcaccgatgaaaataaatggaagtccgcccgcgaggctgtggaagacagcagattttgggagctggtggataaagaacggaacctccacctggaggggaagtgcgagacatgtgtctacaatatgatgggaaaaagagaaaagaaacttggcgagttcggcaaagccaaggggtctcgggcgatttggtacatgtggctgggagcccgctttctcgagttcgaggctctgggctttcttaacgaagaccattggttctccagagagaatagcctgtctggggtggagggagaaggcctccacaaactggggtatatcctgcgggatgtttccaagaaagagggcggagccatgtacgctgacgacaccgccggctgggatacgcgcatcaccctcgaagacctgaagaacgaggaaatggtgacaaatcacatggagggggagcataagaaacttgccgaagcgatttttaagctgacctatcagaacaaagtcgtgagagttcaacggcccacaccgcgcggaaccgtgatggatatcattagcagacgggaccagcgcggctccgggcaggtcggaacgtacggcctcaatacattcaccaacatggaggctcaactgatcagacagatggaaggggagggcgtgttcaagaatattcagcaccttacagttaccgaggaagccgccgtgcagaactggctggctcgggtcggacgcgagagactcagccggatggccatctctggcgatgactgcgtggtcaaacctctggatgaccgctttgctaacgccctgacggcgctcaatgatatggggaagatcagaaaggacattcaacagtgggaacccagcaaaggatggaacgattggacccaggtgcccttctgctcccatcactttcatgagctgatcatgaaggacggccgggttcttgtggtcccttgtagaaatcaggatgaactgattgggcgcgcccggatctctcaaggagctggctggagcctcagagagacagcctgcctggggaaatcctatgctcagatgtggtctcttatgtacttccaccgccgggacctgagactcgccgcgaacgccatttgtagcgctgtgccgtcccactgggtgcccacctctcgcacaacctggagcatccatgccaagcacgagtggatgacaaccgaagacatgctgacggtttggaatcgggtgtggattagagagaacccttggatggaagataaaacacccgtcgagtcctgggaagagatcccttatctgggcaagcgcgaggaccagtggtgcggaagcctcatcggcctgacctctcgggctacctgggccaagaatattcaggctgccatcaaccaagtgagatcccttattgggaatgaagagtacacagattacatgcccagcatgaaacgctttcggagagaagaggaagaggcgggagttctgtggtga

SEQ ID NO: 19689 - RNA, 9876 nt, synthetic construct
  misc_feature 1..9876: note = derived and/or modified CDS sequence (opt5) from DENV-2__GU131930__SS-prME
  source 1..9876: mol_type = other RNA
tccgctggaatgatcattatgctgatccccacagtgatggctttccacctcacaacgagaaacggggagcctcatatgattgtcgggatccaggaaaagggcaagtccctgctttttaagaccgaggacggggttaatatgtgcacactgatggccatggatctcggagaactgtgtgaggacaccattacatacaagtgcccgcttctgcggcaaaacgaacccgaggatatcgactgttggtgcaattctaccagcacatgggtgacctatggcacgtgtaccacaaccggggagcacagaagagaaaagcggtccgtggcgctcgttcctcatgtgggaatgggcctggagacacgcaccgaaacgtggatgtcttccgagggcgcttggaaacacgcccagagaatcgagacatggattctgcggcatcccgggttcaccatcatggccgctattctcgcctacacaatcggaaccacccactttcagcgcgctctgattttcatccttctgacagccgttgcgccttccatgacgatgagatgcattggcatctctaaccgggattttgtggaaggggtcagcggaggctcctgggtggacatcgttctcgagcacgggagctgtgtgaccacaatggccaagaataagcccaccctggatttcgaacttattaaaacagaggctaagcagcctgccaccctgcgcaaatattgcatcgaagctaagctcacgaacacaaccaccgagtctagatgtccgacacaaggagagccctccctgaaagaggaacaagacaagcggtttgtctgcaagcatagcatggtggatcgcggctggggcaatgggtgtggactgttcggcaaagggggaattgtgacctgcgccatgtttacatgcaagaaaaacatggaaggcaagatcgtccagcctgagaatctcgaatacacgattgttgtgacaccccactctggggaggagcatgcggtgggaaacgacacaggcaaacacggcaaggaaatcaaagtcacccctcagtccagcatcacagaggccgaactgaccgggtatggaacggtgaccatggagtgttctcccagaacaggccttgatttcaatgaaatggttctgctccaaatggagtccaaggcttggctggtgcaccggcagtggtttcttgacctgccgctcccttggctgcccggggccgataagcagggaagcaactggattcagaaagagaccctggtcacattcaagaatcctcatgctaaaaagcaagacgtggttgtgctcggctcccaggaaggggccatgcacaccgccctgacgggcgctacagagatccagatgtctagcggaaaccttctgtttaccggccatctcaaatgccgcctgagaatggacaaacttcaactgaaggggatgtcctacagcatgtgtacaggaaaattcaaggtcgtgaaagaaattgcggagacccagcacggcaccatcgtcattcgggtgcagtatgagggggatggatctccctgcaagatccccttcgaaatcatggacctcgagaaaagatacgttctgggccgcctgattacagtgaatcctatcgtcacggaaaaggattccccggtgaacattgaggccgaacccccttttggggacagctacatcattatcggcgttgagcccggacagctcaagctgaactggttcaaaaagggctctagcattgggcaaatgtttgagaccacaatgcggggagctaaaagaatggccatccttggcgataccgcctgggacttcgggtccctgggaggcgtgtttacatctatcgggaaggctctccatcaggtcttcggcgccatttatggagcggcttttagcggcgtgtcctggaccatgaaaatcctgattggggtgatcattacgtggatcggaatgaatagccgctctacatccctgagcgtttctcttgtcctcgtgggcatcgtgaccctgtacctgggggtcatggtgcaggccgattccggatgtgttgtgagctggaagaacaaggaactcaaatgcggctccgggattttcatcaccgacaatgtccacacatggaccgagcagtataagtttcaacctgaatctcccagcaaactggcctccgctattcagaaggcccaggaggaaggcatctgtggcattcggtctgtgacaagacttgagaacctgatgtggaaacagatcacgccggagctcaatcacatcctggctgaaaacgaggttaagctgaccattatgacaggcgatatcaaagggattatgcaagccggaaagcgcagccttcggcctcagcccaccgaactcaagtactcctggaaaacatggggcaaggcgaaaatgctgagcaccgagtctcataatcagacgttcctgatcgacgggcctgaaaccgccgagtgccccaacacaaatagagcttggaactccctcgaggtggaagattatggatttggcgtcttcaccacaaatatttggctgaaacttaaagagaagcaggacgccttttgtgacagcaagctgatgtctgctgccatcaaagataaccgcgcggtgcacgccgacatgggctactggatcgaatccgctctcaatgatacctggaagattgagaaagccagcttcatcgaggttaagaactgccattggcctaaatctcacacactgtggagcaatggggtgctggaatccgagatgattatccccaagaaccttgctggaccggtcagccaacacaactatcggcctggctaccatacccagacggccgggccctggcacctcggaaagctggaaatggacttcgatttttgtgacggcacaaccgtgattgtgaccgaggattgcgggaatagaggaccctctctgcgcacaaccacggcctccggcaaactcatcacagaatggtgctgtcggagctgcaccctgcctccgcttagataccggggcgaggacgggtgttggtatggaatggagattcgccccctgaaggaaaaagaggaaaacctcgtcaattccctggttacagctggccatggacaggtggataacttctctctgggagtgcttggcatggcgctctttctggaggaaatgctgagaacccgggtcgggacaaagcacgccatcctcctggtggctgttagcttcgtgacccttatcacgggaaatatgtcctttaaagacctgggcagagtcgtggttatggtgggcaccacaatgaccgatgacattgggatgggagtcacatacctcgccctgctggccgctttcaaggtgcgccctacctttgccgcgggccttctgctccggaagctgacgtctaaagagctcatgatgacaaccatcgggattgttctgcttagccaatccacaatccccgagaccattctggaactcaccgatgctctggccctgggaatgatggtgcttaagatcgtcagagacatggagaaatatcagctggccgtgacaatcatggctattctctgcgtgcctaacgccgtcatcctgcagaatgcgtggaaggtttcttgtacgattctcgctgtggtgagcgtcagccccctgcttctgaccagctctcagcagaagacagactggatccctctcgccctgaccattaagggcctgaaccccacagccatcttccttaccacgctgtcccgcacaaataaaaagagaagctggccgctcaacgaagctatcatggccgtggggatggtttctattctggcttccagcctcctgaagaatgatatccctatgaccggaccccttgtggccggcggcctgctgaccgtctgctacgtgctcacagggcggtctgcggacctggagcttgaacgcgccaccgatgttaaatgggaggaccaggctgagatttccggaagctcccctatcctgagcattacaatctctgaagatggcagcatgtccattaagaacgaggaagaggagcagacgctcaccatcctgatcagaacagggctcctggtgatttctggactttttcccgtcagcatcccgattaccgccgctgcctggtatctgtgggaagtgaaaaagcagcgggccggcgtcctgtgggacgtgccttctccccctcccatggggaaagctgagctcgaagatggagcgtaccgcatcaagcaaaagggcattctgggctatagccagatcggggccggagtttacaaagagggcacattccataccatgtggcacgtgacgagaggggctgtccttatgcacaagggaaaacggatcgaacccagctgggccgacgtgaagaaagatctgatttcctacggcgggggatggaagctcgagggcgagtggaaggaaggcgaggaagttcaggtgctggccctcgagcctgggaaaaatccgcgcgctgtccagaccaagcccggactgtttaaaacaaacaccggcacaatcggggccgtgtctcttgacttcagccctggaacctccggcagccccattatcgataagaaagggaaggtggttggactgtatggcaatggcgtcgtgacaagatctggggcgtacgtgtccgctattgcccaaacggaaaagagcatcgaggacaaccctgagatcgaagatgacatttttcggaaacgcagactgaccatcatggacctccatcccggagccggcaagacaaaacggtatctgcctgctattgtcagagaggccatcaagcgcgggcttcggaccctgattctcgcgccgaccagagtggttgctgccgaaatggaggaagccctgcgcggactccccatccggtaccagacccctgctattagagccgagcacacgggccgcgagatcgtggatctgatgtgtcatgctaccttcacaatgcggcttctgtctcccgtcagagtgcctaactataatctgatcattatggacgaagcccacttcaccgatcccgcgtccatcgccgctcgcgggtacattagcacacgggttgagatgggcgaagccgctggaatctttatgaccgccacgccgcctggctccagagaccccttcccccagtctaacgcccctattatcgatgaggagcgggaaatccccgagcgcagctggaatacagggcatgaatgggtgaccgactttaaaggaaagaccgtctggttcgtgccttccattaaggctggcaacgatatcgcggcctgcctccgcaagaatgggaagaaagttattcaactgagccggaagacatttgactctgagtatgtgaaaacccgcacaaacgattgggacttcgtcgtgaccacggatatctccgaaatgggagctaattttaaggccgagagagtgattgacccgcggagatgtatgaaacccgtcatccttacagacggcgaggaacgcgttatcctggccgggcctatgcccgtgacccacagctctgctgcccagcggagaggccgcattggacggaaccctaagaatgagaacgatcagtacatctacatgggcgaacccctcgagaatgacgaagattgcgcgcactggaaggaggctaaaatgctgctggacaacattaatacaccggaggggatcattcctagcatgttcgaacccgagagagaaaaggtggatgccatcgacggagagtatcgcctccggggcgaagccagaaaaacctttgtcgatcttatgcgcagaggggacctgcctgtgtggctggcttacaaggttgccgcggagggaattaactatgccgatcggcgctggtgtttcgacggcatcaaaaataaccagatcctcgaggaaaacgtggaggtcgaaatttggacgaaggagggggagagaaagaaactgaagccccggtggcttgatgctcgcatctactccgaccctctggccctcaaagaatttaaggagttcgctgccggcagaaaatctctgaccctgaatctcattacagaaatgggacggcttcccaccttcatgacacaaaagaccagagatgctctggacaacctggccgtgctccatacagcggaggccggcgggcgcgcttataatcacgccctgagcgaacttccggagaccctggagacgctcctgctgctcacacttctggctaccgttaccggaggcatctttctgttcctcatgtccgggcggggaattggcaagatgacactgggcatgtgctgcatcatcaccgcctctattcttctgtggtacgcccagatccagcctcattggattgctgcgagcatcattctcgaatttttcctgatcgtgctgctcatccccgagcccgaaaaacagagaacacctcaagacaaccagcttacgtatgtcgtgattgccatcctgaccgtcgtggctgccacaatggccaatgagatggggtttctggaaaagaccaaaaaggatctcggactgggctccattgctacacagcagccggagagcaacatccttgacattgatctgcgccccgcctctgcgtggaccctctacgccgttgctacgaccttcgtgacacctatgctgcggcactccatcgagaatagctccgtgaacgtctctctgaccgccattgctaatcaagccacagttctcatggggcttggaaaaggctggcccctgagcaagatggacatcggggtgcctctgctcgcgatcggatgttactcccaggtgaaccccattaccctgacggccgcccttctgctcctggtcgcccactatgctatcattggccctggcctgcaggccaaggctacaagagaagcccagaaacgggcggccgctgggatcatgaagaatccgaccgtggatggaattacagttatcgacctcgatcccatcccttacgaccccaaatttgagaagcaacttggccaggtgatgctgctgattctctgcgtcacccaggtgctgatgatgcgcaccacatgggccctttgtgaagctctgacgctcgccaccgggcctatctctacactgtgggagggaaaccccggcagattctggaataccacaattgccgtcagcatggcgaacatctttcgggggtcctatctggctggagccggcctccttttcagcattatgaaaaataccacgaacacacgcagaggcaccgggaatatcggagaaaccctgggcgagaagtggaaatctcggctgaacgctctcgggaagtccgagtttcaaacatacaagaaaagcggaatccaggaagtggatcgcaccctggccaaggagggcattaaaagaggggaaacagaccatcacgccgtttctcggggatccgctaaacttcgctggttcgtggagagaaacatggtcacgccggagggcaaagtggttgatctgggctgcgggcggggaggctggagctattactgtgggggactcaagaatgtgagagaagtcaagggcctgaccaaagggggacctggccatgaggaacccatccccatgtctacatatggctggaacctggtgcgcctccagagcggggtggacgtctttttcattcctcccgagaagtgcgatacccttctgtgtgacatcggagaatcctctcctaatccgacagtcgaggccggccggaccctgagagtgctcaacctggtggagaattggcttaacaataacacgcagttctgcattaaagtcctgaatccctacatgcctagcgttatcgaaaagatggaggcgctccaacgcaaatacgggggagccctggtgcggaaccccctgtccagaaatagcacccacgaaatgtattgggtgtccaacgcttctggcaatatcgtcagctccgtgaacatgatttctcgcatgctcatcaatcggtttacaatgagacataagaaggccacctacgagcctgacgttgatcttgggagcggaacacgcaacattggcatcgaatccgagattcccaacctggacatcattggcaaacggatcgagaagatcaaacaggaacacgagacctcttggcactatgatcaggaccatccgtacaagacatgggcttatcacgggagctacgaaaccaaacagacgggatccgccagctctatggtgaatggcgtcgtgagactgctcacaaagccttgggatgttctgcccaccgtgacccaaatggcgatgacagacacgacccctttcgggcagcagcgcgtctttaaggagaaagtggatacacggacccaggaacccaaggagggaaccaagaaacttatgaaaattaccgccgagtggctgtggaaggaactcggcaaaaagaagacacctagaatgtgtacccgcgaggagttcacgagaaaagtgcggtccaacgctgccctgggggctatctttaccgacgagaataagtggaaaagcgcccgcgaggctgtcgaagattctagattctgggagctggttgacaaggaacggaacctccatctggagggaaaatgcgaaacatgtgtgtataatatgatgggcaagagagagaagaaacttggcgagtttgggaaggccaaaggatcccgggcgatttggtacatgtggctgggcgcccgcttcctcgaatttgaggctctggggttccttaacgaagatcactggtttagcagagaaaattctctgtccggagtggaaggcgaggggctccacaagctgggctacatcctgcgggacgtcagcaaaaaggagggaggcgccatgtatgctgacgataccgccgggtgggacacacgcattaccctcgaagatctgaagaacgaggaaatggtgacgaatcatatggagggagaacacaagaaacttgccgaggcgatcttcaaactgacataccaaaacaaagttgtgagagtccagcggcccaccccgcgcggcacagtgatggacatcatttccagacgggatcagcgcgggagcggacaagttggcacctatgggctcaatacgtttaccaacatggaggctcagctgatcagacagatggaaggcgagggagtgttcaaaaatattcagcatcttacagccaccgaagaggtcgccgtgaagaactggctggctcgggttggccgcgagagactctctcggatggccatcagcggggacgattgcgtggtcaagcctctggacgatcgcttcgctaatgccctgacagcgctcaacgacatgggaaaaattagaaaggatatccaacagtgggaaccctccaaaggctggaacgactggacccaggtgcccttttgctctcaccatttccacgagctgatcatgaaggatgggcgggtccttgtggttccttgtagaaatcaggacgaactgattggacgcgcccggatcagccaaggcgctgggtggtccctcagagagacagcctgcctgggcaaatcttacgctcagatgtggagccttatgtattttcaccgccgggacctgagactcgccgcgaacgccatttgttccgctgtgccgtctcattgggtccccaccagccgcacgacatggtccatccacgccaagcatgaatggatgaccaccgaggatatgctgacagtgtggaatcgggtgtggattagagagaacccttggatggaagacaagacccccgttgagagctgggaagagatcccttacctgggaaaacgcgaagatcagtggtgcggctctctcattgggctgacatcccgggctacgtgggccaagaatatccaggctgccatcaaccaagtgagaagccttattggaaatgaggagtataccgactacatgccctctatgaaacgcttccggagagaagaggaagaggcgggcgtcctgtggtga

SEQ ID NO: 19690 - RNA, 9876 nt, synthetic construct
  misc_feature 1..9876: note = derived and/or modified CDS sequence (opt5) from DENV-2__GU131931__SS-prME
  source 1..9876: mol_type = other RNA
agcgccggcatgatcattatgctgatccccaccgtgatggctttccacctgacgacgcggaatggggagcctcatatgattgttggaatccaggaaaagggcaagagcctgctttttaagaccgaggacggggttaatatgtgcacgctgatggccatggatctcggagaactgtgtgaggacaccattacatacaaatgcccgcttctgcggcaaaacgaacccgaggatatcgactgttggtgcaattctaccagcacatgggtgacctatggcacgtgtaccacaaccggggagcaccgcagagaaaagcggtccgtggcgctcgtccctcatgtgggaatgggcctggagacacgcaccgaaacgtggatgtctagcgagggcgcttggaaacacgcccagagaatcgagacatggattctgcggcatcccgggttcaccatcatggccgctattctcgcccacacaatcggaaccacccactttcagcgcgttctgattttcatccttctgacagctgtggccccttccatgacgatgagatgcattggcatctctaaccgggattttgtcgaaggggtgagcggaggctcctgggttgacatcgtgctcgagcatgggagctgtgtcaccacaatggcgaagaataagcccaccctggatttcgaacttattaaaacagaggccaagcagcctgctaccctgcgcaaatactgcatcgaagccaagctcacgaacacaaccaccgagtctagatgtccgacacaaggagagccctccctgaaagaggaacaagacaagcggtttgtgtgcaagcacagcatggtggatcgcggctggggcaatgggtgtggactgttcggcaaagggggaattgttacctgcgctatgtttacatgcaagaaaaacatggaaggcaagatcgtccagcctgagaatctcgaatatacgattgtggtgacaccccattctggggaggagcacgccgtcggaaacgacacaggcaaacacggcatggaaatcaaggtgacccctcagtccagcatcacagaggcggaactgaccgggtacggaacggttaccatggagtgttctcccagaacaggccttgatttcaatgaaatggtgctgctccaaatggagaacaaagcctggctggtccatcggcagtggtttcttgacctgccgctcccttggctgcccggggctgataagcaggagtccaattggattcagaaggaaaccctggtgacattcaaaaaccctcacgccaagaaacaagacgttgtggtcctcggaagccaggagggcgctatgcataccgccctgacgggggccacagaaatccagatgtcctctggcaatcttctgtttaccggacacctcaagtgccgcctgagaatggacaaacttcaactgaagggcatgagctattccatgtgtacagggaagttcaaagtggtcaaggagattgctgagacccagcatggaaccatcgtgattcgggttcagtacgaaggcgatgggagcccctgcaaaatccccttcgagatcatggacctcgaaaagagatatgtgctgggacgcctgattacagtcaaccctatcgtgacggagaaagattctccggttaacattgaagcggagcccccttttggcgactcctacatcattatcggggtggagcccggccagctcaagctgaattggttcaagaaaggaagctctattggccaaatgtttgaaaccacaatgagaggggccaagagaatggctatccttggagataccgcctgggacttcggcagcctcgggggagtctttacatccatcggcaaagccctccaccagattttcggggctatctacggcgccgcgttttctggagtgagctggaccatgaagattctgatcggcgtgattatcacgtggatcgggatgaactcccgcagcacatctctgtccgttagccttgtcctcgtgggaattgtgaccctgtatctgggcgtcatggtgcaggctgattctgggtgtgttgtgtcctggaaaaataaggagctcaagtgcggaagcggcatcttcattaccgacaacgtccacacatggaccgaacagtacaaatttcaacctgagtccccctctaagctggccagcgccatccagaaagctcaggaagaggggatttgtggcatccggtccgtgacaagacttgagaatctgatgtggaagcagatcacgccggaactcaaccatattctggccgagaatgaagttaaactgaccatcatgacaggagatattaagggcatcatgcaagctgggaaacgctctcttcggcctcagcccaccgagctcaagtatagctggaagacatggggaaaagccaagatgctgtccaccgaaagccacaaccagacgttcctgattgacggccctgagaccgcggagtgccccaatacaaacagagcctggaactctctcgaagtggaggattacgggtttggagtcttcaccacaaacatctggctgaaacttaaggaaaaacaggacgctttttgtgactccaagctgatgagcgccgctatcaaggataatcgcgccgtgcatgcggacatgggctattggattgagtctgccctcaacgatacctggaaaatcgagaaggcttccttcattgaagttaaaaattgccactggcctaagagccacacactgtggtctaacggcgtgctggagagcgaaatgatcattcccaaaaaccttgccgggccggtctcccaacataattaccggcctggatatcacacccagatcgctggcccctggcatctcgggaagctggagatggacttcgatttttgtgacggaacgacagtgattgtgaccgaagattgcggcaacagagggcccagcctgcgcaccacaaccgcctctggaaagctcatcacggagtggtgctgtcggtcctgcacactgcctccgcttagataccggggcgaggacggctgttggtacgggatggaaatccgccccctgaaagagaaggaagagaatctcgtcaacagcctggttaccgccggacacggccaggtggataatttctccctgggggtgcttggaatggctctctttctggaagagatgctgagaacacgggtcggcaccaaacatgcgattctcctggtggccgtttctttcgtgacacttatcaccgggaacatgagctttaaggacctgggaagagtcgtggttatggtgggcgctacgatggccgatgacattggcatgggggtcacctatctcgccctgctggctgccttcaaagtgcgccctacatttgcggctggacttctgctccggaagctgacctccaaggagctcatgatgacaaccatcggcattgttctgctttctcaaagcacgatccccgaaacagtgctggagctcaccgatgccctggccctggggatgatggtccttaaaatcgtgagaaatatggaaaagtaccagctggctgtgacaattatggccatcctctgcgtccctaacgcggttattctgcagaatgcttggaaagtgtcctgtaccatcctcgccgtggtctctgtgagccccctgcttctgacctccagccagcaaaagacagactggattcctctcgccctgacgatcaaaggactgaaccccaccgctatcttccttacaaccctgtctcgcacaaataagaaaagatcctggccgctcaacgaggccattatggctgttggcatggtgagcatcctggcctcttccctcctgaagaatgacattcctatgaccgggccccttgtcgcgggaggcctgctgacggtgtgctatgttctcacaggccggagcgccgatctggaacttgagcgcgctaccgacgtgaagtgggaggatcaggccgaaatctctgggtccagccctattctgtccatcaccattagcgaggacggatctatgagcatcaaaaacgaagaggaggaacagacactcaccatcctgattagaacaggcctcctggtcatctccgggctttttcccatttctatcccgattacggctgccgcctggtacctgtgggaggtgaagaaacagcgggctggagtcctgtgggatgtgccttctccccctcccatgggcaaggcggaactcgaggacggggcctatcgcatcaaacaaaagggaatcctgggctactcccagattggcgctggggtttataaggaaggaaccttccacacaatgtggcacgtgaccagaggcgccgtccttatgcataaagggaagcggatcgagccctcctgggccgatgtgaaaaaggacctgattagctacggaggcgggtggaaactcgagggagaatggaaggagggcgaagaggttcaggtgctggctctcgaacctggcaagaatccgcgcgccgtccagacaaaacccgggctgtttaagaccaacacgggaaccatcggcgcggtgtcccttgatttctctcctgggacaagcggatcccccattatcgacaaaaagggcaaagtggttgggctgtacggaaacggcgtcgtgaccagaagcggcgcttatgtgtctgccatcgcccaaacagagaagtccattgaggataatcctgaaatcgaggacgatatttttcggaagcgcagactgaccatcatggacctccaccccggggctggaaaaacaaagcggtacctgcctgccattgtcagagaagcgatcaaacgcggccttcggacgctgattctcgctccgaccagagtggttgccgccgagatggaagaggctctgcgcgggctccccatccggtatcagacccctgccatcagagctgagcataccggacgcgaaattgtggacctgatgtgtcacgccaccttcacaatgcggcttctgagccccgtcagagtgcctaactacaatctgatcattatggatgaggcgcatttcacggaccccgcctctatcgctgcccgcggctatatttccacccgggttgaaatgggggaggctgccggcatctttatgacagccaccccgcctggaagcagagatcccttcccccagtccaacgctcctatcattgacgaggaacgggagatccccgaacgctcttggaatagcggccacgagtgggtgacagattttaaggggaaaaccgtctggttcgtgccttccattaaggcgggaaacgacatcgccgcttgcctcagaaagaatggcaaaaaggttattcaactgagccggaaaacgtttgattctgaatacgtgaagacacgcaccaacgactgggatttcgtcgtgaccacagacatctccgagatgggggccaattttaaagccgagagagtgatcgatccgcggagatgtatgaagcccgtcattcttaccgacggagaggaacgcgttatcctggctggccctatgcccgtgacacacagctctgccgcgcagcggagagggcgcattggccggaaccctaaaaatgaaaacgaccagtatatctacatgggagagcccctcgaaaatgatgaggactgcgctcattggaaggaggccaagatgctgctggataacattaataccccggaaggcatcattcctagcatgttcgagcccgaaagagagaaagtggacgccatcgatggggaataccgcctccggggagaggctagaaagacgtttgtcgaccttatgcgcagaggcgatctgcctgtgtggctggcctataaagttgcggccgaggggatcaactacgctgaccggcgctggtgtttcgatggaattaagaacaatcagatcctcgaagagaacgtggaagtcgagatttggacaaaagagggcgaaagaaagaagctgaaaccccggtggcttgacgcccgcatctattccgatcctctggctctcaaggagtttaaagagttcgccgctgggagaaagtctctgaccctgaatctcattacagagatgggccggcttcccaccttcatgacgcagaagaccagagacgccctggataacctggcggtgctccacacagccgaagctggaggccgcgcctacaatcatgctctgagcgagcttccggagaccctggaaacactcctgctgctcacccttctggccacagttaccgggggaatctttctgttcctcatgtccggccgggggatcggaaagatgacgctgggcatgtgctgcattatcacagcctctattcttctgtggtatgctcagatccagcctcactggattgcggccagcatcatcctcgagtttttcctgattgtgctgctcatccccgaacccgagaagcagagaacccctcaagacaaccagcttacctacgtcgtgattgctatcctgacagtcgtggccgccaccatggctaatgaaatgggctttctggagaaaacaaagaaagacctcgggctgggatccattgccacgcagcagccggagagcaacatccttgatattgacctgcgccccgcgtctgcctggaccctctatgctgttgccacaaccttcgtgacacctatgctgcggcactccatcgaaaatagctccgtgaacgtctctctgaccgctatcgccaatcaagcgacggttctcatgggccttgggaagggatggcccctgagcaaaatggatattggcgtgcctctgctcgccatcgggtgttactcccaggtgaaccccattaccctgacagctgcccttctgctcctggtcgctcattacgccatcattggacctggcctgcaggctaaggccaccagagaggcgcagaagcgggccgctgccggcatcatgaaaaatccgacagtggacgggatcaccgttattgatctcgaccccatcccttatgatcccaagtttgaaaaacaacttggacaggtgatgctgctgattctctgcgtcacacaggtgctgatgatgcgcacaacctgggctctttgtgaggccctgacactcgccaccggccctatctctaccctgtgggaagggaaccccggaagattctggaatacaacgattgcggtcagcatggctaacatctttcggggctcctacctggccggggctggactccttttcagcatcatgaagaataccacaaacacccgcagaggcacaggcaacattggggagaccctgggagagaaatggaagtctcggctgaatgccctcggcaaatccgaatttcaaatctataaaaagagcgggattcaggaggtggaccgcacgctggccaaagaaggaatcaagagaggcgagacagatcaccatgctgtttctcgggggtccgccaaacttcgctggttcgtggagagaaacatggtcaccccggaaggaaaggtggttgacctgggctgcggcagagggggatggagctactattgtggcgggctcaaaaatgtgcgggaggtcaagggactgaccaagggcgggcctggacacgaagaacccattcccatgtctacatacggctggaacctggtgcgcctccagagcggcgtggatgtctttttcatccctcccgaaaaatgcgacacccttctgtgtgatatcggggagtcctctcctaatccgacagtcgaggcgggacggacgctgagagtgctcaacctggtggaaaattggcttaacaataacacccagttctgcattaaggtcctgaatccctatatgcctagcgttatcgagaaaatggaagccctccaacgcaagtacggcggggctctggtgcggaaccccctgtccagaaatagcacacatgagatgtactgggtgtccaacgcctctggaaatattgtcagctccgtgaacatgatctctcgcatgctcattaaccggtttaccatgagacacaaaaaggctacatatgaacctgacgttgaccttggcagcgggacccgcaatatcggaattgagtccgagatccccaacctggatatcattggcaagcggatcgagaagattaaggaggaacacgagacgtcttggcattacgaccaggatcacccgtataaaacctgggcctaccatggcagctatgaaacaaagcagaccgggtccgcgagctctatggtgaatggagtcgtgagactgctcacaaaaccttgggacgttctgcccaccgtgacacagatggccatgaccgatacgacacctttcggccaacagcgcgtctttaaggagaaggtggacacccggacccaggagcccaaagaagggacaaagaaacttatgaagatcacggctgagtggctgtggaaagaactcggaaagaaaaagacccctagaatgtgtacacgcgaggagttcaccagaaaggtgcggtccaacgccgctctgggcgccatttttacagatgaaaataaatggaaaagcgctcgcgaggccgtcgaagactctagattctgggagctggttgataaagaacggaacctccacctggaggggaagtgcgagacctgtgtgtacaatatgatgggaaaaagagaaaagaaacttggcgagtttggcaaagcgaaggggtcccgggccatctggtatatgtggctgggagctcgcttcctcgaatttgaggccctgggcttccttaacgaagaccactggtttagcagagaaaattctctgtccggggtggagggagaaggcctccataaactggggtacatcctgcgggatgtcagcaagaaagagggcggagctatgtacgccgacgacacagccggctgggatacccgcattacgctcgaagacctgaagaacgaggaaatggtgaccaatcacatggagggggagcataagaaacttgcggaagctatcttcaagctgacatatcagaacaaagttgtgagagtccaacggcccaccccgcgcggaacagtgatggatattatctccagacgggaccagcgcggcagcgggcaggttggaacctacggcctcaatacgtttacaaacatggaggcccaactgattagacagatggaaggggagggcgtgttcaagaatatccagcaccttaccgtcacagaggaagccgctgtgcagaactggctggcccgggttggacgcgagagactctctcggatggctatcagcggcgatgactgcgtggtcaaacctctggatgaccgcttcgccaacgcgctgaccgccctcaatgatatggggaagattagaaaggacatccaacagtgggaaccctccaaaggatggaacgattggacacaggtgcccttttgctctcatcacttccacgagctgattatgaaggacggccgggtccttgtggttccttgtagaaatcaggatgaactgatcgggcgcgctcggattagccaaggagccggctggtccctcagagagaccgcttgcctggggaaatcttatgcccagatgtggagccttatgtactttcatcgccgggacctgagactcgcggccaacgctatctgttccgccgtgccgtctcactgggtccccacaagccgcaccacatggtccattcatgctaagcacgagtggatgaccacagaagacatgctgaccgtgtggaatcgggtgtggatcagagagaacccttggatggaagataaaacgcccgttgagagctgggaagagatcccttatctgggcaagcgcgaggaccagtggtgcggatctctcattggcctgacatcccgggccacctgggctaagaatatccaggccgcgattaaccaagtgagaagccttatcgggaatgaagagtacaccgattatatgccctctatgaaacgcttccggagagaagaggaagaggccggagtcctgtggtga

SEQ ID NO: 19691 - RNA, 9876 nt, synthetic construct
  misc_feature 1..9876: note = derived and/or modified CDS sequence (opt5) from DENV-2__GU131932__SS-prME
  source 1..9876: mol_type = other RNA
agcgccggcatgatcattatgctgatccccaccgtgatggctttccacctgacaacgcggaatggggagcctcatatgattgtcggaatccaggaaaagggcaaaagcctgctttttaagaccgaggacggggttaatatgtgcacactgatggccatggatctcggagaactgtgtgaggacaccattacatacaaatgcccgcttctgcggcaaaacgaacccgaggatatcgactgttggtgcaattctaccagcacatgggtgacctatggcacgtgtaccacaaccggggagcaccgcagagaaaagcggtccgtggcgctcgtccctcatgtgggaatgggcctggagacacgcaccgaaacgtggatgtctagcgagggcgcttggaaacacgcccagagaatcgagacatggattctgcggcatcccgggttcaccatcatggccgctattctcgcctacacaatcggaaccacccactttcagcgcgttctgattttcatccttctgacagctgtggccccttccatgacgatgagatgcattggcatctctaaccgggattttgtcgaaggggtgagcggaggctcctgggttgacatcgtgctcgagcacgggagctgtgtcaccacaatggcgaagaataagcccaccctggatttcgaacttattaaaacagaggccaagcagcctgctaccctgcgcaaatattgcatcgaagccaagctcacgaacacaaccaccgagtctagatgtccgacacaaggagagccctccctgaaagaagaacaagacaagcggtttgtgtgcaagcatagcatggtggatcgcggctggggcaatgggtgtggactgttcggcaaagggggaattgtgacctgcgctatgtttacatgcaagaaaaacatggaaggcaagatcgttcagcctgagaatctcgaatacacgattgtggtgacaccccactctggggaggagcatgccgtcggaaacgacacaggcaaacacggcatggaaatcaaggtgacccctcagtccagcatcacagaggcggaactgaccgggtatggaacggttaccatggagtgttctcccagaacaggccttgatttcaatgaaatggtgctgctccaaatggagaacaaagcctggctggtccaccggcagtggtttcttgacctgccgctcccttggctgcccggggctgataagcaggagtccaattggattcagaaggaaaccctggtgacattcaaaaaccctcatgccaagaaacaagacgttgtggtcctcggaagccaggagggcgctatgcacaccgccctgacgggggccacagaaatccagatgtcctctggcaatcttctgtttaccggacatctcaagtgccgcctgagaatggacaaacttcaactgaagggcatgagctactccatgtgtacagggaagttcaaagtggtcaaggagattgctgagacccagcacggaaccatcgtgattcgggttcagtatgaaggcgatgggagcccctgcaaaatccccttcgagatcatggacctcgaaaagagatacgtgctgggacgcctgattacagtcaaccctatcgtgacggagaaagattctccggttaacattgaagcggagcccccttttggcgactcctacatcattatcggggtggagcccggccagctcaagctgaattggttcaagaaaggaagctctattggccaaatgtttgaaaccacaatgagaggggccaagagaatggctatccttggagataccgcctgggacttcggcagcctcgggggagtctttacatccatcggcaaagccctccatcaggtgttcggggctatttatggcgccgcgttttctggagtgagctggaccatgaagatcctgattggcgttatcattacgtggatcgggatgaactcccgcagcacatctctgtccgtcagccttgtgctcgtgggaatcgtcaccctgtacctgggcgtgatggttcaggctgattctgggtgtgtggtctcctggaaaaataaggagctcaagtgcggaagcggcattttcatcaccgacaacgtgcacacatggaccgaacagtataaatttcaacctgagtccccctctaagctggccagcgccattcagaaagctcaggaagaggggatctgtggcattcggtccgttacaagacttgagaatctgatgtggaagcagatcacgccggaactcaaccacatcctggccgagaatgaagtgaaactgaccattatgacaggagatatcaagggcattatgcaagctgggaaacgctctcttcggcctcagcccaccgagctcaagtacagctggaagacatggggaaaagccaagatgctgtccaccgaaagctataaccagacgttcctgatcgacggccctgagaccgcggagtgccccaatacaaacagagcctggaactctctcgaagtcgaggattacgggtttggagtgttcaccacaaacatttggctgaaacttaaggaaaaacaggacgctttttgtgactccaagctgatgagcgccgctatcaaggataatcgcgccgttcatgcggacatgggctattggatcgagtctgccctcaacgatacctggaaaattgagaaggcttccttcatcgaagtgaaaaattgccactggcctaagagccatacactgtggtctaacggcgtcctggagagcgaaatgattatccccaaaaaccttgccgggccggtgtcccaacacaattaccggcctggataccacacccagattgctggcccctggcatctcgggaagctggagatggacttcgatttttgtgacggaacgacagtgatcgtcaccgaagattgcggcaacagagggcccagcctgcgcaccacaaccgcctctggaaagctcattacggagtggtgctgtcggtcctgcacactgcctccgcttagatatcggggcgaggacggctgttggtacgggatggaaatccgccccctgaaagagaaggaagagaatctcgttaacagcctggtgaccgccggacacggccaggtggataatttctccctgggggtccttggaatggctctctttctggaagagatgctgagaacacgggtgggcaccaaacatgcgatcctcctggttgccgtgtctttcgtcacacttattaccgggaacatgagctttaaggacctgggaagagtggttgtgatggtcggcgctacgatggccgatgacatcggcatgggggtgacctatctcgccctgctggctgccttcaaagttcgccctacatttgcggctggacttctgctccggaagctgacctccaaggagctcatgatgacaaccattggcatcgtgctgctttctcaaagcacgattcccgaaacagtcctggagctcaccgatgccctggccctggggatgatggtgcttaaaatcgtgagaaatatggaaaagtaccagctggctgtcacaatcatggccattctctgcgttcctaacgcggtgatcctgcagaatgcttggaaagtgtcctgtaccattctcgccgtcgtgtctgttagccccctgcttctgacctccagccagcaaaagacagactggatccctctcgccctgacgattaaaggactgaaccccaccgctatcttccttacaaccctgtctcgcacaaataagaaaagatcctggccgctcaacgaggccatcatggctgtgggcatggtcagcattctggcctcttccctcctgaagaatgacatccctatgaccgggccccttgtggcgggaggcctgctgacggtttgctatgtgctcacaggccggagcgccgatctggaacttgagcgcgctaccgacgtcaagtgggaggatcaggccgaaatttctgggtccagccctatcctgtccattaccatcagcgaggacggatctatgagcattaaaaacgaagaggaggaacagacactcaccatcctgatcagaacaggcctcctggtgatttccgggctttttcccatctctattccgatcacggctgccgcctggtacctgtgggaggtcaagaaacagcgggctggagtgctgtgggatgttccttctccccctcccatgggcaaggcggaactcgaggacggggcctatcgcattaaacaaaagggaatcctgggctactcccagatcggcgctggggtgtacaaggaaggaaccttccacacaatgtggcatgtcaccagaggcgccgtgcttatgcacaaagggaagcggattgagccctcctgggccgatgttaaaaaggacctgatcagctatggaggcgggtggaaactcgagggagaatggaaggagggcgaagaggtgcaggtcctggctctcgaacctggcaagaatccgcgcgccgtgcagacaaaacccgggctgtttaagaccaacacgggaaccattggcgcggtgtcccttgatttctctcctgggacaagcggatcccccatcattgacaaaaagggcaaagttgtcgggctgtacggaaacggcgtggtgaccagaagcggcgcttatgtctctgccatcgcccaaacagagaagtccatcgaggataatcctgaaattgaggacgatatctttcggaagcgcagactgaccattatggacctccaccccggggctggaaaaacaaagcggtacctgcctgccatcgtgagagaagcgattaaacgcggccttcggacgctgatcctcgctccgaccagagttgtggccgccgagatggaagaggctctgcgcgggctccccattcggtatcagacccctgccatcagagctgagcataccggacgcgaaatcgtcgacctgatgtgtcacgccaccttcacaatgcggcttctgagccccgtgagagttcctaactacaatctgattatcatggatgaggcgcatttcacggaccccgcctctattgctgcccgcggctatatctccacccgggtggaaatgggggaggctgccggcatttttatgacagccaccccgcctggaagcagagatcccttcccccagtccaacgctcctatcatcgacgaggaacgggagattcccgaacgctcttggaatagcggccacgagtgggtcacagattttaaggggaaaaccgtgtggttcgttccttccatcaaggcgggaaacgacattgccgcttgcctcagaaagaatggcaaaaaggtgatccaactgagccggaaaacgtttgattctgaatacgtcaagacacgcaccaacgactgggatttcgtggtgaccacagacatttccgagatgggggccaattttaaagccgagagagtcatcgatccgcggagatgtatgaagcccgttatccttaccgacggagaggaacgcgtgattctggctggccctatgcccgtgacacatagctctgccgcgcagcggagagggcgcatcggccggaaccctaaaaatgaaaacgaccagtacatttatatgggagagcccctcgaaaatgatgaggactgcgctcactggaaggaggccaagatgctgctggataacatcaataccccggaaggcattatccctagcatgttcgagcccgaaagagagaaagtcgacgccattgatggggaataccgcctccggggagaggctagaaagacgtttgtggaccttatgcgcagaggcgatctgcctgtttggctggcctataaagtggcggccgaggggatcaactacgctgaccggcgctggtgtttcgatggaatcaagaacaatcagattctcgaagagaacgtcgaagtggagatctggacaaaagagggcgaaagaaagaagctgaaaccccggtggcttgacgcccgcatttattccgatcctctggctctcaaggagtttaaagagttcgccgctgggagaaagtctctgaccctgaatctcatcacagagatgggccggcttcccaccttcatgacgcagaagaccagagacgccctggataacctggcggttctccacacagccgaagctggaggccgcgcctacaatcatgctctgagcgagcttccggagaccctggaaacactcctgctgctcacccttctggccacagtgaccgggggaatttttctgttcctcatgtccggccgggggatcggaaagatgacgctgggcatgtgctgcatcattacagcctctatccttctgtggtatgctcagattcagcctcactggatcgcggccagcattatcctcgagtttttcctgatcgtcctgctcattcccgaacccgagaagcagagaacccctcaagacaaccagcttacctacgtggtcatcgctattctgacagtggttgccgccaccatggctaatgaaatgggctttctggagaaaacaaagaaagacctcgggctgggatccatcgccacgcagcagccggagagcaacattcttgatatcgacctgcgccccgcgtctgcctggaccctctacgctgtggccacaaccttcgtgacacctatgctgcggcattccattgaaaatagctccgtcaacgtttctctgaccgctatcgccaatcaagcgacggtgctcatgggccttgggaagggatggcccctgagcaaaatggatatcggcgtgcctctgctcgccattgggtgttattcccaggtcaaccccatcaccctgacagctgcccttctgctcctggtggctcactacgccattatcggacctggcctgcaggctaaggccaccagagaggcgcagaagcgggccgctgccggcattatgaaaaatccgacagttgacgggatcaccgtgatcgatctcgaccccattccttatgatcccaagtttgaaaaacaacttggacaggtcatgctgctgatcctctgcgtgacgcaggtcctgatgatgcgcacaacctgggctctttgtgaggccctgacactcgccaccggccctatttctaccctgtgggaagggaaccccggaagattctggaatacaacgatcgcggtgagcatggctaacatttttcggggctcctacctggccggggctggactccttttcagcatcatgaagaataccacaaacacccgcagaggcacaggcaacatcggggagaccctgggagagaaatggaagaatcggctgaacgccctcggcaaatctgaatttcaaatttataagaagtccgggatccaggaggttgaccgcacgctggccaaagaaggaattaagagaggcgagacagatcaccatgctgtgagccgggggtctgccaaacttcgctggttcgtcgagagaaatatggtgaccccggaaggaaaggttgtggacctgggctgcggcagagggggatggtcctactattgtggcgggctcaaaaacgtccgggaggtgaagggactgaccaagggcgggcctggacacgaagaacccatccccatgagcacatacggctggaatctggtgcgcctccagtctggcgttgatgtctttttcattcctcccgaaaaatgcgacacccttctgtgtgatatcggggagagctcccctaacccgacagtggaggcgggacggacgctgagagtgctcaatctggtcgaaaactggcttaataacaatacccagttctgcatcaaggttctgaacccctacatgccttctgtgattgagaaaatggaagccctccaacgcaagtatggcggggctctggtgcggaatcccctgagcagaaactccacacatgagatgtactgggtcagcaatgcctccggaaacatcgtgtctagcgttaacatgatttcccgcatgctcatcaatcggtttaccatgagacacaaaaaggctacatatgaacctgacgtggaccttggctctgggacccgcaacattggaatcgagagcgagattcccaatctggatatcatcggcaagcggattgagaaaatcaaggaggaacatgagacgtcctggcactacgaccaggatcacccgtataaaacctgggcctaccatggctcttatgaaacaaagcagaccgggagcgcgtccagcatggtcaacggagtggttagactgctcacaaaaccttgggacgtgctgcccaccgtcacacagatggccatgaccgatacgacacctttcggccaacagcgcgtgtttaaggagaaggtggacacccggacccaggagcccaaagaagggacaaagaaacttatgaagattacggctgagtggctgtggaaagaactcggaaagaaaaagacccctagaatgtgtacacgcgaggagttcaccagaaaggtccggtctaatgccgctctgggcgccatctttacagatgaaaacaaatggaagtccgctcgcgaggccgttgaagacagcagattctgggagctggtggataaagaacggaatctccacctggaggggaagtgcgagacctgtgtgtacaacatgatgggaaaaagagaaaagaaacttggcgagtttggcaaagcgaaggggtctcgggccatttggtacatgtggctgggagctcgcttcctcgaatttgaggccctgggcttccttaatgaagaccattggttttccagagagaacagcctgtctggggtcgagggagaaggcctccacaaactggggtatatcctgcgggatgtgtccaagaaagagggcggagctatgtacgccgacgacacagccggctgggatacccgcatcacgctcgaagacctgaagaatgaggaaatggttaccaaccacatggagggggagcataagaaacttgcggaagctattttcaagctgacatatcagaataaagtggtcagagtgcaacggcccaccccgcgcggaacagttatggatatcattagcagacgggaccagcgcggctccgggcaggtcggaacctacggcctcaacacgtttacaaatatggaggcccaactgatcagacagatggaaggggagggcgtcttcaagaacattcagcaccttaccgtgacagaggaagccgctgttcagaactggctggcccgggtgggacgcgagagactcagccggatggctatctctggcgatgactgcgtcgtgaaacctctggatgaccgcttcgccaatgcgctgaccgccctcaacgatatggggaagatcagaaaggacattcaacagtgggaacccagcaaaggatggaatgattggacgcaggtccccttttgctcccatcacttccatgagctgatcatgaaggacggccgggtgcttgttgtgccttgtagaaaccaggatgaactgattgggcgcgctcggatctctcaaggagccggctggagcctcagagagaccgcttgcctggggaaatcctatgcccagatgtggtctcttatgtactttcaccgccgggacctgagactcgcggccaatgctatttgtagcgccgtcccgtcccactgggtgcccacatctcgcaccacatggagcatccatgctaagcacgagtggatgaccacagaagacatgctgaccgtgtggaaccgggtttggattagagagaatccttggatggaagataaaacgcccgtggagtcctgggaagagatcccttatctgggcaagcgcgaggaccagtggtgcggaagcctcatcggcctgacatctcgggccacctgggctaagaacattcaggccgcgatcaatcaagtcagatcccttattgggaacgaagagtacaccgattacatgcccagcatgaaacgcttccggagagaagaggaagaggccggagtgctgtggtga

SEQ ID NO: 19692 - RNA, 9876 nt, synthetic construct
  misc_feature 1..9876: note = derived and/or modified CDS sequence (opt5) from DENV-2__GQ199892__SS-prME
  source 1..9876: mol_type = other RNA
accgccggcgtgatcgtcatgctgattcccacagctatggccttccacctcacgacccggaacggggagcctcatatgatcgttggacggcaggaaaagggcaagagcctgctttttaagacagaggacggggtgaatatgtgcaccctgatggcgattgatctcggagaactgtgtgaggacacaatcacctacaagtgcccgcttctgcgccaaaacgaacccgaggatattgactgttggtgcaattccacatctacctgggtgacgtatggcacctgtacaaccacaggggagcacagacgggaaaagcgcagcgtcgctctcgtgcctcatgttggaatgggcctggagaccagaacggaaacatggatgtcctctgagggcgcctggaagcacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaagaccgaggctaagcagcctgccacgctgagaaaatattgcattgaagctaagctcacaaacaccaccacagagagccggtgtccgacccaaggagagccctctctgaatgaggaacaggacaaacgctttatctgcaagcattccatggtggatagaggctggggcaacgggtgtggactgttcggcaaaggcgggattgtcacatgcgccatgtttacgtgcaaaaagaatatggaagggaaaatcgttcagcctgagaacctcgaatacaccattgtgatcacaccccacagcggggaggagcatgcggtgggaaatgacaccggcaagcacggcaaagaaatcaagattacacctcagtcttccaccacggaggccgaactgaccgggtatggaacagtcaccatggagtgtagcccccggacaggccttgatttcaacgaaatggtgctgctccaaatggaggacaaggcttggctggttcaccgccagtggtttcttgatctgccgctcccttggctgcccggggccgacacccagggatctaattggatccagaaggagacgctggtgacattcaagaaccctcatgctaaaaagcaagacgtcgtggttctcggctcccaggaaggggccatgcacaccgccctgacaggcgctaccgagattcagatgagctccggaaatcttctgtttaccggccatctcaaatgcagactgcggatggataaacttcaactgaaagggatgtcttacagcatgtgtacaggaaagttcaagatcgtgaaagaaattgcggagacgcagcacggcaccatcgtcatcagagtgcagtatgagggggacggagccccctgcaagattcccttcgaaatcacagatctcgagaaacgccatgtcctgggccggctgattaccgtgaaccctatcgttacagaaaaggactccccggtgaacattgaggctgaacccccttttggggatagctacatcattgtcggcgtggagcccggacagctcaaactgaattggttcaagaagggctctagcatcgggcaaatgtttgagaccacgatgagaggagccaaacgcatggccatccttggcgacacagcttgggatttcgggagcctgggaggcgtttttacctctattgggaaggccctccaccaggtgttcggcgcgatctacggagctgcctttagcggcgtctcctggaccatgaaaattctgatcggggtgattatcacatggatcggaatgaactctcggagcacctccctgagcgtgtctcttgttctcgtcggcgtggtgacactgtatctgggggccatggtccaggctgactccggatgtattgtgagctggaagaataaagaactcaagtgcggctctgggatcttcattacggataacgttcacacctggacagagcagtacaagtttcaacctgaatcccccagcaaactggcctccgctatccagaaggcccatgaggaaggcatttgtggaatcagatctgtgacccgccttgagaatctgatgtggaaacagatcacaccggagctcaaccacattctgagcgaaaatgaggtcaagctgaccatcatgacgggcgacattaaagggatcatgcaggcgggaaagcggtcccttagacctcaacccaccgaactcaaatattcttggaagacatggggcaaggccaaaatgctgagcaccgagtcccataaccagacattcctgattgatgggcctgaaaccgctgagtgccccaatacaaaccgcgcctggaatagcctcgaggtggaagactacggatttggcgttttctctaccaacatctggctgaaacttcgggagaaacaggacgtgttttgtgattccaagctgatgagcgctgccatcaaagacaatagagcggtccacgccgatatgggctattggattgaatctgctctcaacgacacgtggaagatggagaaggcctccttcatcgaggtgaaaagctgccactggcctaagtctcatacactgtggagcaatggggttctggaatccgagatgattatccccaaaaacttcgctggaccggtgagccagcacaactaccgccctggctatcatacccaaaccgccgggccctggcaccttggaaagctcgaaatggattttgacttctgtgagggcacaaccgtcgtggtgacggaagattgcgggaatcggggaccctctctgagaacaaccacagcctccggcaaactgattaccgagtggtgctgtcggagctgcacactccctccgctgcgctacagaggcgaggacgggtgttggtacggaatggaaatccggccccttaaggagaaggaagagaacctggtcaattccctcgttaccgctggccatgggcagattgataacttttctctgggaatcctgggcatggcgcttttcctcgaagagatgctgagaacgcgcgtggggaccaaacacgccatcctgctcgtggctctgagctttgtcacacttattaccggaaatatgtccttccgggacctgggcagagtgatggttatggtgggcgccacaatgaccgatgacatcgggatgggagtcacgtatctcgccctgctggctgcctttaaggtgcgccctacattcgcggctggccttctgctcagaaaactgacctctaaggagctcatgatggccacaattgggatcgccctgcttagccagtccaccctgcccgaaaccattctcgagctgacagatgctctggcccttggaatgatggcgctgaaaatcgttcggaacatggaaaagtaccaactcgctgtgacgatcatggccatttcttgcgtccctaatgccgtgatcctgcagaacgcttggaaggttagctgtaccattctcgccgctgtgtccgtcagccccctgcttctgacatcttcccagcagaaagccgactggatccctctcgcgctgaccattaagggcctgaatcccacagccatctttcttaccacgctgagccgcacatctaaaaagagatcctggccgctcaacgaggctatcatggccgtggggatggtgagcattctggcttcttccctcctgaaaaatgacatccctatgaccggaccccttgtcgccggcggcctgctgaccgtttgctatgtgctcacagggcggagcgccgatctggaacttgagcgcgctgcggacgtgaagtgggaggatcaagccgaaatttccggaagctctcctatcctgagcattaccatctccgaggacggctctatgagcattaaaaacgaagaggaggaacagacactcacgatcctgatcagaaccgggctcctggtcatttccggagtgttccccgtttctatcccgattacagctgccgcctggtacctttgggaggtgaagaagcagcgggctggcgtcctgtgggatgtgccttctccccctcccgttgggaaagccgaactggaggacggagcgtatcgcatcaagcagagaggcattctcggctactcccaaatcggggctggagtgtataaagaaggcacctttcacacaatgtggcatgtcaccagaggggccgtgctgatgcaccgcggaaagagaatcgagccctcctgggccgatgtcaaaaaggaccttattagctacggcgggggatggaagctggagggcgaatggaaagagggcgaagaggtgcaggttctcgctctggaacctgggaagaatccgcgggccgtgcagacgaaacccggaatcttcaagaccaacacaggcaccattggggcggtctccctcgattttagccctggaacatctggctcccccatcgtggacagaaaagggaaggttgtgggactgtacggcaatggcgtcgtgacccgcagcggggcttatgtgtctgccattgcccagacagagaagtccatcgaggataaccctgaaatcgaggacgatattttccggaaaaagagacttacgatcatggacctgcatcccggagctggcaaaaccaagcgctacctgcctgccattgttcgggaagctatcaaaagagggctccgcacactgattcttgccccgacccgggtcgtggcggccgagatggaagaggctctgagaggactccccatccgctatcaaacccctgccattcgggctgagcacacaggcagagaaatcgtggacctgatgtgtcatgccacgttcaccatgcggctcctgagccccgtccgcgtgcctaactacaatcttatcattatggatgaggcccactttacagaccccgcttccatcgcggccagagggtatatttctacccgggttgaaatgggcgaggctgccggaatcttcatgacagccaccccgcctggcagccgcgatccctttccccagtccaacgctcctattatggacgaggaaagagagatccccgaacggagctggaactctgggcacgagtgggtgacggatttcaagggaaagacagtctggtttgtgccttccatcaaagccggcaatgacattgcggcttgcctgagaaagaatgggaaaaaggttatccagctgagccgcaaaaccttcgattctgaatacgtgaagacccgggccaacgactgggattttgtcgtgacaaccgacattagcgagatgggagccaatttcaaggctgagagagttatcgatccgcgccggtgtatgaaacccgtgattctcacagacggcgaagagagagtcatcctggccgggcctatgcccgtgacccattcctctgcggcccaacgccggggcagaatcggacgcaaccctaagaatgaaaacgaccagtatatttacatgggcgagccccttgaaaatgatgaggactgcgctcactggaaagaggccaagatgctgctcgataacatcaatacgccggaagggattatccctagcatgtttgagcccgaaagagagaaagtggacgctattgatggagaataccggctgcgcggcgaggccagaaagacattcgtcgacctgatgcggcgcggggatctccctgtttggcttgcttataaagtggccgcggagggaatcaactacgccgacagaaagtggtgttttgatggcattaagaataaccagatcctggaagagaacgtggaagtcgagatctggaccaaagagggggaacggaagaaactgaagcccagatggctcgacgctcgcatttattccgatcctctggcccttaaagagttcaaggagttcgctgccggccggaagtctctgacactcaatctgatcaccgagatgggaagactgcccacgtttatgacccagaaagcccgcaacgctctcgacaatcttgcggtgctgcatacagccgaagttggcgggcgggcttacacccacgccctgagcgagctcccggagacactggaaacccttctgctcctgacactgctcgccaccgtgacgggaggcattttcctttttctgatgtccgggaagggaatcggcaaaatgacactgggcatgtgctgcattatcaccgctagcatcctcctgtggtatgcccaaattcagcctcactggatcgcggcctctattatccttgagttctttctgattgtcctcctgatccccgaacccgagaagcagagaacccctcaggataaccaactgacatacgtggttatcgctattctcaccgtggtcgccgctacaatggccaatgaaatggggttccttgagaaaacgaagaaggacctgggatttggctccatcaccacacaggagagcgaatccaacattctggacatcgatctccggccggcgtctgcctggaccctgtatgctgtggccacaaccttcgtcacgcccatgcttcgccatagcattgaaaattcctctgtgaacgttagcctgaccgctatcgccaatcaggctacagtgctcatggggctgggaaaaggctggcctctgtccaagatggacattggggtgcccctccttgccatcggatgttacagccaggtcaaccctatcaccctgacagcggccctgctcctgcttgttgctcactacgccattatcggccccggcctgcaagctaaagccaccagagaagcccagaagcgggcggctgccgggattatgaaaaatcctacggtggatggaatcacagtgattgacctcgagccgatcccctatgatcctaagtttgaaaagcagctgggccaggtcatgctgctcatcctttgcgtgacccaagttctgatgatgcgcacaacctgggctctgtgtgaggccctcaccctggccacagggcccatttctacgctttgggagggaaaccctggcagattctggaataccacaatcgctgtgtccatggccaacatttttcgggggagctacctggcgggagccggcctcctgttctctatcatgaaaaataccacaaacacccgcagaggcacggggaatgtcggagaaacactgggcgagaagtggaaatcccggctcaacgctcttggaaagagcgaatttcagatttataaaaagtctggaatccaggaggtggaccgcaccctggccaaagagggcatcaagagaggggaaaccgatcatcacgctgtcagccggggatccgccaagctgagatggttcgtggagcgcaacatggttacacccgaaggcaaagtggtcgacctcggctgcgggcggggaggctggtcttactattgtgggggactgaagaatgtgagagaggttaaaggccttaccaaagggggaccgggccatgaggaacctattcccatgagcacatacggctggaacctggtgcgcctccaatccggggtcgatgtgttctttacgccccctgagaaatgcgacaccctgctgtgtgatatcggagaaagctcccccaatcctacaattgaggcgggccggaccctcagagtgcttaacctggttgaaaattggctgaacaataacacacagttctgcatcaaggtcctcaatccgtatatgccctctgtgattgagaagatggaaaccctgcagcgcaaatacgggggagcccttgtgcggaaccctctgagcagaaattccacgcacgagatgtactgggtctctaacgctaccggcaatatcgttagctccgtgaacatgatctctcgcatgctcattaatcggtttacaatgaagcacaaaaaggccacctatgagcccgacgtggatctggggagcggaacaagaaacatcggcattgaatccgagatccctaacctggacattatcggcaaacgcattgaaaagatcaagcaggagcatgaaaccagctggcactacgaccaagatcatccctataaaacatgggcttaccacgggtcttatgagaccaagcagacgggatccgccagctctatggtcaatggcgtggttcggctccttacaaaaccgtgggacgtggtccctatggtgacccagatggctatgaccgatacaacgcccttcgggcagcaaagagtttttaaggagaaagtggacacccgcacacaggaacctaaggagggaaccaagaaactgatgaagatcacagccgaatggctgtggaaagagctcggcaaggagaaaacccccagaatgtgtacacgggaagagttcacccgcaaggtcagatccaacgcggccctgggggctatttttacggatgaaaataaatggaaaagcgcccgggaggctgtggaagacggaagattctgggagcttgtggatcgggagcgcaacctgcacctcgaaggcaagtgcgagacctgtgtctacaatatgatgggcaaaagagaaaagaaactgggggagtttggaaaggccaaaggctctcgggccatctggtatatgtggctgggggcgcgcttcctcgaatttgaggctctgggattccttaacgaggaccattggttttccagaggcaatagcctgtccggggttgaaggcgagggactccaccggctgggctacattcttcgcgaagtggggaagaaggagggaggcgccatgtacgccgatgacacagctgggtgggataccagaatcacactggaagacctcaaaaacgaggagatggtgaccaatcatatgaagggagaacacaaaaagctggccgaggctattttcaaactgacgtatcagaacaaggtcgtgcgggttcagcgccctacacccagaggcaccgtgatggacatcatcagccggaaggatcaacgcgggtctggccaggtcggaacatacggcctcaataccttcacgaacatggaagcccagctgattagacaaatggagggggagggaatctttaaaagcattcagcatcttaccgcgacagaagagatcgccgtgcagaattggctggctcgggttggccgcgaaagactctcccggatggccatttctggggacgattgcgtggtcaagccgatcgacgatagattcgctagcgccctgaccgcgcttaacgacatgggaaaagtgcgcaaggatatccagcaatgggagccttcccggggctggaatgactggacacaggttcccttttgctctcaccacttccatgaactggtgatgaaagatgggagagtcctcgtggtcccctgtcgcaaccaggacgagctgattggccgggccagaatcagccagggagctggctggtccctgaaggagaccgcctgcctcgggaagtcttatgctcaaatgtggacactgatgtactttcaccgccgggatcttagactggccgctaacgccatttgtagcgcggtgccttcccattgggttccgaccagccgcacgacatggtctatccacgccaaacacgaatggatgaccaccgaggacatgctcgctgtgtggaatcgggtctggattcaggaaaacccctggatggaggataagacacctgtggaatcctgggaggaggtgccctatctgggaaaaagagaagaccagtggtgcggcagccttatcgggctgacctctcgcgccacatgggccaagaatattcagacggctatcaaccaagttcggtccctcatcggaaatgagggctacaccgactatatgcctagcatgaaaagattccggagagaagaggaagaggccggggtgctgtggtga

SEQ ID NO: 19693 - RNA, 9876 nt, synthetic construct
  misc_feature 1..9876: note = derived and/or modified CDS sequence (opt5) from DENV-2__JF730044__SS-prME
  source 1..9876: mol_type = other RNA
accgccggcgtgatcattatgctgatccccacagctatggccttccacctcacgaccagaaacggggagcctcatatgattgtcggacggcaggaaaagggcaaaagcctgctttttaagacagaggacggggttaatatgtgcaccctgatggcgatcgatctcggagaactgtgtgaggacacaattacctacaaatgcccgcttctgcgccaaaacgaacccgaggatatcgactgttggtgcaattccacatctacctgggtgacgtatggcacctgtacaaccacaggggagcacagacgggaaaagcgcagcgtggctctcgtccctcatgtgggaatgggcctggagaccagaacggaaacatggatgtcctctgagggcgcctggaaacacgttcagcggatcgagacctggattctgcgccatcccgggttcacaatcatggccgctattctcgcctacaccatcggaaccacacactttcagagagctctgattttcatccttctgacggccgtggcgcctagcatgaccatgcggtgcattggcatctccaaccgcgattttgtcgaaggggtgtctggaggcagctgggttgacatcgtgctcgagcacgggtcctgtgtcacaaccatggccaagaataagcccacactggatttcgaacttattaaaaccgaggctaaggaacctgccacgctgagaaaatattgcatcgaggctaagctcacaaacaccaccacagagagccggtgtccgacccagggagaaccctctctgaatgaggaacaagacaaacgctttgtgtgcaagcattccatggtggatagaggctggggcaacgggtgtggactgttcggcaaggggggaattgtcacatgcgccatgtttacgtgcaaaaagaatatggagggcaaaatcgttcagcctgaaaacctcgagtacaccattgtgatcacaccccacagcggggaggaacatgcggtgggaaatgacaccggcaagcacggcaaagagatcaagattacacctcagtcttccagcaccgaagccgagctgacggggtatggaaccgtcacaatggaatgttctccccggaccggccttgatttcaacgagatggtgctgctccagatggaggacaaagcttggctggttcaccgccaatggtttcttgatctgccgctcccttggctgcccggggccgacacacagggatccaattggatccagaaggaaaccctggtgacgttcaagaaccctcatgctaaaaagcaggacgtcgtggttctcggcagccaagagggggccatgcacacagccctgaccggcgctacagaaattcagatgtcctctggaaatcttctgtttaccggccatctcaaatgcagactgcggatggataagcttcagctgaaagggatgagctactccatgtgtaccggaaagttcaagatcgtgaaagagattgcggagacacaacacggcacgatcgtcatcagagtgcagtatgaaggggacggaagcccctgcaagattcccttcgagatcatggatctcgaaaaacgccatgtcctgggccggctgattaccgtgaaccctatcgttacagagaaggactctccggtgaacattgaagccgagcccccttttggggattcctacatcattatcggcgtcgagcccggacagctcaaactgaattggttcaagaagggcagctctatcgggcagatgtttgaaaccacaatgagaggagctaaacgcatggccattcttggcgacaccgcctgggatttcgggagcctgggaggcgtgtttacgtccatggggaaggctctccaccaagttttcggcgccatctacggagcggctttttctggcgtgagctggacaatgaaaattctgatcggggtcattatcacctggatcggaatgaactcccggagcacctctctgtccgtgagccttgtgctcgttggcgtcattacactgtatctgggggccatggtgcaggccgactctggatgtgtggtctcctggaagaataaagagctcaagtgcggcagcgggatcttcattaccgataacgtgcacacatggacggaacagtacaagtttcagcctgagtccccctctaaactggctagcgccatccaaaaggctcatgaagagggcatttgtggaatcagatccgttacccgccttgagaatctgatgtggaaacagatcacaccggaactcaaccacattctgtctgagaatgaagtgaagctgaccatcatgacaggcgacattaaagggatcatgcaggccggaaagcggagccttagacctcagcccaccgagctcaaatattcctggaagacgtggggcaaggcgaaaatgctgagcaccgaatctcataaccaaacattcctgattgatgggcctgagaccgccgagtgccccaatacaaaccgcgcttggaattccctcgaagtcgaggactacggatttggcgtgttcaccacaaacatctggctgaagcttcgggaaaaacaggacgttttttgtgatagcaagctgatgtctgccgctatcaaagacaatagagccgtgcacgcggatatgggctattggattgagtccgccctcaacgacacctggaagatggagaaggctagcttcatcgaagtcaaatcttgccactggcctaagagccatacgctgtggtccaatggggtgctggagagcgaaatgattatccccaaatctttcgccggaccggtttcccagcacaactaccgccctggctattacacacagaccgctgggccctggcatcttggaaagctcgagatggattttgacttctgtgaaggcaccacagtggtcgtgaccgaggattgcgggaaccggggacccagcctgagaacgacaaccgcctccggcaaactgattacagagtggtgctgtcggtcttgcaccctccctccgctgcgctacagaggcgaagacgggtgttggtatggaatggagatccggccccttaaggaaaaggaggaaaatctggtgaacagcctcgtcacagccggccacgggcaaattgataatttttccctgggagttctgggcatggctcttttcctcgaggagatgctgagaacccgcgtggggacgaaacatgcgatcctgctcgtggccgtctcttttgtgaccctgatcacaggaaacatgagcttccgggaccttggcagagttatggtgatggtcggcgctaccatgacagatgacattgggatgggagtgacctacctggccctcctggccgcttttaaggttcgccctacgttcgccgcgggcctgcttctgagaaaactcacatccaaggaactgatgatggctaccatcgggattgccctcctgtctcagagcacaatccccgagaccattcttgaactgaccgatgccctcgctctgggaatgatggtgctgaaaatcgtccggaatatggagaagtatcagcttgccgtgacaatcatggcgatttcctgcgttcctaacgctgtgatcctgcaaaatgcctggaaggtcagctgtacgattctcgccgctgtgtctgtgtcccccctgctcctgaccagctctcagcagaaagccgactggatccctcttgctctgacaattaagggcctcaaccccaccgccatctttctgacaaccctgtcccgcacgagcaaaaagagatcttggccgcttaatgaagcgatcatggccgtcgggatggtttccattctggctagctccctcctgaaaaacgacatccctatgacaggacccctcgtggccggcggcctgcttaccgtgtgctacgtcctgaccgggcggagcgctgatctggagctcgagcgcgccacagacgtgaagtgggaagatcaggccgagatttctggaagctcccctatcctgtctattaccatcagcgaagacggctccatgtctattaaaaatgaggaggaagagcaaacacttacgatcctgatcagaaccgggctcctggttattagcggactcttccccgtgtccatcccgattacagctgcggcctggtatctgtgggaagtcaagaagcagcgggctggcgtgctttgggatgttccttctccccctcccgtggggaaagccgagctggaagacggagcctaccgcatcaagcagaaaggcattctgggctatagccagatcggggctggagtctacaaggagggcacctttcacacaatgtggcacgtgaccagaggggccgtcctcatgcatcggggaaaacgcatcgagccctcctgggcggatgtgaagaaggacctgattagctacggcgggggatggaaacttgaaggcgagtggaaggaaggcgaggaagttcaagtgctggctctcgagcctgggaaaaacccgagagccgtccagacgaagcccggactgttcaaaaccaatacaggcaccatcggggccgtgtctctcgatttttcccctggaacaagcggctctcccattgttgaccggaaggggaaggtggtcggactgtatggcaacggcgtggtgaccagatccggggcttacgttagcgccatcgcgcagacagagaaatccattgaagataatcctgagatcgaagacgatatcttccgcaagaaacggcttacgattatggacctgcaccccggagctggcaagaccaaaagatatctgcctgccatcgtccgcgaggccattaagcgggggctcagaacactgatccttgctccgacccgcgtggtggccgctgaaatggaggaggccctgcggggactccccattagataccagacccctgcgatccgcgccgaacatacaggccgggagattgtcgacctgatgtgtcacgctacgttcaccatgagactcctgtctcccgtgcgggttcctaactataaccttatcatcatggatgaagcccattttacagaccccgctagcattgccgcccgcgggtacatctccaccagagtggagatgggcgaggctgcgggaattttcatgacagccaccccgcctggcagccgggatccctttccccaatctaatgctcctatcatggacgaagagcgcgaaattcccgagagatcctggaacagcgggcacgaatgggtcacggatttcaagggaaaaacagtgtggtttgttccttctatcaaggccggcaatgacatcgccgcttgcctgcggaaaaacgggaagaaagtgattcagctgagcagaaagaccttcgattccgagtatgtcaagacccgcacaaatgactgggattttgtggttaccacagacatctctgagatgggagccaacttcaaagcggaacgggtgattgatccgagacgctgtatgaagcccgtcatcctcaccgacggcgaggaacgggtgattctggctgggcctatgcccgtgacgcacagctccgccgcccagagacgcggccggatcggaagaaatcctaaaaacgagaatgaccaatacatctacatgggcgaaccccttgagaacgatgaggactgcgctcattggaaggaagccaaaatgctgctcgataatattaacacaccggaggggatcattccttctatgtttgaacccgagcgcgaaaaggtcgacgcgatcgatggagagtatagactgcggggcgaggcccgcaaaaccttcgttgacctgatgagacggggggatctccctgtgtggcttgcttaccgcgtggccgctgaaggaattaattatgccgacagacggtggtgttttgatggcgtcaagaacaatcagatcctggaggaaaacgtggaggttgagatttggacaaaggaaggggagagaaaaaagctgaaaccccgctggctcgacgctcggatctacagcgatcctctggcccttaaggaattcaaagagttcgcggccggcagaaagtccctgaccctcaacctgatcacggaaatgggacgcctgcccacctttatgacacagaaggctcgggacgccctcgataatcttgctgtgctgcacaccgccgaggccggcgggagagcttataaccatgcgctgagcgagctcccggaaacactggagacccttctgctcctgacactgctcgccaccgtcacgggaggcattttcctttttctgatgtctgggaaaggagtgggcaagatgacactgggcatgtgctgcatcattaccgcttccatcctcctgtggtacgcccagattcaacctcactggatcgccgctagcatcattcttgaattctttctgatcgttctcctgattcccgagcccgaaaaacagcggacccctcaggacaatcagctgacatatgtggtcatcgccattctcaccgtggtcgcggccacaatggctaacgagatggggttccttgagaagacgaaaaaggacctgggactgggctccatcgccacccaagaaccggagtctaatatcctcgatattgacctgcgccccgctagcgcctggacactttacgcggtggccaccacatttgttacccctatgctgagacactccatcgaaaactctagcgtgaatgtgtccctcacggctattgccaaccaggctaccgtcctgatggggctgggaaagggctggcccctcagcaaaatggatatcggggttcctcttctggccattggatgttactctcaggtgaatcccgtgacactgaccgctgccctcctgcttctggtcgcgcattatgccatcattggccctggcctccaggctaaggccacacgggaggctcaaaaacgcgccgccgcggggatcatgaagaacccgaccgtggacggaatcacggttattgatctggaccccatcccttacgatcccaaattcgaaaagcagctgggccaggtgatgctccttattctgtgcgtcacacaggtgctgatgatgagaaccacatgggctctctgtgaggccctgacccttgctaccgggcctatctccacactgtgggagggaaatcccggccggttttggaacacgaccattgccgtcagcatggccaatatcttccgcgggtcttatctcgctggagccggcctgctgttttccatcatgaagaacacaaccaatacaagacggggcaccgggaacattggagaaacgctcggcgagaaatggaagagccgccttaatgcgctggggaaatctgaattccaaatctacaagaaaagcggaattcaggaggtggacagaacactggccaaggagggcatcaaacggggggaaaccgatcaccatgctgtttccagaggatctgccaagctccgctggtttgtggagcggaacatggtcaccccggaaggcaaggtggttgacctgggctgcgggagaggaggctggagctattactgtgggggacttaaaaacgtgaaggaggtcaaaggcctgacaaaggggggacctggccacgaagagcccattcccatgtccacctatggctggaatctcgtgcgcctgcagagcggggtggatgttttcttcacacctcccgagaaatgcgacacgctgctctgtgatatcggagaatcctctcctaacccgaccatcgaggctggccggacacttagagtcctgagcctggtggaaaattggctcaacaatgacacccaattttgcattaaggtgctgaacccctacatgccttccgtcatcgagaagatggaaacacttcagcgcaaatacgggggagccctggttcggaatcccctctctagaaacagcacccatgagatgtattgggtgtccaatgcgacgggcaacattgtgtctagcgtcaatatgatctcccgcatgctgattaaccggttcaccatgaagcacaaaaaggccacatacgagcctgacgtggatctggggagcggaaccagaaatatcggcatcgaatctgagattcccaacctcgacatcattggcaaacgcatcgaaaagattaagcaggagcacgaaacatcctggcattatgatcaggaccacccgtacaaaacctgggcttatcatgggagctacgagacaaagcaaaccggatctgcctccagcatggttaatggcgtggtccggcttctgacgaaaccttgggatgtggttcccatggtgacacagatggctatgaccgacaccacaccttttgggcagcagagagtcttcaaggagaaagtggatacgcgcacccaagaacccaaggagggaacaaagaaactgatgaagatcaccgccgaatggctctggaaagagctgggcaagaaaaagacacctagaatgtgtacccgggaggaatttacacgcaaagtgagatctaacgctgcccttggggcgattttcaccgacgagaacaagtggaagtccgcccgggaagctgtcgaggatagcagattttgggaactggttgacaaagagcggaatctccacctggagggaaagtgcgaaacgtgtgtgtataacatgatgggcaaacgcgagaagaaactgggcgaattcgggaaggccaagggatccagagctatctggtacatgtggctcggcgcccggtttctggagttcgaagcccttgggtttctgaatgaggatcactggttcagccgcgagaactctctcagcggagtggaaggcgaggggctgcataaacttggctacatcctgagagacgtcggaaagaaagaaggcggggcgatgtatgctgacgataccgccggatgggacacacggattaccctcgaggatctgaagaatgaagagatggtgacaaaccacatggagggcgaacataaaaagctggccgaggctatctttaagctcacctaccagaataaagttgtgcgcgtccagagacccacgccgcgggggacagtgatggacattatctcccgcagagatcagcggggatctggccaagttgggacctatggcctgaacacattcaccaatatggaagcccagcttattcgccagatggagggagagggcatcttcaagagcatccaacacctgacggctaccgaagagattgccgtgcagaactggctcgcgagagtcgggcgggaacgcctgtccagaatggccatctctggagacgattgcgtggttaaacctcttgacgatcggtttgctagcgccctgacagctctcaatgacatgggcaaggtgagaaaagatattcagcagtgggagccctcccgcgggtggaacgactggacccaagtccccttctgctctcatcactttcacgaactgatcatgaaggatggacgggtgctggtcgtgccttgtagaaatcaggacgagctcattggccgcgcccggatcagccagggggcgggctggtccctgaaggagacagcctgccttggaaaaagctacgctcagatgtggtctctgatgtatttccatagacgcgacctccggctggccgctaacgccatctgttccgctgttccgagccactgggtgcccacctctagaacaacctggtccattcatgccaagcacgaatggatgacgacagaggatatgcttaccgtctggaatcgcgtgtggatccaagaaaacccttggatggaggacaaaacccccgtggaaagctgggaggaggttccttacctgggcaagcgggaagatcagtggtgcgggtccctcattggactgacatctagagcgacctgggccaaaaacatccagacagctattaatcaggtgcgcagcctgatcggcaacgaggaatatacggactacatgccctccatgaagcggtttagacgggaggaagaggaggccggggtcctctggtga

SEQ ID NO: 19694 - RNA, 9876 nt, synthetic construct
  misc_feature 1..9876: note = derived and/or modified CDS sequence (opt5) from DENV-2__FJ639697__SS-prME
  source 1..9876: mol_type = other RNA
accgccggcgtgatcattatgctgatccccacagctatggccttccacctcacgaccagaaacggggagcctcatatgattgtcggacggcaggaaaagggcaaaagcctgctttttaagacagaggacggggttaatatgtgcaccctgatggcgatcgatctcggagaactgtgtgaggacacaattacctacaaatgcccgcttctgcgccaaaacgaacccgaggatatcgactgttggtgcaattccacatctacctgggtgacgtatggcacctgtacaaccacaggggagcacagacgggaaaagcgcagcgtggctctcgtccctcatgtgggaatgggcctggagaccagaacggaaacatggatgtcctctgagggcgcctggaaacacgttcagcggatcgagacctggattctgcgccatcccgggttcacaatcatggccgctattctcgcctacaccatcggaaccacacactttcagagagctctgattttcatccttctgacggccgtggcgcctagcatgaccatgcggtgcattggcatctccaaccgcgattttgtcgaaggggtgtctggaggcagctgggttgacatcgtgctcgagcacgggtcctgtgtcacaaccatggccaagaataagcccacactggatttcgaacttattaaaaccgaggctaaggaacctgccacgctgagaaaatattgcatcgaggctaagctcacaaacaccaccacagagagccggtgtccgacccagggagaaccctctctgaatgaggaacaagacaaacgctttgtgtgcaagcattccatggtggatagaggctggggcaacgggtgtggactgttcggcaaggggggaattgtcacatgcgccatgtttacgtgcaaaaagaatatggagggcaaaatcgttcagcctgaaaacctcgagtacaccattgtgatcacaccccacagcggggaggaacatgcggtgggaaatgacaccggcaagcacggcaaagagatcaagattacacctcagtcttccagcaccgaagccgagctgacggggtatggaaccgtcacaatggaatgttctccccggaccggccttgatttcaacgagatggtgctgctccagatggaggacaaagcttggctggttcaccgccaatggtttcttgatctgccgctcccttggctgcccggggccgacacacagggatccaattggatccagaaggaaaccctggtgacgttcaagaaccctcatgctaaaaagcaggacgtcgtggttctcggcagccaagagggggccatgcacacagccctgaccggcgctacagaaattcagatgtcctctggaaatcttctgtttaccggccatctcaaatgcagactgcggatggataagcttcagctgaaagggatgagctactccatgtgtaccggaaagttcaagatcgtgaaagagattgcggagacacaacacggcacgatcgtcatcagagtgcagtatgaaggggacggaagcccctgcaagattcccttcgagatcatggatctcgaaaaacgccatgtcctgggccggctgattaccgtgaaccctatcgttacagagaaggactctccggtgaacattgaagccgagcccccttttggggattcctacatcattatcggcgtcgagcccggacagctcaaactgaattggttcaagaagggcagctctatcgggcagatgtttgaaaccacaatgagaggagctaaacgcatggccattcttggcgacaccgcctgggatttcgggagcctgggaggcgtgtttacgtccatggggaaggctctccaccaagttttcggcgccatctacggagcggctttttctggcgtgagctggacaatgaaaattctgatcggggtcattatcacctggatcggaatgaactcccggagcacctctctgtccgtgagccttgtgctcgttggcgtcattacactgtatctgggggccatggtgcaggccgactctggatgtgtggtctcctggaagaataaagagctcaagtgcggcagcgggatcttcattaccgataacgtgcacacatggacggaacagtacaagtttcagcctgagtccccctctaaactggctagcgccatccaaaaggctcatgaagagggcatttgtggaatcagatccgttacccgccttgagaatctgatgtggaaacagatcacaccggaactcaaccacattctgtctgagaatgaagtgaagctgaccatcatgacaggcgacattaaagggatcatgcaggccggaaagcggagccttagacctcagcccaccgagctcaaatattcctggaagacgtggggcaaggcgaaaatgctgagcaccgaatctcataaccaaacattcctgattgatgggcctgagaccgccgagtgccccaatacaaaccgcgcttggaattccctcgaagtcgaggactacggatttggcgtgttcaccacaaacatctggctgaagcttcgggaaaaacaggacgttttttgtgatagcaagctgatgtctgccgctatcaaagacaatagagccgtgcacgcggatatgggctattggattgagtccgccctcaacgacacctggaagatggagaaggctagcttcatcgaagtcaaatcttgccactggcctaagagccatacgctgtggtccaatggggtgctggagagcgaaatgattatccccaaatctttcgccggaccggtttcccagcacaactaccgccctggctattacacacagaccgctgggccctggcatcttggaaagctcgagatggattttgacttctgtgaaggcaccacagtggtcgtgaccgaggattgcgggaaccggggacccagcctgagaacgacaaccgcctccggcaaactgattacagagtggtgctgtcggtcttgcaccctccctccgctgcgctacagaggcgaagacgggtgttggtatggaatggagatccggccccttaaggaaaaggaggaaaatctggtgaacagcctcgtcacagccggccacgggcaaattgataatttttccctgggagttctgggcatggctcttttcctcgaggagatgctgagaacccgcgtggggacgaaacatgcgatcctgctcgtggccgtctcttttgtgaccctgatcacaggaaacatgagcttccgggaccttggcagagttatggtgatggtcggcgctaccatgacagatgacattgggatgggagtgacctacctggccctcctggccgcttttaaggttcgccctacgttcgccgcgggcctgcttctgagaaaactcacatccaaggaactgatgatggctaccatcgggattgccctcctgtctcagagcacaatccccgagaccattcttgaactgaccgatgccctcgctctgggaatgatggtgctgaaaatcgtccggaatatggagaagtatcagcttgccgtgacaatcatggcgatttcctgcgttcctaacgctgtgatcctgcaaaatgcctggaaggtcagctgtacgattctcgccgctgtgtctgtgtcccccctgctcctgaccagctctcagcagaaagccgactggatccctcttgctctgacaattaagggcctcaaccccaccgccatctttctgacaaccctgtcccgcacgagcaaaaagagatcttggccgcttaatgaagcgatcatggccgtcgggatggtttccattctggctagctccctcctgaaaaacgacatccctatgacaggacccctcgtggccggcggcctgcttaccgtgtgctacgtcctgaccgggcggagcgctgatctggagctcgagcgcgccacagacgtgaagtgggaagatcaggccgagatttctggaagctcccctatcctgtctattaccatcagcgaagacggctccatgtctattaaaaatgaggaggaagagcaaacacttacgatcctgatcagaaccgggctcctggttattagcggactcttccccgtgtccatcccgattacagctgcggcctggtatctgtgggaagtcaagaagcagcgggctggcgtgctttgggatgttccttctccccctcccgtggggaaagccgagctggaagacggagcctaccgcatcaagcagaaaggcattctgggctatagccagatcggggctggagtctacaaggagggcacctttcacacaatgtggcacgtgaccagaggggccgtcctcatgcatcggggaaaacgcatcgagccctcctgggcggatgtgaagaaggacctgattagctacggcgggggatggaaacttgaaggcgagtggaaggaaggcgaggaagttcaagtgctggctctcgagcctgggaaaaacccgagagccgtccagacgaagcccggactgttcaaaaccaatacaggcaccatcggggccgtgtctctcgatttttcccctggaacaagcggctctcccattgttgaccggaaggggaaggtggtcggactgtatggcaacggcgtggtgaccagatccggggcttacgttagcgccatcgcgcagacagagaaatccattgaagataatcctgagatcgaagacgatatcttccgcaagaaacggcttacgattatggacctgcaccccggagctggcaagaccaaaagatatctgcctgccatcgtccgcgaggccattaagcgggggctcagaacactgatccttgctccgacccgcgtggtggccgctgaaatggaggaggccctgcggggactccccattagataccagacccctgcgatccgcgccgaacatacaggccgggagattgtcgacctgatgtgtcacgctacgttcaccatgagactcctgtctcccgtgcgggttcctaactataaccttatcatcatggatgaagcccattttacagaccccgctagcattgccgcccgcgggtacatctccaccagagtggagatgggcgaggctgcgggaattttcatgacagccaccccgcctggcagccgggatccctttccccaatctaatgctcctatcatggacgaagagcgcgaaattcccgagagatcctggaacagcgggcacgaatgggtcacggatttcaagggaaaaacagtgtggtttgttccttctatcaaggccggcaatgacatcgccgcttgcctgcggaaaaacgggaagaaagtgattcagctgagcagaaagaccttcgattccgagtatgtcaagacccgcacaaatgactgggattttgtggttaccacagacatctctgagatgggagccaacttcaaagcggaacgggtgattgatccgagacgctgtatgaagcccgtcatcctcaccgacggcgaggaacgggtgattctggctgggcctatgcccgtgacgcacagctccgccgcccagagacgcggccggatcggaagaaatcctaaaaacgagaatgaccaatacatctacatgggcgaaccccttgagaacgatgaggactgcgctcattggaaggaagccaaaatgctgctcgataatattaacacaccggaggggatcattccttctatgtttgaacccgagcgcgaaaaggtcgacgcgatcgatggagagtatagactgcggggcgaggcccgcaaaaccttcgttgacctgatgagacggggggatctccctgtgtggcttgcttaccgcgtggccgctgaaggaattaattatgccgacagacggtggtgttttgatggcgtcaagaacaatcagatcctggaggaaaacgtggaggttgagatttggacaaaggaaggggagagaaaaaagctgaaaccccgctggctcgacgctcggatctacagcgatcctctggcccttaaggaattcaaagagttcgcggccggcagaaagtccctgaccctcaacctgatcacggaaatgggacgcctgcccacctttatgacacagaaggctcgggacgccctcgataatcttgctgtgctgcacaccgccgaggccggcgggagagcttataaccatgcgctgagcgagctcccggaaacactggagacccttctgctcctgacactgctcgccaccgtcacgggaggcattttcctttttctgatgtctgggaaaggagtgggcaagatgacactgggcatgtgctgcatcattaccgcttccatcctcctgtggtacgcccagattcaacctcactggatcgccgctagcatcattcttgaattctttctgatcgttctcctgattcccgagcccgaaaaacagcggacccctcaggacaatcagctgacatatgtggtcatcgccattctcaccgtggtcgcggccacaatggctaacgagatggggttccttgagaagacgaaaaaggacctgggactgggctccatcgccacccaagaaccggagtctaatatcctcgatattgacctgcgccccgctagcgcctggacactttacgcggtggccaccacatttgttacccctatgctgagacactccatcgaaaactctagcgtgaatgtgtccctcacggctattgccaaccaggctaccgtcctgatggggctgggaaagggctggcccctcagcaaaatggatatcggggttcctcttctggccattggatgttactctcaggtgaatcccgtgacactgaccgctgccctcctgcttctggtcgcgcattatgccatcattggccctggcctccaggctaaggccacacgggaggctcaaaaacgcgccgccgcggggatcatgaagaacccgaccgtggacggaatcacggttattgatctggaccccatcccttacgatcccaaattcgaaaagcagctgggccaggtgatgctccttattctgtgcgtcacacaggtgctgatgatgagaaccacatgggctctctgtgaggccctgacccttgctaccgggcctatctccacactgtgggagggaaatcccggccggttttggaacacgaccattgccgtcagcatggccaatatcttccgcgggtcttatctcgctggagccggcctgctgttttccatcatgaagaacacaaccaatacaagacggggcaccgggaacattggagaaacgctcggcgagaaatggaagagccgccttaatgcgctggggaaatctgaattccaaatctacaagaaaagcggaattcaggaggtggacagaacactggccaaggagggcatcaaacggggggaaaccgatcaccatgctgtttccagaggatctgccaagctccgctggtttgtggagcggaacatggtcaccccggaaggcaaggtggttgacctgggctgcgggagaggaggctggagctattactgtgggggacttaaaaacgtgaaggaggtcaaaggcctgacaaaggggggacctggccacgaagagcccattcccatgtccacctatggctggaatctcgtgcgcctgcagagcggggtggatgttttcttcacacctcccgagaaatgcgacacgctgctctgtgatatcggagaatcctctcctaacccgaccatcgaggctggccggacacttagagtcctgagcctggtggaaaattggctcaacaatgacacccaattttgcattaaggtgctgaacccctacatgccttccgtcatcgagaagatggaaacacttcagcgcaaatacgggggagccctggttcggaatcccctctctagaaacagcacccatgagatgtattgggtgtccaatgcgacgggcaacattgtgtctagcgtcaatatgatctcccgcatgctgattaaccggttcaccatgaagcacaaaaaggccacatacgagctggacgtggatctcgggagcggaaccagaaatatcggcatcgaatctgagattcctaaccttgacatcattggcaaacgcatcgaaaagattaagcaggagcacgaaacatcctggcattatgatcaggaccacccctacaaaacctgggcttatcatgggagctacgagacaaagcaaaccggatctgcctccagcatggttaatggcgtggtccggctgctgacgaaaccgtgggatgtggttcctatggtgacacagatggctatgaccgacaccacaccctttgggcagcagagagtcttcaaggagaaagtggatacgcgcacccaagaacctaaggagggaacaaagaaactcatgaagatcaccgccgaatggctgtggaaagagcttggcaagaaaaagacacccagaatgtgtacccgggaggaatttacacgcaaagtgagatctaacgctgccctgggggcgattttcaccgacgagaacaagtggaagtccgcccgggaagctgtcgaggatagcagattttgggaactcgttgacaaagagcggaatctgcacctggagggaaagtgcgaaacgtgtgtgtataacatgatgggcaaacgcgagaagaaactcggcgaattcgggaaggccaagggatccagagctatctggtacatgtggctgggcgcccggtttcttgagttcgaagccctggggtttctcaatgaggatcactggttcagccgcgagaactctctgagcggagtggaaggcgaggggcttcataaactgggctacatcctcagagacgtcggaaagaaagaaggcggggcgatgtatgctgacgataccgccggatgggacacacggattaccctggaggatctgaagaatgaagagatggtgacaaaccacatggagggcgaacataaaaagctcgccgaggctatctttaagctgacctaccagaataaagttgtgcgcgtccagagacctacgccccgggggacagtgatggacattatctcccgcagagatcagcggggatctggccaagttgggacctatggccttaacacattcaccaatatggaagcccagctgattcgccagatggagggagagggcatcttcaagagcatccaacacctcacggtgaccgaagagattgctgtccagaactggctggccagagtggggcgggaacgcctttccagaatggcgatctctggagacgattgcgttgtgaaaccgctggacgatcggtttgccagcgctctcacagccctgaatgacatgggcaaggtcagaaaagatattcagcagtgggagccttcccgcgggtggaacgactggacccaagtgcccttctgctctcatcactttcacgaactgatcatgaaggatggacgggtcctcgtggttccctgtagaaatcaggacgagctgattggccgcgctcggatcagccagggggccggctggtcccttaaggagacagcgtgcctgggaaaaagctacgcccagatgtggtctctcatgtatttccatagacgcgacctgcggcttgctgccaacgctatctgttccgccgtgcctagccactgggtcccgacctctagaacaacctggtccattcatgctaagcacgaatggatgacgacagaggatatgctgaccgtgtggaatcgcgtgtggatccaagaaaacccctggatggaggacaaaacccctgttgaaagctgggaggaggtgccctacctcggcaagcgggaagatcagtggtgcgggtccctgattggactgacatctagaaccacatgggccaaaaacatccagacggcgattaatcaggtccgcagcctcatcggcaacgaggaatataccgactacatgccttccatgaagcggtttagacgggaggaagaggaggccggggtgctgtggtga

SEQ ID NO: 19695 - RNA, 9876 nt, synthetic construct
  misc_feature 1..9876: note = derived and/or modified CDS sequence (opt5) from DENV-2__FJ639698__SS-prME
  source 1..9876: mol_type = other RNA
accgccggagtgatcattatgctgatccccaccgctatggccttccacctcacgacccggaatggggagcctcatatgattgtcggacggcaggaaaagggcaagagcctgctttttaagacggaggacggggttaatatgtgcaccctgatggcgatcgatctcggagaactgtgtgaggacacaattacctacaagtgcccccttctgagacaaaacgaacccgaggatatcgactgttggtgcaattccacatctacctgggtgacgtatggcacctgtacaaccacaggggagcacagacgggaaaagcgcagcgtggctctcgtccctcatgtgggaatgggcctggagaccagaacggaaacatggatgtcctctgagggcgcctggaagcacgcccagcggatcgagacctggattctgcgccatcccgggttcacaatcatggctgccattctcgcttacaccatcggaaccacacactttcagagagccctgattttcatccttctgacggcggttgcccctagcatgaccatgcggtgcattggcatctccaaccgcgattttgtggaaggggtctctggaggcagctgggtggacatcgttctcgagcacgggtcctgtgtgacaaccatggctaagaataagcccacactggatttcgaacttattaaaaccgaggccaaggaacctgctacgctgagaaaatattgcatcgaggccaagctcacaaacaccaccacagagagccggtgtccgacccagggagaaccctctctgaatgaggaacaagacaaacgctttgtctgcaagcattccatggtggatagaggctggggcaacgggtgtggactgttcggcaaaggcgggattgtgacatgcgcgatgtttagctgcaaaaagaatatggaggggaaaatcgtccagcctgaaaacctcgagtacacgattgttatcacaccccactctggggaggaacatgccgtgggaaatgacacaggcaagcacggcaaagagatcaagattacccctcagtccagcatcacagaagctgagctgaccgggtatggaacggtgaccatggaatgttctccccggacaggccttgatttcaacgagatggtcctgctccagatggaggacaaagcctggctggtgcaccgccaatggtttcttgatctgccgctcccttggctgcccggggctgacacccagggatccaattggattcagaaggaaacactggttaccttcaagaaccctcatgccaaaaagcaggacgtggtcgtgctcggcagccaagagggggccatgcacacggctctgacaggcgcgaccgaaatccagatgtcctctggaaatcttctgtttacaggccatctcaaatgcagactgcggatggataaacttcagctgaaagggatgagctactccatgtgtaccggaaagttcaagattgttaaagagatcgccgagacccaacacggcacaatcgtgattagagtccagtatgaaggggacggaagcccctgcaagatccccttcgagattatggatctcgaaaaacgccatgtgctgggccggctgatcacggtcaaccctattatcaccgagaaggactctccggtgaacattgaagctgagcccccttttggggattcctacatcatcattggcgttgagcccggacagctcaaactgaattggttcaagaagggcagctctatcgggcagatgtttgaaacaaccatgagaggagccaaacgcatggccattcttggcgacacagcttgggatttcgggagcctgggaggcgtgtttacctccatcgggaaggccctccaccaagtcttcggcgcgatttacggagctgccttttctggcgtgagctggacgatgaaaatcctgatcggggttattatcacatggattggaatgaactcccggagcacctctctgtccgtgagccttgtcctcgtgggcgtgatcaccctgtatctgggggccatggttcaggctgactctggatgtgtcgtgtcctggaagaataaagagctcaagtgcggcagcgggattttcatcacagataacgtgcacacctggacagaacagtacaagtttcagcctgagtccccctctaaactggccagcgctatccaaaaggcccatgaagagggcatttgtggaatcagatccgtcacgcgccttgagaatctgatgtggaaacagattaccccggaactcaaccacatcctgtctgagaatgaagtgaagctgacaattatgaccggcgacatcaaagggatcatgcaggcgggaaagcggagccttagacctcagcccacagagctcaaatattcctggaagacctggggcaaggccaaaatgctgagcacggaatctcataaccaaaccttcctgattgatgggcctgagacagctgagtgccccaataccaaccgcgcctggaactccctcgaagttgaggactacggatttggcgtgttcacaaccaacatctggctgaaacttaaagaaaagcaggacgtcttttgtgatcctaaactgatgagcgctgccattaaggacaatcgggcggtgcacgccgatatgggctattggatcgagtctgctctcaacgacacatggaagatggagaaagcctccttcattgaagttaagagctgccactggcccaaatctcataccctgtggagcaatggggtgctggagtccgaaatgatcattccgaagggattcgctggccctgtcagccagcacaactacagacccgggtattacacgcagacagccggaccctggcatcttggcaaactcgagatggattttgacttctgtgaagggaccaccgtggttgtgacagaggattgcggaaaccgcggcccttctctgcggaccacgacagcctccggcaagctgatcaccgagtggtgctgtagaagctgcacactcccgcccctgcggtaccgcggggaagacggatgttggtatggcatggagatcagacctcttaaggaaaaagaggaaaatctggtcaactccctcgtgaccgctgggcacggacaaattgataatttttctctgggcgtgctggggatggcgcttttcctcgaggagatgctgcggacaagagtcggaaccaagcatgccatcctgctcgttgctgtgagctttgtgacgctgattaccggcaacatgtccttccgcgaccttggccgggtcatggtgatggttggggccacaatgaccgatgacatcggaatgggcgtgacatacctggccctcctggctgcctttaaagtcagacccaccttctctgcggggctgcttctgcgcaagctcacgagcaaagaactgatgatggctacaattggaatcgccctcctgtcccagtctaccatccctgagacaattcttgaactgaccgatgccctcgctctgggcatgatggtgctgaagatcgttagaaatatggagaagtatcagcttgccgtgaccattatggcgatcagctgcgtccccaacgctgtgattctgcaaaatgcctggaaagtttcctgtacaatcctcgccgctgtgagcgtctctcctctgctcctgacgtccagccagcagaaggccgactggatcccccttgctctgaccattaaagggctcaacccgacagccatctttctgaccacactgtctcggacctccaagaaacgcagctggcctcttaatgaagcgattatggccgtgggaatggtgtctatcctggcttccagcctcctgaagaacgacattcccatgacgggccctctcgtcgccggcgggctgcttacagtttgctacgtgctgaccggaagatccgctgatctggagctcgagcgggccaccgacgtgaaatgggaagatcaggccgagatcagcggctctagccccattctgtccatcacaatctctgaagacgggagcatgtccattaagaatgaggaggaggaacaaacccttacaatcctgattcgcacgggactcctggtcatctctggcctcttcccggtgagcattcctatcaccgctgcggcctggtatctgtgggaagttaagaaacagagagctggggtgctttgggatgtcccctcccctccgcccgtgggaaaggccgagctggaagacggcgcctaccggatcaaacagaagggcattctggggtattctcagatcggagctggcgtttacaaagaggggacatttcacaccatgtggcacgtgacacgcggagccgtcctcatgcatagaggcaagcggattgagcctagctgggcggatgtgaagaaagacctgatctcctacgggggaggctggaaacttgaaggcgagtggaaagaaggggaggaagtccaagtgctggctctcgagccgggaaagaacccccgcgccgttcagaccaaacctggcctgttcaagacgaataccgggacaattggagccgtgagcctcgatttttctcccggcacctccgggagccctatcgtcgacagaaagggaaaagtggttggcctgtatggcaacggggtggtcacacggtctggagcttacgtgtccgccatcgcgcagaccgaaaagagcattgaagataatcccgagatcgaagacgatattttccgcaagaagcgccttacaatcatggacctgcaccctggcgctgggaaaacgaagcggtatctgccggccattgtgagagaggccatcaagcgcggactccggaccctgattcttgctcccacaagagttgtcgccgctgaaatggaggaggccctgcgcggcctccctatccggtaccagacccccgcgatcagagccgaacataccgggcgcgagattgtggacctgatgtgtcacgctacattcacgatgcggctcctgtcccctgtgagagtccccaactataaccttatcattatggatgaagcccattttaccgacccggcttctatcgccgcccggggctacattagcacacgcgtggagatgggagaggctgcgggcatcttcatgaccgccacacctcccgggtccagagatccctttcctcaaagcaatgctcccatcatggacgaagaacgggaaattcctgagcgctcttggaactccggacacgaatgggttaccgatttcaaaggcaagacggtgtggtttgtcccgagcatcaaagccgggaatgacattgccgcttgcctgagaaagaacggcaagaaggtgatccagctgtctcggaagacattcgatagcgagtatgttaaaaccagaaccaatgactgggattttgtggtcacaaccgacatttccgagatgggcgccaacttcaaggcggaacgcgtgatcgatccccggagatgtatgaaacctgttatcctcacagacggggaggaacgcgtgattctggctggccccatgcctgtcacccactctagcgccgcccagcggagaggacgcatcggccggaatcccaagaacgagaatgaccaatacatttacatgggggaaccgcttgagaacgatgaggactgcgctcattggaaagaagccaagatgctgctcgataatatcaacacgcctgagggaattatcccctccatgtttgaacctgagagagaaaaagtggacgcgattgatggcgagtatcgcctgagaggggaggcccggaagacattcgtggacctgatgcgcagaggagatctccccgtctggcttgcttaccgggttgccgctgaaggcatcaattatgccgaccgcagatggtgttttgatggggtgaagaacaatcagatcctggaggaaaacgtggaggtcgagatttggaccaaagaaggcgagcggaagaaactgaagcctagatggctcgacgctcgcatctactctgatcccctggcccttaaagagttcaaggagttcgcggccggaagaaagagcctgacactcaacctgattaccgaaatgggcagactgccgacgtttatgacccagaaagctcgcgacgccctcgataatcttgctgtgctgcacacagccgaggttgggggacgggcctataaccatgctctgtccgagctccctgaaaccctggagacacttctgctcctgaccctgctcgcgacagtgaccggcgggatcttcctttttctgatgagcggaaagggcgtcggcaaaatgacgctggggatgtgctgcattatcacagcctctatcctcctgtggtacgctcagattcaaccccactggatcgccgcctccattatccttgagttctttctgattgtgctcctgatccccgagcctgaaaagcagagaaccccgcaggacaatcagctgacctatgttgtgatcgctattctcacagtcgtggccgcgaccatggccaacgagatgggattccttgagaaaacaaagaaggacctgggcctggggagcatcgctacgcaagaacccgagtccaatattctcgatatcgacctgcggcctgcctctgcttggaccctttacgccgtcgcgacaacctttgtgacacccatgctgcgccacagcattgaaaactcctctgttaatgtgagcctcaccgccatcgctaaccaggccacggtgctgatgggactgggcaaagggtggcctctctccaagatggatattggagtcccccttctggctatcggctgttacagccaggttaatcctatcaccctgacagccgctctcctgcttctggtggcccattatgcgattatcggcccggggctccaggccaaagctaccagagaggcccaaaagcgggctgccgccggaattatgaaaaaccccacagtggacggcatcaccgtcattgatctggaccctatcccctacgatcctaagttcgaaaagcagctgggacaggtgatgctccttatcctgtgcgttacacaggtgctgatgatgcgcacaacctgggcgctctgtgaggctctgacacttgccaccggacccatttctaccctgtgggagggcaatccggggagattttggaacacaacgatcgctgtctccatggccaatattttccggggaagctatctcgccggcgctggcctgctgttttctatcatgaaaaacaccacaaatacccgcagagggacaggaaacattggcgaaaccctcggggagaagtggaaatcccggcttaatgccctgggaaagaacgagttccaaatctacaaaaagagcggcatccaggaggtggaccgcacgctggcgaaagaggggattaagagaggagaaacagatcaccatgccgtctctcggggcagcgctaagctcagatggtttgtggagcgcaacatggttacccctgaaggcaaagtggtcgacctggggtgcggacggggcgggtggtcctattactgtggaggccttaagaatgtgagagaggttaaagggctgaccaagggaggccccggccacgaagaacccatccctatgtctacatatgggtggaacctcgtgcgcctgcagagcggagtcgatgtgttcttcacaccccctgagaaatgcgacaccctgctctgtgatattggcgaatccagcccgaatcccacgatcgaggccgggcggacccttagagtgctgtccctggttgaaaactggctcaataacgacacacaattttgcattaaggtcctgaatccttacatgccctctgtgatcgagaagatggaaacccttcagcgcaaatacggaggcgctctggtgcggaaccctctcagcagaaattccacacatgagatgtattgggtctctaacgccaccgggaatatcgttagctccgtgaacatgatttctcgcatgctgatcaatcggttcacgatgaagcacaaaaaggcgacctacgagcccgacgtggatctgggaagcggcacaagaaacattggcatcgaatccgagattccgaatctcgacatcattgggaaacgcatcgaaaagatcaagcaggagcacgaaaccagctggcattatgatcaggaccacccttacaaaacatgggcctatcatggatcttacgagaccaagcaaacaggctccgctagctctatggtcaacggggtggttcggcttctgaccaaaccctgggatgtggtccctatggtgacgcagatggccatgacagacaccaccccctttggacagcagagagttttcaaggagaaagtggatacacgcacgcaagaacctaaggagggcaccaagaaactgatgaagattacagctaaatggctctggaaggaactggggaaaaagaaaacccccagaatctgtacacgggaggagtttaccaagaaggtccgctccaacgccgctcttggagccattttcacagacgaaaataaatggaaaagcgcgagagaggccgtggaagattctcggttttgggagctggtggacaaagaaagaaacctccacctggagggcaagtgcgagacctgtgtctataatatgatgggcaaacgggaaaagaagctgggggagttcggaaaagctaagggctcccgcgccatctggtacatgtggctcggggctagatttctggagttcgaggcccttggatttctgaacgaagatcactggttcagccgggaaaattccctcagcggcgttgagggggaaggcctgcataaacttggatacattctgcgcgacgtgtctaagaaagagggcggggccatgtatgcggacgatacggctggatgggacaccagaatcacactcgaagatctgaagaacgaggaaatggtgaccaatcacatggagggcgagcataagaaactggccgaagccatctttaagctcacataccagaacaaagtcgtgcgggttcagcgcccgacccctagagggacggtgatggacattatcagccggcgcgatcagagaggatccggccaagtcgggacatatggcctgaataccttcacaaacatggaggctcagcttattcggcagatggaaggagagggcatcttcaagtctattcaacacctgaccgtgacggaggaagttgccgtgcagaattggctcgctcgcgtcgggagagagcggctgagccgcatggccatctccggagacgattgcgtggttaaaccccttgacgatagatttgcgtctgccctgaccgctctcaacgacatgggcaaggtgcggaaggatatccagcagtgggaacccagcagagggtggaatgactggacacaagtccctttctgctcccatcactttcacgagctgattatgaaagatggacgcgtgctggtcgtgccgtgtcggaaccaggacgaactcatcggcagagcccgcatttctcagggggctggctggagcctgaaggagaccgcctgccttggaaaatcctacgcgcagatgtggagcctgatgtatttccatcggagagacctccgcctggccgctaatgccatctgttctgctgttccctcccactgggtgcctacaagccggaccacatggtctattcatgccaagcacgagtggatgaccacggaagatatgcttacagtctggaacagagtgtggatccaagagaacccctggatggaagacaaaacccctgtggagtcctgggaagaggttccctacctgggcaagcgcgaggatcagtggtgcgggagcctcattggactgacctcccgggctacatgggccaagaatatccagaccgcgatcaaccaggtgagatctctgattggcaatgaagagtatacagactacatgcctagcatgaaacgctttcggagagaagaggaagaggccggggtcctctggtga

SEQ ID NO: 19696 - RNA, 9876 nt, synthetic construct
  misc_feature 1..9876: note = derived and/or modified CDS sequence (opt5) from DENV-2__FJ639699__SS-prME
  source 1..9876: mol_type = other RNA
accgccggagtgatcattatgctgatccccaccgctatggccttccacctcacgaccagaaatggggagcctcatatgattgtgggacggcaggaaaagggcaagagcctgctttttaagacagaggacggggttaatatgtgcaccctgatggcgatcgatctcggagaactgtgtgaggacacaattacctacaagtgcccgcttctgagacaaaacgaacccgaggatatcgactgttggtgcaattccacatctacctgggtgacgtatggcacctgtacaaccacaggggagcacagacgggaaaagcgcagcgtggctctcgtccctcatgtgggaatgggcctggagaccagaacggaaacatggatgtcctctgagggcgcctggaagcacgcccagcggatcgagacctggattctgcgccatcccgggttcacaatcatggctgccattctcgcttacaccatcggaaccacacactttcagagagccctgattttcatccttctgacggcggttgcccctagcatgaccatgcggtgcattggcatctccaaccgcgattttgtggaaggggtctctggaggcagctgggtggacatcgttctcgagcacgggtcctgtgtgacaaccatggctaagaataagcccacactggatttcgaacttattaaaaccgaggccaaggaacctgctacgctgagaaaatattgcatcgaggccaagctcacaaacaccaccacagagagccggtgtccgacccagggagaaccctctctgaatgaggaacaagacaaacgctttgtctgcaagcattccatggtggatagaggctggggcaacgggtgtggactgttcggcaaagggggaattgtgacatgcgcgatgtttagctgcaaaaagaatatggagggcaaaatcgtccagcctgaaaacctcgagtacacgattgttatcacaccccactctggggaggaacatgccgtgggaaatgacacaggcaagcacggcaaagagatcaagattacccctcagtccagcatcacagaagctgagctgaccgggtatggaacggtgaccatggaatgttctccccggacaggccttgatttcaacgagatggtcctgctccagatggaggacaaagcctggctggtgcaccgccaatggtttcttgatctgccgctcccttggctgcccggggctgacacccagggatccaattggattcagaaggaaacactggttaccttcaagaaccctcatgccaaaaagcaggacgtggtcgtgctcggcagccaagagggggccatgcacacggctctgacaggcgcgaccgaaatccagatgtcctctggaaatcttctgtttacaggccatctcaaatgcagactgcggatggataaacttcagctgaaagggatgagctactccatgtgtaccggaaagttcaagattgttaaagagatcgccgagacccaacacggcacaatcgtgattagagtccagtatgaaggggacggaagcccctgcaagatccccttcgagattatggatctcgaaaaacgccatgtgctgggccggctgatcacggtcaaccctattatcaccgagaaggactctccggtgaacattgaagctgagcccccttttggggattcctacatcatcattggcgttgagcccggacagctcaaactgaattggttcaagaagggcagctctatcgggcagatgtttgaaacaaccatgagaggagccaaacgcatggccattcttggcgacacagcttgggatttcgggagcctgggaggcgtgtttacctccatcgggaaggccctccaccaagtcttcggcgcgatttacggagctgccttttctggcgtgagctggacgatgaaaatcctgatcggggttattatcacatggattggaatgaactcccggagcacctctctgtccgtgagccttgtcctcgtgggcgtgatcaccctgtatctgggggccatggttcaggctgactctggatgtgtcgtgtcctggaagaataaagagctcaagtgcggcagcgggattttcatcacagataacgtgcacacctggacagaacagtacaagtttcagcctgagtccccctctaaactggccagcgctatccaaaaggcccatgaagagggcatttgtggaatcagatccgtcacgcgccttgagaatctgatgtggaaacagattaccccggaactcaaccacatcctgtctgagaatgaagtgaagctgacaattatgaccggcgacatcaaagggatcatgcaggcgggaaagcggagccttagacctcagcccacagagctcaaatattcctggaagacctggggcaaggccaaaatgctgagcacggaatctcataaccaaaccttcctgattgatgggcctgagacagctgagtgccccaataccaaccgcgcctggaactccctcgaagttgaggactacggatttggcgtgttcacaaccaacatctggctgaaacttaaagaaaagcaggacgtcttttgtgatagcaaactgatgtctgctgccattaaggacaatcgggcggtgcacgccgatatgggctattggatcgagtccgctctcaacgacacatggaagatggagaaagccagcttcattgaagttaagtcttgccactggcctaaaagccataccctgtggtccaatggggtgctggagagcgaaatgatcattcccaagggattcgctggcccggtctctcagcacaactacagacctgggtattacacgcagacagccggaccctggcatcttggcaaactcgagatggattttgacttctgtgaagggaccaccgtggttgtgacagaggattgcggaaaccgcggcccctccctgcggaccacgacagccagcggcaagctgatcaccgagtggtgctgtagatcctgcacactccctccgctgcggtaccgcggggaagacggatgttggtatggcatggagatcagaccccttaaggaaaaagaggaaaatctggtcaactctctcgtgaccgctgggcacggacaaattgataattttagcctgggcgtgctggggatggcgcttttcctcgaggagatgctgcggacaagagtcggaaccaagcatgccatcctgctcgttgctgtgtcctttgtgacgctgattaccggcaacatgtctttccgcgaccttggccgggtcatggtgatggttggggccacaatgaccgatgacatcggaatgggcgtgacatacctggccctcctggctgcctttaaagtcagacctaccttcgcggctgggctgcttctgcgcaagctcacgagcaaagaactgatgatggccacaattggaatcgccctcctgtcccagtctaccatccccgagacaattcttgaactgaccgatgctctcgccctgggcatgatgatcctgaagattgtgagaaatatggagaagtatcagcttgcggttaccatcatggctattagctgcgtgcctaacgccgtcatcctgcaaaatgcctggaaagtgtcctgtacaatcctcgctgccgttagcgtgtctcccctgctcctgacgtccagccagcagaaggctgactggattcctcttgccctgaccatcaaagggctcaaccccacagcgatttttctgaccacactgtctcggacctccaagaaacgcagctggccgcttaatgaagccatcatggctgtcggaatggtgtctattctggcctccagcctcctgaagaacgacatccctatgacgggccccctcgtggctggcgggctgcttacagtctgctacgttctgaccggaagatccgccgatctggagctcgagcgggccaccgacgtgaaatgggaagatcaggctgagattagcggctctagccctatcctgtccatcacaatttctgaagacgggagcatgtccatcaagaatgaggaggaggaacaaacccttacaattctgatccgcacgggactcctggtgatttctggcctcttccccgtcagcatcccgatcaccgcggccgcttggtatctgtgggaagtgaagaaacagagagccggggttctttgggatgtgccttctccccctcccgtcggaaaggccgagctggaagacggcgcttaccggattaaacagaagggcatcctggggtatagccagattggagccggcgtgtacaaagaggggacatttcacaccatgtggcacgttacacgcggagcggtgctcatgcatagaggcaagcggatcgagcccagctgggctgatgtcaagaaagacctgatttcctacgggggaggctggaaacttgaaggcgagtggaaagaaggggaggaagtgcaagtcctggccctcgagcctggaaagaacccgcgcgccgtgcagaccaaacccggcctgttcaagacgaataccgggacaatcggagctgttagcctcgatttttctcctggcacctccgggagccccatcgtggacagaaagggaaaagtcgtgggcctgtatggcaacggggttgtgacacggtctggagcctacgtctccgcgattgctcagaccgaaaagagcatcgaagataatcctgagattgaagacgatatcttccgcaagaagcgccttacaattatggacctgcaccccggcgccgggaaaacgaagcggtatctgcctgccatcgtgagagaggctattaagcgcggactccggaccctgatccttgccccgacaagagtggttgctgccgaaatggaggaggcgctgcgcggcctccccatccggtaccagacccctgccattagagctgaacataccgggcgcgagatcgtcgacctgatgtgtcacgccacattcacgatgcggctcctgtcccccgtgagagtgcctaactataaccttattatcatggatgaagctcattttaccgaccccgcctctattgccgctcggggctacatcagcacacgcgtcgagatgggagaggcggccggcatcttcatgaccgctacaccgcctgggtccagagatccctttccccaaagcaatgcccctattatggacgaagaacgggaaatccccgagcgctcttggaactccggacacgaatgggtgaccgatttcaaaggcaagacggtttggtttgtgcctagcattaaagccgggaatgacatcgctgcctgcctgagaaagaacggcaagaaggtcattcagctgtctcggaagacattcgatagcgagtatgtgaaaaccagaaccaatgactgggattttgttgtgacaaccgacatctccgagatgggcgcgaacttcaaggctgaacgcgtcatcgatccgcggagatgtatgaaacccgtgattctcacagacggggaggaacgcgttatcctggccggccctatgcccgtgacccactctagcgccgctcagcggagaggacgcattggccggaatcctaagaacgagaatgaccaatacatctacatgggggaaccccttgagaacgatgaggactgcgcccattggaaagaagcgaagatgctgctcgataatattaacacgccggagggaatcattccttccatgtttgaacccgagagagaaaaagtcgacgccatcgatggcgagtatcgcctgagaggggaggctcggaagacattcgtggacctgatgcgcagaggagatctccctgtgtggcttgcctaccgggtcgctgccgaaggcatcaattatgctgaccgcagatggtgttttgatggggttaagaacaatcagattctggaggaaaacgtggaggtggagatctggaccaaagaaggcgagcggaagaaactgaagcccagatggctcgacgcccgcatttactctgatcctctggcgcttaaagagttcaaggagttcgccgctggacggaagtccctgacactcaacctgatcaccgaaatgggcagactgcccacgtttatgacccagaaagcccgcgacgctctcgataatcttgccgtcctgcacacagccgaggtcgggggacgggcttataaccatgcgctgtccgagctcccggaaaccctggagacacttctgctcctgaccctgctcgccacagttaccggcgggattttcctttttctgatgagcggaaagggcgtgggcaaaatgacgctggggatgtgctgcatcatcacagcttctattctcctgtggtacgcccagatccaacctcactggattgccgcttccatcattcttgagttctttctgatcgtcctcctgatccccgagcccgaaaagcagagaacccctcaggacaatcagctgacctatgtggttattgccatcctcacagtggtcgcggccaccatggctaacgagatgggattccttgagaaaacaaagaaggacctgggcctggggagcattgccacgcaagaaccggagtccaatatcctcgatattgacctgcggcccgcttctgcctggaccctttacgcggtggccacaacctttgtcacacctatgctgcgccacagcatcgaaaactcctctgtgaatgttagcctcaccgctattgccaaccaggctacggtgctgatgggactgggcaaagggtggcccctctccaagatggatatcggagtgcctcttctggccatcggctgttacagccaggtcaatcccattaccctgacagctgccctcctgcttctggttgcgcattatgccatcattggccctgggctccaggctaaagccaccagagaggctcaaaagcgggccgccgcgggaatcatgaaaaacccgacagtggacggcattaccgtgatcgatctggaccccatcccttacgatcccaagttcgaaaagcagctggggcaggtcatgctccttattctgtgcgtgacgcaggttctgatgatgcgcacaacctgggctctctgtgaggccctgacacttgctaccggacctatctctaccctgtgggagggcaatcccgggagattttggaacacaacgattgccgtgtccatggccaatatcttccggggaagctatctcgctggcgccggcctgctgttttctattatgaaaaacaccacaaatacccgcagagggacaggaaacatcggcgaaaccctcggggagaagtggaaatcccggcttaatgcgctgggaaagaacgagttccaaatctacaaaaagagcggcattcaggaggtcgaccgcacgctggccaaagaggggatcaagagaggagaaacagatcaccatgctgtgtctcggggcagcgccaagctcagatggtttgtcgagcgcaacatggtgaccccggaaggcaaagttgtggacctggggtgcggacggggcgggtggtcctattactgtggaggccttaagaatgtcagagaggtgaaagggctgaccaagggaggccctggccacgaagaacccattcccatgtctacatatgggtggaacctcgttcgcctgcagagcggagtggatgtcttcttcacccctcccgagaaatgcgacacactgctctgtgatatcggcgaatccagccctaatccgacgattgaggctgggcggacccttagagtgctgtccctggtggaaaactggctcaataacgacacacaattttgcatcaaggttctgaatccctacatgccttctgtcatcgagaagatggaaacccttcagcgcaaatacggaggcgccctggtgcggaaccccctcagcagaaattccacacatgagatgtattgggtgtctaacgcgaccgggaatattgtcagctccgttaacatgatctctcgcatgctgattaatcggttcacgatgaagcacaaaaaggccacctacgagcctgacgtggatctgggaagcggcacaagaaacatcggcattgaatccgagatccccaatctcgacattatcgggaaacgcatcgaaaagattaagcaggagcacgaaaccagctggcattatgatcaggaccacccgtacaaaacatgggcttatcatggatcttacgagaccaagcaaacaggctccgccagctctatggtgaacggggtcgtgcggcttctgaccaaaccttgggatgttgtgcccatggtcacgcagatggctatgacagacaccaccccttttggacagcagagagtgttcaaggagaaagttgatacacgcacgcaagaacccaaggagggcaccaagaaactgatgaagatcacagccaaatggctctggaaggaactggggaaaaagaaaacccctagaatttgtacacgggaggagtttaccaagaaggtgcgctccaacgctgcccttggagcgatcttcacagacgaaaataaatggaaaagcgccagagaggctgtcgaagattctcggttttgggagctggtggacaaagaaagaaacctccacctggagggcaagtgcgagacctgtgtgtataatatgatgggcaaacgggaaaagaagctgggggagttcggaaaagccaagggctcccgcgctatttggtacatgtggctcggggccagatttctggagttcgaggcccttggatttctgaacgaagatcactggttcagccgggaaaattccctcagcggcgtcgagggggaaggcctgcataaacttggatacatcctgcgcgacgtttctaagaaagagggcggggcgatgtatgctgacgatacggccggatgggacaccagaatcacactcgaagatctgaagaacgaggaaatggtgaccaatcacatggagggcgagcataagaaactggccgaagctatttttaagctcacataccagaacaaagtggtccgggtgcagcgccccaccccgagagggacggttatggacatcattagccggcgcgatcagagaggatccggccaagtggggacatatggcctgaataccttcacaaacatggaggcccagcttatccggcagatggaaggagagggcattttcaagtctatccaatacctgaccgtcacggaggaagtggctgttcagaattggctcgcccgcgtggggagagagcggctgagccgcatggcgatctccggagacgattgcgtcgtgaaacctcttgacgatagatttgcctctgctctgaccgccctcaacgacatgggcaaggttcggaaggatattcagcagtgggaacccagcagagggtggaatgactggacacaagtgcccttctgctcccaccattttcacgagctgatcatgaaagatggacgcgtcctggtggtcccttgtcggaaccaggacgaactcattggcagagctcgcatctctcagggggccggctggagcctgaaggagaccgcgtgccttggaaaatcctatgcccagatgtggagcctgatgtacttccaccggagagacctccgcctggctgccaatgctatttgttctgccgtgccgtcccattgggttcccacaagccggaccacatggtctatccacgctaagcatgagtggatgaccacggaagatatgcttacagtgtggaacagagtctggattcaagagaacccttggatggaagacaaaacccccgtggagtcctgggaagaggtgccttatctgggcaagcgcgaggatcagtggtgcgggagcctcatcggactgacctcccgggccacatgggcgaagaatatccagaccgccattaaccaggttagatctctgatcggcaatgaagagtacacagactacatgcccagcatgaaacgctttcggagagaagaggaagaggctggggtgctctggtga

SEQ ID NO: 19697 - RNA, 9876 nt, synthetic construct
  misc_feature 1..9876: note = derived and/or modified CDS sequence (opt5) from DENV-2__FJ639700__SS-prME
  source 1..9876: mol_type = other RNA
accgccggagtgatcattatgctgatccccaccgctatggccttccacctcacgaccagaaatggggagcctcatatgattgtcggacggcaggaaaagggcaagagcctgctttttaagacggaggacggggttaatatgtgcaccctgatggcgatcgatctcggagaactgtgtgaggacacaattacctacaagtgcccgcttctgagacaaaacgaacccgaggatatcgactgttggtgcaattccacatctacctgggtgacgtatggcacctgtacaaccacaggggagcacagacgggaaaagcgcagcgtggctctcgtccctcatgtgggaatgggcctggagaccagaacggaaacatggatgtcctctgagggcgcctggaagcacgcccagcggatcgagacctggattctgcgccatcccgggttcacaatcatggctgccattctcgcttacaccatcggaaccacacactttcagagagccctgattttcatccttctgacggcggttgcccctagcatgaccatgcggtgcattggcatctccaaccgcgattttgtggaaggggtctctggaggcagctgggtggacatcgttctcgagcacgggtcctgtgtgacaaccatggctaagaataagcccacactggatttcgaacttattaaaaccgaggccaaggaacctgctacgctgagaaaatattgcatcgaggccaagctcacaaacaccaccacagagagccggtgtccgacccagggagaaccctctctgaatgaggaacaagacaaacgctttgtctgcaagcattccatggtggatagaggctggggcaacgggtgtggactgttcggcaaaggcgggattgtgacatgcgcgatgtttagctgcaaaaagaatatggaggggaaaatcgtccagcctgaaaacctcgagtacacgattgttatcacaccccactctggggaggaacatgccgtgggaaatgacacaggcaagcacggcaaagagatcaagattacccctcagtccagcatcacagaagctgagctgaccgggtatggaacggtgaccatggaatgttctccccggacaggccttgatttcaacgagatggtcctgctccagatggaggacaaagcctggctggtgcaccgccaatggtttcttgatctgccgctcccttggctgcccggggctgacacccagggatccaattggattcagaaggaaacactggttaccttcaagaaccctcatgccaaaaagcaggacgtggtcgtgctcggcagccaagagggggccatgcacacggctctgacaggcgcgaccgaaatccagatgtcctctggaaatcttctgtttacaggccatctcaaatgcagactgcggatggataaacttcagctgaaagggatgagctactccatgtgtaccggaaagttcaagattgttaaagagatcgccgagacccaacacggcacaatcgtgattagagtccagtatgaaggggacggaagcccctgcaagatccccttcgagattatggatctcgaaaaacgccatgtgctgggccggctgatcacggtcaaccctattatcaccgagaaggactctccggtgaacattgaagctgagcccccttttggggattcctacatcatcattggcgttgagcccggacagctcaaactgaattggttcaagaagggcagctctatcgggcagatgtttgaaacaaccatgagaggagccaaacgcatggccattcttggcgacacagcttgggatttcgggagcctgggaggcgtgtttacctccatcgggaaggccctccaccaagtcttcggcgcgatttacggagctgccttttctggcgtgagctggacgatgaaaatcctgatcggggttattatcacatggattggaatgaactcccggagcacctctctgtccgtgagccttgtcctcgtgggcgtgatcaccctgtatctgggggccatggttcaggctgactctggatgtgtcgtgtcctggaagaataaagagctcaagtgcggcagcgggattttcatcacagataacgtgcacacctggacagaacagtacaagtttcagcctgagtccccctctaaactggccagcgctatccaaaaggcccatgaagagggcatttgtggaatcagatccgtcacgcgccttgagaatctgatgtggaaacagattaccccggaactcaaccacatcctgtctgagaatgaagcgaagctgacaattatgaccggcgacatcaaagggatcatgcaggccggaaagcggagccttagacctcagcccacagagctcaaatattcctggaagacctggggcaaggctaaaatgctgagcacggaatctcataaccaaaccttcctgattgatgggcctgagacagccgagtgccccaataccaaccgcgcttggaactccctcgaagtggaggactacggatttggcgttttcacaaccaacatctggctgaaacttaaagaaaagcaggacgtgttttgtgatagcaaactgatgtctgccgcgattaaggacaatcgggccgtccacgctgatatgggctattggatcgagtccgccctcaacgacacatggaagatggagaaagctagcttcattgaagtgaagtcttgccactggcctaaaagccataccctgtggtccaatggggttctggagagcgaaatgatcattcccaagggattcgccggcccggtgtctcagcacaactacagacctgggtatcatacgcagacagccggaccctggcaccttggcaaactcgagatggattttgacttctgtgaagggaccaccgtcgtggttacagaggattgcggaaaccgcggcccctccctgcggaccacgacagctagcggcaagctgatcaccgagtggtgctgtagatcctgcacactccctccgctgcggtaccgcggggaagacggatgttggtacggcatggagatcagaccccttaaggaaaaagaggaaaatctggtgaactctctcgtcaccgcggggcatggacaaattgataattttagcctgggcgtgctggggatggcccttttcctcgaggagatgctgcggacaagagtgggaaccaagcacgctatcctgctcgtcgccgtttcctttgtgacgctgattaccggcaacatgtctttccgcgaccttggccgggtgatggtcatggtgggggccacaatgaccgatgacatcggaatgggcgttacatatctggctctcctggccgcgtttaaagtgagacctaccttcgctgccgggctgcttctgcgcaagctcacgagcaaagaactgatgatggccacaattggaatcgctctcctgtcccagtctaccatccccgagacaattcttgaactgaccgatgccctcgcgctgggcatgatgatcctgaagattgtcagaaatatggagaagtaccagcttgctgtgaccatcatggccattagctgcgttcctaacgccgtgatcctgcaaaatgcttggaaagtctcctgtacaatcctcgccgctgtgagcgtttctcccctgctcctgacgtccagccagcagaaggccgactggattcctcttgcgctgaccatcaaagggctcaaccccacagccatttttctgaccacactgtctcggacctccaagaaacgcagctggccgcttaatgaagctatcatggccgtgggaatggtctctattctggcttccagcctcctgaagaacgacatccctatgacgggccccctcgtggccggcgggctgcttacagtgtgctatgtcctgaccggaagatccgccgatctggagctcgagcgggctaccgacgttaaatgggaagatcaggcggagattagcggctctagccctatcctgtccatcacaatttctgaagacgggagcatgtccatcaagaatgaggaggaggaacaaacccttacaattctgatccgcacgggactcctggtgatttctggcctcttccccgtgagcatcccgatcaccgccgctgcctggtacctgtgggaagtcaagaaacagagagccggggtgctttgggatgttccttctccccctcccgtgggaaaggctgagctggaagacggcgcctatcggattaaacagaagggcatcctggggtacagccagattggagcgggcgtctataaagaggggacatttcacaccatgtggcatgtgacacgcggagctgttctcatgcacagaggcaagcggatcgagcccagctgggccgatgtgaagaaagacctgatttcctacgggggaggctggaaacttgaaggcgagtggaaagaaggggaggaagtccaagtgctggccctcgagcctggaaagaacccgcgcgctgtccagaccaaacccggcctgttcaagacgaataccgggacaatcggagccgtgagcctcgatttttctcctggcacctccgggagccccatcgttgacagaaagggaaaagtggtcggcctgtacggcaacggggtggttacacggtctggagcgtatgtgtccgctattgcccagaccgaaaagagcatcgaagataatcctgagattgaagacgatatcttccgcaagaagcgccttacaattatggacctgcatcccggcgccgggaaaacgaagcggtacctgcctgctatcgtcagagaggccattaagcgcggactccggaccctgatccttgctccgacaagagtggtggccgcggaaatggaggaggccctgcgcggcctccccatccggtatcagacccctgctattagagccgaacacaccgggcgcgagatcgttgacctgatgtgtcatgctacattcacgatgcggctcctgtcccccgtcagagtgcctaactacaaccttattatcatggatgaagcccactttaccgaccccgcctctattgctgcgcggggctatatcagcacacgcgtggagatgggagaggccgctggcatcttcatgaccgccacaccgcctgggtccagagatccctttccccaaagcaatgcccctattatggacgaagaacgggaaatccccgagcgctcttggaactccggacacgaatgggtcaccgatttcaaaggcaagacggtgtggtttgttcctagcattaaagctgggaatgacatcgccgcgtgcctgagaaagaacggcaagaaggtgattcagctgtctcggaagacattcgatagcgagtacgtcaaaaccagaaccaatgactgggattttgtggttacaaccgacatctccgagatgggcgctaacttcaaggccgaacgcgtgatcgatccgcggagatgtatgaaacccgtcattctcacagacggggaggaacgcgtgatcctggccggccctatgcccgttacccattctagcgctgcccagcggagaggacgcattggccggaatcctaagaacgagaatgaccaatatatctacatgggggaaccccttgagaacgatgaggactgcgcgcactggaaagaagccaagatgctgctcgataatattaacacgccggagggaatcattccttccatgtttgaacccgagagagaaaaagtggacgctatcgatggcgagtaccgcctgagaggggaggcccggaagacattcgtcgacctgatgcgcagaggagatctccctgtgtggcttgcttatcgggtggccgctgaaggcatcaattacgccgaccgcagatggtgttttgatggggtcaagaacaatcagattctggaggaaaacgttgaggtggagatctggaccaaagaaggcgagcggaagaaactgaagcccagatggctcgacgcgcgcatttattctgatcctctggcccttaaagagttcaaggagttcgctgccggacggaagtccctgacactcaacctgatcaccgaaatgggcagactgcccacgtttatgacccagaaagctcgcgacgccctcgataatcttgccgtgctgcatacagctgaggtcgggggacgggcgtacaaccacgccctgtccgagctcccggaaaccctggagacacttctgctcctgaccctgctcgctacagtgaccggcgggattttcctttttctgatgagcggaaagggcgttggcaaaatgacgctggggatgtgctgcatcatcacagcctctattctcctgtggtatgcccagatccaacctcactggattgctgcctccatcattcttgagttctttctgatcgtgctcctgatccccgagcccgaaaagcagagaacccctcaggacaatcagctgacctacgtcgtgattgcgatcctcacagttgtggccgctaccatggccaacgagatgggattccttgagaaaacaaagaaggacctgggcctggggagcattgctacgcaagaaccggagtccaatatcctcgatattgacctgcggcccgcctctgcgtggaccctttatgccgtcgctacaacctttgtgacacctatgctgcgccatagcatcgaaaactcctctgtcaatgtgagcctcaccgccattgctaaccaggccacggttctgatgggactgggcaaagggtggcccctctccaagatggatatcggagtgcctcttctggctatcggctgttacagccaggtgaatcccattaccctgacagccgcgctcctgcttctggtcgcccactacgctatcattggccctgggctccaggccaaagctaccagagaggcccaaaagcgggccgcggctggaatcatgaaaaacccgacagttgacggcattaccgtgatcgatctggaccccatcccttatgatcccaagttcgaaaagcagctgggacaggtgatgctccttattctgtgcgtcacacaggtgctgatgatgcgcacaacctgggccctctgtgaggctctgacacttgccaccggacctatctctaccctgtgggagggcaatcccgggagattttggaacacaacgattgccgtttccatggctaatatcttccggggaagctacctcgccggcgcgggcctgctgttttctattatgaaaaacaccacaaatacccgcagagggacaggaaacatcggcgaaaccctcggggagaagtggaaatcccggcttaatgccctgggaaagaacgagttccaaatctataaaaagagcggcattcaggaggtggaccgcacgctggctaaagaggggatcaagagaggagaaacagatcatcacgccgtctctcggggcagcgctaagctcagatggtttgtggagcgcaacatggtcaccccggaaggcaaagtggttgacctggggtgcggacggggcgggtggtcctactattgtggaggccttaagaatgtgagagaggtcaaagggctgaccaagggaggccctggccatgaagaacccattcccatgtctacatacgggtggaacctcgtgcgcctgcagagcggagttgatgtgttcttcacccctcccgagaaatgcgacacactgctctgtgatatcggcgaatccagccctaatccgacgattgaggccgggcggacccttagagtcctgtccctggtggaaaactggctcaataacgacacacaattttgcatcaaggtgctgaatccctatatgccttctgttatcgagaagatggaaacccttcagcgcaaatacggaggcgcgctggtccggaaccccctcagcagaaattccacacacgagatgtactgggtgtctaacgccaccgggaatattgtgagctccgtcaacatgatctctcgcatgctgattaatcggttcacgatgaagcacaaaaaggctacctatgagcctgacgttgatctgggaagcggcacaagaaacatcggcattgaatccgagatccccaatctcgacattatcgggaaacgcatcgaaaagattaagcaggagcatgaaaccagctggcactacgatcaggaccatccgtataaaacatgggcctaccacggatcttatgagaccaagcaaacaggctccgctagctctatggtgaacggggtggtccggcttctgaccaaaccttgggatgtggttcccatggtgacgcagatggccatgacagacaccaccccttttggacagcagagagtcttcaaggagaaagtggatacacgcacgcaagaacccaaggagggcaccaagaaactgatgaagatcacagctaaatggctctggaaggaactggggaaaaagaaaacccctagaatttgtacacgggaggagtttaccaagaaggttcgctccaacgccgcgcttggagccatcttcacagacgaaaataaatggaaaagcgctagagaggccgtggaagattctcggttttgggagctggtcgacaaagaaagaaacctccacctggagggcaagtgcgagacctgtgtgtacaatatgatgggcaaacgggaaaagaagctgggggagttcggaaaagctaagggctcccgcgccatttggtatatgtggctcggggccagatttctggagttcgaggcgcttggatttctgaacgaagatcattggttcagccgggaaaattccctcagcggcgtggagggggaaggcctgcacaaacttggatacatcctgcgcgacgtctctaagaaagagggcggggctatgtacgccgacgatacggccggatgggacaccagaatcacactcgaagatctgaagaacgaggaaatggttaccaatcatatggagggcgagcacaagaaactggctgaagccatttttaagctcacatatcagaacaaagtggtgcgggtccagcgccccaccccgagagggacggtgatggacatcattagccggaaggatcagcgcggatccggccaagttgggacatacggcctgaataccttcacaaacatggaggctcagcttatcagacagatggaaggagagggcattttcaaatctatccaatatctgaccgtgacggaggaagtcgccgtgcagaattggctcgcgcgggttgggcgcgagagactgagccggatggccatctccggagacgattgcgtggtcaagcctcttgacgatcgctttgcttctgccctgaccgctctcaacgacatgggcaaggtgagaaaagatattcagcagtgggaacccagccgggggtggaatgactggacacaagttcccttctgctcccatcactttcacgagctgatcatgaaggatggaagagtgctggtcgtgccttgtcgcaaccaggacgaactcattggccgggccagaatctctcagggggcgggctggagcctgaaagagaccgcctgccttggaaagtcctacgctcagatgtggagcctgatgtatttccatcgccgggacctcagactggccgctaatgccatttgttctgctgtcccgtcccactgggtgcccacaagccgcaccacatggtctatccatgccaaacacgagtggatgaccacggaagatatgcttacagtttggaaccgggtgtggattcaagagaacccttggatggaagacaagacccccgtcgagtcctgggaagaggtgccttacctgggcaagagagaggatcagtggtgcgggagcctcatcggactgacctcccgcgcgacatgggccaaaaatatccagaccgctattaaccaggtgcggtctctgatcggcaatgaagagtatacagactacatgcccagcatgaagagatttcgccgggaagaggaagaggccggggttctctggtga

SEQ ID NO: 19698 - RNA, 9876 nt, synthetic construct
  misc_feature 1..9876: note = derived and/or modified CDS sequence (opt5) from DENV-2__GQ868620__SS-prME
  source 1..9876: mol_type = other RNA
agcgctggaatgatcattatgctgatccccaccgtgatggctttccacctcaccacgagaaatggggagcctcatatgattgtcgggatccaggaaaagggaaagagcctgctttttaagaccgaggacggggttaatatgtgcacactgatggccatggatctcggagaactgtgtgaggacaccattacatacaagtgcccgcttctgcggcaaaacgaacccgaggatatcgactgttggtgcaattctaccagcacatgggtgacctatggcacgtgtaccacaaccggggagcacagaagagaaaagcggtccgtggcgctcgttcctcatgtgggaatgggcctggagacacgcaccgaaacgtggatgtctagcgagggcgcttggaagcacgcccagagaatcgagacatggattctgcggcatcccgggttcaccatcatggccgctattctcgcctacacaatcggaaccacccactttcagcgcgctctgattttcatccttctgacagccgttgcgccttccatgacgatgagatgcattggcatctctaaccgggattttgtggaaggggtcagcggaggctcctgggtggacatcgttctcgagcacgggagctgtgtgaccacaatggccaagaataagcccaccctggatttcgaacttattaaaacagaggctaagcagcctgccaccctgcgcaaatattgcatcgaagctaagctcacgaacacaaccaccgagtctagatgtccgacacaaggagagccctccctgaaagaggaacaagacaagcggtttgtctgcaagcatagcatggtggatcgcggctggggcaatgggtgtggactgttcggcaaagggggaattgtgacctgcgccatgtttacatgcaagaaaaacatggaaggcaagatcgtccagcctgagaatctcgaatacacgattgttgtgacaccccactctggggaggagcatgcggtgggaaacgacacaggcaaacacggcaaggaaatcaaagtcacccctcagtccagcatcacagaggccgaactgaccgggtatggaacggtgaccatggagtgttctcccagaacaggccttgatttcaatgaaatggttctgctccaaatggagaacaaggcttggctggtgcaccggcagtggtttcttgacctgccgctcccttggctgcccggggccgataagcagggatccaattggattcagaaagagaccctggtcacattcaagaaccctcatgctaaaaagcaagacgtggttgtgctcggcagccaggaaggggccatgcacaccgccctgacgggcgctacagagatccagatgtcctctggaaatcttctgtttaccggccatctcaaatgccgcctgagaatggacaaacttcaactgaaggggatgagctactccatgtgtacaggaaaattcaaggtcgtgaaagaaattgcggagacccagcacggcaccatcgtcattcgggtgcagtatgagggggatggaagcccctgcaagatccccttcgaaatcatggacctcgagaaaagatacgttctgggccgcctgattacagtgaaccctatcgtcacggaaaaggattctccggtgaacattgaggccgaacccccttttggggactcctacatcattatcggcgttgagcccggacagctcaagctgaattggttcaaaaagggcagctctattgggcaaatgtttgagaccacaatgcggggagctaaaagaatggccatccttggcgataccgcctgggacttcgggagcctgggaggcgtgtttacatccatcgggaaggctctccatcaggtcttcggcgccatttatggagcggctttttctggcgtgagctggaccatgaaaatcctgattggggtgatcattacgtggatcggaatgaactcccgcagcacatctctgtccgttagccttgtcctcgtgggcatcgtgaccctgtacctgggggtcatggtgcaggccgattctggatgtgttgtgtcctggaagaataaggaactcaaatgcggcagcgggattttcatcaccgacaacgtccacacatggaccgagcagtataagtttcaacctgaatccccctctaaactggccagcgctattcagaaggcccaggaggaaggcatctgtggcattcggtccgtgacaagacttgagaatctgatgtggaaacagatcacgccggagctcaaccacatcctggctgaaaatgaggttaagctgaccattatgacaggcgatatcaaagggattatgcaagccggaaagcgctctcttcggcctcagcccaccgaactcaagtacagctggaaaacatggggcaaggcgaaaatgctgtccaccgagagccataaccagacgttcctgatcgacgggcctgaaaccgccgagtgccccaatacaaacagagcttggaactctctcgaggtggaagattatggatttggcgtcttcaccacaaacatttggctgaaacttaaagagaagcaggacgccttttgtgactccaagctgatgagcgctgccatcaaagataatcgcgcggtgcacgccgacatgggctactggatcgaatctgctctcaacgatacctggaagattgagaaagcctccttcatcgaggttaagaattgccattggcctaaaagccacacactgtggtctaacggggtgctggaaagcgagatgattatccccaagaaccttgctggaccggtctcccaacacaattatcggcctggctaccatacccagattgccgggccctggcacctcggaaagctggaaatggacttcgatttttgtgacggcacgacagtgatcgtgaccgaggattgcgggaacagaggacccagcctgcgcaccacaaccgcctctggcaaactcattacggaatggtgctgtcggtcctgcacactgcctccgcttagataccggggcgaggacgggtgttggtatggaatggagatccgccccctgaaggaaaaagaggaaaatctcgtcaacagcctggttaccgctggccatggacaggtggataatttctccctgggagtgcttggcatggcgctctttctggaggaaatgctgagaacacgggtcgggaccaagcacgccatcctcctggtggctgtttctttcgtgacacttattaccggaaacatgagctttaaagacctgggcagagtcgtggttatggtgggcgccacgatgaccgatgacatcgggatgggagtcacatacctcgccctgctggctgccttcaaggtgcgccctacctttgcggctggccttctgctccggaagctgacatccaaagagctcatgatgaccacgattgggatcgttctgctttctcaaagcacaattcccgagaccatcctggaactcacagatgccctggccctgggaatgatggtgcttaagatcgtcagaaatatggagaaatatcagctggctgtgaccattatggccatcctctgcgtgcctaacgcggtcattctgcagaatgcttggaaggtttcctgtaccatcctcgccgtggtgtctgtcagccccctgcttctgacatccagccagcagaagacggactggattcctctcgccctgaccatcaagggcctgaaccccacagctatcttccttaccacactgtctcgcaccaataaaaagagatcctggccgctcaacgaagccattatggctgtggggatggttagcatcctggcctcttccctcctgaagaatgacattcctatgacgggaccccttgtggcgggcggcctgctgacagtctgctacgtgctcaccgggcggagcgccgatctggagcttgaacgcgctaccgacgttaaatgggaggatcaggccgagatctctggatccagccctattctgtccatcacaattagcgaagacggctctatgagcatcaagaacgaggaagaggagcagaccctcacaatcctgattagaacggggctcctggtgatctccggactttttcccgtctctattccgatcaccgctgccgcctggtatctgtgggaagtgaaaaagcagcgggctggcgtcctgtgggatgtgccttctccccctcccatggggaaagcggagctcgaagacggagcctaccgcattaagcaaaagggcatcctgggctattcccagatcggggctggagtttacaaagagggcacattccataccatgtggcacgtgacaagaggggccgtccttatgcacaagggaaaacggattgaaccctcctgggccgatgtgaagaaagacctgatcagctacggcgggggatggaagctcgagggcgagtggaaggaaggcgaggaagttcaggtgctggctctcgagcctgggaaaaatccgcgcgtcgtgcagaccaagcccggactgtttaaaacgaacaccggcacaattggggccgtgtcccttgatttctctcctggaaccagcggctcccccatcattgacaagaaagggaaggttgtcggactgtatggcaacggcgtggtgacaagaagcggggcgtacgtctctgctatcgcccaaaccgaaaagtccatcgaggataatcctgagattgaagacgatatctttcggaaacgcagactgacaattatggacctccatcccggagccggcaagacgaaacggtatctgcctgctatcgtgagagaggccattaagcgcgggcttcggaccctgatcctcgcgccgacaagagttgtggctgccgaaatggaggaagccctgcgcggactccccattcggtaccagacccctgctatcagagccgagcacaccggccgcgagatcgtcgacctgatgtgtcatgctacattcacgatgcggcttctgagccccgtgagagttcctaactataatctgattatcatggatgaagcccacttcaccgaccccgcgtctattgccgctcgcgggtacatctccacacgggtggagatgggcgaagccgctggaatttttatgaccgccacaccgcctggcagcagagatcccttcccccagtccaacgcccctatcatcgacgaggagcgggaaattcccgagcgctcttggaatagcgggcatgaatgggtcaccgattttaaaggaaagacggtgtggttcgttccttccatcaaggctggcaacgacattgcggcctgcctccgcaagaatgggaagaaagtgatccaactgagccggaagacatttgattctgagtatgtcaaaacccgcaccaacgactgggatttcgtggtgacaaccgacatttccgaaatgggagctaattttaaggccgagagagtcatcgatccgcggagatgtatgaaacccgttatccttacagacggcgaggaacgcgtgattctggccgggcctatgcccgtgacccacagctctgctgcccagcggagaggccgcatcggacggaaccctaagaatgagaacgaccagtacatttacatgggcgaacccctcgagaatgatgaagactgcgcgcactggaaggaggctaaaatgctgctggataacatcaatacgccggaggggattatccctagcatgttcgaacccgagagagaaaaggtcgacgccattgatggagagtatcgcctccggggcgaagccagaaaaacatttgtggaccttatgcgcagaggggatctgcctgtttggctggcttacaaggtggccgcggagggaatcaactatgccgaccggcgctggtgtttcgatggcatcaaaaacaatcagattctcgaggaaaacgtcgaggtggaaatctggaccaaggagggggagagaaagaaactgaagccccggtggcttgacgctcgcatttactccgatcctctggccctcaaagaatttaaggagttcgctgccggcagaaaatctctgacactgaatctcatcaccgaaatgggacggcttcccacgttcatgacccaaaagacaagagacgctctggataacctggccgttctccataccgcggaggccggcgggcgcgcttataatcacgccctgagcgaacttccggagacactggagaccctcctgctgctcacacttctggctaccgtgacgggaggcatttttctgttcctcatgtccgggcggggaatcggcaagatgacactgggcatgtgctgcatcattaccgcctctatccttctgtggtacgcccagattcagcctcattggatcgctgcgagcattatcctcgaatttttcctgatcgtcctgctcattcccgagcccgaaaaacagagaacccctcaagacaaccagcttacatatgtggtcatcgccattctgaccgtggttgctgccacaatggccaatgagatggggtttctggaaaagacgaaaaaggacctcggactgggctccatcgctacccagcagccggagagcaacattcttgatatcgacctgcgccccgcctctgcgtggacactctacgccgtggctaccacattcgtgacccctatgctgcggcactccattgagaatagctccgtcaacgtttctctgacggccatcgctaatcaagccaccgtgctcatggggcttggaaaaggctggcccctgagcaagatggatatcggggtgcctctgctcgcgattggatgttactcccaggtcaaccccatcacactgaccgccgcccttctgctcctgattgcccactatgctatcattggccctggcctgcaggccaaggctacaagagaagcccagaaacgggcggccgctgggatcatgaagaatccgaccgtggacggaatcacggttattgatctcgaccccatcccttacgatcccaaatttgagaagcaacttggccaggtgatgctgctgattctctgcgtcacacaggtgctgatgatgcgcaccacatgggccctttgtgaagctctgaccctcgccaccgggcctatctctacactgtgggagggaaaccccggcagattctggaatacgaccattgccgtcagcatggcgaacatctttcgggggtcctatctggctggagccggcctccttttcagcatcatgaaaaatgctaacaacacacgcagaggcaccgggaatattggagaaacactgggcgagaagtggaaatctcggctgaacgccctcgggaagtccgagtttcaaatctacaagaaaagcggcattcaggaagtggaccgcaccctggccaaggagggcatcaaaagaggggaaacggatcatcacgctgtttctcggggatccgccaaacttcgctggttcgtggagagaaatatggtcacaccggagggcaaagtggttgacctgggctgcgggcggggaggctggagctattactgtgggggactcaagaacgtgagagaagtcaagggcctgaccaaagggggacctggccatgaggaacccattcccatgtctacctatggctggaatctggtgcgcctccagagcggggtggatgtctttttcatccctcccgagaagtgcgacacacttctgtgtgatatcggagaatcctctcctaacccgaccgtcgaggcgggccggacactgagagtgctcaatctggtggagaactggcttaataacgacacgcagttctgcattaaagtcctgaatccctacatgcctagcgttatcgaaaagatggaggccctccaacgcaaatacgggggagctctggtgcggaaccccctgtccagaaatagcacccacgaaatgtattgggtgtccaacgcctctggcaatattgtcagctccgtgaacatgatctctcgcatgctcattaaccggtttacaatgagacataagaaggctacctacgagcctgacgttgatcttgggagcggaacacgcaatatcggcattgaatccgagatccccaacctggacatcattggcaaacggatcgagaagattaaacaggaacacgagacctcttggtattacgatcaggaccacccgtataagacgtgggcctaccatgggagctatgaaaccaaacagacaggatccgcgagctctatggtgaatggcgtcgtgagactgctcaccaagccttgggatgttctgcccacagtgacccaaatggccatgacagacaccacgcctttcgggcagcagcgcgtctttaaggagaaagtggatacacggacccaggaacccaaggagggaaccaagaaacttatgaaaatcacagctgagtggctgtggaaagaactcggcaaaaagaagacgcctagaatgtgtacccgcgaggagttcattagaaaagtgcggtccaacgccgctctgggggccatctttacagacgagaataagtggaaaagcgctcgcgaggccgtcgaagattctagattctgggagctggttgacaaggaacggaacctccacctggagggaaaatgcgaaacctgtgtgtacaatatgatgggcaagagagagaagaaacttggcgagtttgggaaggcgaaaggatcccgggccatctggtacatgtggctgggcgctcgcttcctcgaatttgaggccctggggttccttaacgaagatcattggtttagcagagaaaattctctgtccggagtggaaggcgaggggctccacaagctgggctatattctgcgggacgtcagcaaaaaggagggaggcgctatgtacgccgacgatacagccgggtgggacacccgcatcacactcgaagatctgaagaacgaggaaatggtgaccaatcacatggagggagaacataagaaacttgcggaggctattttcaaactgacgtatcaaaacaaagttgtgagagtccagcggcccaccccgcgcggcacagtgatggacatcatttccagacgggatcagcgcgggagcggacaagttggcacctacgggctcaatacatttaccaacatggaggcccagctgatcagacagatggaaggcgagggagtgttcgaaaatatccagcaccttacggtcacagaggaggtggccgttcaaaactggctggctcgggtgggccgcgaaagactctctcggatggccattagcggggacgattgcgtcgtgaaacctctggacgatcgcttcgctaacgccctgaccgcgctcaatgacatgggaaagatcagaaaggatattcagcagtgggagccctccaaaggctggaacgactggacacaggtccccttttgctctcatcacttccatgaactgatcatgaaggatgggcgggtgcttgttgtgccttgtagaaatcaagacgagctgattggacgcgcccggatcagccagggcgctgggtggtccctcagagaaaccgcctgcctgggcaaatcttatgctcagatgtggagccttatgtactttcaccgccgggacctgagactcgccgcgaacgccatttgttccgctgtcccgtctcactgggtgcccacgagccgcaccacatggtccatccatgccaagcacgagtggatgaccacagaggatatgctgaccgtgtggaatcgggtttggatcagagaaaacccttggatggaggacaaaacacccgtggaaagctgggaggaaattccttatctgggaaagcgcgaggatcagtggtgcggctctctcatcgggctgacctcccgggctacgtgggccaagaatattcaagctgccatcaaccaggtcagaagccttattggaaatgaggaatacacagactacatgccctctatgaaacgcttccggagagaggaagaggaagcgggcgtgctgtggtga

SEQ ID NO: 19699 - RNA, 9876 nt, synthetic construct
  misc_feature 1..9876: note = derived and/or modified CDS sequence (opt5) from DENV-2__FJ639702__SS-prME
  source 1..9876: mol_type = other RNA
accgccggcgtgatcattatgctgatccccacagctatggccttccacctcacgaccagaaacggggagcctcatatgattgtcggacggcaggaaaagggcaaaagcctgctttttaagacagaggacggggttaatatgtgcaccctgatggcgatcgatctcggagaactgtgtgaggacacaattacctacaaatgcccgcttctgcgccaaaacgaacccgaggatatcgactgttggtgcaattccacatctacctgggtgacgtatggcacctgtacaaccacaggggagcacagacgggaaaagcgcagcgtggctctcgtccctcatgtgggaatgggcctggagaccagaacggaaacatggatgtcctctgagggcgcctggaaacacgttcagcggatcgagacctggattctgcgccatcccgggttcacaatcatggccgctattctcgcctacaccatcggaaccacacactttcagagagctctgattttcatccttctgacggccgtggcgcctagcatgaccatgcggtgcattggcatctccaaccgcgattttgtcgaaggggtgtctggaggcagctgggttgacatcgtgctcgagcacgggtcctgtgtcacaaccatggccaagaataagcccacactggatttcgaacttattaaaaccgaggctaaggaacctgccacgctgagaaaatattgcatcgaggctaagctcacaaacaccaccacagagagccggtgtccgacccagggagaaccctctctgaatgaggaacaagacaaacgctttgtgtgcaagcattccatggtggatagaggctggggcaacgggtgtggactgttcggcaaggggggaattgtcacatgcgccatgtttacgtgcaaaaagaatatggagggcaaaatcgttcagcctgaaaacctcgagtacaccattgtgatcacaccccacagcggggaggaacatgcggtgggaaatgacaccggcaagcacggcaaagagatcaagattacacctcagtcttccagcaccgaagccgagctgacggggtatggaaccgtcacaatggaatgttctccccggaccggccttgatttcaacgagatggtgctgctccagatggaggacaaagcttggctggttcaccgccaatggtttcttgatctgccgctcccttggctgcccggggccgacacacagggatccaattggatccagaaggaaaccctggtgacgttcaagaaccctcatgctaaaaagcaggacgtcgtggttctcggcagccaagagggggccatgcacacagccctgaccggcgctacagaaattcagatgtcctctggaaatcttctgtttaccggccatctcaaatgcagactgcggatggataagcttcagctgaaagggatgagctactccatgtgtaccggaaagttcaagatcgtgaaagagattgcggagacacaacacggcacgatcgtcatcagagtgcagtatgaaggggacggaagcccctgcaagattcccttcgagatcatggatctcgaaaaacgccatgtcctgggccggctgattaccgtgaaccctatcgttacagagaaggactctccggtgaacattgaagccgagcccccttttggggattcctacatcattatcggcgtcgagcccggacagctcaaactgaattggttcaagaagggcagctctatcgggcagatgtttgaaaccacaatgagaggagctaaacgcatggccattcttggcgacaccgcctgggatttcgggagcctgggaggcgtgtttacgtccatggggaaggctctccaccaagttttcggcgccatctacggagcggctttttctggcgtgagctggacaatgaaaattctgatcggggtcattatcacctggatcggaatgaactcccggagcacctctctgtccgtgagccttgtgctcgttggcgtcattacactgtatctgggggccatggtgcaggccgactctggatgtgtggtctcctggaagaataaagagctcaagtgcggcagcgggatcttcattaccgataacgtgcacacatggacggaacagtacaagtttcagcctgagtccccctctaaactggctagcgccatccaaaaggctcatgaagagggcatttgtggaatcagatccgttacccgccttgagaatctgatgtggaaacagatcacaccggaactcaaccacattctgtctgagaatgaagtgaagctgaccatcatgacaggcgacattaaagggatcatgcaggccggaaagcggagccttagacctcagcccaccgagctcaaatattcctggaagacgtggggcaaggcgaaaatgctgagcaccgaatctcataaccaaacattcctgattgatgggcctgagaccgccgagtgccccaatacaaaccgcgcttggaattccctcgaagtcgaggactacggatttggcgtgttcaccacaaacatctggctgaagcttcgggaaaaacaggacgttttttgtgatagcaagctgatgtctgccgctatcaaagacaatagagccgtgcacgcggatatgggctattggattgagtccgccctcaacgacacctggaagatggagaaggctagcttcatcgaagtcaaatcttgccactggcctaagagccatacgctgtggtccaatggggtgctggagagcgaaatgattatccccaaatctttcgccggaccggtttcccagcacaactaccgccctggctattacacacagaccgctgggccctggcatcttggaaagctcgagatggattttgacttctgtgaaggcaccacagtggtcgtgaccgaggattgcgggaaccggggacccagcctgagaacgacaaccgcctccggcaaactgattacagagtggtgctgtcggtcttgcaccctccctccgctgcgctacagaggcgaagacgggtgttggtatggaatggagatccggccccttaaggaaaaggaggaaaatctggtgaacagcctcgtcacagccggccacgggcaaattgataatttttccctgggagttctgggcatggctcttttcctcgaggagatgctgagaacccgcgtggggacgaaacatgcgatcctgctcgtggccgtctctctggtgacccttatcacaggaaacatgagctttcgggacctgggcagagttatggtgatggtcggcgctaccatgacagatgacattgggatgggagtgacctacctcgccctgctggccgctttcaaggttcgccctacgtttgccgcgggccttctgctcagaaaactgacatccaaggaactcatgatggctaccatcgggattgccctgctttctcagagcacaatccccgagaccattctggaactcaccgatgccctggctctgggaatgatggtgcttaaaatcgtccggaatatggagaagtatcagctggccgtgacaatcatggcgatttcctgcgttcctaacgctgtgatcctccaaaatgcctggaaggtcagctgtacgattctggccgctgtgtctgtgtcccccctcctgcttaccagctctcagcagaaagccgactggatccctctggctctcacaattaagggcctgaaccccaccgccatcttcctgacaaccctttcccgcacgagcaaaaagagatcttggccgctgaatgaagcgatcatggccgtcgggatggtttccattctcgctagctccctgctcaaaaacgacatccctatgacaggacccctggtggccggcggccttctgaccgtgtgctacgtcctgaccgggcggagcgctgatctcgagctggagcgcgccacagacgtgaagtgggaagatcaggccgagatttctggaagctcccctatcctttctattaccatcagcgaagacggctccatgtctattaaaaatgaggaggaagagcaaacactgacgatcctcatcagaaccgggctgctcgttattagcggactgtttcccgtgtccatcccgattacagctgcggcctggtatctttgggaagtcaagaagcagcgggctggcgtgctgtgggatgttccttctccccctcccgtggggaaagccgagctggaagacggagcctaccgcatcaagcagaaaggcattctcggctatagccagatcggggctggagtctacaaggagggcaccttccacacaatgtggcacgtgaccagaggggccgtcctgatgcatcggggaaaacgcatcgagccctcctgggcggatgtgaagaaggaccttattagctacggcgggggatggaaactggaaggcgagtggaaggaaggcgaggaagttcaagtgctcgctctggagcctgggaaaaacccgagagccgtccagacgaagcccggactctttaaaaccaatacaggcaccatcggggccgtgtctctggatttctcccctggaacaagcggctctcccattgttgaccggaaggggaaggtggtcggactttatggcaacggcgtggtgaccagatccggggcttacgttagcgccatcgcgcagacagagaaatccattgaagataatcctgagatcgaagacgatatctttcgcaagaaacggctgacgattatggacctgcaccccggagctggcaagaccaaaagatatctccctgccatcgtccgcgaggccattaagcgggggctgagaacacttatcctggctccgacccgcgtggtggccgctgaaatggaggaggccctccggggactgcccattagataccagacccctgcgatccgcgccgaacatacaggccgggagattgtcgacctcatgtgtcacgctacgttcaccatgagactgctttctcccgtgcgggttcctaactataacctgatcatcatggatgaagcccatttcacagaccccgctagcattgccgcccgcgggtacatctccaccagagtggagatgggcgaggctgcgggaatttttatgacagccaccccgcctggcagcaaggatcccttcccccaatctaatgctcctatcatggacgaagagcgggaaattcccgagcgctcctggaacagcgggcacgaatgggtcacggattttaaaggaaagacagtgtggttcgttccttctatcaaagccggcaatgacatcgccgcttgcctgagaaagaacgggaaaaaggtgattcagctcagccggaagacctttgattccgagtatgtcaaaaccagaacaaatgactgggatttcgtggttaccacagacatctctgagatgggagccaactttaaggcggaacgcgtgattgatccgcggagatgtatgaaacccgtcatcctgaccgacggcgaggaacgcgtgattcttgctgggcctatgcccgtgacgcacagctccgccgcccagcggagaggccgcatcggacggaatcctaagaacgagaatgaccaatacatctacatgggcgaacccctggagaacgatgaggactgcgctcattggaaagaagccaagatgctcctggataatattaacacaccggaggggatcattccttctatgttcgaacccgagagagaaaaagtcgacgcgatcgatggagagtatcgcctgagaggcgaggcccggaagacctttgttgacctcatgcgcagaggggatcttcctgtgtggctggcttaccgggtggccgctgaaggaattaattatgccgaccgcagatggtgtttcgatggcgtcaagaacaatcagatcctggaggaaaacgtggaggttgagatttggacaaaagaaggggagcggaagaaactcaagcccagatggctggacgctcgcatctacagcgatcctcttgccctgaaagaatttaaggagttcgcggccggccggaagtccctcaccctgaacctgatcacggaaatgggaagactccccaccttcatgacacagaaagctcgcgacgcccttgataatctggctgtgctgcacaccgccgaggccggcgggcgggcttataaccatgcgctcagcgagctgccggaaacacttgagaccctgctcctgctgacactccttgccaccgtcacgggaggcgtgtttctgttcctgatgtctgggaagggagttggcaaaatgacactcggcatgtgctgcattatcaccgcttccattctgctttggtacgcccagatccaacctcactggattgccgctagcatcatcctggaatttttcctcattgtgctgctgatccccgagcccgaaaagcagagaacccctcaggacaatcagctcacatatgtcgtgattgccatccttaccgtcgtggcggccacaatggctaacgagatggggtttctggagaaaacgaagaaggacctgggactcggctccattgccacccaagaaccggagtctaatatcctggatatcgaccttcggcccgctagcgcctggacactgtacgcggttgccaccacattcgtgacccctatgctccgccactccattgaaaactctagcgtgaatgtctccctgacggctatcgccaaccaggctaccgttctgatggggctcggaaaaggctggccccttagcaagatggatattggggtgcctctgctggccatcggatgttactctcaggtgaatcccgtcacactcaccgctgccctgcttctgctcgtggcgcattatgccattatcggccctggcctgcaggctaaagccacaagagaggctcaaaagcgggccgccgcggggattatgaaaaacccgaccgttgacggaatcacggtgatcgatctggaccccattccttacgatcccaagtttgaaaagcagctcggccaggtcatgcttctgatcctgtgcgtgacacaggtcctcatgatgcgcaccacatgggctctgtgtgaggcccttaccctggctaccgggcctatttccacactctgggagggaaatcccggcagattctggaacacgaccatcgccgtgagcatggccaatatttttcgggggtcttatctggctggagccggcctgctcttctccatcatgaaaaacacaaccaatacacgcagaggcaccgggaacatcggagaaacgcttggcgagaagtggaaaagccggctgaatgcgctggggaagtctgaatttcaaatttacaaaaagagcggaatccaggaggttgaccgcacactcgccaaagagggcattaagagaggggaaaccgatcaccatgctgtgtcccggggatctgccaagctgagatggttcgtcgagcgcaacatggtgaccccggaaggcaaagttgtggaccttggctgcgggcggggaggctggagctattactgtgggggactgaagaacgtcaaagaggtgaagggcctcacaaaagggggacctggccacgaagagcccatccccatgtccacctatggctggaatctggtgagactgcagagcggggttgatgtctttttcacacctcccgagaagtgcgacacgctcctttgtgatattggagaatcctctcctaacccgaccatcgaggctggccgcacactgcgggtgctgagcctcgtggaaaattggctgaacaatgacacccaattctgcatcaaggtccttaacccctacatgccttccgttattgagaaaatggaaacactgcagagaaagtacgggggagccctcgtgcgcaatcccctgtctcggaacagcacccatgagatgtattgggtgtccaatgcgacgggcaacatcgtctctagcgtgaatatgatttccagaatgctgatcaaccgctttaccatgaaacacaagaaagccacatacgagcctgacgttgatctcgggagcggaacccggaatattggcatcgaatctgagatccccaaccttgacattatcggcaagagaattgaaaagatcaaacaggagcacgaaacatcctggcattatgatcaggaccacccgtacaagacctgggcttatcatgggagctacgagacaaaacaaaccggatctgcctccagcatggtgaatggcgtcgtgcgcctgctgacgaagccttgggatgttgtgcccatggtcacacagatggctatgaccgacaccacacctttcgggcagcagcgggtgtttaaagagaaggtggatacgagaacccaagaacccaaggagggaacaaaaaagctcatgaaaattaccgccgaatggctgtggaaggagcttggcaaaaagaaaacacctcgcatgtgtaccagagaggaattcacacggaaggtccgctctaacgctgccctgggggcgatctttaccgacgagaacaagtggaaatccgccagagaagctgttgaggatagccggttctgggaactcgtggacaaggagagaaatctgcacctggagggaaaatgcgaaacgtgtgtgtataacatgatgggcaagcgggagaaaaagctcggcgaatttgggaaggccaaaggatcccgcgctatttggtacatgtggctgggcgccagattccttgagtttgaagccctggggttcctcaatgaggatcactggtttagccgggagaactctctgagcggagtcgaaggcgaggggcttcataagctgggctacatcctccgcgacgtgggaaaaaaggaaggcggggcgatgtatgctgacgataccgccggatgggacacaagaatcaccctggaggatctgaaaaatgaagagatggttacaaaccacatggagggcgaacataagaagctcgccgaggctattttcaaactgacctaccagaataaggtggtccgggtgcagcgccccacgccgagagggacagttatggacatcatttcccggcgcgatcagagaggatctggccaagtggggacctatggccttaacacatttaccaatatggaagcccagctgatccggcagatggagggagagggcattttcaaaagcatccaacacctcacggctaccgaagagatcgccgtccagaactggctggcgcgcgtggggagagaacggctttcccgcatggccatttctggagacgattgcgttgtgaagcctctggacgatagattcgctagcgccctcacagctctgaatgacatgggcaaagtccggaaggatatccagcagtgggagccctccagagggtggaacgactggacccaagtgcccttttgctctcatcacttccacgaactgattatgaaggatggacgcgtcctcgtggttccttgtcggaatcaggacgagctgatcggcagagcccgcattagccagggggcgggctggtcccttaaagagacagcctgcctgggaaagagctacgctcagatgtggtctctcatgtattttcatcggagagacctgcgccttgccgctaacgccatctgttccgctgtgccgagccactgggtccccacctctcggacaacctggtccatccatgccaaacacgaatggatgacgacagaggatatgctgaccgtgtggaatagagtgtggattcaagaaaacccttggatggaggacaagacccccgttgaaagctgggaggaggtgccttacctcggcaaacgcgaagatcagtggtgcgggtccctgatcggactgacatctcgggcgacctgggccaagaacattcagacagctatcaatcaggtcagaagcctcattggcaacgaggaatatacggactacatgccctccatgaagcgcttccggagagaggaagaggaggccggggtgctgtggtga

SEQ ID NO: 19700 - RNA, 9876 nt, synthetic construct
  misc_feature 1..9876: note = derived and/or modified CDS sequence (opt5) from DENV-2__GQ868621__SS-prME
  source 1..9876: mol_type = other RNA
agcgccggaatgatcattatgctgatccccacagtgatggctttccacctgacaacgagaaatggggagcctcatatgattgtcggaatccaggaaaagggcaaatccctgctttttaagaccgaggacggggttaatatgtgcacactgatggccatggatctcggagaactgtgtgaggacaccattacatacaaatgcccgcttctgcggcaaaacgaacccgaggatatcgactgttggtgcaattctaccagcacatgggtgacctatggcacgtgtaccacaaccggggagcacagaagagaaaagcggtccgtggcgctcgtccctcatgtgggaatgggcctggagacacgcaccgaaacgtggatgtctagcgagggcgcttggaaacacgcccagagaatcgagacatggattctgcggcatcccgggttcaccatcatggccgctattctcgcctacacaatcggaaccacccactttcagcgcgttctgattttcatccttctgacagctgtggccccttccatgacgatgagatgcattggcatctctaaccgggattttgtcgaaggggtgagcggaggctcctgggttgacatcgtgctcgagcacgggagctgtgtcaccacaatggcgaagaataagcccaccctggatttcgaacttattaaaacagaggccaagcagcctgctaccctgcgcaaatattgcatcgaagccaagctcacgaacacaaccaccgagtctagatgtccgacacaaggagagccctccctgaaagaagaacaagacaagcggtttgtgtgcaagcatagcatggtggatcgcggctggggcaatgggtgtggactgttcggcaaagggggaattgtcacatgcgctatgtttacatgcaagaaaaacatggaaggcaagatcgttcagcctgagaatctcgaatacacgattgtggtgacaccccactctggggaggagcatgccgtcggaaacgacacaggcaaacacggcaaggaaatcaaagtgacccctcagtccagcatcacagaggcggaactgaccgggtatggaacggttaccatggagtgttctcccagaacaggccttgatttcaatgaaatggtgctgctccaaatggagaacaaggcctggctggtccaccggcagtggtttcttgacctgccgctcccttggctgcccggggctgataagcaggagtccaattggattcagaaagaaaccctggtgacattcaagaaccctcatgccaaaaagcaagacgttgtggtcctcggaagccaggagggcgctatgcacaccgccctgacgggggccacagaaatccagatgtcctctggcaatcttctgtttaccggacatctcaaatgccgcctgagaatggacaaacttcaactgaagggcatgagctactccatgtgtacagggaaattcaaggtggtcaaagagattgctgagacccagcacggaaccatcgtgattcgggttcagtatgaaggcgatgggagcccctgcaagatccccttcgagatcatggacctcgagaagcggtacattctgggacgcctgatcacagtgaaccctattgtcacggagaaggattctccggtgaacatcgaagcggagcccccttttggcgactcctacattatcattggggttgagcccggccagctcaagctgaattggttcaaaaagggaagctctatcggccaaatgtttgaaaccacaatgagaggggccaaaagaatggctatccttggagataccgcctgggacttcggcagcctcgggggagtgtttacatccattggcaaggccctccatcaggtcttcggggctatctatggcgccgcgttttctggagtgagctggaccatgaaaattctgatcggcgtgattatcacgtggatcgggatgaactcccgcagcacatctctgtccgttagccttgtcctcgtgggaattgtgaccctgtacctgggcgtcatggtgcaggctgattctgggtgtgttgtgtcctggaagaataaggagctcaaatgcggaagcggcatcttcattaccgacaacgtccacacatggaccgaacagtataagtttcaacctgagtccccctctaaactggccagcgccatccagaaggctcaggaagaggggatttgtggcatccggtccgtgacaagacttgagaatctgatgtggaaacagatcacgccggaactcaaccacattctggccgagaatgaagttaagctgaccatcatgacaggagatattaaaggcatcatgcaagctgggaagcgctctcttcggcctcagcccaccgagctcaagtacagctggaaaacatggggaaaggccaaaatgctgtccaccgaaagctataaccagacgttcctgattgacggccctgagaccgcggagtgccccaatacaaacagagcctggaactctctcgaagtggaggattacgggtttggagtcttcaccacaaacatctggctgaaacttaaagaaaagcaggacgctttttgtgactccaagctgatgagcgccgctatcaaagataatcgcgccgtgcatgcggacatgggctattggattgagtctgccctcaacgatacctggaagatcgagaaggctagcttcattgaagttaagaattgccactggcctaaaagccatacactgtggtctaacggcgtgctggagagcgaaatgatcattcccaagaaccttgccgggccggtctcccaacacaattaccggcctggataccacacccagatcgctggcccctggcatctcgggaagctggagatggacttcgatttttgtgacggaacgacagtgattgtgaccgaagattgcggcaacagagggcccagcctgcgcaccacaaccgcctctggaaaactcatcacggagtggtgctgtcggtcctgcacactgcctccgcttagatatcggggcgaggacggctgttggtacgggatggaaatccgccccctgaaggagaaagaagagaatctcgtcaacagcctggttaccgccggacacggccaggtggataatttctccctgggggtgcttggaatggctctctttctggaagagatgctgagaacacgggtcggcaccaagcatgcgattctcctggtggccgtttctttcatgacacttatcaccgggaacatgagctttaaagacctgggaagagtggtcgtgatggttggcgctacgatggccgatgacattggcatgggggtgacctatctcgccctgctggctgccttcaaggtccgccctacatttgcggctggacttctgctccggaagctgacctccaaagagctcatgatgacaaccatcggcattgtgctgctttctcaaagcacgatccccgaaacagttctggagctcaccgatgccctggccctggggatgatggtgcttaagatcgtcagaaatatggaaaaataccagctggctgtgacaattatggccatcctctgcgtgcctaacgcggtcattctgcagaatgcttggaaggtttcctgtaccatcctcgccgtggtgtctgtcagccccctgcttctgacctccagccagcagaagacagactggattcctctcgccctgacgatcaagggactgaaccccaccgctatcttccttacaaccctgtctcgcacaaataaaaagagatcctggccgctcaacgaggccattatggctgtgggcatggttagcatcctggcctcttccctcctgaagaatgacattcctatgaccgggccccttgtggcgggaggcctgctgacggtctgctatgtgctcacaggccggagcgccgatctggaacttgagcgcgctaccgacgttaaatgggaggatcaggccgaaatctctgggtccagccctattctgtccatcaccattagcgaggacggatctatgagcatcaagaacgaagaggaggaacacacactcaccatcctgattagaacaggcctcctggtgatctccgggctttttcccatttctatcccgattacggctgccgcctggtacctgtgggaggtcaaaaagcagcgggctggagtgctgtgggatgtcccttctccccctcccatgggcaaagcggaactcgaggacggggcctatcgcatcaagcagaagggaatcctgggctactcccaaattggcgctggggtgtacaaagaaggaaccttccatacaatgtggcacgttaccagaggcgccgtgcttatgcacaaggggaaacggatcgagccctcctgggccgatgtcaagaaagacctgattagctatggaggcgggtggaagctcgagggagaatggaaggagggcgaagaggtgcaggttctggctctcgaacctggcaaaaatccgcgcgccgtgcagacaaagcccgggctgtttaaaaccaacacgggaaccatcggcgcggtctcccttgatttctctcctgggacaagcggatcccccattatcgacaagaaaggcaaggtggtggggctgtacggaaacggcgttgtcaccagaagcggcgcttatgtgtctgccatcgcccagacagagaagtccattgaggataatcctgaaatcgaggacgatatttttcggaaacgcagactgaccatcatggacctccatcccggggctggaaagacaaaacggtacctgcctgccattgtgagagaagcgatcaagcgcggccttcggacgctgattctcgctccgaccagagtcgtggccgccgagatggaagaggctctgcgcgggctccccatccggtatcaaacccctgccatcagagctgagcacaccggacgcgaaattgttgacctgatgtgtcatgccaccttcacaatgcggcttctgagccccgtgagagtccctaactacaatctgatcattatggatgaggcgcacttcacggaccccgcctctatcgctgcccgcggctatatttccacccgggtggaaatgggggaggctgccggcatctttatgacagccaccccgcctggaagcagagatcccttcccccagtccaacgctcctatcattgacgaggaacgggagatccccgaacgctcttggaatagcggccatgagtgggttacagattttaaagggaagaccgtgtggttcgtcccttccattaaggcgggaaacgacatcgccgcttgcctccgcaaaaatggcaagaaagtgattcagctgagccggaagacgtttgattctgaatacgttaaaacacgcaccaacgactgggatttcgtggtcaccacagacatctccgagatgggggccaattttaaggccgagagagtgatcgatccgcggagatgtatgaaacccgtgattcttaccgacggagaggaacgcgtcatcctggctggccctatgcccgttacacacagctctgccgcgcaacggagagggcgcattggccggaaccctaagaatgaaaacgaccagtacatctatatgggagagcccctcgaaaatgatgaggactgcgctcactggaaggaggccaaaatgctgctggataacattaataccccggaaggcatcattcctagcatgttcgagcccgaaagagagaaggtggacgccatcgatggggaataccgcctccggggagaggctagaaaaacgtttgtggaccttatgcgcagaggcgatctgcctgtctggctggcctataaggtggcggccgaggggatcaactacgctgaccggcgctggtgtttcgatggaattaaaaacaatcagatcctcgaagagaacgttgaagtggagatttggacaaaggagggcgaaagaaagaaactgaagccccggtggcttgacgcccgcatctattccgatcctctggctctcaaagagtttaaggagttcgccgctgggagaaaatctctgaccctgaatctcattacagagatgggccggcttcccaccttcatgacgcagaagaccagagacgccctggataacctggcggtcctccatacagccgaagctggaggccgcgcctacaatcacgctctgagcgagcttccggagaccctggaaacactcctgctgctcacccttctggccacagtgaccgggggaatctttctgttcctcatgtccggccgggggatcggaaagatgacgctgggcatgtgctgcattatcacagcctctattcttctgtggtatgctcaaatccagcctcattggattgcggccagcatcatcctcgagtttttcctgattgttctgctcatccccgaacccgagaaacagagaacccctcaggacaaccaacttacctacgtggtcattgctatcctgacagtggtcgccgccaccatggctaatgaaatgggctttctggagaagaccaagaaggacctcgggctgggatccattgccacgcagcagccggagagcaacatccttgatattgacctgcgccccgcgtctgcctggaccctctacgctgtggccacaaccttcgttacacctatgctgcggcactccatcgaaaatagctccgtgaacgtgtctctgaccgctatcgccaatcaggcgacggtcctcatgggccttgggaaaggatggcccctgagcaagatggatattggcgttcctctgctcgccatcgggtgttattcccaagtgaaccccattaccctgacagctgcccttctgctcctggtggctcactacgccatcattggacctggcctgcaggctaaggccaccagagaggcgcagaaacgggccgctgccggcatcatgaagaatccgacagtcgacgggatcaccgtgattgatctcgaccccatcccttatgatcccaaatttgaaaagcagcttggacaagttatgctgctgattctctgcgtgacgcaggtcctgatgatgcgcacaacctgggctctttgtgaggccctgacactcgccaccggccctatctctaccctgtgggaagggaaccccggaagattctggaatacaacgattgcggtgagcatggctaacatctttcggggctcctacctggccggggctggactccttttcagcatcatgaaaaataccacaaacacccgcagaggcacaggcaacattggggagaccctgggagagaagtggaaatctcggctgaatgccctcggcaagtccgaatttcagatctataagaaaagcgggattcaagaggtcgaccgcacgctggccaaggaaggaatcaaaagaggcgagacagatcatcacgctgtgtctcgggggtccgccaaacttcgctggttcgttgagagaaacatggtgaccccggaaggaaaagtcgtggacctgggctgcggcagagggggatggagctactattgtggcgggctcaagaatgttcgggaggtgaagggactgaccaaaggcgggcctggacatgaagaacccattcccatgtctacatacggctggaacctggtccgcctccagagcggcgtggatgtgtttttcatccctcccgaaaagtgcgacacccttctgtgtgatatcggggagtcctctcctaatccgacagttgaggcgggacggacgctgagagtcctcaacctggtggaaaattggcttaacaataacacccagttctgcattaaagtgctgaatccctacatgcctagcgtcatcgagaagatggaagccctccagcgcaaatatggcggggctctggttcggaaccccctgtccagaaatagcacacacgagatgtactgggtgtccaacgcctctggaaatattgtgagctccgtcaacatgatctctcgcatgctcattaaccggtttaccatgagacataagaaggctacatatgaacctgacgtggaccttggcagcgggacccgcaatatcggaattgagtccgaggttcccaacctggatatcatcggcaaacggattgaaaagatcaaacaagagcacgaaacgtcttggcactacgaccaggatcatccgtataagacctgggcctaccacggcagctatgagacaaaacagaccgggtccgcgagctctatggtgaatggagtcgtgagactgctcacaaagccttgggacgttctgcccaccgtgacacagatggccatgaccgatacgacacctttcggccaacagcgcgtctttaaggaaaaagtggacacccggacccaggagcccaaggaggggaccaagaaacttatgaaaattacggctgaatggctgtggaaggagctcggcaaaaagaagacccctagaatgtgtacacgcgaagagttcaccagaaaagtgcggtccaacgccgctctgggcgccatctttacagatgagaataagtggaaaagcgctcgcgaagccgtcgaggactctagattctgggaactggttgataaggagcggaacctccatctggaagggaaatgcgagacctgtgtgtacaatatgatgggaaagagagagaagaaacttggcgaatttggcaaggcgaaagggtcccgggccatttggtacatgtggctgggagctcgcttcctcgagtttgaagccctgggcttccttaacgaggaccactggtttagcagagaaaattctctgtccggggtggagggagagggcctccacaagctggggtatatcctgcgggatgtcagcaaaaaggaaggcggagctatgtacgccgacgacacagccggctgggatacccgcatcacgctcgaggacctgaagaacgaagagatggtgaccaatcatatggaaggggagcacaagaaacttgcggaggctattttcaaactgacatatcagaacaaagttgtgagagtccaacggcccaccccgcgcggaacagtgatggatatcatttccagacgggaccagcgcggcagcgggcaggttggaacctacggcctcaatacgtttacaaacatggaagcccaactgatcagacagatggagggggaaggcgtgttcaaaaatattcagcatcttaccgtcacagaggaggtggccgttcagaactggctggctcgggtgggacgcgaaagactctctcggatggccatcagcggcgatgactgcgtcgtgaagcctctggatgaccgcttcgctaacgccctgaccgcgctcaatgatatggggaagatcagaaaagacattcaacagtgggagccctccaagggatggaacgattggacgcaggtccccttttgctctcaccatttccacgaactgatcatgaaagacggccgggtgcttgttgtgccttgtagaaatcaggatgagctgattgggcgcgcccggatcagccaaggagctggctggtccctcagagaaaccgcctgcctggggaagtcttatgctcagatgtggagccttatgtactttcaccgccgggacctgagactcgccgcgaacgccatttgttccgctgtcccgtctcattgggtgcccacaagccgcaccacatggtccatccacgccaaacatgagtggatgaccacagaggacatgctgaccgtgtggaatcgggtttggattagagaaaacccttggatggaggataagacgcccgtggaaagctgggaggaaatcccttatctgggcaagcgcgaggaccagtggtgcggatctctcatcggcctgacatcccgggctacctgggccaaaaatattcaggctgccatcaaccaagtcagaagccttattgggaatgaggaatacaccgattacatgccctctatgaagcgcttccggagagaggaagaggaagcgggagtgctgtggtga

SEQ ID NO: 19701 - RNA, 9876 nt, synthetic construct
  misc_feature 1..9876: note = derived and/or modified CDS sequence (opt5) from DENV-2__FJ639704__SS-prME
  source 1..9876: mol_type = other RNA
agcgccggcatgatcattatgctgatccccaccgtcgtcgctttccacctgaccacgagaaatggggagcctcatatgattgttggaatccaggaaaagggcaagagcctgctttttaagaccgaggacggggtgaatatgtgcacgctgatggccatggatctcggagaactgtgtgaggacaccattacatacaagtgcccgcttctgcggcaaaacgaacccgaggatatcgactgttggtgcaattctaccagcacatgggtgacctatggcacgtgtaccacaaccggggagcacagaagagaaaagcggtccgtcgcgctcgtgcctcatgttggaatgggcctggagacacgcaccgaaacgtggatgtctagcgagggcgcttggaaacacgcccagagaatcgagacatggattctgcggcatcccgggttcaccatcatggccgctattctcgcctacacaatcggaaccacccactttcagcgcgctctgattttcatccttctgacagccgtggcgccttccatgacgatgagatgcattggcatctctaaccgggattttgtcgaaggggtgagcggaggctcctgggttgacatcgtgctcgagcacgggagctgtgtcaccacaatggccaagaataagcccaccctggatttcgaacttattaaaacagaggctaagcagcctgccaccctgcgcaaatattgcatcgaagctaagctcacgaacacaaccaccgagtctagatgtccgacacaaggagagccctccctgaaagaagaacaggacaagcggtttgtgtgcaagcatagcatggtggatcgcggctggggcaatgggtgtggactgttcggcaaagggggaattgtgacctgcgccatgtttacatgcaagaaaaacatggaaggcaagatcgttcagcctgagaatctcgaatacacgattgtggtgacaccccactctggggaggagcatgcggtcggaaacgacacaggcaaacacggcaaggaaatcaaagtgacccctcagtccagcatcacagaggccgaactgaccgggtatggaacggttaccatggagtgttctcccagaacaggccttgatttcaatgaaatggtgctgctccaaatggagaacaaggcttggctggtccaccggcagtggtttcttgacctgccgctcccttggctgcccggggccgataagcaggagtccaattggattcagaaagaaaccctggtgacattcaagaaccctcatgctaaaaagcaagacgttgtggtcctcggaagccaggagggcgccatgcacaccgccctgacgggggctacagaaatccagatgtcctctggcaatcttctgtttaccggacatctcaaatgccgcctgagaatggacaaacttcaactgaagggcatgagctactccatgtgtacagggaaattcaaggtggtcaaagagattgcggagacccagcacggaaccatcgtgattcgggttcagtatgaaggcgatgggagcccctgcaagatccccttcgagatcatggacctcgagaagcggtacgtgctgggacgcctgattacagtcaaccctatcgtgacggagaaggattctccggttaacattgaagccgagcccccttttggcgactcctacatcattatcggggtggagcccggccagctcaagctgaattggttcaaaaagggaagctctattggccaaatgtttgaaaccacaatgagaggggctaaaagaatggccatccttggagataccgcctgggacttcggcagcctcgggggagtctttacatccatcggcaaggctctccatcaggtgttcggggccatttatggcgcggctttttctggagtgagctggaccatgaaaatcctgattggcgttatcattacgtggatcgggatgaactcccgcagcacatctctgtccgtcagccttgtgctcgtgggaatcgtcaccctgtacctgggcgtgatggttcaggccgattctgggtgtgtggtctcctggaagaataaggagctcaaatgcggaagcggcattttcatcaccgacaacgtgcacacatggaccgaacagtataagtttcaacctgagtccccctctaaactggccagcgctattcagaaggcccaggaagaggggatctgtggcattcggtccgttacaagacttgagaatctgatgtggaaacagatcacgccggaactcaaccacatcctggctgagaatgaagtgaagctgaccattatgacaggagatatcaaaggcattatgcaagccgggaagcgctctcttcggcctcagcccaccgagctcaagtacagctggaaaacatggggaaagaccaaaatgctgtccacggaaagctataaccagaccttcctgatcgacggccctgagacaaccgagtgccccaatacaaacagagcgtggaactctctcgaagtcgaggattacgggtttggagtgttcaccacaaacatttggctgaaacttaaagaaaagcaggacgccttttgtgactccaagctgatgagcgctgccatcaaagataatcgcgctgttcatgccgacatgggctattggatcgagtctgcgctcaacgatacctggaagattgagaaagcctccttcatcgaagtgaagaattgccactggcctaaaagccatacgctgtggtctaacggcgtcctggagagcgaaatgattatccccaagaaccttgctgggccggtgtcccaacacaattaccggcctggataccacacacagattgccggcccctggcatctcgggaagctggagatggacttcgatttttgtgacggaaccaccgtgatcgtcacagaagattgcggcaacagagggcccagcctgcgcaccacgacagcttctggaaaactcattaccgagtggtgctgtcggtcctgcacactgcctccgcttagatatcggggcgaggacggctgttggtacgggatggaaatccgccccctgaaggagaaagaagagaatctcgttaacagcctggtgaccgccggacacggccaggtggataatttctccctgggggtccttggaatggccctctttctggaagagatgctgagaacacgggtgggcaccaagcatgctatcctcctggttgcggtgtctttcgtcacgcttattaccgggaacatgagctttaaagacctgggaagagtggttgtgatggtcggcgccacaatggctgatgacatcggcatgggggtgacctatctcgccctgctggccgctttcaaggttcgccctacatttgccgcgggacttctgctccggaagctgacctccaaagagctcatgatgacgacaattggcatcgtgctgctttctcaaagcaccattcccgaaacaatcctggagctcaccgatgctctggccctggggatgatggtccttaagatcgtgagaaatatggaaaaataccagctggccgtgaccattatggctatcctctgcgtccctaacgccgttattctgcagaatgcgtggaaggtgtcctgtacaatcctcgctgtggtctctgtgagccccctgcttctgacgtccagccagcaaaaagccgactggattcctctcgccctgaccatcaagggactgaaccccacagctatcttccttaccacactgtctcgcaccaataaaaagagatcctggccgctcaacgaggccattatggctgttggcatggtgagcatcctggcctcttccctcctgaagaatgacattcctatgacggggccccttgtcgcgggaggcctgctgacagtgtgctatgttctcaccggccggagcgccgatctggaacttgagcgcgctaccgacgtgaaatgggaggaacaggccgagatctctgggtccagccctattctgtccatcacaattagcgaagatggatctatgagcatcaagaacgaggaggaagaacagaccctcacaatcctgattagaacgggcctcctggtcatctccgggctttttcccatttctatcccgattaccgctgccgcctggtacctgtgggaagtgaaaaagcagcgggctggagtcctgtgggacgtgccttctccccctcccatgggcaaagcggagctcgaagatggggcctatcgcatcaagcaaaagggaatcctgggctactcccagattggcgctggggtttacaaagagggaacattccacaccatgtggcatgtgacaagaggcgccgtccttatgcacaaggggaaacggatcgagccctcctgggccgacgtgaagaaagatctgattagctatggaggcgggtggaagctcgaaggagagtggaaggaaggcgaggaagttcaggtgctggctctcgagcctggcaaaaatccgcgcgccgtccagaccaagcccgggctgtttaaaacgaacaccggaacaatcggcgcggtgtcccttgacttctctcctgggaccagcggatcccccattatcgataagaaaggcaaggtggttgggctgtacggaaacggcgtcgtgacaagaagcggcgcttatgtgtctgccatcgcccaaaccgagaagtccattgaagacaatcctgagatcgaagatgacatttttcggaaacgcagactgacaatcatggatctccaccccggggctggaaagacgaaacggtacctgcctgccattgtcagagaggcgatcaagcgcggccttcggaccctgattctcgctccgacaagagtggttgccgccgaaatggaggaggctctgcgcgggctccccatccggtatcagacccctgccatcagagctgaacataccggacgcgagattgtggacctgatgtgtcacgccacattcacgatgcggcttctgagccccgtcagagtgcctaactacaatctgatcattatggacgaagcgcatttcaccgatcccgcctctatcgctgcccgcggctatatttccacacgggttgagatgggggaggctgccggcatctttatgaccgccacaccgcctggaagcagagaccccttcccccagtccaacgctcctatcattgatgaggaacgggaaatccccgagcgctcttggaatagcggccacgaatgggtgaccgactttaaagggaagacggtctggttcgtgccttccattaaggcgggaaacgatatcgccgcttgcctccgcaaaaatggcaagaaagttattcaactgagccggaagacatttgactctgagtacgtgaaaacccgcaccaacgattgggacttcgtcgtgacaaccgatatctccgagatgggggccaattttaaggccgaaagagtgatcgacccgcggagatgtatgaaacccgtcattcttacagatggagaggaacgcgttatcctggctggccctatgcccgtgacccatagctctgccgcgcagcggagagggcgcattggccggaaccctaagaatgagaacgaccagtacatctatatgggagaacccctcgagaatgacgaggattgcgctcactggaaggaagccaaaatgctgctggacaacattaatacgccggagggcatcattcctagcatgttcgaacccgagagagaaaaggtggatgccatcgacggggagtaccgcctccggggagaggctagaaaaacatttgtcgatcttatgcgcagaggcgacctgcctgtgtggctggcctataaggttgcggccgaagggatcaactacgctgatcggcgctggtgtttcgacggaattaaaaacaatcagatcctcgaggaaaacgtggaggtcgagatttggaccaaggaaggcgagagaaagaaactgaagccccggtggcttgatgcccgcatctattccgaccctctggctctcaaagaatttaaggagttcgccgctgggagaaaatctctgacactgaatctcattaccgaaatgggccggcttcccacgttcatgacccaaaagacaagagatgccctggacaacctggcggtgctccacaccgccgaggctggaggccgcgcctacaatcatgctctgagcgagcttccggaaacactggagaccctcctgctgctcacacttctggccaccgttacagggggaatctttctgttcctcatgtccggccgggggatcggaaagatgacactgggcatgtgctgcattatcaccgcctctattcttctgtggtatgctcagatccagcctcactggattgcggccagcatcatcctcgaatttttcctgattgtgctgctcatccccgagcccgaaaaacagagaacccctcaagataaccagcttacatacgtcgtgattgctatcctgaccgtcgtggccgccacaatggctaatgagatgggctttctggagaagacgaaaaaggacctcgggctgggatccattgccacccagcagccggaaagcaacatccttgacattgatctgcgccccgcgtctgcctggacactctacgctgttgccaccacattcatcacccctatgctgcggcattccatcgagaatagctccgtgaacatttctctgacggctatcgccaatcaagcgaccgtgctcatgggccttgggaaaggatggcccctgagcaagatggacattggcgtccctctgctcgccatcgggtgttattcccaggttaaccccattacactgaccgctgcccttctgctcctggtggctcactacgccatcatcggacctggcctgcaggctaaggccacaagagaagcgcagaaacgggccgctgccggcattatgaagaatccgaccgtggatgggatcacggtcattgacctcgatcccatcccttatgaccccaaatttgagaagcaacttggacaggtgatgctgctgattctctgcgttacacaggtgctgatgatgcgcaccacatgggctctttgtgaagccctgaccctcgccaccggccctatctctacactgtgggaggggaaccccggaagattctggaatacgaccatcgcggtcagcatggctaacatttttcggggctcctacctggccggggctggactccttttcagcatcatgaaaaatacaaccaacacacgcagaggcaccggcaacattggggagacgctgggagaaaagtggaaatctcggctgaatgccctcggcaagtccgagtttcaaatctataagaaaagcgggattcaggaagtggatcgcacactggccaaggagggaatcaaaagaggcgagaccgaccaccatgctgtctctcgggggtccgccaaacttcgctggttcgtggaaagaaacatggttaccccggagggaaaagtggtcgatctgggctgcggcagagggggatggagctactattgtggcgggctcaagaatgtgaaggaagttaaaggactgacaaagggcgggcctggacacgaggaacccatccccatgtctacctacggctggaacctggtgcggctccagagcggcgtcgacgtgtttttcattcctcccgagaaatgcgatacacttctgtgtgacatcggggagtcctctcctaatccgacggtggaagcgggacgcaccctgcgggttctcaacctggtcgagaattggcttaacaataacacacagttctgcattaaggtgctgaatccctacatgcctagcgtgatcgagaagatggaggccctccaaagaaagtatggcggggctctggtccgcaaccccctgtcccggaatagcacccatgaaatgtactgggtttccaacgcctctggaaatattgtgagctccgtgaacatgatctctagaatgctcattaaccgctttacaatgcggcacaagaaagctacctatgagcctgatgtcgaccttggcagcgggacgagaaatatcggaatcgagtccgaagtgcccaacctggacattatcggcaagcgcattgagaaaatcaagcaggaacatgagacctcttggcactacgatcaggaccacccgtataaaacatgggcctaccatggcagctatgaaaccaagcagacagggtccgcgagctctatggttaatggagtggtccggctgctcaccaagccttgggatgtgctgcccacagttacccaaatggccatgacggacacaacccctttcggccagcagagagtgtttaaagagaaggtcgatacccgcacacaggagcccaaagaagggacgaagaaacttatgaagattaccgctgagtggctgtggaaagaactcggaaagaagaaaacacctcggatgtgtaccagagaggagttcacacgcaaggtgagatccaacgccgctctgggcgccatctttaccgacgaaaataaatggaaaagcgctcgggaggccgtggaagattctcgcttctgggagctggtcgacaaagaaagaaacctccacctggaggggaagtgcgagacatgtgtttacaatatgatgggaaagcgggagaagaaacttggcgagtttggcaaagcgaaggggtccagagccatctggtacatgtggctgggagctcggttcctcgaatttgaggccctgggcttccttaacgaagatcattggtttagccgcgaaaattctctgtccggggtggagggagaaggcctccacaaactggggtatattctgagagacgtgagcaagaaggagggcggagctatgtacgccgatgacaccgccggctgggacacgcggatcaccctcgaagatctgaaaaacgaggaaatggtcacaaatcacatggagggggagcataagaaacttgcggaagctattttcaagctgacctatcaaaacaaagtggttcgcgtgcagagacccacaccgcggggaaccgtcatggacatcatttcccgcagagatcagcggggcagcgggcaagtgggaacgtacggcctcaatacatttaccaacatggaggcccagctgatccgccagatggaaggggagggcgttttcaagaatatccagcaccttacagtgaccgaggaagtcgccgtgcaaaactggctggctagagttggacgggagcgcctctctagaatggccattagcggcgacgattgcgtggtcaagcctctggacgatcggttcgctaacgccctgacggcgctcaatgacatggggaaaatccgcaaggatattcagcagtgggaaccctccaaaggatggaacgactggacccaggtgcccttttgctctcatcacttccatgagctgatcatgaaggatggcagagtccttgtggttccttgtcggaatcaagacgaactgattgggagagcccgcatcagccagggagctggctggtccctccgggagacagcctgcctggggaaatcttatgctcagatgtggagccttatgtactttcacagacgcgatctgcggctcgccgcgaacgccatttgttccgctgtgccgtctcactgggtccccaccagcagaacaacctggtccatccatgccaagcacgagtggatgacaaccgaagacatgctgacggtgtggaatcgcgtgtggatccgggagaacccttggatggaagacaagacacccgttgagagctgggaagagattccttatctgggcaaaagagaggatcagtggtgcggatctctcatcggcctgacctcccgcgctacctgggccaagaatattcaagctgccatcaaccaggtgcggagccttattgggaatgaagagtacacagactacatgccctctatgaaaagattccgccgggaagaggaagaggcgggagtcctgtggtga

SEQ ID NO: 19702 - RNA, 9876 nt, synthetic construct
  misc_feature 1..9876: note = derived and/or modified CDS sequence (opt5) from DENV-2__GQ868622__SS-prME
  source 1..9876: mol_type = other RNA
agcgccggaatgatcattatgctgatccccaccgtgatggctttccacctcacaacgcggaatggggaacctcatatgattgtcggaatccaggaaaagggcaagagcctgctttttaagaccgaagacggggttaatatgtgcacactgatggccatggatctcggagaactgtgtgaggacaccattacatacaaatgcccgcttctgcggcaaaacgaacccgaggatatcgactgttggtgcaattctaccagcacatgggtgacctatggcacgtgtaccacaaccggggagcaccgccgggaaaagcggtccgtggcgctcgttcctcatgtgggaatgggcctggagacacgcaccgaaacgtggatgtctagcgagggcgcttggaaacacgcccagagaatcgagacatggattctgcggcatcccgggttcaccatcatggccgctattctcgcctacacaatcggaaccacccactttcagcgcgctctgattttcatccttctgacagccgttgcgccttccatgacgatgagatgcattggcatctctaaccgggattttgtggaaggggtcagcggaggctcctgggtggacatcgttctcgagcacgggagctgtgtgaccacaatggccaagaataagcccaccctggatttcgaacttattaaaacagaggctcgccagcctgccaccctgagaaagtattgcatcgaagctaaactcacgaacacaaccaccgagtctcggtgtccgacacaaggagagccctccctgaaggaagaacaagacaaacgctttgtctgcaagcatagcatggtggatagaggctggggcaatgggtgtggactgttcggcaaaggcgggattgtgacctgcgccatgtttacatgcaaaaagaacatggaagggaaaatcgtccagcctgagaatctcgaatacacgattgttgtgacaccccactctggggaggagcatgcggtgggaaacgacacaggcaagcacggcaaagaaatcaaggtcacccctcagtccagcatcacagaggccgaactgaccgggtatggaacggtgaccatggagtgttctccccggacaggccttgatttcaatgaaatggttctgctccaaatggagaacaaggcttggctggtgcaccgccagtggtttcttgacctgccgctcccttggctgcccggggccgataagcagggatccaattggattcagaaggagaccctggtcacattcaaaaaccctcatgctaagaaacaagacgtggttgtgctcggcagccaggaaggggccatgcacaccgccctgacgggcgctacagagatccagatgtcctctggaaatcttctgtttaccggccatctcaagtgcagactgcggatggacaaacttcaactgaaggggatgagctactccatgtgtacaggaaagttcaaagtcgtgaaggaaattgcggagacccagcacggcaccatcgtcattagagtgcagtatgagggggatggaagcccctgcaaaatccccttcgaaatcatggacctcgagaagcgctacgttctgggccggctgattacagtgaaccctatcgtcacggaaaaagattctccggtgaacattgaggccgaacccccttttggggactcctacatcattatcggcgttgagcccggacagctcaagctgaattggttcaagaaaggcagctctattgggcaaatgtttgagaccacaatgagaggagctaagcgcatggccatccttggcgataccgcctgggacttcgggagcctgggaggcgtgtttacatccatcgggaaagctctccatcaggtcttcggcgccatttatggagcggctttttctggcgtgagctggaccatgaagatcctgattggggtgatcattacgtggatcggaatgaactcccggagcacatctctgtccgttagccttgtcctcgtgggcatcgtgaccctgtacctgggggtcatggtgcaggccgattctggatgtgttgtgtcctggaaaaataaggaactcaagtgcggcagcgggattttcatcaccgacaacgtccacacatggaccgagcagtataaatttcaacctgaatccccctctaagctggccagcgctattcagaaagcccaggaggaaggcatctgtggaattagatccgtgacacgccttgagaatctgatgtggaagcagatcacgccggagctcaaccacatcctggctgaaaatgaggttaaactgaccattatgacaggcgatatcaaggggattatgcaagccggaaaacggtctcttagacctcagcccaccgaactcaagtacagctggaagacatggggcaaagcgaagatgctgtccaccgagagccataaccagacgttcctgatcgacgggcctgaaaccgccgagtgccccaatacaaaccgcgcttggaactctctcgaggtggaagattatggatttggcgtcttcaccacaaacatttggctgaaacttaaggagaaacaggacgccttttgtgactccaagctgatgagcgctgccatcaaggataatcgggcggtgcacgccgacatgggctactggatcgaatctgctctcaacgatacctggaaaattgagaaggcctccttcatcgaggttaaaaattgccattggcctaagagccacacactgtggtctaacggggtgctggaaagcgagatgattatccccaaaaaccttgctggaccggtctcccaacacaattatagacctggctaccatacccagattgccgggccctggcacctcggaaagctggaaatggacttcgatttttgtgacggcacgacagtgatcgtgaccgaggattgcgggaaccgcggacccagcctgcggaccacaaccgcctctggcaagctcattacggaatggtgctgtagatcctgcacactgcctccgcttcggtaccgcggcgaggacgggtgttggtatggaatggagatcagacccctgaaagaaaaggaggaaaatctcgtcaacagcctggttaccgctggccatggacaggtggataatttctccctgggagtgcttggcatggcgctctttctggaggaaatgctgcggacaagagtcgggaccaaacacgccatcctcctggtggctgtttctttcgtgacacttattaccggaaacatgagctttaaggacctgggccgcgtcgtggttatggtgggcgccacgatgaccgatgacatcgggatgggagtcacatacctcgccctgctggctgccttcaaagtgcggcctacctttgcggctggccttctgctcagaaagctgacatccaaggagctcatgatgaccacgattgggatcgttctgctttctcaaagcacaattcccgagaccatcctggaactcacagatgccctggccctgggaatgatggtgcttaaaatcgtccgcgacatggagaagtatcagctggctgtgaccattatggccatcctctgcgtgcctaatgcggtcattctgcagaacgcttggaaagtttcctgtaccatcctcgccgtggtgtctgtcagccccctgcttctgacatccagccagcaaaagacggactggattcctctcgccctgaccatcaaaggcctgaatcccacagctatcttccttaccacactgtctagaaccaacaagaaacggtcctggccgctcaatgaagccattatggctgtggggatggttagcatcctggcctcttccctcctgaagaacgatattcctatgacgggaccccttgtggcgggcggcctgctgacagtctgctacgtgctcaccgggcgcagcgccgacctggagcttgaaagagctaccgatgttaagtgggaggaccaggccgagatctctggatccagccctattctgtccatcacaattagcgaagatggctctatgagcatcaaaaatgaggaagaggagcagaccctcacaatcctgattcggacggggctcctggtgatctccggactttttcccgtctctattccgatcaccgctgccgcctggtatctgtgggaagtgaagaaacagcgcgctggcgtcctgtgggacgtgccttctccccctcccatggggaaggcggagctcgaagatggagcctacagaattaaacaaaagggcatcctgggctattcccagatcggggctggagtttacaaggagggcacattccataccatgtggcacgtgacaagaggggccgtccttatgcacaaaggaaagcgcattgaaccctcctgggccgacgtgaaaaaggatctgatcagctacggcgggggatggaaactcgagggcgagtggaaggaaggcgaggaagttcaggtgctggctctcgagcctgggaagaacccgagagccgtccagaccaaacccggactgtttaagacgaataccggcacaattggggcggtgtcccttgacttctctcctggaaccagcggctcccccatcattgataaaaaggggaaagtggttggactgtatggcaacggcgtcgtgacacggagcggggcttacgtgtctgccatcgcccaaaccgaaaagtccatcgaggacaaccctgagattgaagatgacatctttcgcaagagacggctgacaattatggacctccatcccggagctggcaaaacgaagagatatctgcctgccatcgtccgcgaggcgattaaacgggggcttagaaccctgatcctcgctccgacacgcgtggttgccgccgaaatggaggaagctctgcggggactccccattagataccagacccctgccatccgcgctgagcacaccggccgggagatcgtggatctgatgtgtcatgccacattcacgatgagacttctgagccccgtccgcgtgcctaattataacctgattatcatggacgaagcgcacttcaccgatcccgcctctattgctgcccgggggtacatctccacaagagttgagatgggcgaagctgccggaatttttatgaccgccacaccgcctggcagccgggaccccttcccccagtccaatgctcctatcatcgatgaggagcgcgaaattcccgagagatcttggaacagcgggcatgaatgggtgaccgactttaagggaaaaacggtctggttcgtgccttccatcaaggcgggcaatgatattgccgcttgcctccggaagaacgggaaaaaggttatccaactgagccgcaaaacatttgactctgagtatgtgaagaccagaaccaatgattgggacttcgtcgtgacaaccgatatttccgaaatgggagccaactttaaagccgagcgggtgatcgacccgagacgctgtatgaagcccgtcatccttacagacggcgaggaacgggttattctggctgggcctatgcccgtgacccacagctctgccgcgcagagacgcggccggatcggaagaaatcctaaaaacgagaatgatcagtacatttacatgggcgaacccctcgagaacgacgaagattgcgctcactggaaggaggccaagatgctgctggacaatatcaacacgccggaggggattatccctagcatgttcgaacccgagcgcgaaaaagtggatgccattgacggagagtatcggctcagaggcgaagctcgcaagacatttgtcgatcttatgagaagaggggacctgcctgtgtggctggcctacaaagttgcggccgagggaatcaattatgctgatcgcagatggtgtttcgacggcatcaagaacaaccagattctcgaggaaaatgtggaggtcgaaatctggaccaaagagggggagcggaagaagctgaaaccccgctggcttgatgccagaatttactccgaccctctggctctcaaggaatttaaagagttcgccgctggccggaagtctctgacactgaacctcatcaccgaaatgggaagacttcccacgttcatgacccagaagacccgcgatgccctggacaatctggcggtgctccataccgccgaggctggcgggcgggcctataaccacgctctgagcgaacttccggagacactggagaccctcctgctgctcacacttctggccaccgttacgggaggcatttttctgttcctcatgtccgggagaggaatcggcaagatgacactgggcatgtgctgcatcattaccgcctctatccttctgtggtacgctcagattcagcctcattggatcgcggccagcattatcctcgaatttttcctgatcgtgctgctcattcccgagcccgaaaagcagcgcacccctcaagacaatcagcttacatatgtcgtgatcgctattctgaccgtcgtggccgccacaatggctaacgagatggggtttctggagaagacgaagaaagatctcggactgggctccatcgccacccagcagccggagagcaatattcttgacatcgatctgcggcccgcgtctgcctggacactctacgctgttgccaccacattcgtgacccctatgctgagacactccattgagaacagctccgtgaatgtctctctgacggctatcgccaaccaagcgaccgttctcatggggcttggaaagggctggcccctgagcaaaatggacatcggggtgcctctgctcgccattggatgttactcccaggtgaatcccatcacactgaccgctgcccttctgctcctggtcgctcactatgccattatcggccctggcctgcaggctaaggccacacgggaagcgcagaagcgcgccgctgccgggattatgaaaaacccgaccgtggatggaatcacggttatcgacctcgatcccattccttacgaccccaagtttgagaaacaacttggccaggtgatgctgctgatcctctgcgtcacacaggtgctgatgatgagaaccacatgggctctttgtgaagccctgaccctcgccaccgggcctatttctacactgtgggagggaaatcccggccggttctggaacacgaccatcgcggtcagcatggctaatatttttcgcgggtcctatctggccggagctggcctccttttcagcatcatgaagaacacaaccaatacaagacggggcaccgggaacatcggagaaacgctgggcgagaaatggaagtctcgcctgaacgccctcgggaaatccgagtttcaaacatacaaaaagagcggcattcaggaagtggatagaaccctggccaaagagggcatcaagagaggggaaaccgaccatcacgctgtttctcgcggatccgccaaacttagatggttcgtggagcggaatatggtcacaccggagggcaaggtggttgatctgggctgcgggagaggaggctggagctattactgtgggggactcaaaaacgtgcgcgaagtcaagggcctgaccaaagggggacctggccatgaggaacccattcccatgtctacatatggctggaatctggtgcggctccagagcggggtggacgtctttttcatccctcccgagaaatgcgatacgcttctgtgtgacattggagaatcctctcctaacccgaccgtcgaggcgggcagaacactgcgcgtgctcaatctggtggagaactggcttaataacaatacccagttctgcatcaaggtcctgaacccctacatgcctagcgttatcgagaagatggaggccctccaacggaagtacgggggagctctggtgagaaatcccctgtcccgcaacagcacacacgaaatgtattgggtgtccaatgcctctggcaacattgtcagctccgtgaatatgatctctcggatgctcattaacagatttaccatgcgccataaaaaggctacgtacgagcctgacgttgatcttgggagcggaacccggaacatcggcattgaatccgagatccccaatctggacattatcggcaagagaatcgagaaaattaagcaggaacacgagacatcttggcactatgatcaggaccatccgtacaaaacctgggcctatcacgggagctacgaaacaaagcagaccggatccgcgagctctatggtgaacggcgtcgtgcgcctgctcacaaaaccttgggatgttctgcccaccgtgacgcaaatggccatgacagacaccacccctttcgggcagcagcgggtctttaaggagaaggtggatacaagaacgcaggaacccaaagagggaaccaagaaacttatgaagatcacagctgagtggctgtggaaagaactcggcaagaaaaagacccctcgcatgtgtacaagagaggagttcacccggaaggtgcgctccaatgccgctctgggggccatttttacagacgagaacaaatggaaaagcgctagagaggccgtcgaagatcggagattctgggagctggttgacaaagaacggaatctccatctggagggaaagtgcgaaacctgtgtgtataacatgatgggcaaacgcgagaagaaacttggcgagtttgggaaagcgaagggatctagagccatctggtacatgtggctgggcgctcggttcctcgaatttgaggccctggggttccttaatgaagatcactggttttcccgcgagaacagcctgtctggagtggaaggcgaggggctccacaaactgggctacattctgagagacgtctccaagaaagagggaggcgctatgtatgccgacgatacggccgggtgggacacccggatcacactcgaagatctgaagaatgaggaaatggtgaccaaccatatggagggagaacacaagaaacttgcggaggctatcttcaagctgacataccaaaataaagttgtgcgcgtccagagacccaccccgcggggcacggtgatggacattatcagccgcagagatcagcgggggtccggacaagttggcacatatgggctcaacacctttacaaatatggaggcccagctgattcgccagatggaaggcgagggagtgttcaagaacatccagcatcttaccgccacggaagaggtcgctgtgcaaaattggctggccagagttggccgggagcgcctcagcagaatggctatttctggggacgattgcgtggtcaaacctctggacgatcggttcgccaacgcgctgaccgccctcaacgacatgggaaagatcagaaaggatatccagcagtgggaacccagcaaaggctggaatgactggacacaggtgcccttttgctcccaccatttccacgagctgattatgaaggatgggcgcgtccttgtggttccttgtcggaaccaagacgaactgatcggacgggctcgcatttctcagggcgccgggtggagcctccgggagaccgcttgcctgggcaaatcctacgcccagatgtggtctcttatgtattttcacagacgcgacctgcggctcgcggccaatgctatctgtagcgccgtgccgtcccattgggtccccacatctagaaccacatggagcattcacgctaagcatgaatggatgaccacggaggatatgctgacagtgtggaaccgcgtgtggatccgggagaatccttggatggaagacaaaacccccgttgagtcctgggaagagattccttacctgggaaagagagaagatcagtggtgcggcagcctcatcgggctgacctctcgcgccacatgggctaagaacatccaagccgcgattaatcaggtgcggtcccttatcggaaacgaggagtataccgactacatgcccagcatgaaaagattccggagagaagaggaagaggccggcgtcctgtggtga

SEQ ID NO: 19703 - RNA, 9876 nt, synthetic construct
  misc_feature 1..9876: note = derived and/or modified CDS sequence (opt5) from DENV-2__FJ639705__SS-prME
  source 1..9876: mol_type = other RNA
agcgccggaatgatcattatgctgatccccaccgtgatggctttccacctcacaacgcggaatggggaacctcatatgattgtcggaatccaggaaaagggcaaaagcctgctttttaagaccgaagacggggttaatatgtgcacactgatggccatggatctcggagaactgtgtgaggacaccattacatacaaatgcccgcttctgcggcaaaacgaacccgaggatatcgactgttggtgcaattctaccagcacatgggtgacctatggcacgtgtaccacaaccggggagcaccgccgggaaaagcggtccgtggcgctcgttcctcatgtgggaatgggcctggagacacgcaccgaaacgtggatgtctagcgagggcgcttggaaacacgcccagcggatcgagacatggattctgcggcatcccgggttcaccatcatggccgctattctcgcctacacaatcggaaccacccactttcagcgcgctctgattttcatccttctgacagccgttgcgccttccatgacgatgagatgcattggcatctctaaccgggattttgtggaaggggtcagcggaggctcctgggtggacatcgttctcgagcacgggagctgtgtgaccacaatggccaagaataagcccaccctggatttcgaacttattaaaacagaggctcgccagcctgccaccctgagaaagtattgcatcgaagctaaactcacgaacacaaccaccgagtctcggtgtccgacacaaggagagccctccctgaaggaagaacaagacaaacgctttgtctgcaagcatagcatggtggatagaggctggggcaatgggtgtggactgttcggcaaaggcgggattgtgacctgcgccatgtttacatgcaaaaagaacatggaagggaaaatcgtccagcctgagaatctcgaatacacgattgttgtgacaccccactctggggaggagcatgcggtgggaaacgacacaggcaagcacggcaaagaaatcaaggtcacccctcagtccagcatcacagaggccgaactgaccgggtatggaacggtgaccatggagtgttctccccggacaggccttgatttcaatgaaatggttctgctccaaatggagaacaaggcttggctggtgcaccgccagtggtttcttgacctgccgctcccttggctgcccggggccgataagcagggatccaattggattcagaaggagaccctggtcacattcaaaaaccctcatgctaagaaacaagacgtggttgtgctcggcagccaggaaggggccatgcacaccgccctgacgggcgctacagagatccagatgtcctctggaaatcttctgtttaccggccatctcaagtgcagactgcggatggacaaacttcaactgaaggggatgagctactccatgtgtacaggaaagttcaaagtcgtgaaggaaattgcggagacccagcacggcaccatcgtcattagagtgcagtatgagggggatggaagcccctgcaaaatccccttcgaaatcatggacctcgagaagcgctacgttctgggccggctgattacagtgaaccctatcgtcacggaaaaagattctccggtgaacattgaggccgaacccccttttggggactcctacatcattatcggcgttgagcccggacagctcaagctgaattggttcaagaaaggcagctctattgggcaaatgtttgagaccacaatgagaggagctaagcgcatggccatccttggcgataccgcctgggacttcgggagcctgggaggcgtgtttacatccatcgggaaagctctccatcaggtcttcggcgccatttatggagcggctttttctggcgtgagctggaccatgaagatcctgattggggtgatcattacgtggatcggaatgaactcccggagcacatctctgtccgttagccttgtcctcgtgggcatcgtgaccctgtacctgggggtcatggtgcaggccgattctggatgtgttgtgtcctggaaaaataaggaactcaagtgcggcagcgggattttcatcaccgacaacgtccacacatggaccgagcagtataaatttcaacctgaatccccctctaagctggccagcgctattcagaaagcccaggaggaaggcatctgtggaattagatccgtgacacgccttgagaatctgatgtggaagcagatcacgccggagctcaaccacatcctggctgaaaatgaggttaaactgaccattatgacaggcgatatcaaggggattatgcaagccggaaaacggtctcttagacctcagcccaccgaactcaagtacagctggaagacatggggcaaagcgaagatgctgtccaccgagagccataaccagacgttcctgatcgacgggcctgaaaccgccgagtgccccaatacaaaccgcgcttggaactctctcgaggtggaagattatggatttggcgtcttcaccacaaacatttggctgaaacttaaggagaaacaggacgccttttgtgactccaagctgatgagcgctgccatcaaggataatcgggcggtgcacgccgacatgggctactggatcgaatctgctctcaacgatacctggaaaattgagaaggcctccttcatcgaggttaaaaattgccattggcctaagagccacacactgtggtctaacggggtgctggaaagcgagatgattatccccaaaaaccttgctggaccggtctcccaacacaattatagacctggctaccatacccagattgccgggccctggcacctcggaaagctggaaatggacttcgatttttgtgacggcacgacagtgatcgtgaccgaggattgcgggaaccgcggacccagcctgcggaccacaaccgcctctggcaagctcattacggaatggtgctgtagatcctgcacactgcctccgcttcggtaccgcggcgaggacgggtgttggtatggaatggagatcagacccctgaaagaaaaggaggaaaatctcgtcaacagcctggttaccgctggccatggacaggtggataatttctccctgggagtgcttggcatggcgctctttctggaggaaatgctgcggacaagagtcgggaccaaacacgccatcctcctggtggctgtttctttcgtgacacttattaccggaaacatgagctttaaggacctgggccgcgtcgtggttatggtgggcgccacgatgaccgatgacatcgggatgggagtcacatacctcgccctgctggctgccttcaaagtgcggcctacctttgcggctggccttctgctcagaaagctgacatccaaggagctcatgatgaccacgattgggatcgttctgctttctcaaagcacaattcccgagaccatcctggaactcacagatgccctggccctgggaatgatggtgcttaaaatcgtccgcgacatggagaagtatcagctggctgtgaccattatggccatcctctgcgtgcctaatgcggtcattctgcagaacgcttggaaagtttcctgtaccatcctcgccgtggtgtctgtcagccccctgcttctgacatccagccagcaaaagacggactggattcctctcgccctgaccatcaaaggcctgaatcccacagctatcttccttaccacactgtctagaaccaacaagaaacggtcctggccgctcaatgaagccattatggctgtggggatggttagcatcctggcctcttccctcctgaagaacgatattcctatgacgggaccccttgtggcgggcggcctgctgacagtctgctacgtgctcaccgggcgcagcgccgacctggagcttgaaagagctaccgatgttaagtgggaggaccaggccgagatctctggatccagccctattctgtccatcacaattagcgaagatggctctatgagcatcaaaaatgaggaagaggagcagaccctcacaatcctgattcggacggggctcctggtgatctccggactttttcccgtctctattccgatcaccgctgccgcctggtatctgtgggaagtgaagaaacagcgcgctggcgtcctgtgggacgtgccttctccccctcccatggggaaggcggagctcgaagatggagcctacagaattaaacaaaagggcatcctgggctattcccagatcggggctggagtttacaaggagggcacattccataccatgtggcacgtgacaagaggggccgtccttatgcacaaaggaaagcgcattgaaccctcctgggccgacgtgaaaaaggatctgatcagctacggcgggggatggaaactcgagggcgagtggaaggaaggcgaggaagttcaggtgctggctctcgagcctgggaagaacccgagagccgtccagaccaaacccggactgtttaagacgaataccggcacaattggggcggtgtcccttgacttctctcctggaaccagcggctcccccatcattgataaaaaggggaaagtggttggactgtatggcaacggcgtcgtgacacggagcggggcttacgtgtctgccatcgcccaaaccgaaaagtccatcgaggacaaccctgagattgaagatgacatctttcgcaagagacggctgacaattatggacctccatcccggagctggcaaaacgaagagatatctgcctgccatcgtccgcgaggcgattaaacgggggcttagaaccctgatcctcgctccgacacgcgtggttgccgccgaaatggaggaagctctgcggggactccccattagataccagacccctgccatccgcgctgagcacaccggccgggagatcgtggatctgatgtgtcatgccacattcacgatgagacttctgagccccgtccgcgtgcctaattataacctgattatcatggacgaagcgcacttcaccgatcccgcctctattgctgcccgggggtacatctccacaagagttgagatgggcgaagctgccggaatttttatgaccgccacaccgcctggcagccgggaccccttcccccagtccaatgctcctatcatcgatgaggagcgcgaaattcccgagagatcttggaacagcgggcatgaatgggtgaccgactttaagggaaaaacggtctggttcgtgccttccatcaaggcgggcaatgatattgccgcttgcctccggaagaacgggaaaaaggttatccaactgagccgcaaaacatttgactctgagtatgtgaagaccagaaccaatgattgggacttcgtcgtgacaaccgatatttccgaaatgggagccaactttaaagccgagcgggtgatcgacccgagacgctgtatgaagcccgtcatccttacagacggcgaggaacgggttattctggctgggcctatgcccgtgacccacagctctgccgcgcagagacgcggccggatcggaagaaatcctaaaaacgagaatgatcagtacatttacatgggcgaacccctcgagaacgacgaagattgcgctcactggaaggaggccaagatgctgctggacaatatcaacacgccggaggggattatccctagcatgttcgaacccgagcgcgaaaaagtggatgccattgacggagagtatcggctcagaggcgaagctcgcaagacatttgtcgatcttatgagaagaggggacctgcctgtgtggctggcctacaaagttgcggccgagggaatcaattatgctgatcgcagatggtgtttcgacggcatcaagaacaaccagattctcgaggaaaatgtggaggtcgaaatctggaccaaagagggggagcggaagaagctgaaaccccgctggcttgatgccagaatttactccgaccctctggctctcaaggaatttaaagagttcgccgctggccggaagtctctgacactgaacctcatcaccgaaatgggaagacttcccacgttcatgacccagaagacccgcgatgccctggacaatctggcggtgctccataccgccgaggctggcgggcgggcctataaccacgctctgagcgaacttccggagacactggagaccctcctgctgctcacacttctggccaccgttacgggaggcatttttctgttcctcatgtccgggagaggaatcggcaagatgacactgggcatgtgctgcatcattaccgcctctatccttctgtggtacgctcagattcagcctcattggatcgcggccagcattatcctcgaatttttcctgatcgtgctgctcattcccgagcccgaaaagcagcgcacccctcaagacaatcagcttacatatgtcgtgatcgctattctgaccgtcgtggccgccacaatggctaacgagatggggtttctggagaagacgaagaaagatctcggactgggctccatcgccacccagcagccggagagcaatattcttgacatcgatctgcggcccgcgtctgcctggacactctacgctgttgccaccacattcgtgacccctatgctgagacactccattgagaacagctccgtgaatgtctctctgacggctatcgccaaccaagcgaccgttctcatggggcttggaaagggctggcccctgagcaaaatggacatcggggtgcctctgctcgccattggatgttactcccaggtgaatcccatcacactgaccgctgcccttctgtctctcgtcgctcactatgccattatcggccctggcctgcaggctaaggccacacgggaagcgcagaagcgcgccgctgccgggattatgaaaaacccgaccgtggatggaatcacggttatcgacctggatcccattccttacgaccccaagtttgagaaacaactcggccaggtgatgcttctgatcctgtgcgtcacacaggtgctcatgatgagaaccacatgggctctgtgtgaagcccttaccctggccaccgggcctattagcacactctgggagggaaatcccggccggttctggaacacgaccatcgcggtctccatggctaatatttttcgcgggagctatctggccggagctggcctcctgttctctatcatgaagaacacaaccaatacaagacggggcaccgggaacatcggagaaacgcttggcgagaaatggaagtcccgcctgaacgccctggggaaaagcgagtttcaaacatacaagaagtctggcattcaggaagtggatagaaccctcgccaaagagggcatcaagagaggggaaaccgaccatcacgctgtttcccgcggaagcgccaaactgagatggttcgtggagcggaatatggtcacaccggagggcaaggtggttgatcttggctgcgggagaggaggctggtcttattactgtgggggactgaaaaacgtgcgcgaagtcaagggcctcaccaaagggggacctggccatgaggaacccattcccatgagcacatatggctggaatctggtgcggctgcagtccggggtggacgtctttttcatccctcccgagaaatgcgatacgctcctttgtgacattggagaatctagccctaacccgaccgtcgaggcgggcagaacactgcgcgtgctgaatctcgtggagaactggctgaataacaatacccagttctgcatcaaggtccttaacccctacatgccttccgttatcgagaaaatggaggccctgcaacggaagtacgggggagctctcgtgagaaatcccctgagccgcaactccacacacgaaatgtattgggtgtctaatgccagcggcaacattgtctcctctgtgaatatgatcagccggatgctgattaacagatttaccatgcgccataaaaaggctacgtacgagcctgacgttgatctcgggtccggaacccggaacatcggcattgaatctgagatccccaatcttgacattatcggcaagagaatcgagaaaattaagcaggaacacgagacaagctggcactatgatcaggaccatccgtacaaaacctgggcctatcacgggtcctacgaaacaaagcagaccggaagcgcgtcttccatggtgaacggcgtcgtgcgcctgctgacaaaaccttgggatgttctccccaccgtgacgcaaatggccatgacagacaccacccctttcgggcagcagcgggtctttaaggagaaggtggatacaagaacgcaggaacccaaagagggaaccaagaaactgatgaagatcacagctgagtggctttggaaagaactgggcaagaaaaagacccctcgcatgtgtacaagagaggagttcacccggaaggtgcgcagcaatgccgctctcggggccatttttacagacgagaacaaatggaagtctgctagagaggccgtcgaagattcccggttctgggagctggttgacaaagaaagaaatctgcatctcgagggaaagtgcgaaacctgtgtgtataacatgatgggcaaacgggagaagaagctgggcgagtttgggaaagcgaagggaagccgcgccatctggtacatgtggcttggcgctagattcctggaatttgaggccctcgggttcctgaatgaagatcactggttttctcgggagaactcccttagcggagtggaaggcgaggggctgcacaaactcggctacattctgcgcgacgtctccaagaaagagggaggcgctatgtatgccgacgatacggccgggtgggacaccagaatcacactggaagatctcaagaatgaggaaatggtgaccaaccatatggagggagaacacaagaaactggcggaggctatcttcaaacttacataccaaaataaagttgtgcgggtccagcgccccaccccgagaggcacggtgatggacattatcagccggcgcgatcagagagggtctggacaagttggcacatatgggctgaacacctttacaaatatggaggcccagctcattcggcagatggaaggcgagggagtgttcaagaacatccagcatctgaccgccacggaagaggtcgctgtgcaaaattggcttgcccgcgttggcagagagcggctgagccgcatggctatttccggggacgattgcgtggtcaaacctctcgacgatagattcgccaacgcgctgaccgccctgaacgacatgggaaagatccggaaggatatccagcagtgggaaccctctaaaggctggaatgactggacacaggtgcccttttgcagccaccatttccacgagctcattatgaaggatgggagagtcctggtggttccttgtcgcaaccaagacgaacttatcggacgggctagaatttcccagggcgccgggtggtctctgcgcgagaccgcttgcctcggcaaaagctacgcccagatgtggtccctgatgtattttcaccggagagaccttcgcctggcggccaatgctatctgttctgccgtgccgagccattgggtccccacatcccggaccacatggagcattcacgctaagcatgaatggatgaccacggaggatatgctcacagtgtggaacagagtgtggatccgcgagaatccttggatggaagacaaaacccccgttgagtcttgggaagagattccttacctgggaaagcgggaagatcagtggtgcggctccctgatcgggctcaccagcagagccacatgggctaagaacatccaagccgcgattaatcaggtgcgctctctgatcggaaacgaggagtataccgactacatgccctccatgaaacggttcagacgggaagaggaagaggccggcgtcctttggtga

SEQ ID NO: 19704 - RNA, 9876 nt, synthetic construct
  misc_feature 1..9876: note = derived and/or modified CDS sequence (opt5) from DENV-2__FJ639706__SS-prME
  source 1..9876: mol_type = other RNA
agcgccggaatgatcattatgctgatccccaccgtgatggctttccacctcaccacgagaaacggggagcctcatatgattgtcggaatccaggaaaagggaaagagcctgctttttaagaccgaggacggggttaatatgtgcacactgatggccatggatctcggagaactgtgtgaggacaccattacatacaagtgcccgcttctgcggcaaaacgaacccgaggatatcgactgttggtgcaattctaccagcacatgggtgacctatggcacgtgtaccacaaccggggagcacagaagagaaaagcggtccgtggcgctcgtccctcatgtgggaatgggcctggagacacgcaccgaaacgtggatgtctagcgagggcgcttggaagcacgcccagagaatcgagacatggattctgcggcatcccgggttcaccatcatggccgctattctcgcctacacaatcggaaccacccactttcagcgcgctctgattttcatccttctgacagccgttgcgccttccatgacgatgagatgcattggcatctctaaccgggattttgtggaaggggtcagcggaggctcctgggtggacatcgttctcgagcacgggagctgtgtgaccacaatggccaagaataagcccaccctggatttcgaacttattaaaacagaggctaagcagcctgccaccctgcgcaaatattgcatcgaagctaagctcacgaacacaaccaccgagtctagatgtccgacacaaggagagccctccctgaaagaagaacaagacaagcggtttgtctgcaagcatagcatggtggatcgcggctggggcaatgggtgtggactgttcggcaaagggggaattgtgacctgcgccatgtttacatgcaagaaaaacatggaaggcaagatcgtccagcctgagaatctcgaatacacgattgttgtgacaccccactctggggaggagcatgcggtgggaaacgacacaggcaaacacggcaaggaaatcaaagtcacccctcagtccagcatcacagaggccgaactgaccgggtatggaacggtgaccatggagtgttctcccagaacaggccttgatttcaatgaaatggttctgctccaaatggagaacaaggcttggctggtgcaccggcagtggtttcttgacctgccgctcccttggctgcccggggccgataagcagggatccaattggattcagaaagagaccctggtcacattcaagaaccctcatgctaaaaagcaagacgtggttgtgctcggcagccaggaaggggccatgcacaccgccctgacgggcgctacagagatccagatgtcctctggaaatcttctgtttaccggccatctcaaatgccgcctgagaatggacaaacttcaactgaaggggatgagctactccatgtgtacaggaaaattcaaggtcgtgaaagaaattgcggagacccagcacggcaccatcgtcattcgggtgcagtatgagggggatggaagcccctgcaagatccccttcgaaatcatggacctcgagaaaagatacgttctgggccgcctgattacagtgaaccctatcgtcacggaaaaggattctccggtgaacattgaggccgaacccccttttggggactcctacatcattatcggcgttgagcccggacagctcaagctgaattggttcaaaaagggcagctctattgggcaaatgtttgagaccacaatgcggggagctaaaagaatggccatccttggcgataccgcctgggacttcgggagcctgggaggcgtgtttacatccatcgggaaggctctccatcaggtcttcggcgccatttatggagcggctttttctggcgtgagctggaccatgaaaatcctgattggggtgatcattacgtggatcggaatgaactcccgcagcacatctctgtccgttagccttgtcctcgtgggcatcgtgaccctgtacctgggggtcatggtgcaggccgattctggatgtgttgtgtcctggaagaataaggaactcaaatgcggcagcgggattttcatcaccgacaacgtccacacatggaccgagcagtataagtttcaacctgaatccccctctaaactggccagcgctattcagaaggcccaggaggaaggcatctgtggcattcggtccgtgacaagacttgagaatctgatgtggaaacagatcacgccggagctcaaccacatcctggctgaaaatgaggttaagctgaccattatgacaggcgatatcaaagggattatgcaagccggaaagcgctctcttcggcctcagcccaccgaactcaagtacagctggaaaacatggggcaaggcgaaaatgctgtccaccgagagccataaccagacgttcctgatcgacgggcctgaaaccgccgagtgccccaatacaaacagagcttggaactctctcgaggtggaagattatggatttggcgtcttcaccacaaacatttggctgaaacttaaagagaagcaggacgccttttgtgactccaagctgatgagcgctgccatcaaagataatcgcgcggtgcacgccgacatgggctactggatcgaatctgctctcaacgatacctggaagattgagaaagcctccttcatcgaggttaagaattgccattggcctaaaagccacacactgtggtctaacggggtgctggaaagcgagatgattatccccaagaaccttgctggaccggtctcccaacacaattatcggcctggctaccatacccagattgccgggccctggcacctcggaaagctggaaatggacttcgatttttgtgacggcacgacagtgatcgtgaccgaggattgcgggaacagaggacccagcctgcgcaccacaaccgcctctggcaaactcattacggaatggtgctgtcggtcctgcacactgcctccgcttagataccggggcgaggacgggtgttggtatggaatggagatccgccccctgaaggaaaaagaggaaaatctcgtcaacagcctggttaccgctggccatggacaggtggataatttctccctgggagtgcttggcatggcgctctttctggaggaaatgctgagaacacgggtcgggaccaagcacgccatcctcctggtggctgtttctttcgtgacacttattaccggaaacatgagctttaaagacctgggcagagtcgtggttatggtgggcgccacgatgaccgatgacatcgggatgggagtcacatacctcgccctgctggctgccttcaaggtgcgccctacctttgcggctggccttctgctccggaagctgacatccaaagagctcatgatgaccacgattgggatcgccctgctttctcaaagcacaattcccgagaccatcctggaactcacagatgccctggctctgggaatgatggttcttaagatcgtgagagacatggagaaatatcagctggccgtcaccattatggcgatcctctgcgtgcctaatgctgtgattctgcagaacgcctggaaggtctcctgtaccatcctcgccgttgtgtctgtgagccccctgcttctgacatccagccagcagaagacggactggattcctctcgctctgaccatcaagggcctgaatcccacagccatcttccttaccacactgtctcgcaccaacaaaaagagatcctggccgctcaatgaagctattatggccgtcgggatggtgagcatcctggcgtcttccctcctgaagaacgatattcctatgacgggaccccttgttgccggcggcctgctgacagtgtgctacgtcctcaccgggcggagcgctgacctggagcttgaacgcgccaccgatgtgaaatgggaggaccaggctgagatctctggatccagccctattctgtccatcacaattagcgaagatggctctatgagcatcaagaatgaggaagaggagcagaccctcacaatcctgattagaacggggctcctggttatctccggactttttcccgtgtctattccgatcaccgccgccgcttggtatctgtgggaagtcaaaaagcagcgggcgggcgtgctgtgggacgtcccttctccccctcccatggggaaagccgagctcgaagatggagcttaccgcattaagcaaaagggcatcctgggctattcccagatcggggccggagtgtacaaagagggcacattccataccatgtggcacgttacaagaggggccgtgcttatgcacaagggaaaacggattgaaccctcctgggctgacgtcaagaaagatctgatcagctacggcgggggatggaagctcgagggcgagtggaaggaaggcgaggaagtgcaggttctggccctcgagcctgggaaaaacccgcgcgcggtgcagaccaagcccggactgtttaaaacgaataccggcacaattggggctgtctcccttgacttctctcctggaaccagcggctcccccatcattgataagaaagggaaggtggtgggactgtatggcaacggcgttgtcacaagaagcggggcctacgtgtctgccatcgctcaaaccgaaaagtccatcgaggacaaccctgagattgaagatgacatctttcggaaacgcagactgacaattatggacctccatcccggagccggcaagacgaaacggtatctgcctgcgatcgtgagagaggctattaagcgcgggcttcggaccctgatcctcgccccgacaagagtcgtggccgctgaaatggaggaagccctgcgcggactccccattcggtaccagacccctgctatcagagccgagcacaccggccgcgagatcgttgatctgatgtgtcatgcgacattcacgatgcggcttctgagccccgtgagagtccctaattataacctgattatcatggacgaagcccacttcaccgatcccgcttctattgccgctcgcgggtacatctccacacgggtggagatgggcgaagccgccggaatttttatgaccgctacaccgcctggcagcagagaccccttcccccagtccaatgcgcctatcatcgatgaggagcgggaaattcccgagcgctcttggaacagcgggcatgaatgggttaccgactttaaaggaaagacggtgtggttcgtcccttccatcaaggccggcaatgatattgctgcctgcctccgcaagaatgggaagaaagtgatccaactgagccggaagacatttgactctgagtatgttaaaacccgcaccaatgattgggacttcgtggtcacaaccgatatttccgaaatgggagccaactttaaggctgagagagtgatcgacccgcggagatgtatgaaacccgtgatccttacagacggcgaggaacgcgtcattctggccgggcctatgcccgttacccacagctctgcggctcagcggagaggccgcatcggacggaatcctaagaacgagaatgatcagtacatttacatgggcgaacccctcgagaacgacgaagattgcgcccactggaaggaggccaaaatgctgctggacaatatcaacacgccggaggggattatccctagcatgttcgaacccgagagagaaaaggtggatgctattgacggagagtatcgcctccggggcgaagccagaaaaacatttgtggatcttatgcgcagaggggacctgcctgtctggctggcgtacaaggtggccgctgagggaatcaattatgccgatcggcgctggtgtttcgacggcatcaaaaacaaccagattctcgaggaaaatgttgaggtggaaatctggaccaaggagggggagagaaagaaactgaagccccggtggcttgatgctcgcatttactccgaccctctggccctcaaagaatttaaggagttcgctgccggcagaaaatctctgacactgaacctcatcaccgaaatgggacggcttcccacgttcatgacccaaaagacaagagatgcgctggacaatctggccgtcctccataccgctgaggccggcgggcgcgcttataaccacgccctgagcgaacttccggagacactggagaccctcctgctgctcacacttctggccaccgtgacgggaggcatttttctgttcctcatgtccgggcggggaatcggcaagatgacactgggcatgtgctgcatcattaccgcttctatccttctgtggtacgcgcagattcagcctcattggatcgccgctagcattatcctcgaatttttcctgatcgttctgctcattcccgagcccgaaaaacagagaacccctcaagacaatcagcttacatatgtggtcatcgccattctgaccgtggtcgccgctacaatggccaacgagatggggtttctggaaaagacgaaaaaggatctcggactgggctccatcgcgacccagcagccggagagcaatattcttgacatcgatctgcgccccgcctctgcttggacactctacgccgtggctaccacattcgttacccctatgctgcggcactccattgagaacagctccgtgaatgtgtctctgacggccatcgcgaaccaagccaccgtcctcatggggcttggaaaaggctggcccctgagcaagatggacatcggggttcctctgctcgctattggatgttactcccaggtgaatcccatcacactgaccgccgcccttctgctcctggtggcccactatgctattatcggccctggcctgcaggccaaggcgacaagagaagcccagaaacgggctgccgctgggattatgaagaacccgaccgtcgatggaatcacggtgatcgacctcgatcccattccttacgaccccaaatttgagaagcaacttggccaggttatgctgctgatcctctgcgtgacacaggtcctgatgatgcgcaccacatgggccctttgtgaagccctgaccctcgcgaccgggcctatttctacactgtgggagggaaatcccggcagattctggaacacgaccatcgctgtgagcatggccaatatttttcgggggtcctatctggctggagccggcctccttttcagcatcatgaaaaacacaaccaatacacgcagaggcaccgggaacatcggagaaacgctgggcgagaagtggaaatctcggctgaacgccctcgggaagtccgagtttcaaacatacaagaaaagcggcattcaggaagtcgatcgcaccctggctaaggagggcatcaaaagaggggaaaccgaccatcacgccgtgtctcggggatccgcgaaacttcgctggttcgttgagagaaatatggtgacaccggagggcaaagtcgtggatctgggctgcgggcggggaggctggagctattactgtgggggactcaagaacgttagagaagtgaagggcctgaccaaagggggacctggccatgaggaacccattcccatgtctacatatggctggaatctggtccgcctccagagcggggtggacgtgtttttcatccctcccgagaagtgcgatacgcttctgtgtgacattggagaatcctctcctaacccgaccgttgaggccggccggacactgagagtcctcaatctggtggagaactggcttaataacaatacccagttctgcatcaaagtgctgaacccctacatgcctagcgtcatcgaaaagatggaggctctccaacgcaaatacgggggagccctggttcggaatcccctgtccagaaacagcacacacgaaatgtattgggtgtccaatgcttctggcaacattgtgagctccgtcaatatgatctctcgcatgctcattaaccggtttaccatgagacataagaaggccacgtacgagcctgacgtggatcttgggagcggaacccgcaacatcggcattgaatccgagatccccaatctggacattatcggcaaacggatcgagaagattaaacaggaacacgagacatcttggcactatgatcaggaccatccgtacaagacctgggcgtatcacgggagctacgaaacaaaacagaccggatccgccagctctatggttaacggcgtggtcagactgctcacaaagccttgggatgtgctgcccaccgttacgcaaatggctatgacagacaccacccctttcgggcagcagcgcgtgtttaaggagaaagtcgatacacggacgcaggaacccaaggagggaaccaagaaacttatgaaaatcacagccgagtggctgtggaaagaactcggcaaaaagaagacccctagaatgtgtacacgcgaggagttcaccagaaaagtgcggtccaatgctgccctgggggctatttttacagacgagaacaagtggaaaagcgcccgcgaggcggtggaagattctagattctgggagctggtcgacaaggaacggaatctccatctggagggaaaatgcgaaacctgtgtttataacatgatgggcaagagagagaagaaacttggcgagtttgggaaggccaaaggatcccgggctatctggtacatgtggctgggcgcccgcttcctcgaatttgaggctctggggttccttaatgaagatcactggtttagcagagagaactctctgtccggagtggaaggcgaggggctccacaagctgggctacattctgcgggacgtgagcaaaaaggagggaggcgccatgtatgccgacgatacggcggggtgggacacccgcatcacactcgaagatctgaagaatgaggaaatggtcaccaaccatatggagggagaacacaagaaacttgctgaggccatcttcaaactgacataccaaaataaagtggttagagtgcagcggcccaccccgcgcggcacggtcatggacattatctccagaaaagatcagcgggggagcggacaagtgggcacatatgggctcaacacctttacaaatatggaggcccagctgattcgccagatggaaggcgagggagttttcaagaacatccagcatcttaccgctacggaagaggtggccgtccaaaattggctggctagagtgggccgggagcgcctctctagaatggccattagcggggacgattgcgttgtgaagcctctggacgatcggttcgcgaacgccctgaccgctctcaacgacatgggaaaaatccgcaaggatatccagcagtgggaaccctccaaaggctggaatgactggacacaggtccccttttgctctcaccatttccacgagctgattatgaaggatgggagagtgcttgtcgtgccttgtcggaaccaagacgaactgatcgggagagctcgcattagccagggcgctgggtggtccctccgggagaccgcctgcctgggcaaatcttacgcgcagatgtggagccttatgtattttcacagacgcgacctgcggctcgccgctaatgccatctgttccgctgttccgtctcattgggtgcccacaagcagaaccacatggtccattcacgccaagcatgaatggatgaccacggaggatatgctgacagtctggaaccgcgtgtggatccgggagaatccttggatggaagacaagacccccgtggagagctgggaagagattccttacctgggaaaaagagaagatcagtggtgcggctctctcatcgggctgacctcccgcgctacatgggccaagaacatccaagcggccattaatcaggttcggagccttatcggaaacgaggagtataccgactacatgccctctatgaaaagattccgccgggaagaggaagaggctggcgtgctgtggtga

SEQ ID NO: 19705 - RNA, 9876 nt, synthetic construct
  misc_feature 1..9876: note = derived and/or modified CDS sequence (opt5) from DENV-2__FJ639707__SS-prME
  source 1..9876: mol_type = other RNA
agcgccggaatgatcattatgctgatccccaccgtcatggctttccacctgaccacgagaaatggggagcctcatatgattgtcggaatccaggaaaagggcaagagcctgctttttaagaccgaggacggggttaatatgtgcacgctgatggccatggatctcggagaactgtgtgaggacaccattacatacaagtgcccgcttctgcggcaaaacgaacccgaggatatcgactgttggtgcaattctaccagcacatgggtgacctatggcacgtgtaccacaaccggggagcacagaagagaaaagcggtccgtggcgctcgtccctcatgtgggaatgggcctggagacacgcaccgaaacgtggatgtctagcgagggcgcttggaaacacgcccagagaatcgagacatggattctgcggcatcccgggttcaccatcatggccgctattctcgcctacacaatcggaaccacccactttcagcgcgttctgattttcatccttctgacagctgtggccccttccatgacgatgagatgcattggcatctctaaccgggattttgtcgaaggggtgagcggaggctcctgggttgacatcgtgctcgagcacgggagctgtgtcaccacaatggcgaagaataagcccaccctggatttcgaacttattaaaacagaggccaagcagcctgctaccctgcgcaaatattgcatcgaagccaagctcacgaacacaaccaccgagtctagatgtccgacacaaggagagccctccctgaaagaagaacaagacaagcggtttgtgtgcaagcatagcatggtggatcgcggctggggcaatgggtgtggactgttcggcaaagggggaattgtgacctgcgctatgtttacatgcaagaaaaacatggaaggcaagatcgttcagcctgagaatctcgaatacacgattgtggtgacaccccactctggggaggagcatgccgtcggaaacgacacaggcaaacacggcaaggaaatcaaagtgacccctcagtccagcatcacagaggcggaactgaccgggtatggaacggttaccatggagtgttctcccagaacaggccttgatttcaatgaaatggtgctgctccaaatggagaacaaggcctggctggtccaccggcagtggtttcttgacctgccgctcccttggctgcccggggctgataagcaggagtccaattggattcagaaagaaaccctggtgacattcaagaaccctcatgccaaaaagcaagacgttgtggtcctcggaagccaggagggcgctatgcacaccgccctgacgggggccacagaaatccagatgtcctctggcaatcttctgtttaccggacatctcaaatgccgcctgagaatggacaaacttcaactgaagggcatgagctactccatgtgtacagggaaattcaaggtggtcaaagagattgctgagacccagcacggaaccatcgtgattcgggttcagtatgaaggcgatgggagcccctgcaagatccccttcgagatcatggacctcgagaagcggtacattctgggacgcctgatcacagtgaaccctattgtcacggagaaggattctccggtgaacatcgaagcggagcccccttttggcgactcctacattatcattggggttgagcccggccagctcaagctgaattggttcaaaaagggaagctctatcggccaaatgtttgaaaccacaatgagaggggccaaaagaatggctatccttggagataccgcctgggacttcggcagcctcggcggggtgtttacatccattgggaaggccctccatcaggtcttcggggctatctatggcgccgcgttttctggagtgagctggaccatgaaaattctgatcggcgtgattatcacgtggatcgggatgaactcccgcagcacatctctgtccgttagccttgtcctcgtgggaattgtgaccctgtacctgggcgtcatggtgcaggctgattctgggtgtgttgtgtcctggaagaataaggagctcaaatgcggaagcggcatcttcattaccgacaacgtccacacatggaccgaacagtataagtttcaacctgagtccccctctaaactggccagcgccatccagaaggctcaggaagaggggatttgtggcatccggtccgtgacaagacttgagaatctgatgtggaaacagatcacgccggaactcaaccacattctggccgagaatgaagttaagctgaccatcatgacaggagatattaaaggcatcatgcaagctgggaagcgctctcttcggcctcagcccaccgagctcaagtacagctggaaaacatggggaaaggccaaaatgctgtccaccgaaagctataaccagacgttcctgattgacggccctgagaccacagagtgccccaataccaacagagcgtggaactctctcgaagtggaggattacgggtttggagtcttcacaaccaacatctggctgaaacttaaagaaaagcaggacgccttttgtgactccaagctgatgagcgctgccatcaaagataatcgcgctgtgcatgccgacatgggctattggattgagtctgcgctcaacgatacatggaagatcgagaaagcctccttcattgaagttaagaattgccactggcctaaaagccataccctgtggtctaacggcgtgctggagagcgaaatgatcattcccaagaaccttgctgggccggtctcccaacacaattaccggcctggataccacacgcagatcgccggcccctggcatctcgggaagctggagatggacttcgatttttgtgacggaacaaccgtgattgtgaccgaagattgcggcaacagagggcccagcctgcgcacaaccacggcttctggaaaactcatcacagagtggtgctgtcggtcctgcaccctgcctccgcttagatatcggggcgaggacggctgttggtacgggatggaaatccgccccctgaaggagaaagaagagaatctcgtcaacagcctggttacagccggacacggccaggtggataatttctccctgggggtgcttggaatggccctctttctggaagagatgctgagaacccgggtcggcacaaagcatgctattctcctggtggcggtttctttcatgacccttatcacggggaacatgagctttaaagacctgggaagagtggtcgtgatggttggcgccaccatggctgatgacattggcatgggggtgacatatctcgccctgctggccgctttcaaggtccgccctacctttgccgcgggacttctgctccggaagctgacatccaaagagctcatgatgaccacgatcggcattgtgctgctttctcaaagcacaatccccgaaaccgttctggagctcacagatgctctggccctggggatgatggtgcttaagatcgtcagaaatatggaaaaataccagctggccgtgaccattatggctatcctctgcgtgcctaacgccgtcattctgcagaatgcgtggaaggtttcctgtaccatcctcgctgtggtgtctgtcagccccctgcttctgacatccagccagcagaagacggactggattcctctcgccctgaccatcaagggactgaaccccacagccatcttccttaccacactgtctcgcaccaataaaaagagatcctggccgctcaacgaggctattatggccgtgggcatggttagcatcctggcttcttccctcctgaagaatgacattcctatgacggggccccttgccgcgggaggcctgctgacagtgtgctatgtcctcaccggccggagcgccgatctggaacttgagcgcgctaccgacgtgaaatgggaggatcaggccgaaatctctgggtccagccctattctgtccatcacaattagcgaggacggatctatgagcatcaagaacgaagaggaggaacagaccctcacaatcctgattagaacgggcctcctggttatctccgggctttttcccatttctatcccgattaccgctgccgcctggtacctgtgggaggtgaaaaagcagcgggctggagtcctgtgggatgtgccttctccccctcccatgggcaaagcggaactcgaggacggggcctatcgcatcaagcaaaagggaatcctgggctactcccagattggcgctggggtctacaaagaaggaacattccacaccatgtggcatgtgacaagaggcgccgttcttatgcacaaggggaaacggatcgagccctcctgggccgatgtgaagaaagacctgattagctatggaggcgggtggaagctcgagggagaatggaaggagggcgaagaggtccaggtgctggctctcgaacctggcaaaaatccgcgcgccgttcagaccaagcccgggctgtttaaaacgaacaccggaacaatcggcgcggtgtcccttgatttctctcctgggaccagcggatcccccattatcgacaagaaaggcaaggtcgtggggctgtacggaaacggcgtggttacaagaagcggcgcttatgtctctgccatcgcccaaaccgagaagtccattgaggataatcctgaaatcgaggacgatatttttcggaaacgcagactgacaatcatggacctccaccccggggctggaaagacgaaacggtacctgcctgccattgtgagagaagcgatcaagcgcggccttcggaccctgattctcgctccgacaagagtggtcgccgccgagatggaagaggctctgcgcgggctccccatccggtatcagacccctgccatcagagctgagcataccggacgcgaaattgtggacctgatgtgtcacgccacattcacgatgcggcttctgagccccgttagagtgcctaactacaatctgatcattatggatgaggcgcatttcaccgaccccgcctctatcgctgcccgcggctatatttccacacgggtcgaaatgggggaggctgccggcatctttatgaccgccacaccgcctggaagcagagatcccttcccccagtccaacgctcctatcattgacgaggaacgggagatccccgaacgctcttggaatagcggccacgagtgggtgaccgattttaaagggaagacggtttggttcgtgccttccattaaggcgggaaacgacatcgccgcttgcctccgcaaaaatggcaagaaagtcattcaactgagccggaagacatttgattctgaatacgccaaaacccgcaccaacgactgggatttcgtggttacaaccgacatctccgagatgggggccaattttaaggctgagagagtgatcgatccgcggagatgtatgaaacccgtcattcttacagacggagaggaacgcgtgatcctggccggccctatgcccgtgacccatagctctgcggctcagcggagagggcgcattggccggaaccctaagaatgaaaacgaccagtacatctatatgggagagcccctcgaaaatgatgaggactgcgcccactggaaggaggccaaaatgctgctggataacattaatacgccggaaggcatcattcctagcatgttcgagcccgaaagagagaaggtcgacgctatcgatggggaataccgcctccggggagaggccagaaaaacatttgttgaccttatgcgcagaggcgatctgcctgtgtggctggcgtataaggtggccgctgaggggatcaactacgccgaccggcgctggtgtttcgatggaattaaaaacaatcagatcctcgaagagaacgtcgaagtggagatttggaccaaggagggcgaaagaaagaaactgaagccccggtggcttgactcccgcatctattctgatcctctggctctcaaagagtttaaggagttcgccgctgggagaaaaagcctgacactgaatctcattaccgagatgggccggcttcccacgttcatgacccaaaagacaagagacgccctggataacctggcggttctccacaccgccgaagctggaggccgcgcctacaatcatgctctgtccgagcttccggagacactggaaaccctcctgctgctcacacttctggccaccgtgacagggggaatctttctgttcctcatgtctggccgggggatcggaaagatgacactgggcatgtgctgcattatcaccgccagcattcttctgtggtatgctcagatccagcctcactggattgcggcctccatcatcctcgagtttttcctgattgtcctgctcatccccgaacccgagaaacagagaacccctcaagacaaccagcttacatacgtggttattgctatcctgaccgtggtcgccgccacaatggctaatgaaatgggctttctggagaagacgaaaaaggacctcgggctgggaagcattgccacccagcagccggagtctaacatccttgatattgacctgcgccccgcgtccgcctggacactctacgctgtggccaccacattcgtcacccctatgctgcggcatagcatcgaaaattcctctgtgaacgttagcctgacggctatcgccaatcaagcgaccgtgctcgtgggccttgggaaaggatggcccctgtccaagatggatattggcgtccctctgctcgccatcgggtgttattctcaggttaaccccattacactgaccgctgcccttctgctcctggtggctcactacgccatcattggacctggcctgcaggctaaggccacaagagaggcgcagaaacgggccgctgccggcatcatgaagaatccgaccgtggacgggatcacggtcattgatctcgaccccatcccttatgatcccaaatttgaaaagcaacttggacaggtgatgctgctgattctctgcgttacacaggtgctgatgatgcgcaccacatgggctctttgtgaggccctgaccctcgccaccggccctatcagcacactgtgggaagggaaccccggaagattctggaatacgaccattgcggtctccatggctaacatctttcggggcagctacctggccggggctggactccttttctctatcatgaaaaatacaaccaacacacgcagaggcaccggcaacattggggagacgctgggagagaagtggaaatcccggctgaatgccctcggcaagagcgaatttcaaatctataagaaatctgggattcaggaggtggaccgcacactggccaaggaaggaatcaaaagaggcgagaccgatcaccatgctgtctcccgggggagcgccaaacttcgctggttcgtggagagaaacatggttaccccggaaggaaaagtggtcgacctgggctgcggcagagggggatggtcttactattgtggcgggctcaagaatgtgcgggaggttaagggactgacaaaaggcgggcctggacacgaagaacccattcccatgagcacctacggctggaacctggtgcgcctccagtccggcgtcgatgtgtttttcatccctcccgaaaagtgcgacacacttctgtgtgatatcggggagtctagccctaatccgacggtggaggcgggacggaccctgagagttctcaacctggtcgaaaattggcttaacaataacacacagttctgcattaaagtgctgaatccctacatgccttccgtgatcgagaagatggaagccctccaacgcaaatatggcggggctctggtccggaaccccctgagcagaaattccacccatgagatgtactgggtttctaacgccagcggaaatattgtgtcctctgtgaacatgatcagccgcatgctcattaaccggtttacaatgagacacaagaaggctacctatgaacctgacgtcgaccttggctccgggacgcgcaatatcggaattgagtctgaggtgcccaacctggatatcatcggcaaacggattgaaaagatcaaacaggagcatgaaaccagctggcactacgaccaggatcacccgtataagacatgggcctaccatggctcctatgagaccaaacagacagggagcgcgtcttccatggttaatggagtggtcagactgctcaccaagccttgggacgtgctgcccacagttacccaaatggccatgacggatacaacccctttcggccagcagcgcgtgtttaaggaaaaagtcgacacccggacacaggagcccaaggaggggacgaagaaacttatgaaaattaccgctgaatggctgtggaaagagctcggcaagaagaagacacctagaatgtgtacccgcgaagagttcacaagaaaagtgcggagcaacgccgctctgggcgccatctttaccgatgagaataagtggaaatctgctcgcgaagccgtggaggactccagattctgggaactggtcgataaggagcggaacctccacctggaagggaaatgcgagacatgtgtttacaatatgatgggaaagagagagaagaaacttggcgaatttggcaaggcgaaagggagccgggccatttggtacatgtggctgggagctcgcttcctcgagtttgaagccctgggcttccttaacgaggaccattggttttctagagaaaattccctgagcggggtggagggagagggcctccacaagctggggtatatcctgcgggatgtgtccaaaaaggaaggcggagctatgtacgccgacgacaccgccggctgggatacgcgcatcaccctcgaggacctgaagaacgaagagatggtcacaaatcacatggaaggggagcataagaaacttgcggaggctattttcaaactgacctatcaaaacaaagtggttagagtgcagcggcccacaccgcgcggaaccgtcatggatatcattagcagacgggaccagcgcggctctgggcaagtgggaacgtacggcctcaatacatttaccaacatggaagcccagctgatcagacagatggagggggaaggcgttttcaaaaatattcagcaccttacagtgaccgaggaggtcgccgtgcaaaactggctggctcgggttggacgcgaaagactcagccggatggccatctccggcgatgactgcgtggtcaagcctctggatgaccgcttcgctaacgccctgacggcgctcaatgatatggggaagatcagaaaagacattcagcagtgggagccctctaagggatggaacgattggacccaggtgcccttttgcagccatcacttccatgaactgatcatgaaagacggccgggtccttgtggttccttgtagaaatcaagatgagctgattgggcgcgcccggatctcccagggagctggctggtctctcagagaaacagcctgcctgggaaagagctatgctcagatgtggtcccttatgtactttcaccgccgggacctgagactcgccgcgaacgccatttgttctgctgtgccgagccactgggtccccacctcccgcacaacctggagcatccatgccaaacacgagtggatgacaaccgaggacatgctgacggtgtggaatcgggtgtggattagagaaaacccttggatggaggataagacacccgttgaatcttgggaggaaatcccttatctgggcaagcgcgaggaccagtggtgcggatccctcatcggcctgaccagccgggctacctgggccaaaaatattcaagctgccatcaaccaggtgagatctcttattgggaatgaggaatacacagattacatgccctccatgaagcgcttccggagagaggaagaggaagcgggagtcctgtggtga

SEQ ID NO: 19706 - RNA, 9876 nt, synthetic construct
  misc_feature 1..9876: note = derived and/or modified CDS sequence (opt5) from DENV-2__FJ639708__SS-prME
  source 1..9876: mol_type = other RNA
agcgccggaatgatcattatgctgatccccacagtgatggctttccacctgacaacgagaaatggggagcctcatatgattgtcggaatccaggaaaagggcaaatccctgctttttaagaccgaggacggggttaatatgtgcacactgatggccatggatctcggagaactgtgtgaggacaccattacatacaaatgcccgcttctgcggcaaaacgaacccgaggatatcgactgttggtgcaattctaccagcacatgggtgacctatggcacgtgtaccacaaccggggagcacagaagagaaaagcggtccgtggcgctcgtccctcatgtgggaatgggcctggagacacgcaccgaaacgtggatgtctagcgagggcgcttggaaacacgcccagagaatcgagacatggattctgcggcatcccgggttcaccatcatggccgctattctcgcctacacaatcggaaccacccactttcagcgcgttctgattttcatccttctgacagctgtggccccttccatgacgatgagatgcattggcatctctaaccgggattttgtcgaaggggtgagcggaggctcctgggttgacatcgtgctcgagcacgggagctgtgtcaccacaatggcgaagaataagcccaccctggatttcgaacttattaaaacagaggccaagcagcctgctaccctgcgcaaatattgcatcgaagccaagctcacgaacacaaccaccgagtctagatgtccgacacaaggagagccctccctgaaagaagaacaagacaagcggtttgtgtgcaagcatagcatggtggatcgcggctggggcaatgggtgtggactgttcggcaaagggggaattgtcacatgcgctatgtttacatgcaagaaaaacatggaaggcaagatcgttcagcctgagaatctcgaatacacgattgtggtgacaccccactctggggaggagcatgccgtcggaaacgacacaggcaaacacggcaaggaaatcaaagtgacccctcagtccagcatcacagaggcggaactgaccgggtatggaacggttaccatggagtgttctcccagaacaggccttgatttcaatgaaatggtgctgctccaaatggagaacaaggcctggctggtccaccggcagtggtttcttgacctgccgctcccttggctgcccggggctgataagcaggagtccaattggattcagaaagaaaccctggtgacattcaagaaccctcatgccaaaaagcaagacgttgtggtcctcggaagccaggagggcgctatgcacaccgccctgacgggggccacagaaatccagatgtcctctggcaatcttctgtttaccggacatctcaaatgccgcctgagaatggacaaacttcaactgaagggcatgagctactccatgtgtacagggaaattcaaggtggtcaaagagattgctgagacccagcacggaaccatcgtgattcgggttcagtatgaaggcgatgggagcccctgcaagatccccttcgagatcatggacctcgagaagcggtacattctgggacgcctgatcacagtgaaccctattgtcacggagaaggattctccggtgaacatcgaagcggagcccccttttggcgactcctacattatcattggggttgagcccggccagctcaagctgaattggttcaaaaagggaagctctatcggccaaatgtttgaaaccacaatgagaggggccaaaagaatggctatccttggagataccgcctgggacttcggcagcctcgggggagtgtttacatccattggcaaggccctccatcaggtcttcggggctatctatggcgccgcgttttctggagtgagctggaccatgaaaattctgatcggcgtgattatcacgtggatcgggatgaactcccgcagcacatctctgtccgttagccttgtcctcgtgggaattgtgaccctgtacctgggcgtcatggtgcaggctgattctgggtgtgttgtgtcctggaagaataaggagctcaaatgcggaagcggcatcttcattaccgacaacgtccacacatggaccgaacagtataagtttcaacctgagtccccctctaaactggccagcgccatccagaaggctcaggaagaggggatttgtggcatccggtccgtgacaagacttgagaatctgatgtggaaacagatcacgccggaactcaaccacattctggccgagaatgaagttaagctgaccatcatgacaggagatattaaaggcatcatgcaagctgggaagcgctctcttcggcctcagcccaccgagctcaagtacagctggaaaacatggggaaaggccaaaatgctgtccaccgaaagctataaccagacgttcctgattgacggccctgagaccgcggagtgccccaatacaaacagagcctggaactctctcgaagtggaggattacgggtttggagtcttcaccacaaacatctggctgaaacttaaagaaaagcaggacgctttttgtgactccaagctgatgagcgccgctatcaaagataatcgcgccgtgcatgcggacatgggctattggattgagtctgccctcaacgatacctggaagatcgagaaggctagcttcattgaagttaagaattgccactggcctaaaagccatacactgtggtctaacggcgtgctggagagcgaaatgatcattcccaagaaccttgccgggccggtctcccaacacaattaccggcctggataccacacccagatcgctggcccctggcatctcgggaagctggagatggacttcgatttttgtgacggaacgacagtgattgtgaccgaagattgcggcaacagagggcccagcctgcgcaccacaaccgcctctggaaaactcatcacggagtggtgctgtcggtcctgcacactgcctccgcttagatatcggggcgaggacggctgttggtacgggatggaaatccgccccctgaaggagaaagaagagaatctcgtcaacagcctggttaccgccggacacggccaggtggataatttctccctgggggtgcttggaatggctctctttctggaagagatgctgagaacacgggtcggcaccaagcatgcgattctcctggtggccgtttctttcatgacacttatcaccgggaacatgagctttaaagacctgggaagagtggtcgtgatggttggcgctacgatggccgatgacattggcatgggggtgacctatctcgccctgctggctgccttcaaggtccgccctacatttgcggctggacttctgctccggaagctgacctccaaagagctcatgatgacaaccatcggcattgtgctgctttctcaaagcacgatccccgaaacagttctggagctcaccgatgccctggccctggggatgatggtgcttaagatcgtcagaaatatggaaaaataccagctggctgtgacaattatggccatcctctgcgtgcctaacgcggtcattctgcagaatgcttggaaggtttcctgtaccatcctcgccgtggtgtctgtcagccccctgcttctgacctccagccagcagaagacagactggattcctctcgccctgacgatcaagggactgaaccccaccgctatcttccttacaaccctgtctcgcacaaataaaaagagatcctggccgctcaacgaggccattatggctgtgggcatggttagcatcctggcctcttccctcctgaagaatgacattcctatgaccgggccccttgtggcgggaggcctgctgacggtctgctatgtgctcacaggccggagcgccgatctggaacttgagcgcgctaccgacgttaaatgggaggatcaggccgaaatctctgggtccagccctattctgtccatcaccattagcgaggacggatctatgagcatcaagaacgaagaggaggaacagacactcaccatcctgattagaacaggcctcctggtgatctccgggctttttcccatttctatcccgattacggctgccgcctggtacctgtgggaggtcaaaaagcagcgggctggagtgctgtgggatgtcccttctccccctcccatgggcaaagcggaactcgaggacggggcctatcgcatcaagcaaaagggaatcctgggctactcccagattggcgctggggtgtacaaagaaggaaccttccacacaatgtggcatgttaccagaggcgccgtgcttatgcacaaggggaaacggatcgagccctcctgggccgatgtcaagaaagacctgattagctatggaggcgggtggaagctcgagggagaatggaaggagggcgaagaggtgcaggttctggctctcgaacctggcaaaaatccgcgcgccgtgcagacaaagcccgggctgtttaaaaccaacacgggaaccatcggcgcggtctcccttgatttctctcctgggacaagcggatcccccattatcgacaagaaaggcaaggtggtggggctgtacggaaacggcgttgtcaccagaagcggcgcttatgtgtctgccatcgcccaaacagagaagtccattgaggataatcctgaaatcgaggacgatatttttcggaaacgcagactgaccatcatggacctccaccccggggctggaaagacaaaacggtacctgcctgccattgtgagagaagcgatcaagcgcggccttcggacgctgattctcgctccgaccagagtcgtggccgccgagatggaagaggctctgcgcgggctccccatccggtatcagacccctgccatcagagctgagcataccggacgcgaaattgttgacctgatgtgtcacgccaccttcacaatgcggcttctgagccccgtgagagtccctaactacaatctgatcattatggatgaggcgcatttcacggaccccgcctctatcgctgcccgcggctatatttccacccgggtggaaatgggggaggctgccggcatctttatgacagccaccccgcctggaagcagagatcccttcccccagtccaacgctcctatcattgacgaggaacgggagatccccgaacgctcttggaatagcggccacgagtgggttacagattttaaagggaagaccgtgtggttcgtcccttccattaaggcgggaaacgacatcgccgcttgcctccgcaaaaatggcaagaaagtgattcaactgagccggaagacgtttgattctgaatacgttaaaacacgcaccaacgactgggatttcgtggtcaccacagacatctccgagatgggggccaattttaaggccgagagagtgatcgatccgcggagatgtatgaaacccgtgattcttaccgacggagaggaacgcgtcatcctggctggccctatgcccgttacacatagctctgccgcgcagcggagagggcgcattggccggaaccctaagaatgaaaacgaccagtacatctatatgggagagcccctcgaaaatgatgaggactgcgctcactggaaggaggccaaaatgctgctggataacattaataccccggaaggcatcattcctagcatgttcgagcccgaaagagagaaggtggacgccatcgatggggaataccgcctccggggagaggctagaaaaacgtttgtggaccttatgcgcagaggcgatctgcctgtctggctggcctataaggtggcggccgaggggatcaactacgctgaccggcgctggtgtttcgatggaattaaaaacaatcagatcctcgaagagaacgttgaagtggagatttggacaaaggagggcgaaagaaagaaactgaagccccggtggcttgacgcccgcatctattccgatcctctggctctcaaagagtttaaggagttcgccgctgggagaaaatctctgaccctgaatctcattacagagatgggccggcttcccaccttcatgacgcaaaagaccagagacgccctggataacctggcggtcctccacacagccgaagctggaggccgcgcctacaatcatgctctgagcgagcttccggagaccctggaaacactcctgctgctcacccttctggccacagtgaccgggggaatctttctgttcctcatgtccggccgggggatcggaaagatgacgctgggcatgtgctgcattatcacagcctctattcttctgtggtatgctcagatccagcctcactggattgcggccagcatcatcctcgagtttttcctgattgttctgctcatccccgaacccgagaaacagagaacccctcaagacaaccagcttacctacgtggtcattgctatcctgacagtggtcgccgccaccatggctaatgaaatgggctttctggagaagaccaagaaggacctcgggctgggatccattgccacgcagcagccggagagcaacatccttgatattgacctgcgccccgcgtctgcctggaccctctacgctgtggccacaaccttcgttacacctatgctgcggcattccatcgaaaatagctccgtgaacgtgtctctgaccgctatcgccaatcaagcgacggtcctcatgggccttgggaaaggatggcccctgagcaagatggatattggcgttcctctgctcgccatcgggtgttattcccaggtgaaccccattaccctgacagctgcccttctgctcctggtggctcactacgccatcattggacctggcctgcaggctaaggccaccagagaggcgcagaaacgggccgctgccggcatcatgaagaatccgacagtcgacgggatcaccgtgattgatctcgaccccatcccttatgatcccaaatttgaaaagcaacttggacaggttatgctgctgattctctgcgtgacgcaggtcctgatgatgcgcacaacctgggctctttgtgaggccctgacactcgccaccggccctatctctaccctgtgggaagggaaccccggaagattctggaatacaacgattgcggtgagcatggctaacatctttcggggctcctacctggccggggctggactccttttcagcatcatgaaaaataccacaaacacccgcagaggcacaggcaacattggggagaccctgggagagaagtggaaatctcggctgaatgccctcggcaagtccgaatttcaaatctataagaaaagcgggattcaggaggtcgaccgcacgctggccaaggaaggaatcaaaagaggcgagacagatcaccatgctgtgtctcgggggtccgccaaacttcgctggttcgttgagagaaacatggtgaccccggaaggaaaagtcgtggacctgggctgcggcagagggggatggagctactattgtggcgggctcaagaatgttcgggaggtgaagggactgaccaaaggcgggcctggacacgaagaacccattcccatgtctacatacggctggaacctggtccgcctccagagcggcgtggatgtgtttttcatccctcccgaaaagtgcgacacccttctgtgtgatatcggggagtcctctcctaatccgacagttgaggcgggacggacgctgagagtcctcaacctggtggaaaattggcttaacaataacacccagttctgcattaaagtgctgaatccctacatgcctagcgtcatcgagaagatggaagccctccaacgcaaatatggcggggctctggttcggaaccccctgtccagaaatagcacacatgagatgtactgggtgtccaacgcctctggaaatattgtgagctccgtcaacatgatctctcgcatgctcattaaccggtttaccatgagacacaagaaggctacatatgaacctgacgtggaccttggcagcgggacccgcaatatcggaattgagtccgaggttcccaacctggatatcatcggcaaacggattgaaaagatcaaacaggagcatgaaacgtcttggcactacgaccaggatcacccgtataagacctgggcctaccatggcagctatgagacaaaacagaccgggtccgcgagctctatggtgaatggagtcgtgagactgctcacaaagccttgggacgttctgcccaccgtgacacaaatggccatgaccgatacgacacctttcggccagcagcgcgtctttaaggaaaaagtggacacccggacccaggagcccaaggaggggaccaagaaacttatgaaaattacggctgaatggctgtggaaggagctcggcaaaaagaagacccctagaatgtgtacacgcgaagagttcaccagaaaagtgcggtccaacgccgctctgggcgccatctttacagatgagaataagtggaaaagcgctcgcgaagccgtcgaggactctagattctgggaactggttgataaggagcggaacctccacctggaagggaaatgcgagacctgtgtgtacaatatgatgggaaagagagagaagaaacttggcgaatttggcaaggcgaaagggtcccgggccatttggtacatgtggctgggagctcgcttcctcgagtttgaagccctgggcttccttaacgaggaccattggtttagcagagaaaattctctgtccggggtggagggagagggcctccacaagctggggtatatcctgcgggatgtcagcaaaaaggaaggcggagctatgtacgccgacgacacagccggctgggatacccgcatcacgctcgaggacctgaagaacgaagagatggtgaccaatcacatggaaggggagcataagaaacttgcggaggctattttcaaactgacatatcaaaacaaagttgtgagagtccagcggcccaccccgcgcggaacagtgatggatatcatttccagacgggaccagcgcggcagcgggcaagttggaacctacggcctcaatacgtttacaaacatggaagcccagctgatcagacagatggagggggaaggcgtgttcaaaaatattcagcaccttaccgtcacagaggaggtggccgttcaaaactggctggctcgggtgggacgcgaaagactctctcggatggccatcagcggcgatgactgcgtcgtgaagcctctggatgaccgcttcgctaacgccctgaccgcgctcaatgatatggggaagatcagaaaagacattcagcagtgggagccctccaagggatggaacgattggacgcaggtccccttttgctctcatcacttccatgaactgatcatgaaagacggccgggtgcttgttgtgccttgtagaaatcaagatgagctgattgggcgcgcccggatcagccagggagctggctggtccctcagagaaaccgcctgcctggggaagtcttatgctcagatgtggagccttatgtactttcaccgccgggacctgagactcgccgcgaacgccatttgttccgctgtcccgtctcactgggtgcccacaagccgcaccacatggtccatccatgccaaacacgagtggatgaccacagaggacatgctgaccgtgtggaatcgggtttggattagagaaaacccttggatggaggataagacgcccgtggaaagctgggaggaaatcccttatctgggcaagcgcgaggaccagtggtgcggatctctcatcggcctgacatcccgggctacctgggccaaaaatattcaagctgccatcaaccaggtcagaagccttattgggaatgaggaatacaccgattacatgccctctatgaagcgcttccggagagaggaagaggaagcgggagtgctgtggtga

SEQ ID NO: 19707 - RNA, 9876 nt, synthetic construct
  misc_feature 1..9876: note = derived and/or modified CDS sequence (opt5) from DENV-2__FJ639709__SS-prME
  source 1..9876: mol_type = other RNA
agcgccggaatgatcattatgctgatccccaccgtgatggctttccacctcacaacgagaaacggggagcctcatatgattgtcgggatccaggaaaagggaaagtccctgctttttaagaccgaggacggggttaatatgtgcacactgatggccatggatctcggagaactgtgtgaggacaccattacatacaagtgcccgcttctgcggcaaaacgaacccgaggatatcgactgttggtgcaattctaccagcacatgggtgacctatggcacgtgtaccacaaccggggagcacagaagagaaaagcggtccgtggcgctcgttcctcatgtgggaatgggcctggagacacgcaccgaaacgtggatgtctagcgagggcgcttggaaacacgcccagagaatcgagacatggattctgcggcatcccgggttcaccatcatggccgctattctcgcctacacaatcggaaccacccactttcagcgcgctctgattttcatccttctgacagccgttgcgccttccatgacgatgagatgcattggcatctctaaccgggattttgtggaaggggtcagcggaggctcctgggtggacatcgttctcgagcacgggagctgtgtgaccacaatggccaagaataagcccaccctggatttcgaacttattaaaacagaggctaagcagcctgccaccctgcgcaaatattgcatcgaagctaagctcacgaacacaaccaccgagtctagatgtccgacacaaggagagccctccctgaaagaggaacaagacaagcggtttgtctgcaagcatagcatggtggatcgcggctggggcaatgggtgtggactgttcggcaaagggggaattgtgacctgcgccatgtttacatgcaagaaaaacatggaaggcaagatcgtccagcctgagaatctcgaatacacgattgttgtgacaccccactctggggaggagcatgcggtgggaaacgacacaggcaaacacggcaaggaaatcaaagtcacccctcagtccagcatcacagaggccgaactgaccgggtatggaacggtgaccatggagtgttctcccagaacaggccttgatttcaatgaaatggttctgctccaaatggagaacaaggcttggctggtgcaccggcagtggtttcttgacctgccgctcccttggctgcccggggccgataagcagggatccaattggattcagaaagagaccctggtcacattcaagaaccctcatgctaaaaagcaagacgtggttgtgctcggcagccaggaaggggccatgcacaccgccctgacgggcgctacagagatccagatgtcctctggaaatcttctgtttaccggccatctcaaatgccgcctgagaatggacaaacttcaactgaaggggatgagctactccatgtgtacaggaaaattcaaggtcgtgaaagaaattgcggagacccagcacggcaccatcgtcattcgggtgcagtatgagggggatggaagcccctgcaagatccccttcgaaatcatggacctcgagaaaagatacgttctgggccgcctgattacagtgaaccctatcgtcacggaaaaggattctccggtgaacattgaggccgaacccccttttggggactcctacatcattatcggcgttgagcccggacagctcaagctgaattggttcaaaaagggcagctctattgggcaaatgtttgagaccacaatgcggggagctaaaagaatggccatccttggcgataccgcctgggacttcgggagcctgggaggcgtgtttacatccatcgggaaggctctccatcaggtcttcggcgccatttatggagcggctttttctggcgtgagctggaccatgaaaatcctgattggggtgatcattacgtggatcggaatgaactcccgcagcacatctctgtccgttagccttgtcctcgtgggcatcgtgaccctgtacctgggggtcatggtgcaggccgattctggatgtgttgtgtcctggaagaataaggaactcaaatgcggcagcgggattttcatcaccgacaacgtccacacatggaccgagcagtataagtttcaacctgaatccccctctaaactggccagcgctattcagaaggcccaggaggaaggcatctgtggcattcggtccgtgacaagacttgagaatctgatgtggaaacagatcacgccggagctcaaccacatcctggctgaaaatgaggttaagctgaccattatgacaggcgatatcaaagggattatgcaagccggaaagcgctctcttcggcctcagcccaccgaactcaagtacagctggaaaacatggggcaaggcgaaaatgctgtccaccgagagccataaccagacgttcctgatcgacgggcctgaaaccgccgagtgccccaatacaaacagagcttggaactctctcgaggtggaagattatggatttggcgtcttcaccacaaacatttggctgaaacttaaagagaagcaggacgccttttgtgactccaagctgatgagcgctgccatcaaagataatcgcgcggtgcacgccgacatgggctactggatcgaatctgctctcaacgatacctggaagattgagaaagcctccttcatcgaggttaagaattgccattggcctaaaagccacacactgtggtctaacggggtgctggaaagcgagatgattatccccaagaaccttgctggaccggtctcccaacacaattatcggcctggctaccatacccagattgccgggccctggcacctcggaaagctggaaatggacttcgatttttgtgacggcacgacagtgatcgtgaccgaggattgcgggaacagaggacccagcctgcgcaccacaaccgcctctggcaaactcattacggaatggtgctgtcggtcctgcacactgcctccgcttagataccggggcgaggacgggtgttggtatggaatggagatccgccccctgaaggaaaaagaggaaaatctcgtcaacagcctggttaccgctggccatggacaggtggataatttctccctgggagtgcttggcatggcgctctttctggaggaaatgctgagaacacgggtcgggaccaagcacgccatcctcctggtggctgtttctttcgtgacacttattaccggaaacatgagctttaaagacctgggcagagtcgtggttatggtgggcgccacgatgaccgatgacatcgggatgggagtcacatacctcgccctgctggctgccttcaaggtgcgccctacctttgcggctggccttctgctccggaagctgacatccaaagagctcatgatgaccacgattgggatcgttctgctttctcaaacaaccattcccgagacaatcctggaactcaccgatgccctggccctgggaatgatggtgcttaagatcgtcagagacatggagaaatatcagctggctgtgaccattatggccatcctctgcgtgcctaatgcggtcattctgcagaacgcttggaaggttagctgtacaatcctcgccgtggtgtccgtctctcccctgcttctgacgagctcccagcagaagaccgactggattcctctcgccctgacaatcaagggcctgaatcccaccgctatcttccttacaaccctgagccgcacgaacaaaaagagatcttggccgctcaatgaagccattatggctgtggggatggtttccatcctggccagctctctcctgaagaacgatattcctatgacaggaccccttgtggcgggcggcctgctgaccgtctgctacgtgctcaccgggcggtccgccgacctggagcttgaacgcgctacagatgttaaatgggaggaccaggccgagatcagcggatcttcccctattctgagcatcaccatttccgaagatggcagcatgtctatcaagaatgaggaagaggagcagacactcacgatcctgattagaaccgggctcctggtgatcagcggactttttcccgtctccattccgatcacagctgccgcctggtatctgtgggaagtgaaaaagcagcgggctggcgtcctgtgggacgtgccttctccccctcccatggggaaagcggagctcgaagatggagcctaccgcattaagcaaaagggcatcctgggctatagccagatcggggctggagtttacaaagagggcaccttccatacaatgtggcacgtgaccagaggggccgtccttatgcacaagggaaaacggattgaaccctcctgggccgacgtgaagaaagatctgatctcttacggcgggggatggaagctcgagggcgagtggaaggaaggcgaggaagttcaggtgctggctctcgagcctgggaaaaacccgcgcgccgtccagacgaagcccggactgtttaaaaccaatacaggcaccattggggcggtgagccttgacttctcccctggaacatctggcagccccatcattgataagaaagggaaggtggttggactgtatggcaacggcgtcgtgaccagatccggggcttacgtgagcgccatcgcccaaacagaaaagtctatcgaggacaaccctgagattgaagatgacatctttcggaaacgcagactgacgattatggacctccatcccggagctggcaagaccaaacggtatctgcctgccatcgtcagagaggcgattaagcgcgggcttcggacactgatcctcgctccgaccagagtggttgccgccgaaatggaggaagctctgcgcggactccccattcggtaccagacccctgccatcagagctgagcacacaggccgcgagatcgtggatctgatgtgtcatgccacgttcaccatgcggcttctgtcccccgtcagagtgcctaattataacctgattatcatggacgaagcgcacttcacagatcccgccagcattgctgcccgcgggtacatctctacccgggttgagatgggcgaagctgccggaatttttatgacagccaccccgcctggctccagagaccccttcccccagagcaatgctcctatcatcgatgaggagcgggaaattcccgagcgctcctggaactctgggcatgaatgggtgacggactttaaaggaaagacagtctggttcgtgcctagcatcaaggcgggcaatgatattgccgcttgcctccgcaagaatgggaagaaagttatccaactgtcccggaagacctttgacagcgagtatgtgaaaacccgcacaaatgattgggacttcgtcgtgaccacagatatttctgaaatgggagccaactttaaggccgagagagtgatcgacccgcggagatgtatgaaacccgtcatccttaccgacggcgaggaacgcgttattctggctgggcctatgcccgtgacgcactccagcgccgcgcagcggagaggccgcatcggacggaatcctaagaacgagaatgatcagtacatttacatgggcgaacccctcgagaacgacgaagattgcgctcactggaaggaggccaaaatgctgctggacaatatcaacacaccggaggggattatcccttctatgttcgaacccgagagagaaaaggtggatgccattgacggagagtatcgcctccggggcgaagctagaaaaacctttgtcgatcttatgcgcagaggggacctgcctgtgtggctggcctacaaggttgcggccgagggaatcaattatgctgatcggcgctggtgtttcgacggcatcaaaaacaaccagattctcgaggaaaatgtggaggtcgaaatctggacaaaggagggggagagaaagaaactgaagccccggtggcttgatgcccgcatttacagcgaccctctggctctcaaagaatttaaggagttcgccgctggcagaaaatccctgaccctgaacctcatcacggaaatgggacggcttcccaccttcatgacacaaaagaccagagatgccctggacaatctggcggtgctccatacagccgaggctggcgggcgcgcctataaccacgctctgtctgaacttccggagaccctggagacactcctgctgctcacccttctggccacggttacaggaggcatttttctgttcctcatgagcgggcggggaatcggcaagatgaccctgggcatgtgctgcatcattaccgcctccatccttctgtggaatgctcagattcagcctcattggatcgcggcctctattatcctcgaatttttcctgatcgtgctgctcattcccgagcccgaaaaacagagaacacctcaagacaaccagcttacctacgtcgtgatcgctattctgacagtcgtggccgccacgatggctaatgagatggggtttctggaaaagaccaaaaaggatctcggactgggcagcatcgccacacagcagccggagtccaacattcttgacatcgatctgcgccccgcgagcgcctggaccctctatgctgttgccacaaccttcgtgacgcctatgctgcggcactctattgaaaattccagcgtgaacgtctccctgaccgctatcgccaatcaagcgacagttctcatggggcttggaaaaggctggcccctgtctaagatggacatcggggtgcctctgctcgccattggatgttacagccaggtgaaccccatcaccctgacagctgcccttctgctcctggtcgctcactacgccattatcggccctggcctgcaggctaaggccaccagagaagcgcagaaacgggccgctgccgggattatgaagaatccgacggtggatggaatcacagttatcgacctcgatcccattccttatgaccccaaatttgagaagcaacttggccaggtgatgctgctgatcctctgcgtcacccaggtgctgatgatgcgcacaacctgggctctttgtgaagccctgaccctcgccacagggcctatttccacgctgtgggagggaaaccccggcagattctggaataccacaatcgcggtctctatggctaacatttttcgggggagctacctggccggagctggcctccttttctccatcatgaaaaataccacaaacacccgcagaggcacggggaacatcggagaaacactgggcgagaagtggaaaagccggctgaatgccctcgggaagtctgagtttcaaacctataagaaatccggcattcaggaagtggatcgcaccctggccaaggagggcatcaaaagaggggaaacagaccatcacgctgttagccggggatctgccaaacttcgctggttcgtggagagaaacatggtcaccccggagggcaaagtggttgatctgggctgcgggcggggaggctggtcctactattgtgggggactcaagaatgtgagagaagtcaagggcctgacaaaagggggacctggccatgaggaacccattcccatgagcacgtacggctggaacctggtgcgcctccagtctggggtggacgtctttttcatccctcccgagaagtgcgatacccttctgtgtgacattggagaaagctcccctaatccgacagtcgaggcgggccggaccctgagagtgctcaacctggtggagaattggcttaacaataacacacagttctgcatcaaagtcctgaatccctatatgccttctgttatcgaaaagatggaggccctccaacgcaaatacgggggagctctggtgcggaaccccctgagcagaaattccacccacgaaatgtactgggtgagcaacgcctccggcaatattgtctctagcgtgaacatgatctcccgcatgctcattaaccggtttacgatgagacataagaaggctacctatgagcctgacgttgatcttgggtctggaacacgcaatatcggcattgaaagcgagatccccaacctggacattatcggcaaacggatcgagaagattaaacaggaacacgagacctcctggcactacgatcaggaccatccgtataagacatgggcctaccacgggtcttatgaaaccaaacagacaggaagcgcgtccagcatggtgaatggcgtcgtgagactgctcaccaagccttgggatgttctgcccacggtgacacaaatggccatgaccgacaccacacctttcgggcagcagcgcgtctttaaggagaaagtggatacgcggacccaggaacccaaggagggaaccaagaaacttatgaaaatcaccgctgagtggctgtggaaggaactcggcaaaaagaagacacctagaatgtgtacccgcgaggagttcacaagaaaagtgcggtctaacgccgctctgggggccatttttaccgacgagaataagtggaaatccgctcgcgaggccgtcgaagatagcagattctgggagctggttgacaaggaacggaacctccatctggagggaaaatgcgaaacgtgtgtgtacaatatgatgggcaagagagagaagaaacttggcgagtttgggaaggcgaaaggatctcgggccatctggtatatgtggctgggcgctcgcttcctcgaatttgaggccctggggttccttaacgaagatcactggttttccagagagaatagcctgtctggagtggaaggcgaggggctccacaagctgggctacattctgcgggacgtctccaaaaaggagggaggcgctatgtacgccgacgataccgccgggtgggacacacgcatcaccctcgaagatctgaagaacgaggaaatggtgacaaatcatatggagggagaacacaagaaacttgcggaggctatcttcaaactgacctatcaaaacaaagttgtgagagtccagcggcccacgccgcgcggcacagtgatggacattatcagcagacgggatcagcgcgggtccggacaagttggcacctacgggctcaatacatttaccaacatggaggcccagctgattagacagatggaaggcgagggagtgttcaaaaatatccagcatcttacggccaccgaagaggtcgctgtgcaaaactggctggcccgggttggccgcgagagactcagccggatggctatttctggggacgattgcgtggtcaagcctctggacgatcgcttcgccaacgcgctgacagccctcaatgacatgggaaagatcagaaaagatatccagcagtgggaacccagcaagggctggaacgactggacccaggtgcccttttgctcccaccatttccacgagctgattatgaaagatgggcgggtccttgtggttccttgtagaaatcaagacgaactgatcggacgcgctcggatttctcagggcgccgggtggagcctcagagagacagcttgcctgggcaagtcctatgcccagatgtggtctcttatgtactttcaccgccgggacctgagactcgcggccaacgctatctgtagcgccgtgccgtcccattgggtccccacctctcgcacaacctggagcattcacgctaaacatgaatggatgacgacagaggatatgctgaccgtgtggaatcgggtgtggatcagagagaacccttggatggaagacaagacccccgttgagtcctgggaagagattccttatctgggaaagcgcgaagatcagtggtgcggcagcctcatcgggctgacatctcgggccacctgggctaaaaatatccaagccgcgattaaccaggtgagatcccttatcggaaatgaggagtacacagactatatgcccagcatgaagcgcttccggagagaagaggaagaggccggcgtcctgtggtga

SEQ ID NO: 19708 - RNA, 9876 nt, synthetic construct
  misc_feature 1..9876: note = derived and/or modified CDS sequence (opt5) from DENV-2__FJ639710__SS-prME
  source 1..9876: mol_type = other RNA
agcgctggcatgatcattatgctgatccccaccgtgatggctttccacctcacaacgagaaatggggagcctcatatgattgtcgggatccaggaaaagggcaagagcctgctttttaagaccgaggacggggttaatatgtgcacactgatggccatggatctcggagaactgtgtgaggacaccattacatacaaatgcccgcttctgcggcaaaacgaacccgaggatatcgactgttggtgcaattctaccagcacatgggtgacctatggcacgtgtaccacaaccggggagcaccgcagagaaaagcggtccgtggcgctcgttcctcatgtgggaatgggcctggagacacgcaccgaaacgtggatgtctagcgagggcgcttggaaacacgcccagagaatcgagacatggattctgcggcatcccgggttcaccatcatggccgctattctcgcctacacaatcggaaccacccactttcagcgcgctctgattttcatccttctgacagccgttgcgccttccatgacgatgagatgcattggcatctctaaccgggattttgtggaaggggtcagcggaggctcctgggtggacatcgttctcgagcacgggagctgtgtgaccacaatggccaagaataagcccaccctggatttcgaacttattaaaacagaggctaagcagcctgccaccctgcgcaaatattgcatcgaagctaagctcacgaacacaaccaccgagtctagatgtccgacacaaggagagccctccctgaaagaggaacaagacaagcggtttgtctgcaagcatagcatggtggatcgcggctggggcaatgggtgtggactgttcggcaaaggggccattgtgacctgcgcgatgtttacatgcaagaaaaacatggaaggaaagatcgtccagcctgagaatctcgaatacacgattgttgtgacaccccactctggcgaggagcatgccgtggggaacgacacaggaaaacacggcaaggaaatcaaagtcacccctcagtccagcatcacagaggctgaactgaccggctatgggacggtgaccatggagtgttctcccagaacaggacttgatttcaatgaaatggttctgctccaaatggagaacaaggcctggctggtgcaccggcagtggtttcttgacctgccgctcccttggctgcccggcgctgataagcaggagtccaattggattcagaaagaaaccctggtcacattcaagaaccctcatgccaaaaagcaagacgtggttgtgctcgggagccaggagggagccatgcacaccgctctgacgggcgcgacagaaatccagatgtcctctgggaatcttctgtttaccggccatctcaaatgccgcctgagaatggacaaacttcaactgaagggaatgagctactccatgtgtacaggcaaattcaaggtcgtgaaagagattgccgagacccagcacgggaccatcgtcattcgggtgcagtatgaaggagatggcagcccctgcaagatccccttcgagatcatggacctcgagaagagatacgttctggggcgcctgattacagtgaaccctatcgtcacggagaaggattctccggtgaacattgaagctgagcccccttttggagactcctacatcattatcggcgttgagcccgggcagctcaagctgaattggttcaaaaagggcagctctattggacaaatgtttgaaaccacaatgcggggcgccaaaagaatggccatccttggggataccgcttgggacttcggaagcctgggcggggtgtttacatccatcggaaaggccctccatcaggtcttcggcgcgatttatggggctgccttttctggcgtgagctggaccatgaaaatcctgattggagtgatcattacgtggatcggcatgaactcccgcagcacatctctgtccgttagccttatcctcgtcgggattgtgaccctgtacctgggagtgatggtccaggccgattctggctgtgtggtttcctggaagaataaggagctcaaatgcgggagcggaatcttcattaccgacaacgtgcacacatggaccgaacagtataagtttcaacctgagtccccctctaaactggctagcgccatccagaaggctcaggaagagggcatttgtgggatccggtccgtcacaagacttgagaatctgatgtggaaacagatcacgccggaactcaaccacattctggccgagaatgaagtgaagctgaccatcatgacaggcgatattaaaggaatcatgcaagcgggccgccggtctcttagacctcagcccaccgagctcaagtacagctggaagacatgggggaaagccaagatgctgtccaccgaaagctataaccagacgttcctgattgacggacctgagaccacagagtgccccaataccaaccgcgcttggaactctctcgaagttgaggattacggctttggggtgttcacaaccaacatctggctgaaacttaaggaaaaacaggacgccttttgtgactccaagctgatgagcgctgccatcaaggataatcgggcggtccatgccgacatgggatattggattgagtctgctctcaacgatacatggaaaatcgagaaggcctccttcattgaagtgaaaaattgccactggcctaagagccataccctgtggtctaacggcgttctggagagcgaaatgatcattcccaaaaaccttgctggcccggtgtcccaacacaattacagacctgggtaccacacgcagatcgccggaccctggcatctcggcaagctggagatggacttcgatttttgtgacgggacaaccgtcattgtgaccgaagattgcggaaaccgcggccccagcctgcggacaaccacggcctctgggaagctcatcacagagtggtgctgtagatcctgcaccctgcctccgcttcggtatcgcggagaggacggctgttggtacggcatggaaatcagacccctgaaagagaaggaagagaatctcgtgaacagcctggtcacagctgggcacggacaggttgataatttctccctgggcgtgcttgggatggcgctctttctggaagagatgctgcggaccagagtgggaacaaaacatgccattctcctggtcgctgtgtctttcgttacccttatcacgggcaacatgagctttaaggacctggggcgcgtggtcgtgatggttggagccaccatggccgatgacattggcatgggcgtgacatatctcgctctgctggccgcgttcaaagtccggcctacctttgctgccgggcttctgctcagaaagctgacatccaaggagctcatgatgaccacgatcggaattgtgctgctttctcaaagcacaatccccgaaaccatcctggagctcacagatgccctggctctgggcatgatggttcttaaaattgtgcgcaatatggaaaagtaccagctggccgtcaccatcatggcgattctctgcgtgcctaacgctgtgatcctgcagaatgcctggaaagtctcctgtaccattctcgccgttgtgtctgtgagccccctgcttctgacatccagccagcaaaagacggactggatccctctcgctctgaccatcaaagggctgaaccccacagccattttccttaccacactgtctagaaccaataagaaacggtcctggccgctcaacgaggctatcatggccgtcggaatggtgagcattctggcgtcttccctcctgaagaatgacatccctatgacgggcccccttgttgccgggggactgctgacagtgtgctatgtcctcaccggccgcagcgctgatctggaacttgagagagccaccgacgtgaagtgggaggaacaggctgagatttctggctccagccctatcctgtccattacaatcagcgaagatgggtctatgagcatcaaaaacgaggaggaggaacagaccctcacaattctgatccggacgggactcctggttatttccggcctttttcccatctctattccgatcaccgccgccgcttggtacctgtgggaagtgaagaaacagcgcgcgggggtcctgtgggacgtgccttctccccctcccatgggaaaggccgagctcgaagatggcgcttatagaatcaaacaaaaggggattctgggatactcccagatcggcgccggcgtctacaaggaggggacattccacaccatgtggcatgtgacacggggagccgttcttatgcacaaaggcaagcgcattgagccctcctgggctgacgtgaaaaaggatctgatcagctatgggggaggctggaaactcgaaggggagtggaaggaaggagaggaagtccaggtgctggccctcgagcctggcaagaatccgagagcggttcagaccaaacccggcctgtttaagacgaacaccgggacaattggagctgtgtcccttgacttctctcctggcaccagcgggtcccccatcatcgataaaaagggaaaagtcgtgggcctgtacgggaacggagtggttacacggagcggcgcctatgtctctgccattgctcaaaccgagaagtccatcgaagacaatcctgagattgaagatgacatctttcgcaagagacggctgacaattatggatctccaccccggcgccgggaaaacgaagagatacctgcctgcgatcgtgcgcgaggctattaaacggggacttagaaccctgatcctcgccccgacacgcgtggtcgccgctgaaatggaggaggccctgcggggcctccccatcagatatcagacccctgctattcgcgccgaacataccgggcgggagatcgtggacctgatgtgtcacgcgacattcacgatgagacttctgagccccgttcgcgtgcctaactacaatctgattatcatggacgaagcccatttcaccgatcccgcttctattgccgctcggggatatatctccacaagagtcgagatgggcgaggccgccgggatctttatgaccgctacaccgcctggcagccgggaccccttcccccagtccaacgcgcctattatcgatgaggaacgcgaaattcccgagagatcttggaatagcggacacgaatggatcaccgactttaagggcaaaacggtgtggttcgttccttccattaaggccgggaacgatatcgctgcctgcctccggaagaatggcaagaaggtgatccaactgagccgcaaaacatttgactctgagtacgtcaagaccagaaccaacgattgggacttcgtggttacaaccgatatttccgagatgggcgccaattttaaagctgaacgggtgatcgacccgagacgctgtatgaagcccgtcattcttacagatggggaggaacgggtgatcctggccggacctatgcccgtgacccatagctctgcggctcagagacgcggccggattgggagaaaccctaaaaatgagaacgaccagtacatctatatgggcgaacccctcgagaatgacgaggattgcgcccactggaaggaagccaagatgctgctggacaacattaatacgccggagggaatcatccctagcatgttcgaacccgagcgcgaaaaagtcgatgctattgacggcgagtaccggctcagaggggaggcccgcaagacatttgttgatcttatgagacggggagacctgcctgtgtggctggcgtataaagtggccgctgaaggcatcaactacgccgatcgcagatggtgtttcgacgggattaagaacaatcagatcctcgaggaaaacgtcgaggtggagatttggaccaaagaaggagagcggaagaagctgaaaccccgctggcttgatgctagaatctattccgaccctctggccctcaaggaatttaaagagttcgctgccggccggaagtctctgacactgaatctcatcaccgaaatggggagacttcccacgttcatgacccagaagacccgcgatgcgctggacaacctggccgttctccacaccgctgaggccggcggacgggcttacaatcatgccctgagcgagcttccggaaacactggagaccctcctgctgctcacacttctggccaccgtgacgggcgggatttttctgttcctcatgtccggaagaggcatcgggaagatgacactgggaatgtgctgcattatcaccgcttctattcttctgtggtatgcgcagatccagcctcactggatcgccgctagcattatcctcgaatttttcctgattgtcctgctcatccccgagcccgaaaagcagcgcacccctcaagataaccagcttacatacgtggttattgccatcctgaccgtggtcgccgctacaatggccaatgagatgggctttctggagaaaacgaagaaagacctcggcctggggtccattgcgacccagcagccggaaagcaacatccttgacatcgatctgcggcccgcctctgcttggacactctacgccgtggctaccacattcattacccctatgctgagacattccatcgagaatagctccgtcaacacgtctctgaccgccattgcgaatcaagccacagtgctcatgggacttggcaaggggtggcccctgagcaaaatggacatcggagttcctctgctcgctattggctgttattcccaggtgaaccccatcaccctgacagccgcccttctgctcctggtggcccactacgctatcattgggcctggactgcaggccaaggcgacccgggaagcccagaagcgcgctgccgctggcatcatgaaaaatccgacggtcgatggcattacagttatcgacctcgatcccattccttatgaccccaagtttgagaaacaacttggacaggtgatgctgctgatcctctgcgtgacccaggtcctgatgatgagaacaacctgggccctttgtgaagccctgaccctcgcgacaggacctatctctacgctgtgggagggcaaccccgggcggttctggaataccacaattgctgtgagcatggccaacatctttcgcggatcctacctggctggcgccgggctccttttcagcattatgaagaataccacaaacaccagacggggaacgggcaacatcggcgagacactgggggaaaaatggaagtctcgcctgaatgccctcggaaaatccgagtttcaaatttataaaaagagcggcatccaggaagttgatagaaccctggctaaagaggggatcaagcggggagagaccgaccaccatgccgtgtctcgcggctccgcgaaacttagatggttcgtcgaacggaacatggtgacaccggaggggaaggtcgtggatctgggatgcggcagaggcgggtggagctactattgtggaggcctcaaaaatgttaaggaagtgaaggggctgaccaaaggaggccctgggcacgaggaacccattcccatgtctacatacggatggaacctggtccgcctccagagcggcgtggacgtctttttcatccctcccgagaagtgcgatacgcttctgtgtgacattggcgagtcctctcctaatccgaccgtggaagccgggcggacactgagagtcctcaacctggtggagaattggcttaacaataacacccagttctgcatcaaagtgctgaatccctacatgcctagcgttattgaaaagatggaggctctccaacgcaaatatggaggcgccctggtccggaaccccctgtccagaaatagcacacatgaaatgtactgggtgtccaacgcttctgggaatatcgtgagctccgtcaacatgatttctcgcatgctcatcaaccggtttaccatgagacacaagaaggccacgtatgagcctgatgttgaccttggaagcggcacccgcaatatcgggattgagtccgaagtgcccaacctggacatcattggaaaacggatcgagaagattaaacaggaacatgagacatcttggcactacgatcaggaccacccgtataagacctgggcgtaccatggcagctatgaaacaaaacagaccggctccgccagctctatggtgaatggggtcgtgagactgctcacaaagccttgggatgttctgcccaccgtgacgcaaatggctatgacagacaccacccctttcggacagcagcgcgtctttaaggagaaagtggatacacggacgcaggagcccaaggaaggcaccaagaaacttatgaaaatcacagccgagtggctgtggaaagaactcgggaaaaagaagacccctagaatgtgtacacgcgaggagttcaccagaaaagttcggtccaacgctgccctgggagctatctttacagacgaaaataagtggaaaagcgcccgcgaggcggtggaagattctagattctgggagctggtcgacaaggaacggaacctccacctggagggcaaatgcgagacctgtgtgtacaatatgatggggaagagagaaaagaaacttggagagtttggcaaggccaaaggctcccgggctatttggtacatgtggctgggggcccgcttcctcgaatttgaggctctgggattccttaacgaagatcattggtttagcagagaaaattctctgtccggcgtggagggggaaggactccacaagctgggctatatcctgcgggacgtcagcaaaaaggaagggggagccatgtacgccgatgacacggcgggatgggacacccgcattacactcgaggatctgaagaacgaggaaatggttaccaatcacatggagggcgagcataagaaacttgctgaagccatcttcaaactgacatatcaaaacaaagtggtgagagtccagcggcccaccccgcgcgggacggtgatggacattatctccagacgggatcagcgcggaagcggccaagttgggacatacggactcaatacctttacaaacatggaggcccagctgatcagacagatggaaggcgagggggtgttcaaaaatattcagcaccttaccgtcacggaggaagtggctgttcaaaactggctggcccgggtgggccgcgagagactctctcggatggctatcagcggagacgattgcgtcgtgaagcctctggacgatcgcttcgccaacgcgctgaccgccctcaatgacatgggcaagattagaaaagatatccagcagtgggaaccctccaaggggtggaacgactggacacaggttcccttttgctctcatcacttccatgagctgattatgaaagatggacgggtgcttgtcgtgccttgtagaaatcaagacgaactgatcggccgcgctcggattagccagggggccggatggtccctcagagagaccgcttgcctgggcaagtcttatgcccagatgtggagccttatctactttcaccgccgggatctgagactcgcggccaacgctatctgttccgccgtcccgtctcactgggtgcccacaagccgcaccacatggtccattcatgctaaacacgagtggatgaccacggaagacatgctgacagtttggaatcgggtgtggatcagagagaacccttggatggaagacaagacccccgtcgagagctgggaagagattccttatctggggaagcgcgaggatcagtggtgcggctctctcatcggactgacctcccgggccacatgggctaaaaatattcaagccgcgatcaaccaggtgagaagccttatcggcaatgaagagtacaccgactacatgccctctatgaagcgcttccggagagaagaggaagaggccggggtgctgtggtga

SEQ ID NO: 19709 - RNA, 9876 nt, synthetic construct
  misc_feature 1..9876: note = derived and/or modified CDS sequence (opt5) from DENV-2__GQ868623__SS-prME
  source 1..9876: mol_type = other RNA
agcgccggaatgatcattatgctgatccccaccgtgatggctttccacctcacaacgagaaacggggaacctcatatgattgtcgggatccaggaaaagggcaaaagcctgctttttaagaccgaagacggggttaatatgtgcacactgatggccatggatctcggagaactgtgtgaggacaccattacatacaaatgcccgcttctgcggcaaaacgaacccgaggatatcgactgttggtgcaattctaccagcacatgggtgacctatggcacgtgtaccacaaccggggagcacagaagagaaaagcggtccgtggcgctcgtccctcatgtgggaatgggcctggagacacgcaccgaaacgtggatgtctagcgagggcgcttggaaacacgcccagagaatcgagacatggattctgcggcatcccgggttcaccatcatggccgctattctcgcctacacaatcggaaccacccactttcagcgcgctctgattttcatccttctgacagccgttgcgccttccatgacgatgagatgcattggcatctctaaccgggattttgtggaaggggtcagcggaggctcctgggtggacatcgttctcgagcacgggagctgtgtgaccacaatggccaagaataagcccaccctggatttcgaacttattaaaacagaggctaagcagcctgccaccctgcgcaaatattgcatcgaagctaagctcacgaacacaaccaccgagtctagatgtccgacacaaggagagccctccctgaaagaagaacaagacaagcggtttgtctgcaagcatagcatggtggatcgcggctggggcaatgggtgtggactgttcggcaaagggggaattgtgacctgcgccatgtttacatgcaagaaaaacatggaaggcaagatcgtccagcctgagaatctcgaatacacgattgttgtgacaccccactctggggaggagcatgcggtgggaaacgacacaggcaaacacggcaaggaaatcaaagtcacccctcagtccagcatcacagaggccgaactgaccgggtatggaacggtgaccatggagtgttctcccagaacaggccttgatttcaatgaaatggttctgctccaaatggagaacaaggcttggctggtgcaccggcagtggtttcttgacctgccgctcccttggctgcccggggccgataagcagggatccaattggattcagaaagagaccctggtcacattcaagaaccctcatgctaaaaagcaagacgtggttgtgctcggcagccaggaaggggccatgcacaccgccctgacgggcgctacagagatccagatgtcctctggaaatcttctgtttaccggccatctcaaatgccgcctgagaatggacaaacttcaactgaaggggatgagctactccatgtgtacaggaaaattcaaggtcgtgaaagaaattgcggagacccagcacggcaccatcgtcattcgggtgcagtatgagggggatggaagcccctgcaagatccccttcgaaatcatggacctcgagaaaagatacgttctgggccgcctgattacagtgaaccctatcgtcacggaaaaggattctccggtgaacattgaggccgaacccccttttggggactcctacatcattatcggcgttgagcccggacagctcaagctgaattggttcaaaaagggcagctctattgggcaaatgtttgagaccacaatgcggggagctaaaagaatggccatccttggcgataccgcctgggacttcgggagcctgggaggcgtgtttacatccatcgggaaggctctccatcaggtcttcggcgccatttatggagcggctttttctggcgtgagctggaccatgaaaatcctgattggggtgatcattacgtggatcggaatgaactcccgcagcacatctctgtccgttagccttgtcctcgtgggcatcgtgaccctgtacctgggggtcatggtgcaggccgattctggatgtgttgtgtcctggaagaataaggaactcaaatgcggcagcgggattttcatcaccgacaacgtccacacatggaccgagcagtataagtttcaacctgaatccccctctaaactggccagcgctattcagaaggcccaggaggaaggcatctgtggcattcggtccgtgacaagacttgagaatctgatgtggaaacagatcacgccggagctcaaccacatcctggctgaaaatgaggttaagctgaccattatgacaggcgatatcaaagggattatgcaagccggaaagcgctctcttcggcctcagcccaccgaactcaagtacagctggaaaacatggggcaaggcgaaaatgctgtccaccgagagccataaccagacgttcctgatcgacgggcctgaaaccgccgagtgccccaatacaaacagagcttggaactctctcgaggtggaagattatggatttggcgtcttcaccacaaacatttggctgaaacttaaagagaagcaggacgccttttgtgactccaagctgatgagcgctgccatcaaagataatcgcgcggtgcacgccgacatgggctactggatcgaatctgctctcaacgatacctggaagattgagaaagcctccttcatcgaggttaagaattgccattggcctaaaagccacacactgtggtctaacggggtgctggaaagcgagatgattatccccaagaaccttgctggaccggtctcccaacacaattatcggcctggctaccatacccagattgccgggccctggcacctcggaaagctggaaatggacttcgatttttgtgacggcacgacagtgatcgtgaccgaggattgcgggaacagaggacccagcctgcgcaccacaaccgcctctggcaaactcattacggaatggtgctgtcggtcctgcacactgcctccgcttagataccggggcgaggacgggtgttggtatggaatggagatccgccccctgaaggaaaaagaggaaaatctcgtcaacagcctggttaccgctggccatggacaggtggataatttctccctgggagtgcttggcctcgcgctgtttctggaggaaatgctcagaacacgggtcgggaccaagcacgccatcctgcttgtggctgtttctttcgtgacactgattaccggaaacatgagcgtcaaagacctcggcagagtggttgtgatggtcggcgccacgatgaccgatgacatcgggatgggagtgacatacctggccctgcttgctgcctttaaggttcgccctaccttcgcggctggcctgctcctgcggaagctcacatccaaagagctgatgatgaccacgattgggatcgtgcttctgtctcaaagcacaattcccgagaccatcctcgaactgacagatgccctggcccttggaatgatggtcctgaagatcgtgagagacatggagaaatatcagctcgctgtgaccattatggccatcctgtgcgtccctaatgcggttattctccagaacgcttggaaggtgtcctgtaccatcctggccgtggtctctgtgagcccccttctgctcacatccagccagcagaagacggactggattcctctggccctgaccatcaagggccttaatcccacagctatctttctgaccacactctctcgcaccaacaaaaagagatcctggccgctgaatgaagccattatggctgttgggatggtgagcatcctcgcctcttccctgcttaagaacgatattcctatgacgggacccctggtcgcgggcggcctgctcacagtgtgctacgttctgaccgggcggagcgccgaccttgagctggaacgcgctaccgatgtgaaatgggaggaccaggccgagatctctggatccagccctattctctccatcacaattagcgaagatggctctatgagcatcaagaatgaggaagaggagcagaccctgacaatcctcattagaacggggctgcttgtcatctccggactgttccccgtgtctattccgatcaccgctgccgcctggtatctgtgggaagtcaaaaagcagcgggctggcgtgctctgggacgttccttctccccctcccatggggaaagcggagctggaagatggagcctaccgcattaagcaaaagggcatccttggctattcccagatcggggctggagtgtacaaagagggcacatttcataccatgtggcacgtcacaagaggggccgtgctgatgcacaagggaaaacggattgaaccctcctgggccgacgttaagaaagatctcatcagctacggcgggggatggaagctggagggcgagtggaaggaaggcgaggaagtgcaggtcctcgctctggagcctgggaaaaacccgcgcgccgtgcagaccaagcccggacttttcaaaacgaataccggcacaattggggcggtgtccctggacttttctcctggaaccagcggctcccccatcattgataagaaagggaaggttgtcggactgtatggcaacggcgtggtgacaagaagcggggcttacgtctctgccatcgcccaaaccgaaaagtccatcgaggacaaccctgagattgaagatgacatcttccggaaacgcagactcacaattatggacctgcatcccggagctggcaagacgaaacggtatcttcctgccatcgtgagagaggcgattaagcgcgggctgcggaccctcatcctggctccgacaagagttgtggccgccgaaatggaggaagctctccgcggactgcccattcggtaccagacccctgccatcagagctgagcacaccggccgcgagatcgtcgatcttatgtgtcatgccacatttacgatgcggctgctgagccccgtgagagttcctaattataacctcattatcatggacgaagcgcacttcaccgatcccgcctctattgctgcccgcgggtacatctccacacgggtggagatgggcgaagctgccggaattttcatgaccgccacaccgcctggcagcagagacccctttccccagtccaatgctcctatcatcgatgaggagcgggaaattcccgagcgctcttggaacagcgggcatgaatgggtcaccgacttcaaaggaaagacggtgtggtttgttccttccatcaaggcgggcaatgatattgccgcttgcctgcgcaagaatgggaagaaagtgatccaacttagccggaagacattcgactctgagtatgtcaaaacccgcaccaatgattgggactttgtggtgacaaccgatatttccgaaatgggagccaacttcaaggccgagagagtcatcgacccgcggagatgtatgaaacccgttatcctgacagacggcgaggaacgcgtgattctcgctgggcctatgcccgtgacccacagctctgccgcgcagcggagaggccgcatcggacggaatcctaagaacgagaatgatcagtacatttacatgggcgaacccctggagaacgacgaagattgcgctcactggaaggaggccaaaatgctgctcgacaatatcaacacgccggaggggattatccctagcatgtttgaacccgagagagaaaaggtcgatgccattgacggagagtatcgccttcggggcgaagctagaaaaacattcgtggatctgatgcgcagaggggacctgcctgtttggctcgcctacaaggtggcggccgagggaaccaattatgctgatcggcgctggtgttttgacggcatcaaaaacaaccagatcctggaggaaaatgtcgaggtggaaatttggacaaaggagggggagagaaagaaacttaagccccggtggctggatgcccgcatctactccgaccctctcgctctgaaagagttcaaggagtttgccgctggcagaaaatctctgaccctcaaccttattacggaaatgggacggctgcccaccttcatgacacaaaagaccagagatgccctggacaatctcgcggttctgcatacagccgaggctggcgggcgcgcctataaccacgctcttagcgaactgccggagaccctcgagacactgctgctccttaccctgctggccacggtgacaggaggcatcttcctctttctgatgtccgggcggggaattggcaagatgacccttggcatgtgctgcatcatcaccgcctctattctgctctggtacgctcagatccagcctcattggattgcggccagcatcattctggagttctttctgatcgtcctccttatccccgagcccgaaaaacagagaacacctcaagacaatcagctgacctatgtggtcattgctatcctgacagtggttgccgccacgatggctaacgagatggggttcctcgaaaagaccaaaaaggatctgggacttggctccattgccacacagcagccggagagcaatatcctggacattgatctccgccccgcgtctgcctggaccctgtacgctgtggccacaacctttgtgacgcctatgctgcggcactccatcgagaacagctccgtcaatgtttctctcaccgctattgccaaccaagcgacagtgcttatggggctgggaaaaggctggcccctgagcaagatggacatcggggtgcctctcctggccatcggatgttactcccaggtcaatcccattacccttacagctgccctgctcctgctggtggctcactatgccatcattggccctggcctccaggctaaggccaccagagaagcgcagaaacgggccgctgccgggatcatgaagaacccgacggttgatggaattacagtgatcgaccttgatcccatcccttacgaccccaaattcgagaagcaactgggccaggtcatgctgctcattctgtgcgtgacccaggtccttatgatgcgcacaacctgggctctgtgtgaagccctcaccctggccacagggcctatctctacgctgtgggagggaaatcccggcagattttggaacaccacaattgcggtgagcatggctaatatcttccgggggtcctatctcgccggagctggccttctgtttagcattatgaaaaacaccacaaatacccgcagaggcacggggaacatcggagaaacactgggcgagaagtggaaatctcggctcaacgccctggggaagtccgagttccaaacctacaagaaaagcggaatccaggaagttgatcgcacccttgccaaggagggcattaaaagaggggaaacagaccatcacgctgtgtctcggggatccgccaagctgcgctggtttgtcgagagaaatatggtgaccccggagggcaaagttgtggatctcggctgcgggcggggaggctggagctattactgtgggggactgaagaacgtcagagaagtgaagggcctgacaaaagggggacctggccatgaggaacccatccccatgtctacgtatggctggaatctcgtgcgccttcagagcggggttgacgtcttctttattcctcccgagaagtgcgataccctgctgtgtgacatcggagaatcctctcctaacccgacagtggaggcgggccggaccctcagagtgctgaatcttgtcgagaactggctgaataacaatacacagttctgcattaaagttctcaacccctacatgcctagcgtgatcgaaaagatggaggccctgcaacgcaaacacgggggagctctggtgcggaatcccctctccagaaacagcacccatgaaatgtactgggtctccaatgcctctggcaacatcgtgagctccgttaatatgatttctcgcatgcttatcaaccggttcacgatgagacacaagaaggctacctatgagcctgacgtggatctggggagcggaacacgcaacattggcatcgaatccgagattcccaatctggacatcattggcaaacggatcgagaagatcaaacaggaacacgagacctcttggcattacgatcaggaccacccgtataagacatgggcctaccatgggagctatgaaaccaaacagacaggatccgcgagctctatggtcaacggcgtggttagactcctgaccaagccttgggatgtgcttcccacggtcacacaaatggccatgaccgacaccacaccttttgggcagcagcgcgtgttcaaggagaaagtggatacgcggacccaggaacccaaggagggaaccaaaaagctgatgaaaattaccgctgagtggctctggaaggaactgggcaaaaagaagacacctagaatgtgtacccgcgaggaatttacaagaaaagtccggtccaatgccgctctgggggccatcttcaccgacgagaacaagtggaaaagcgctcgcgaggccgttgaagattctagattttgggagctcgtggaccgggaaagaaatctgcaccttgagggaaagtgcgaaacgtgtgtgtacaacatgatgggcaaacgggagaagaagctgggcgagttcgggaaagcgaagggatcccgcgccatttggtatatgtggctcggcgctagatttctggagttcgaggcccttgggtttctgaatgaagatcactggttcagccgggagaactctctctccggagtcgaaggcgaggggctgcataaactgggctacatcctccgcgacgtgagcaagaaagagggaggcgctatgtacgccgacgataccgccgggtgggacacaagaattaccctggaagatcttaagaatgaggaaatggttacaaaccacatggagggagaacataagaaactggcggaggctatctttaagctcacctatcaaaataaagtggtccgggtgcagcgccccacgccgagaggcacagttatggacatcatttcccggcgcgatcagagagggagcggacaagtgggcacctacgggctgaacacattcaccaatatggaggcccagcttatccggcagatggaaggcgagggagtctttaagaacattcagcacctgacggccaccgaagaggtggctgttcaaaattggctcgcccgcgtgggcagagagcggctgtctcgcatggctatcagcggggacgattgcgtcgtgaaacctctggacgatagattcgccaacgcgctcacagccctgaacgacatgggaaagattcggaaggatatccagcagtgggaaccctccaaaggctggaatgactggacccaggtccccttctgctctcatcactttcacgagcttatcatgaaggatgggagagtgctggttgtgccttgtcgcaaccaagacgaactcattggacgggctagaatcagccagggcgccgggtggtccctgcgcgagacagcttgccttggcaaatcttatgcccagatgtggagcctgatgtacttccatcggagagacctccgcctggcggccaatgctatttgttccgccgtcccgtctcactgggtgcccaccagccggacaacctggtccatccatgctaagcacgaatggatgacgacagaggatatgctgaccgtgtggaacagagtttggattcgcgagaatccttggatggaagacaaaacccccgtggagagctgggaagagatcccttatctcggaaagcgggaagatcagtggtgcggctctctgattgggcttacatccagagccacctgggctaagaacatccaagccgcgatcaatcaggtccgcagcctgattggaaacgaggagtacacagactatatgccctctatgaaacggtttagacgggaagaggaagaggccggcgtgctctggtga

SEQ ID NO: 19710 - RNA, 9876 nt, synthetic construct
  misc_feature 1..9876: note = derived and/or modified CDS sequence (opt5) from DENV-2__GQ868624__SS-prME
  source 1..9876: mol_type = other RNA
agcgccggcatgatcattatgctgatccccaccgtgatggctttccacctgacaacgcggaatggggagcctcatatgattgtcggaatccaggaaaagggcaagagcctgctttttaagaccgaggacggggttaatatgtgcacactgatggccatggatctcggagaactgtgtgaggacaccattacatacaaatgcccgcttctgcggcaaaacgaacccgaggatatcgactgttggtgcaattctaccagcacatgggtgacctatggcacgtgtaccacaaccggggagcaccgcagagaaaagcggtccgtggcgctcgtccctcatgtgggaatgggcctggagacacgcaccgaaacgtggatgtctagcgagggcgcttggaaacacgcccagagaatcgagacatggattctgcggcatcccgggttcaccatcatggccgctattctcgcctacacaatcggaaccacccactttcagcgcgttctgattttcatccttctgacagctgtggccccttccatgacgatgagatgcattggcatctctaaccgggattttgtcgaaggggtgagcggaggctcctgggttgacatcgtgctcgagcacgggagctgtgtcaccacaatggcgaagaataagcccaccctggatttcgaacttattaaaacagaggccaagcagcctgctaccctgcgcaaatattgcatcgaagccaagctcacgaacacaaccaccgagtctagatgtccgacacaaggagagccctccctgaaagaggaacaagacaagcggtttgtgtgcaagcatagcatggtggatcgcggctggggcaatgggtgtggactgttcggcaaagggggaattgtgacctgcgctatgtttacatgcaagaaaaacatggaaggcaagatcgttcagcctgagaatctcgaatacacgattgtggtgacaccccactctggggaggagcatgccgtcggaaacgacacaggcaaacacggcatggaaatcaaggtgacccctcagtccagcatcacagaggcggaactgaccgggtatggaacggttaccatggagtgttctcccagaacaggccttgatttcaatgaaatggtgctgctccaaatggagaacaaagcctggctggtccaccggcagtggtttcttgacctgccgctcccttggctgcccggggctgataagcaggagtccaattggattcagaaggaaaccctggtgacattcaaaaaccctcatgccaagaaacaagacgttgtggtcctcggaagccaggagggcgctatgcacaccgccctgacgggggccacagaaatccagatgtcctctggcaatcttctgtttaccggacatctcaagtgccgcctgagaatggacaaacttcaactgaagggcatgagctactccatgtgtacagggaagttcaaagtggtcaaggagattgctgagacccagcacggaaccatcgtgattcgggttcagtatgaaggcgatgggagcccctgcaaaatccccttcgagatcatggacctcgaaaagagatacgtgctgggacgcctgattacagtcaaccctatcgtgacggagaaagattctccggttaacattgaagcggagcccccttttggcgactcctacatcattatcggggtggagcccggccagctcaagctgaattggttcaagaaaggaagctctattggccaaatgtttgaaaccacaatgagaggggccaagagaatggctatccttggagataccgcctgggacttcggcagcctcgggggagtctttacatccatcggcaaagccctccatcaggtgttcggggctatttatggcgccgcgttttctggagtgagctggaccatgaagatcctgattggcgttatcattacgtggatcgggatgaactcccgcagcacatctctgtccgtcagccttgtgctcgtgggaatcgtcaccctgtacctgggcgtgatggttcaggctgattctgggtgtgtggtctcctggaaaaataaggagctcaagtgcggaagcggcattttcatcaccgacaacgtgcacacatggaccgaacagtataaatttcaacctgagtccccctctaagctggccagcgccattcagaaagctcaggaagaggggatctgtggcattcggtccgttacaagacttgagaatctgatgtggaagcagatcacgccggaactcaaccacatcctggccgagaatgaagtgaaactgaccattatgacaggagatatcaagggcattatgcaagctgggaaacgctctcttcggcctcagcccaccgagctcaagtacagctggaagacatggggaaaagccaagatgctgtccaccgaaagctataaccagacgttcctgatcgacggccctgagaccgcggagtgccccaatacaaacagagcctggaactctctcgaagtcgaggattacgggtttggagtgttcaccacaaacatttggctgaaacttaaggaaaaacaggacgctttttgtgactccaagctgatgagcgccgctatcaaggataatcgcgccgttcatgcggacatgggctattggatcgagtctgccctcaacgatacctggaaaattgagaaggcttccttcatcgaagtgaaaaattgccactggcctaagagccatacactgtggtctaacggcgtcctggagagcgaaatgattatccccaaaaaccttgccgggccggtgtcccaacacaattaccggcctggataccacacccagattgctggcccctggcatctcgggaagctggagatggacttcgatttttgtgacggaacgacagtgatcgtcaccgaagattgcggcaacagagggcccagcctgcgcaccacaaccgcctctggaaagctcattacggagtggtgctgtcggtcctgcacactgcctccgcttagatatcggggcgaggacggctgttggtacgggatggaaatccgccccctgaaagagaaggaagagaatctcgttaacagcctggtgaccgccggacacggccaggtggataatttctccctgggggtccttggaatggctctctttctggaagagatgctgagaacacgggtgggcaccaaacatgcgatcctcctggttgccgtgtctttcgtcacacttattaccgggaacatgagctttaaggacctgggaagagtggttgtgatggtcggcgctacgatggccgatgacatcggcatgggggtgacctatctcgccctgctggctgccttcaaagttcgccctacatttgcggctggacttctgctccggaagctgacctccaaggagctcatgatgacaaccattggcatcgtgctgctttctcaaagcacgattcccgaaacagtcctggagctcaccgatgccctggccctggggatgatggtgcttaaaatcgtgagaaatatggaaaagtaccagctggctgtcacaatcatggccattctctgcgttcctaacgcggtgatcctgcagaatgcttggaaagtgtcctgtaccattctcgccgtcgtgtctgttagccccctgcttctgacctccagccagcaaaagacagactggatccctctcgccctgacgattaaaggactgaaccccaccgctatcttccttacaaccctgtctcgcacaaataagaaaagatcctggccgctcaacgaggccatcatggctgtgggcatggtcagcattctggcctcttccctcctgaagaatgacatccctatgaccgggccccttgtggcgggaggcctgctgacggtttgctatgtgctcacaggccggagcgccgatctggaacttgagcgcgctaccgacgtcaagtgggaggatcaggccgaaatttctgggtccagccctatcctgtccattaccatcagcgaggacggatctatgagcattaaaaacgaagaggaggaacagacactcaccatcctgatcagaacaggcctcctggtgatttccgggctttttcccatctctattccgatcacggctgccgcctggtacctgtgggaggtcaagaaacagcgggctggagtgctgtgggatgttccttctccccctcccatgggcaaggcggaactcgaggacggggcctatcgcattaaacaaaagggaatcctgggctactcccagatcggcgctggggtgtacaaggaaggaaccttccacacaatgtggcatgtcaccagaggcgccgtgcttatgcacaaagggaagcggattgagccctcctgggccgatgttaaaaaggacctgatcagctatggaggcgggtggaaactcgagggagaatggaaggagggcgaagaggtgcaggtcctggctctcgaacctggcaagaatccgcgcgccgtgcagacaaaacccgggctgtttaagaccaacacgggaaccattggcgcggtgtcccttgatttctctcctgggacaagcggatcccccatcattgacaaaaagggcaaagttgtcgggctgtacggaaacggcgtggtgaccagaagcggcgcttatgtctctgccatcgcccaaacagagaagtccatcgaggataatcctgaaattgaggacgatatctttcggaagcgcagactgaccattatggacctccaccccggggctggaaaaacaaagcggtacctgcctgccatcgtgagagaagcgattaaacgcggccttcggacgctgatcctcgctccgaccagagttgtggccgccgagatggaagaggctctgcgcgggctccccattcggtatcagacccctgccatcagagctgagcataccggacgcgaaatcgtcgacctgatgtgtcacgccaccttcacaatgcggcttctgagccccgtgagagttcctaactacaatctgattatcatggatgaggcgcatttcacggaccccgcctctattgctgcccgcggctatatctccacccgggtggaaatgggggaggctgccggcatttttatgacagccaccccgcctggaagcagagatcccttcccccagtccaacgctcctatcatcgacgaggaacgggagattcccgaacgctcttggaatagcggccacgagtgggtcacagattttaaggggaaaaccgtgtggttcgttccttccatcaaggcgggaaacgacattgccgcttgcctcagaaagaatggcaaaaaggtgatccaactgagccggaaaacgtttgattctgaatacgtcaagacacgcaccaacgactgggatttcgtggtgaccacagacatttccgagatgggggccaattttaaagccgagagagtcatcgatccgcggagatgtatgaagcccgttatccttaccgacggagaggaacgcgtgattctggctggccctatgcccgtgacacatagctctgccgcgcagcggagagggcgcatcggccggaaccctaaaaatgaaaacgaccagtacatttatatgggagagcccctcgaaaatgatgaggactgcgctcactggaaggaggccaagatgctgctggataacatcaataccccggaaggcattatccctagcatgttcgagcccgaaagagagaaagtcgacgccattgatggggaataccgcctccggggagaggctagaaagacgtttgtggaccttatgcgcagaggcgatctgcctgtttggctggcctataaagtggcggccgaggggatcaactacgctgaccggcgctggtgtttcgatggaatcaagaacaatcagattctcgaagagaacgtcgaagtggagatctggacaaaagagggcgaaagaaagaagctgaaaccccggtggcttgacgcccgcatttattccgatcctctggctctcaaggagtttaaagagttcgccgctgggagaaagtctctgaccctgaatctcatcacagagatgggccggcttcccaccttcatgacgcagaagaccagagacgccctggataacctggcggttctccacacagccgaagctggaggccgcgcctacaatcatgctctgagcgagcttccggagaccctggaaacactcctgctgctcacccttctggccacagtgaccgggggaatttttctgttcctcatgtccggccgggggatcggaaagatgacgctgggcatgtgctgcatcattacagcctctatccttctgtggtatgctcagattcagcctcactggatcgcggccagcattatcctcgagtttttcctgatcgtcctgctcattcccgaacccgagaagcagagaacccctcaagacaaccagcttacctacgtggtcatcgctattctgacagtggttgccgccaccatggctaatgaaatgggctttctggagaaaacaaagaaagacctcgggctgggatccatcgccacgcagcagccggagagcaacattcttgatatcgacctgcgccccgcgtctgcctggaccctctacgctgtggccacaaccttcgtgacacctatgctgcggcattccattgaaaatagctccgtcaacgtttctctgaccgctatcgccaatcaagcgacggtgctcatgggccttgggaagggatggcccctgagcaaaatggatatcggcgtgcctctgctcgccattgggtgttattcccaggtcaaccccatcaccctgacagctgcccttctgctcctggtggctcactacgccattatcggacctggcctgcaggctaaggccaccagagaggcgcagaagcgggccgctgccggcattatgaaaaatccgacagttgacgggatcaccgtgatcgatctcgaccccattccttatgatcccaagtttgaaaaacaacttggacaggtcatgctgctgatcctctgcgtgacgcaggtcctgatgatgcgcacaacctgggctctttgtgaggccctgacactcgccaccggccctatttctaccctgtgggaagggaaccccggaagattctggaatacaacgatcgcggtgagcatggctaacatttttcggggctcctacctggccggggctggactccttttcagcatcatgaagaataccacaaacacccgcagaggcacaggcaacatcggggagaccctgggagagaaatggaagtctcggctgaatgccctcggcaaatccgaatttcaaatttataaaaagagcgggatccaggaggttgaccgcacgctggccaaagaaggaattaagagaggcgagacagatcaccatgctgtgtctcgggggtccgccaaacttcgctggttcgtcgagagaaacatggtgaccccggaaggaaaggttgtggacctgggctgcggcagagggggatggagctactattgtggcgggctcaaaaatgtccgggaggtgaagggactgaccaagggcgggcctggacacgaagaacccatccccatgtctacatacggctggaacctggtgcgcctccagagcggcgttgatgtctttttcattcctcccgaaaaatgcgacacccttctgtgtgatatcggggagtcctctcctaatccgacagtggaggcgggacggacgctgagagtgctcaacctggtcgaaaattggcttaacaataacacccagttctgcatcaaggttctgaatccctacatgcctagcgtgattgagaaaatggaagccctccaacgcaagtatggcggggctctggtgcggaaccccctgtccagaaatagcacacatgagatgtactgggtctccaacgcctctggaaatatcgtgagctccgttaacatgatttctcgcatgctcatcaaccggtttaccatgagacacaaaaaggctacatatgaacctgacgtggaccttggcagcgggacccgcaatattggaatcgagtccgagattcccaacctggatatcatcggcaagcggattgagaagatcaaggaggaacatgagacgtcttggcactacgaccaggatcacccgtataaaacctgggcctaccatggcagctatgaaacaaagcagaccgggtccgcgagctctatggtcaatggagtggttagactgctcacaaaaccttgggacgtgctgcccaccgtcacacagatggccatgaccgatacgacacctttcggccaacagcgcgtgtttaaggagaaggtggacacccggacccaggagcccaaagaagggacaaagaaacttatgaagattacggctgagtggctgtggaaagaactcggaaagaaaaagacccctagaatgtgtacacgcgaggagttcaccagaaaggtccggtccaacgccgctctgggcgccatctttacagatgaaaataaatggaaaagcgctcgcgaggccgttgaagactctagattctgggagctggtggataaagaacggaacctccacctggaggggaagtgcgagacctgtgtgtacaatatgatgggaaaaagagaaaagaaacttggcgagtttggcaaagcgaaggggtcccgggccatttggtacatgtggctgggagctcgcttcctcgaatttgaggccctgggcttccttaacgaagaccattggtttagcagagaaaattctctgtccggggtcgagggagaaggcctccacaaactggggtatatcctgcgggatgtgagcaagaaagagggcggagctatgtacgccgacgacacagccggctgggatacccgcatcacgctcgaagacctgaagaacgaggaaatggttaccaatcacatggagggggagcataagaaacttgcggaagctattttcaagctgacatatcagaacaaagtggtcagagtgcaacggcccaccccgcgcggaacagttatggatatcatttccagacgggaccagcgcggcagcgggcaggtcggaacctacggcctcaatacgtttacaaacatggaggcccaactgatcagacagatggaaggggagggcgtcttcaagaatattcagcaccttaccgtgacagaggaagccgctgttcagaactggctggcccgggtgggacgcgagagactctctcggatggctatcagcggcgatgactgcgtcgtgaaacctctggatgaccgcttcgccaacgcgctgaccgccctcaatgatatggggaagatcagaaaggacattcaacagtgggaaccctccaaaggatggaacgattggacgcaggtccccttttgctctcatcacttccatgagctgatcatgaaggacggccgggtgcttgttgtgccttgtagaaatcaggatgaactgattgggcgcgctcggatcagccaaggagccggctggtccctcagagagaccgcttgcctggggaaatcttatgcccagatgtggagccttatgtactttcaccgccgggacctgagactcgcggccaacgctatttgttccgccgtcccgtctcactgggtgcccacaagccgcaccacatggtccatccatgctaagcacgagtggatgaccacagaagacatgctgaccgtgtggaatcgggtttggattagagagaacccttggatggaagataaaacgcccgtggagagctgggaagagatcccttatctgggcaagcgcgaggaccagtggtgcggatctctcatcggcctgacatcccgggccacctgggctaagaatattcaggccgcgatcaaccaagtcagaagccttattgggaatgaagagtacaccgattacatgccctctatgaaacgcttccggagagaagaggaagaggccggagtgctgtggtga

SEQ ID NO: 19711 - RNA, 9876 nt, synthetic construct
  misc_feature 1..9876: note = derived and/or modified CDS sequence (opt5) from DENV-2__FJ639717__SS-prME
  source 1..9876: mol_type = other RNA
tccgctggaatgatcattatgctgatccccacagtgatggctttccacctcacaacgagaaacggggagcctcatatgattgtcgggatccaggaaaagggcaagtccctgctttttaagaccgaggacggggttaatatgtgcacactgatggccatggatctcggagaactgtgtgaggacaccattacatacaagtgcccgcttctgcggcaaaacgaacccgaggatatcgactgttggtgcaattctaccagcacatgggtgacctatggcacgtgtaccacaaccggggagcacagaagagaaaagcggtccgtggcgctcgtccctcatgtgggaatgggcctggagacacgcaccgaaacgtggatgtcttccgagggcgcttggaaacacgcccagagaatcgagacatggattctgcggcatcccgggttcaccatcatggccgctattctcgcctacacaatcggaaccacccactttcagcgcgctctgattttcatccttctgacagccgttgcgccttccatgacgatgagatgcattggcatctctaaccgggattttgtggaaggggtcagcggaggctcctgggtggacatcgttctcgagcacgggagctgtgtgaccacaatggccaagaataagcccaccctggatttcgaacttattaaaacagaggctaagcagcctgccaccctgcgcaaatattgcatcgaagctaagctcacgaacacaaccaccgagtctagatgtccgacacaaggagagccctccctgaaagaggaacaagacaagcggtttgtctgcaagcatagcatggtggatcgcggctggggcaatgggtgtggactgttcggcaaagggggaattgtgacctgcgccatgtttacatgcaagaaaaacatggaaggcaagatcgtccagcctgagaatctcgaatacacgattgttgtgacaccccactctggggaggagcatgcggtgggaaacgacacaggcaaacacggcaaggaaatcaaagtcacccctcagtccagcatcacagaggccgaactgaccgggtatggaacggtgaccatggagtgttctcccagaacaggccttgatttcaatgaaatggttctgctccaaatggagtccaaggcttggctggtgcaccggcagtggtttcttgacctgccgctcccttggctgcccggggccgataagcagggaagcaactggattcagaaagagaccctggtcacattcaagaatcctcatgctaaaaagcaagacgtggttgtgctcggctcccaggaaggggccatgcacaccgccctgacgggcgctacagagatccagatgtctagcggaaaccttctgtttaccggccatctcaaatgccgcctgagaatggacaaacttcaactgaaggggatgtcctacagcatgtgtacaggaaaattcaaggtcgtgaaagaaattgcggagacccagcacggcaccatcgtcattcgggtgcagtatgagggggatggatctccctgcaagatccccttcgaaatcatggacctcgagaaaagatacgttctgggccgcctgattacagtgaatcctatcgtcacggaaaaggattccccggtgaacattgaggccgaacccccttttggggacagctacatcattatcggcgttgagcccggacagctcaagctgaactggttcaaaaagggctctagcattgggcaaatgtttgagaccacaatgcggggagctaaaagaatggccatccttggcgataccgcctgggacttcgggtccctgggaggcgtgtttacatctatcgggaaggctctccatcaggtcttcggcgccatttatggagcggcttttagcggcgtgtcctggaccatgaaaatcctgattggggtgatcattacgtggatcggaatgaatagccgctctacatccctgagcgtttctcttgtcctcgtgggcatcgtgaccctgtacctgggggtcatggtgcaggccgattccggatgtgttgtgagctggaagaacaaggaactcaaatgcggctccgggattttcatcaccgacaatgtccacacatggaccgagcagtataagtttcaacctgaatctcccagcaaactggcctccgctattcagaaggcccaggaggaaggcatctgtggcattcggtctgtgacaagacttgagaacctgatgtggaaacagatcacgccggagctcaatcacatcctggctgaaaacgaggttaagctgaccattatgacaggcgatatcaaagggattatgcaagccggaaagcgcagccttcggcctcagcccaccgaactcaagtactcctggaaaacatggggcaaggcgaaaatgctgagcaccgagtctcataatcagacgttcctgatcgacgggcctgaaaccgccgagtgccccaacacaaatagagcttggaactccctcgaggtggaagattatggatttggcgtcttcaccacaaatatttggctgaaacttaaagagaagcaggacgccttttgtgacagcaagctgatgtctgctgccatcaaagataaccgcgcggtgcacgccgacatgggctactggatcgaatccgctctcaatgatacctggaagattgagaaagccagcttcatcgaggttaagaactgccattggcctaaatctcacacactgtggagcaatggggtgctggaatccgagatgattatccccaagaaccttgctggaccggtcagccaacacaactatcggcctggctaccatacccagacggccgggccctggcacctcggaaagctggaaatggacttcgatttttgtgacggcacaaccgtgattgtgaccgaggattgcgggaatagaggaccctctctgcgcacaaccacggcctccggcaaactcatcacagaatggtgctgtcggagctgcaccctgcctccgcttagataccggggcgaggacgggtgttggtatggaatggagattcgccccctgaaggaaaaagaggaaaacctcgtcaattccctggttacagctggccatggacaggtggataacttctctctgggagtgcttggcatggcgctctttctggaggaaatgctgagaacccgggtcgggacaaagcacgccatcctcctggtggctgttagcttcgtgacccttatcacgggaaatatgtcctttaaagacctgggcagagtcgtggttatggtgggcaccacaatgaccgatgacattgggatgggagtcacatacctcgccctgctggccgctttcaaggtgcgccctacctttgccgcgggccttctgctccggaagctgacgtctaaagagctcatgatgacaaccatcgggattgttctgcttagccaatccacaatccccgagaccattctggaactcaccgatgctctggccctgggaatgatggtgcttaagatcgtcagagacatggagaaatatcagctggccgtgacaatcatggctattctctgcgtgcctaacgccgtcatcctgcagaatgcgtggaaggtttcttgtacgattctcgctgtggtgagcgtcagccccctgcttctgaccagctctcagcagaagacagactggatccctctcgccctgaccattaagggcctgaaccccacagccatcttccttaccacgctgtcccgcacaaataaaaagagaagctggccgctcaacgaagctatcatggccgtggggatggtttctattctggcttccagcctcctgaagaatgatatccctatgaccggaccccttgtggccggcggcctgctgaccgtctgctacgtgctcacagggcggtctgcggacctggagcttgaacgcgccaccgatgttaaatgggaggaccaggctgagatttccggaagctcccctatcctgagcattacaatctctgaagatggcagcatgtccattaagaacgaggaagaggagcagacgctcaccatcctgatcagaacagggctcctggtgatttctggactttttcccgtcagcatcccgattaccgccgctgcctggtatctgtgggaagtgaaaaagcagcgggccggcgtcctgtgggacgtgccttctccccctcccatggggaaagctgagctcgaagatggagcgtaccgcatcaagcaaaagggcattctgggctatagccagatcggggccggagtttacaaagagggcacattccataccatgtggcacgtgacgagaggggctgtccttatgcacaagggaaaacggatcgaacccagctgggccgacgtgaagaaagatctgatttcctacggcgggggatggaagctcgagggcgagtggaaggaaggcgaggaagttcaggtgctggccctcgagcctgggaaaaatccgcgcgctgtccagaccaagcccggactgtttaaaacaaacaccggcacaatcggggccgtgtctcttgacttcagccctggaacctccggcagccccattatcgataagaaagggaaggtggttggactgtatggcaatggcgtcgtgacaagatctggggcgtacgtgtccgctattgcccaaacggaaaagagcatcgaggacaaccctgagatcgaagatgacatttttcggaaacgcagactgaccatcatggacctccatcccggagccggcaagacaaaacggtatctgcctgctattgtcagagaggccatcaagcgcgggcttcggaccctgattctcgcgccgaccagagtggttgctgccgaaatggaggaagccctgcgcggactccccatccggtaccagacccctgctattagagccgagcacacgggccgcgagatcgtggatctgatgtgtcatgctaccttcacaatgcggcttctgtctcccgtcagagtgcctaactataatctgatcattatggacgaagcccacttcaccgatcccgcgtccatcgccgctcgcgggtacattagcacacgggttgagatgggcgaagccgctggaatctttatgaccgccacgccgcctggctccagagaccccttcccccagtctaacgcccctattatcgatgaggagcgggaaatccccgagcgcagctggaatacagggcatgaatgggtgaccgactttaaaggaaagaccgtctggttcgtgccttccattaaggctggcaacgatatcgcggcctgcctccgcaagaatgggaagaaagttattcaactgagccggaagacatttgactctgagtatgtgaaaacccgcacaaacgattgggacttcgtcgtgaccacggatatctccgaaatgggagctaattttaaggccgagagagtgattgacccgcggagatgtatgaaacccgtcatccttacagacggcgaggaacgcgttatcctggccgggcctatgcccgtgacccacagctctgctgcccagcggagaggccgcattggacggaaccctaagaatgagaacgatcagtacatctacatgggcgaacccctcgagaatgacgaagattgcgcgcactggaaggaggctaaaatgctgctggacaacattaatacaccggaggggatcattcctagcatgttcgaacccgagagagaaaaggtggatgccatcgacggagagtatcgcctccggggcgaagccagaaaaacctttgtcgatcttatgcgcagaggggacctgcctgtgtggctggcttacaaggttgccgcggagggaattaactatgccgatcggcgctggtgtttcgacggcatcaaaaataaccagatcctcgaggaaaacgtggaggtcgaaatttggacgaaggagggggagagaaagaaactgaagccccggtggcttgatgctcgcatctactccgaccctctggccctcaaagaatttaaggagttcgctgccggcagaaaatctctgaccctgaatctcattacagaaatgggacggcttcccaccttcatgacacaaaagaccagagatgctctggacaacctggccgtgctccatacagcggaggccggcgggcgcgcttataatcacgccctgagcgaacttccggagaccctggagacgctcctgctgctcacacttctggctaccgttaccggaggcatctttctgttcctcatgtccgggcggggaattggcaagatgacactgggcatgtgctgcatcatcaccgcctctgtgcttctgtggtacgcccagattcagcctcattggatcgctgcgagcattatcctcgaatttttcctgattgtcctgctcatccccgagcccgaaaaacagagaacacctcaagacaaccagcttacgtatgtggtcatcgccattctgaccgtggttgctgccacaatggccaatgagatggggtttctggaaaagaccaaaaaggatctcggactgggctccatcgctacacagcagccggagagcaacattcttgacatcgatctgcgccccgcctctgcgtggaccctctacgccgtggctacgaccttcgtgacacctatgctgcggcactccattgagaatagctccgtcaacgtttctctgaccgccatcgctaatcaagccacagtgctcatggggcttggaaaaggctggcccctgagcaagatggacattggggtgcctctgctcgcgatcggatgttactcccaggtcaaccccatcaccctgacggccgcccttctgctcctggtggcccactatgctattatcggccctggcctgcaggccaaggctacaagagaagcccagaaacgggcggccgctgggattatgaagaatccgaccgttgatggaatcacagtgattgacctcgatcccatcccttacgaccccaaatttgagaagcaacttggccaggtcatgctgctgatcctctgcgtgacccaggtcctgatgatgcgcaccacatgggccctttgtgaagctctgacgctcgccaccgggcctatttctacactgtgggagggaaaccccggcagattctggaataccacaatcgccgtgagcatggcgaacatttttcgggggtcctatctggctggagccggcctccttttcagcatcatgaaaaataccacgaacacacgcagaggcaccgggaatattggagaaaccctgggcgagaagtggaaatctcggctgaacgctctcgggaagtccgagtttcaaacatacaagaaaagcggaatccaggaagttgatcgcaccctggccaaggagggcatcaaaagaggggaaacagaccatcacgccgtgtctcggggatccgctaaacttcgctggttcgtcgagagaaacatggtgacgccggagggcaaagttgtggatctgggctgcgggcggggaggctggagctattactgtgggggactcaagaatgtcagagaagtgaagggcctgaccaaagggggacctggccatgaggaacccattcccatgtctacatatggctggaacctggtgcgcctccagagcggggttgacgtctttttcatccctcccgagaagtgcgatacccttctgtgtgacattggagaatcctctcctaatccgacagtggaggccggccggaccctgagagtgctcaacctggtcgagaattggcttaacaataacacgcagttctgcatcaaagttctgaatccctacatgcctagcgtgattgaaaagatggaggcgctccaacgcaaatacgggggagccctggtgcggaaccccctgtccagaaatagcacccacgaaatgtattgggtctccaacgcttctggcaatatcgtgagctccgttaacatgatctctcgcatgctcattaatcggtttacaatgagacataagaaggccacctacgagcctgacgtggatcttgggagcggaacacgcaacatcggcattgaatccgagatccccaacctggacattatcggcaaacggattgagaagatcaaacaggaacacgagacctcttggcactatgatcaggaccatccgtacaagacatgggcttatcacgggagctacgaaaccaaacagacgggatccgccagctctatggtcaatggcgtggttagactgctcacaaagccttgggatgtgctgcccaccgtcacccaaatggcgatgacagacacgacccctttcgggcagcagcgcgtgtttaaggagaaagtggatacacggacccaggaacccaaggagggaaccaagaaacttatgaaaatcaccgccgagtggctgtggaaggaactcggcaaaaagaagacacctagaatgtgtacccgcgaggagttcacgagaaaagtccggtccaacgctgccctgggggctatttttaccgacgagaataagtggaaaagcgcccgcgaggctgttgaagattctagattctgggagctggtggacaaggaacggaacctccatctggagggaaaatgcgaaacatgtgtgtataatatgatgggcaagagagagaagaaacttggcgagtttgggaaggccaaaggatcccgggcgatctggtacatgtggctgggcgcccgcttcctcgaatttgaggctctggggttccttaacgaagatcactggtttagcagagaaaattctctgtccggagtcgaaggcgaggggctccacaagctgggctacattctgcgggacgtgagcaaaaaggagggaggcgccatgtatgctgacgataccgccgggtgggacacacgcatcaccctcgaagatctgaagaacgaggaaatggttacgaatcatatggagggagaacacaagaaacttgccgaggcgattttcaaactgacataccaaaacaaagtggtcagagtgcagcggcccaccccgcgcggcacagttatggacatcatctccagacgggatcagcgcgggagcggacaagtgggcacctatgggctcaatacgtttaccaacatggaggctcagctgattagacagatggaaggcgagggagtcttcaaaaatatccagcatcttacagccaccgaagaggtggccgttcaaaactggctggctcgggtgggccgcgagagactctctcggatggccattagcggggacgattgcgtcgtgaagcctctggacgatcgcttcgctaatgccctgacagcgctcaacgacatgggaaagatcagaaaagatattcagcagtgggaaccctccaagggctggaacgactggacccaggtccccttttgctctcaccatttccacgagctgatcatgaaagatgggcgggtgcttgttgtgccttgtagaaatcaagacgaactgatcggacgcgcccggattagccagggcgctgggtggtccctcagagagacagcctgcctgggcaagtcttacgctcagatgtggagccttatgtattttcaccgccgggacctgagactcgccgcgaacgccatctgttccgctgtcccgtctcattgggtgcccaccagccgcacgacatggtccattcacgccaaacatgaatggatgaccaccgaggatatgctgacagtgtggaatcgggtttggatcagagagaacccttggatggaagacaagacccccgtggagagctgggaagagattccttacctgggaaagcgcgaagatcagtggtgcggctctctcatcgggctgacatcccgggctacgtgggccaaaaatattcaagctgccatcaaccaggtcagaagccttatcggaaatgaggagtataccgactacatgccctctatgaagcgcttccggagagaagaggaagaggcgggcgtgctgtggtga

SEQ ID NO: 19712 - RNA, 9876 nt, synthetic construct
  misc_feature 1..9876: note = derived and/or modified CDS sequence (opt5) from DENV-2__FJ639718__SS-prME
  source 1..9876: mol_type = other RNA
agcgccggaatgatcattatgctgatccccacagtgatggctttccacctgacaacgcggaatggggagcctcatatgattgtcggaatccaggaaaagggcaaaagcctgctttttaagaccgaggacggggttaatatgtgcacactgatggccatggatctcggagaactgtgtgaggacaccattacatacaaatgcccgcttctgcggcaaaacgaacccgaggatatcgactgttggtgcaattctaccagcacatgggtgacctatggcacgtgtaccacaaccggggagcaccgcagagaaaagcggtccgtggcgctcgtccctcatgtgggaatgggcctggagacacgcaccgaaacgtggatgtctagcgagggcgcttggaaacacgcccagagaatcgagacatggattctgcggcatcccgggttcaccatcatggccgctattctcgcctacacaatcggaaccacccactttcagcgcgttctgattttcatccttctgacagctgtggccccttccatgacgatgagatgcattggcatctctaaccgggattttgtcgaaggggtgagcggaggctcctgggttgacatcgtgctcgagcacgggagctgtgtcaccacaatggcgaagaataagcccaccctggatttcgaacttattaaaacagaggccaagcagcctgctaccctgcgcaaatattgcatcgaagccaagctcacgaacacaaccaccgagtctagatgtccgacacaaggagagccctccctgaaagaagaacaggacaagcggtttgtgtgcaagcatagcatggtggatcgcggctggggcaatgggtgtggactgttcggcaaagggggaattgtcacatgcgctatgtttacatgcaagaaaaacatggaaggcaagatcgttcagcctgagaatctcgaatacacgattgtggtgacaccccactctggggaggagcatgccgtcggaaacgacacaggcaaacacggcatggaaatcaaggtgacccctcagtccagcatcacagaggcggaactgaccgggtatggaacggttaccatggagtgttctcccagaacaggccttgatttcaatgaaatggtgctgctccaaatggagaacaaagcctggctggtccaccggcagtggtttcttgacctgccgctcccttggctgcccggggctgataagcaggagtccaattggattcagaaggaaaccctggtgacattcaaaaaccctcatgccaagaaacaagacgttgtggtcctcggaagccaggagggcgctatgcacaccgccctgacgggggccacagaaatccagatgtcctctggcaatcttctgtttaccggacatctcaagtgccgcctgagaatggacaaacttcaactgaagggcatgagctactccatgtgtacagggaagttcaaagtggtcaaggagattgctgagacccagcacggaaccatcgtgattcgggttcagtatgaaggcgatgggagcccctgcaaaatccccttcgagatcatggacctcgaaaagagatacgtgctgggacgcctgattacagtcaaccctatcgtgacggagaaagattctccggttaacattgaagcggagcccccttttggcgactcctacatcattatcggggtggagcccggccagctcaagctgaattggttcaagaaaggaagctctattggccaaatgtttgaaaccacaatgagaggggccaagagaatggctatccttggagataccgcctgggacttcggcagcctcggcggggtctttacatccatcgggaaagccctccatcaggtgttcggggctatttatggcgccgcgttttctggagtgagctggaccatgaagatcctgattggcgttatcattacgtggatcgggatgaactcccgcagcacatctctgtccgtcagccttgtgctcgtgggaatcgtcaccctgtacctgggcgtgatggttcaggctgattctgggtgtgtggtctcctggaaaaataaggagctcaagtgcggaagcggcattttcatcaccgacaacgtgcacacatggaccgaacagtataaatttcaacctgagtccccctctaagctggccagcgccattcagaaagctcaggaagaggggatctgtggcattcggtccgttacaagacttgagaatctgatgtggaagcagatcacgccggaactcaaccacatcctggccgagaatgaagtgaaactgaccattatgacaggagatatcaagggcattatgcaagctgggaaacgctctcttcggcctcagcccaccgagctcaagtacagctggaagacatggggaaaagccaagatgctgtccaccgaaagctataaccagacgttcctgatcgacggccctgagaccgcggagtgccccaatacaaacagagcctggaactctctcgaagtcgaggattacgggtttggagtgttcaccacaaacatttggctgaaacttaaggaaaaacaggacgctttttgtgactccaagctgatgagcgccgctatcaaggataatcgcgccgttcatgcggacatgggctattggatcgagtctgccctcaacgatacctggaaaattgagaaggcttccttcatcgaagtgaaaaattgccactggcctaagagccatacactgtggtctaacggcgtcctggagagcgaaatgattatccccaaaaaccttgccgggccggtgtcccaacacaattaccggcctggataccacacccagattgctggcccctggcatctcgggaagctggagatggacttcgatttttgtgacggaacgacagtgatcgtcaccgaagattgcggcaacagagggcccagcctgcgcaccacaaccgcctctggaaagctcattacggagtggtgctgtcggtcctgcacactgcctccgcttagatatcggggcgaggacggctgttggtacgggatggaaatccgccccctgaaagagaaggaagagaatctcgttaacagcctggtgaccgccggacacggccaggtggataatttctccctgggggtccttggaatggctctctttctggaagagatgctgagaacacgggtgggcaccaaacatgcgatcctcctggttgccgtgtctttcgtcacacttattaccgggaacatgagctttaaggacctgggaagagtggttgtgatggtcggcgctacgatggccgatgacatcggcatgggggtgacctatctcgccctgctggctgccttcaaagttcgccctacatttgcggctggacttctgctccggaagctgacctccaaggagctcatgatgacaaccattggcatcgtgctgctttctcaaagcacgattcccgaaacagtcctggagctcaccgatgccctggccctggggatgatggtgcttaaaatcgtgagaaatatggaaaagtaccagctggctgtcacaatcatggccattctctgcgttcctaacgcggtgatcctgcagaatgcttggaaagtgtcctgtaccattctcgccgtcgtgtctgttagccccctgcttctgacctccagccagcaaaagacagactggatccctctcgccctgacgattaaaggactgaaccccaccgctatcttccttacaaccctgtctcgcacaaataagaaaagatcctggccgctcaacgaggccatcatggctgtgggcatggtcagcattctggcctcttccctcctgaagaatgacatccctatgaccgggccccttgtggcgggaggcctgctgacggtttgctatgtgctcacaggccggagcgccgatctggaacttgagaaggctaccgacgtcaaatgggaggatcaggccgaaatttctgggtccagccctatcctgtccattaccatcagcgaggacggatctatgagcattaagaacgaagaggaggaacagacactcaccatcctgatccgcacaggcctcctggtgatttccgggctttttcccatctctattccgatcacggctgccgcctggtacctgtgggaggtcaaaaagcagagagctggagtgctgtgggatgttccttctccccctcccatgggcaaagcggaactcgaggacggggcctatcggattaagcaaaagggaatcctgggctactcccagatcggcgctggggtgtacaaagaaggaaccttccacacaatgtggcatgtcacccgcggcgccgtgcttatgcacaaggggaaaagaattgagccctcctgggccgatgttaagaaagacctgatcagctatggaggcgggtggaagctcgagggagaatggaaggagggcgaagaggtgcaggtcctggctctcgaacctggcaaaaatccgcgggccgtgcagacaaagcccgggctgtttaaaaccaacacgggaaccattggcgcggtgtcccttgatttctctcctgggacaagcggatcccccatcattgacaagaaaggcaaggttgtcgggctgtacggaaacggcgtggtgacccgcagcggcgcttatgtctctgccatcgcccaaacagagaagtccatcgaggataatcctgaaattgaggacgatatctttagaaaacggcgcctgaccattatggacctccaccccggggctggaaagacaaaaagatacctgcctgccatcgtgcgggaagcgattaagagaggccttcgcacgctgatcctcgctccgacccgggttgtggccgccgagatggaagaggctctgagagggctccccattcgctatcagacccctgccatccgggctgagcataccggaagagaaatcgtcgacctgatgtgtcacgccaccttcacaatgcgccttctgagccccgtgcgggttcctaactacaatctgattatcatggatgaggcgcatttcacggaccccgcctctattgctgccagaggctatatctccacccgcgtggaaatgggggaggctgccggcatttttatgacagccaccccgcctggaagccgggatcccttcccccagtccaacgctcctatcatcgacgaggaaagagagattcccgaacggtcttggaatagcggccacgagtgggtcacagattttaaagggaagaccgtgtggttcgttccttccatcaaggcgggaaacgacattgccgcttgcctccgcaaaaatggcaagaaagtgatccaactgagcagaaagacgtttgattctgaatacgtcaaaacacggaccaacgactgggatttcgtggtgaccacagacatttccgagatgggggccaattttaaggccgagcgcgtcatcgatccgagacggtgtatgaaacccgttatccttaccgacggagaagagagagtgattctggctggccctatgcccgtgacacatagctctgccgcgcagcgccgggggagaatcggccgcaaccctaagaatgaaaacgaccagtacatttatatgggagagcccctcgaaaatgatgaggactgcgctcactggaaggaggccaaaatgctgctggataacatcaataccccggaaggcattatccctagcatgttcgagcccgaacgggagaaggtcgacgccattgatggggaatacagactccgcggagaggctcggaaaacgtttgtggaccttatgagacgcggcgatctgcctgtttggctggcctataaggtggcggccgaggggatcaactacgctgacagacggtggtgtttcgatggaatcaaaaacaatcagattctcgaagagaacgtcgaagtggagatctggacaaaggagggcgaacgcaagaaactgaagcccagatggcttgacgcccggatttattccgatcctctggctctcaaagagtttaaggagttcgccgctgggcgcaaatctctgaccctgaatctcatcacagagatgggcagacttcccaccttcatgacgcaaaagacccgggacgccctggataacctggcggttctccacacagccgaagctggaggcagagcctacaatcatgctctgagcgagcttccggagaccctggaaacactcctgctgctcacccttctggccacagtgaccgggggaatttttctgttcctcatgtccggccgcgggatcggaaagatgacgctgggcatgtgctgcatcattacagcctctatccttctgtggtatgctcagattcagcctcactggatcgcggccagcattatcctcgagtttttcctgatcgtcctgctcattcccgaacccgagaaacagcggacccctcaagacaaccagcttacctacgtggtcatcgctattctgacagtggttgccgccaccatggctaatgaaatgggctttctggagaagaccaagaaggacctcgggctgggatccatcgccacgcagcagccggagagcaacattcttgatatcgacctgagacccgcgtctgcctggaccctctacgctgtggccacaaccttcgtgacacctatgctgcgccattccattgaaaatagctccgtcaacgtttctctgaccgctatcgccaatcaagcgacggtgctcatgggccttgggaaaggatggcccctgagcaagatggatatcggcgtgcctctgctcgccattgggtgttattcccaggtcaaccccatcaccctgacagctgcccttctgctcctggtggctcactacgccattatcggacctggcctgcaggctaaggccacccgggaggcgcagaaaagagccgctgccggcattatgaagaatccgacagttgacgggatcaccgtgatcgatctcgaccccattccttatgatcccaaatttgaaaagcaacttggacaggtcatgctgctgatcctctgcgtgacgcaggtcctgatgatgcggacaacctgggctctttgtgaggccctgacactcgccaccggccctatttctaccctgtgggaagggaaccccggacgcttctggaatacaacgatcgcggtgagcatggctaacatttttagaggctcctacctggccggggctggactccttttcagcatcatgaaaaataccacaaacacccggcgcggcacaggcaacatcggggagaccctgggagagaagtggaaatctagactgaatgccctcggcaagtccgaatttcaaatttataagaaaagcgggatccaggaggttgaccggacgctggccaaggaaggaattaaacgcggcgagacagatcaccatgctgtgtctagagggtccgccaaacttcggtggttcgtcgagcgcaacatggtgaccccggaaggaaaagttgtggacctgggctgcggcagagggggatggagctactattgtggcgggctcaagaatgtccgggaggtgaagggactgaccaaaggcgggcctggacacgaggaacccatccccatgtctacatacggctggaacctggtgagactccagagcggcgttgatgtctttttcattcctcccgaaaagtgcgacacccttctgtgtgatatcggggagtcctctcctaatccgacagtggaggcgggacgcacgctgcgggtgctcaacctggtcgaaaattggcttaacaataacacccagttctgcatcaaagttctgaatccctacatgcctagcgtgattgagaagatggaagccctccaaagaaaatatggcggggctctggtgcgcaaccccctgtcccggaatagcacacatgagatgtactgggtctccaacgcctctggaaatatcgtgagctccgttaacatgatttctagaatgctcatcaaccgctttaccatgcggcacaagaaggctacatatgaacctgacgtggaccttggcagcgggaccagaaatattggaatcgagtccgagattcccaacctggatatcatcggcaaacgcattgaaaagatcaaagaggaacatgagacgtcttggcactacgaccaggatcacccgtataagacctgggcctaccatggcagctatgaaacaaaacagaccgggtccgcgagctctatggtcaatggagtggttcggctgctcacaaagccttgggacgtgctgcccaccgtcacacagatggccatgaccgatacgacacctttcggccaacagagagtgtttaaggagaaagtggacacccgcacccaggagcccaaggaagggaccaagaaacttatgaaaattacggctgagtggctgtggaaggaactcggcaagaagaagacccctcggatgtgtacaagagaggagttcacccgcaaagtcagatccaacgccgctctgggcgccatctttacagatgaaaataagtggaaaagcgctcgggaggccgttgaagacaaccgcttctgggagctggtggataaggaaagaaatctccacctggaggggaaatgcgagacctgtgtgtacaacatgatgggaaagcgggaaaagaaacttggcgagtttggcaaggcgaaagggtctagagccatttggtacatgtggctgggagctcggttcctcgaatttgaggccctgggcttccttaatgaagaccattggttttcccgcgagaacagcctgtctggggtcgagggagaaggcctccacaagctggggtatatcctgagagatgtgtccaaaaaggagggcggagctatgtacgccgacgacacagccggctgggatacccggatcacgctcgaagacctgaagaatgaggaaatggttaccaaccacatggagggggagcataagaaacttgcggaagctattttcaaactgacatatcagaataaagtggtccgcgtgcaaagacccaccccgcggggaacagttatggatatcattagccgcagagaccagcggggctccggacaggtgggaacctacggcctcaacacgtttacaaatatggaggcccaactgatccgccagatggaaggggagggcgtcttcaaaaacattcagcaccttaccgtgacagaggaagccgctgttcagaactggctggccagagtgggacgggagcgcctcagcagaatggctatctctggcgatgactgcgtcgtgaagcctctggatgaccggttcgccaatgcgctgaccgccctcaacgatatggggaagatccgcaaagacattcaacagtgggaacccagcaagggatggaatgattggacgcaggtccccttttgctcccatcacttccatgagctggtgatgaaagacggcagagttcttgtggtcccttgtcggaaccaggatgaactgatcgggagagctcgcatttctcaaggagccggctggagcctccgggagaccgcttgcctggggaagtcctatgcccagatgtggtctcttatgtactttcacagacgcgacctgcggctcgcggccaatgctatctgtagcgccgtgccgtcccactgggtgcccacatctagaaccacatggagcattcatgctaaacacgagtggatgaccacagaagacatgctgaccgtttggaaccgcgtgtggatccgggagaatccttggatggaagataagacgcccgtcgagtcctgggaagagattccttatctgggcaagagagaggaccagtggtgcggaagcctcatcggcctgacatctcgcgccacctgggctaaaaacatccaggccgcgattaatcaagtgcggtcccttatcgggaacgaagagtacaccgattacatgcccagcatgaagagattccgccgggaagaggaagaggccggagttctgtggtga

SEQ ID NO: 19713 - RNA, 9876 nt, synthetic construct
  misc_feature 1..9876: note = derived and/or modified CDS sequence (opt5) from DENV-2__GQ868625__SS-prME
  source 1..9876: mol_type = other RNA
agcgccggcatgatcattatgctgatccccaccgtgatggctttccacctgacaacgagaaatggggagcctcatatgattgtcggaatccaggaaaagggcaagagcctgctttttaagaccgaggacggggttaatatgtgcacactgatggccatggatctcggagaactgtgtgaggacaccattacatacaagtgcccgcttctgcggcaaaacgaacccgaggatatcgactgttggtgcaattctaccagcacatgggtgacctatggcacgtgtaccacaaccggggagcaccgcagagaaaagcggtccgtggcgctcgtccctcatgtgggaatgggcctggagacacgcaccgaaacgtggatgtctagcgagggcgcttggaaacacgcccagagaatcgagacatggattctgcggcatcccgggttcaccatcatggccgctattctcgcctacacaatcggaaccacccactttcagcgcgttctgattttcatccttctgacagctgtggccccttccatgacgatgagatgcattggcatctctaaccgggattttgtcgaaggggtgagcggaggctcctgggttgacatcgtgctcgagcacgggagctgtgtcaccacaatggcgaagaataagcccaccctggatttcgaacttattaaaacagaggccaagcagcctgctaccctgcgcaaatattgcatcgaagccaagctcacgaacacaaccaccgagtctagatgtccgacacaaggagagccctccctgaaagaggaacaggacaagcggtttgtgtgcaagcatagcatggtggatcgcggctggggcaatgggtgtggactgttcggcaaagggggaattgtgacctgcgctatgtttacatgcaagaaaaacatggaaggcaagatcgttcagcctgagaatctcgaatacacgattgtggtgacaccccactctggggaggagcatgccgtcggaaacgacacaggcaaacacggcatggaaatcaaggtgacccctcagtccagcatcacagaggcggaactgaccgggtatggaacggttaccatggagtgttctcccagaacaggccttgatttcaatgaaatggtgctgctccaaatggagaacaaagcctggctggtccaccggcagtggtttcttgacctgccgctcccttggctgcccggggctgataagcaggagtccaattggattcagaaggaaaccctggtgacattcaaaaaccctcatgccaagaaacaagacgttgtggtcctcggaagccaggagggcgctatgcacaccgccctgacgggggccacagaaatccagatgtcctctggcaatcttctgtttaccggacatctcaagtgccgcctgagaatggacaaacttcaactgaagggcatgagctactccatgtgtacagggaagttcaaagtggtcaaggagattgctgagacccagcacggaaccatcgtgattcgggttcagtatgaaggcgatgggagcccctgcaaaatccccttcgagatcatggacctcgaaaagagatacgtgctgggacgcctgattacagtcaaccctatcgtgacggagaaagattctccggttaacattgaagcggagcccccttttggcgactcctacatcattatcggggtggagcccggccagctcaagctgaattggttcaagaaaggaagctctattggccggatgtttgaaaccacaatgagaggggccaagcgcatggctatccttggagataccgcctgggacttcggcagcctcgggggagtctttacatccatcggcaaagccctccatcaagtgttcggggctatttatggcgccgcgttttctggagtgagctggaccatgaagatcctgattggcgttatcattacgtggatcgggatgaactcccggagcacatctctgtccgtcagccttgtgctcgtgggaatcgtcaccctgtacctgggcgtgatggttcaggctgattctgggtgtgtggtctcctggaaaaataaggagctcaagtgcggaagcggcattttcatcaccgacaacgtgcacacatggaccgaacagtataaatttcagcctgagtccccctctaagctggccagcgccattcaaaaagctcaggaagaggggatctgtggcattagatccgttacacgccttgagaatctgatgtggaagcagatcacgccggaactcaaccacatcctggccgagaatgaagtgaaactgaccattatgacaggagatatcaagggcattatgcaggctgggaaacggtctcttagacctcaacccaccgagctcaagtacagctggaagacatggggaaaagccaagatgctgtccaccgaaagctataaccagacgttcctgatcgacggccctgagaccgcggagtgccccaatacaaaccgcgcctggaactctctcgaagtcgaggattacgggtttggagtgttcaccacaaacatttggctgaaacttaaggaaaaacaggacgctttttgtgactccaagctgatgagcgccgctatcaaggataatcgggccgttcatgcggacatgggctattggatcgagtctgccctcaacgatacctggaaaattgagaaggcttccttcatcgaagtgaaaaattgccactggcctaagagccatacactgtggtctaacggcgtcctggagagcgaaatgattatccccaaaaaccttgccgggccggtgtcccagcacaattacagacctggataccacacccaaattgctggcccctggcatctcgggaagctggagatggacttcgatttttgtgacggaacgacagtgatcgtcaccgaagattgcggcaaccgcgggcccagcctgcggaccacaaccgcctctggaaagctcattacggagtggtgctgtagatcctgcacactgcctccgcttcggtatcgcggcgaggacggctgttggtacgggatggaaatcagacccctgaaagagaaggaagagaatctcgttaacagcctggtgaccgccggacacggccaggtggataatttctccctgggggtccttggaatggctctctttctggaagagatgctgcggacaagagtgggcaccaaacatgcgatcctcctggttgccgtgtctttcgtcacacttattaccgggaacatgagctttaaggacctgggacgcgtggttgtgatggtcggcgctacgatggccgatgacatcggcatgggggtgacctatctcgccctgctggctgccttcaaagttcggcctacatttgcggctggacttctgctcagaaagctgacctccaaggagctcatgatgacaaccattggcatcgtgctgctttctcagagcacgattcccgaaacagtcctggagctcaccgatgccctggccctggggatgatggtgcttaaaatcgtgcgcaatatggaaaagtaccaactggctgtcacaatcatggccattctctgcgttcctaacgcggtgatcctgcagaatgcttggaaagtgtcctgtaccattctcgccgtcgtgtctgttagccccctgcttctgacctccagccagcagaagacagactggatccctctcgccctgacgattaaaggactgaaccccaccgctatcttccttacaaccctgtctagaacaaataagaaacggtcctggccgctcaacgaggccatcatggctgtgggcatggtcagcattctggcctcttccctcctgaagaatgacatccctatgaccgggccccttgtggcgggaggcctgctgacggtttgctatgtgctcacaggccgcagcgccgatctggaacttgagagagctaccgacgtcaagtgggaggatcaagccgaaatttctgggtccagccctatcctgtccattaccatcagcgaggacggatctatgagcattaaaaacgaagaggaggaacagacactcaccatcctgatccggacaggcctcctggtgatttccgggctttttcccatctctattccgatcacggctgccgcctggtacctgtgggaggtcaagaaacagcgcgctggagtgctgtgggatgttccttctccccctcccatgggcaaggcggaactcgaggacggggcctatagaattaaacagaagggaatcctgggctactcccaaatcggcgctggggtgtacaaggaaggaaccttccacacaatgtggcatgtcacccggggcgccgtgcttatgcacaaagggaagcgcattgagccctcctgggccgatgttaaaaaggacctgatcagctatggaggcgggtggaaactcgagggagaatggaaggagggcgaagaggtgcaggtcctggctctcgaacctggcaagaatccgagagccgtgcagacaaaacccgggctgtttaagaccaacacgggaaccattggcgcggtgtcccttgatttctctcctgggacaagcggatcccccatcattgacaaaaagggcaaagttgtcgggctgtacggaaacggcgtggtgacccggagcggcgcttatgtctctgccatcgcccagacagagaagtccatcgaggataatcctgaaattgaggacgatatctttcgcaagagacggctgaccattatggacctccaccccggggctggaaaaacaaagagatacctgcctgccatcgtgcgcgaagcgattaaacggggccttagaacgctgatcctcgctccgacccgcgttgtggccgccgagatggaagaggctctgcgggggctccccattagatatcaaacccctgccatccgcgctgagcataccggacgggaaatcgtcgacctgatgtgtcacgccaccttcacaatgagacttctgagccccgtgcgcgttcctaactacaatctgattatcatggatgaggcgcatttcacggaccccgcctctattgctgcccggggctatatctccaccagagtggaaatgggggaggctgccggcatttttatgacagccaccccgcctggaagccgggatcccttcccccagtccaacgctcctatcatcgacgaggaacgcgagattcccgaaagatcttggaatagcggccacgagtgggtcacagattttaaggggaaaaccgtgtggttcgttccttccatcaaggcgggaaacgacattgccgcttgcctccggaagaatggcaaaaaggtgatccagctgagccgcaaaacgtttgattctgaatacgtcaagacaagaaccaacgactgggatttcgtggtgaccacagacatttccgagatgggggccaattttaaagccgagcgggtcatcgatccgagacgctgtatgaagcccgttatccttaccgacggagaggaacgggtgattctggctggccctatgcccgtgacacatagctctgccgcgcaaagacgcgggcggatcggcagaaaccctaaaaatgaaaacgaccagtacatttatatgggagagcccctcgaaaatgatgaggactgcgctcactggaaggaggccaagatgctgctggataacatcaataccccggaaggcattatccctagcatgttcgagcccgaacgcgagaaagtcgacgccattgatggggaataccggctcagaggagaggctcgcaagacgtttgtggaccttatgagacggggcgatctgcctgtttggctggcctataaagtggcggccgaggggatcaactacgctgaccgcagatggtgtttcgatggaatcaagaacaatcagattctcgaagagaacgtcgaagtggagatctggacaaaagagggcgaacggaagaagctgaaaccccgctggcttgacgccagaatttattccgatcctctggctctcaaggagtttaaagagttcgccgctgggcggaagtctctgaccctgaatctcatcacagagatgggcagacttcccaccttcatgacgcagaaaacccgcgacgccctggataacctggcggttctccacacagccgaagctggaggccgggcctacaatcatgctctgagcgagcttccggagaccctggaaacactcctgctgctcacccttctggccacagtgaccgggggaatttttctgttcctcatgtccggcagagggatcggaaagatgacgctgggcatgtgctgcatcattacagcctctatccttctgtggtatgctcaaattcagcctcactggatcgcggccagcattatcctcgagtttttcctgatcgtcctgctcattcccgaacccgagaagcagcgcacccctcaggacaaccaacttacctacgtggtcatcgctattctgacagtggttgccgccaccatggctaatgaaatgggctttctggagaaaacaaagaaagacctcgggctgggatccatcgccacgcagcagccggagagcaacattcttgatatcgacctgcggcccgcgtctgcctggaccctctacgctgtggccacaaccttcgtgacacctatgctgagacattccattgaaaatagctccgtcaacgtttctctgaccgctatcgccaatcaggcgacggtgctcatgggccttgggaagggatggcccctgagcaaaatggatatcggcgtgcctctgctcgccattgggtgttattcccaagtcaaccccatcaccctgacagctgcccttctgctcctggtggctcactacgccattatcggacctggcctgcaggctaaggccacccgggaggcgcagaagcgcgccgctgccggcattatgaaaaatccgacagttgacgggatcaccgtgatcgatctcgaccccattccttatgatcccaagtttgaaaaacagcttggacaagtcatgctgctgatcctctgcgtgacgcaggtcctgatgatgagaacaacctgggctctttgtgaggccctgacactcgccaccggccctatttctaccctgtgggaagggaaccccggacggttctggaatacaacgatcgcggtgagcatggctaacatttttcgcggctcctacctggccggggctggactccttttcagcatcatgaagaataccacaaacaccagacggggcacaggcaacatcggggagaccctgggagagaaatggaagtctcgcctgaatgccctcggcaaatccgaatttcagatttataaaaagagcgggatccaagaggttgacagaacgctggccaaagaaggaattaagcggggcgagacagatcaccatgctgtgtctcgcgggtccgccaaacttagatggttcgtcgagcggaacatggtgaccccggaaggaaaggttgtggacctgggctgcggcagagggggatggagctactattgtggcgggctcaaaaatgtccgcgaggtgaagggactgaccaagggcgggcctggacacgaagaacccatccccatgtctacatacggctggaacctggtgcggctccagagcggcgttgatgtctttttcattcctcccgaaaaatgcgacacccttctgtgtgatatcggggagtcctctcctaatccgacagtggaggcgggaagaacgctgcgcgtgctcaacctggtcgaaaattggcttaacaataacacccagttctgcatcaaggttctgaatccctacatgcctagcgtgattgagaaaatggaagccctccagcggaagtatggcggggctctggtgagaaaccccctgtcccgcaatagcacacatgagatgtactgggtctccaacgcctctggaaatatcgtgagctccgttaacatgatttctcggatgctcatcaacagatttaccatgcgccacaaaaaggctacatatgaacctgacgtggaccttggcagcgggacccggaatattggaatcgagtccgagattcccaacctggatatcatcggcaagagaattgagaagatcaaggaggaacatgagacgtcttggcactacgaccaagatcacccgtataaaacctgggcctaccatggcagctatgaaacaaagcagaccgggtccgcgagctctatggtcaatggagtggttcgcctgctcacaaaaccttgggacgtgctgcccaccgtcacacagatggccatgaccgatacgacacctttcggccagcaacgggtgtttaaggagaaggtggacaccagaacccaggagcccaaagaagggacaaagaaacttatgaagattacggctgagtggctgtggaaagaactcggaaagaaaaagacccctcgcatgtgtacaagagaggagttcacccggaaggtccgctccaacgccgctctgggcgccatctttacagatgaaaataaatggaaaagcgctagagaggccgttgaagactctcggttctgggagctggtggataaagaaagaaacctccacctggaggggaagtgcgagacctgtgtgtacaatatgatgggaaaacgggaaaagaaacttggcgagtttggcaaagcgaaggggtcccgcgccatttggtacatgtggctgggagctagattcctcgaatttgaggccctgggcttccttaacgaagaccattggtttagccgggaaaattctctgtccggggtcgagggagaaggcctccacaaactggggtatatcctgcgcgatgtgagcaagaaagagggcggagctatgtacgccgacgacacagccggctgggataccagaatcacgctcgaagacctgaagaacgaggaaatggttaccaatcacatggagggggagcataagaaacttgcggaagctattttcaagctgacatatcagaacaaagtggtccgggtgcagcgccccaccccgagaggaacagttatggatatcatttcccggcgcgaccaaagaggcagcgggcaggtcggaacctacggcctcaatacgtttacaaacatggaggcccagctgatccggcaaatggaaggggagggcgtcttcaagaatattcagcaccttaccgtgacagaggaagccgctgttcagaactggctggcccgcgtgggaagagagcggctctctcgcatggctatcagcggcgatgactgcgtcgtgaaacctctggatgacagattcgccaacgcgctgaccgccctcaatgatatggggaagatccggaaggacattcagcaatgggaaccctccaaaggatggaacgattggacgcaggtccccttttgctctcatcacttccatgagctggtgatgaaggacggcagagttcttgtggtcccttgtcgcaatcaggatgaactgatcgggcgggctagaattagccagggagccggctggtccctccgcgagaccgcttgcctggggaaatcttatgcccaaatgtggagccttatgtactttcaccggagagacctgcgcctcgcggccaacgctatctgttccgccgtgccgtctcactgggtgcccacaagccggaccacatggtccattcatgctaagcacgagtggatgaccacagaagacatgctgaccgtttggaatagagtgtggatccgcgagaacccttggatggaagataaaacgcccgtcgagagctgggaagagattccttatctgggcaagcgggaggaccagtggtgcggatctctcatcggcctgacatccagagccacctgggctaagaatatccaggccgcgattaaccaggtgcgcagccttatcgggaatgaagagtacaccgattacatgccctctatgaaacggttcagacgggaagaggaagaggccggagttctgtggtga

SEQ ID NO: 19714 - RNA, 9876 nt, synthetic construct
  misc_feature 1..9876: note = derived and/or modified CDS sequence (opt5) from DENV-2__KF955401__SS-prME
  source 1..9876: mol_type = other RNA
agcgccggcatgatcattatgctgatccccaccgtgatggctttccacctgacaacgcggaatggggaacctcatatgattgtcggaatccaggaaaagggcaaatccctgctttttaagaccgaagacggggttaatatgtgcacactgatggccatggatcttggagaactgtgtgaggacaccattacatacaaatgcccgcttctgcggcaaaacgaacccgaggatatcgactgttggtgcaattctaccagcacatgggtgacctatggcacgtgtaccacaaccggggagcaccgcagagaaaagcggtccgtggcgctcgtccctcatgtgggaatgggcctggagacacgcaccgaaacgtggatgtctagcgagggcgcttggaaacacgcccagcggatcgagacatggattctgcggcatcccgggttcaccatcatggccgctattctcgcctacacaatcggaaccacccactttcagcgcgttctgattttcatccttctgacagctgtggccccttccatgacgatgagatgcattggcatctctaaccgggattttgtcgaaggggtgagcggaggctcctgggttgacatcgtgctcgagcacgggagctgtgtcaccacaatggcgaagaataagcccaccctggatttcgaacttattaaaacagaggccaagcagcctgctaccctgcgcaaatattgcatcgaagccaagctcacgaacacaaccaccgagtctagatgtccgacacaaggagagccctccctgaaagaagaacaagacaagcggtttgtgtgcaagcatagcatggtggatcgcggctggggcaatgggtgtggactgttcggcaaagggggaattgtgacctgcgctatgtttacatgcaagaaaaacatggaaggcaagatcgttcagcctgagaatctcgaatacacgattgtggtgacaccccactctggggaggagcatgccgtcggaaacgacacaggcaaacacggcatggaaatcaaggtgacccctcagtccagcatcacagaggcggaactgaccgggtatggaacggttaccatggagtgttctcccagaacaggccttgatttcaatgaaatggtgctgctccaaatggagaacaaagcctggctggtccaccggcagtggtttcttgacctgccgctcccttggctgcccggggctgataagcaggagtccaattggattcagaaggaaaccctggtgacattcaaaaaccctcatgccaagaaacaagacgttgtggtcctcggaagccaggagggcgctatgcacaccgccctgacgggggccacagaaatccagatgtcctctggcaatcttctgtttaccggacatctcaagtgccgcctgagaatggacaaacttcaactgaagggcatgagctactccatgtgtacagggaagttcaaagtggtcaaggagattgctgagacccagcacggaaccatcgtgattcgggttcagtatgaaggcgatgggagcccctgcaaaatccccttcgagatcatggacctcgaaaagagatacgtgctgggacgcctgattacagtcaaccctatcgtgacggagaaagattctccggttaacattgaagcggagcccccttttggcgactcctacatcattatcggggtggagcccggccagctcaagctgaattggttcaagaaaggaagctctattggccaaatgtttgaaaccacaatgagaggggctaagagaatggctatccttggagataccgcctgggacttcggcagcctcgggggagtctttacatccatcggcaaagccctccatcaggtgttcggggctatttatggcgtggccttttctggagttagctggaccatgaagatcctgattggcgtcatcattacgtggatcgggatgaactcccgcagcacatctctgtccgtgagccttgtgctcgtcggaatcgtgaccctgtacctgggcgttatggtgcaggcggattctgggtgtgtcgtgtcctggaaaaataaggagctcaagtgcggaagcggcattttcatcaccgacaacgttcacacatggaccgaacagtataaatttcaacctgagtccccctctaagctggctagcgccattcagaaagcccaggaagaggggatctgtggcattcggtccgtgacaagacttgagaatctgatgtggaagcagatcacgccggaactcaaccacatcctggctgagaatgaagtcaaactgaccattatgacaggagatatcaagggcattatgcaagccgggaaacgctctcttcggcctcagcccaccgagctcaagtacagctggaagacatggggaaaagctaagatgctgttcaccgaatcctataaccagacgtttctgatcgacggccctgagaccgccgagtgccccaatacaaacagagcgtggaatagcctcgaagtggaggattacgggttcggagtttttaccacaaacatttggctgaaacttaaggaaaaacaggacgccttctgtgactctaagctgatgtccgctgccatcaaggataatcgcgctgtgcatgccgacatgggctattggatcgagagcgcgctcaacgatacctggaaaattgagaaggcctctttcatcgaagtcaaaaattgccactggcctaagtcccatacactgtggagcaacggcgtgctggagtctgaaatgattatccccaaaaaccttgctgggccggtgagccaacacaattaccggcctggataccacacccagattgccggcccctggcatctcgggaagctggagatggactttgatttctgtgacggaacgacagtcatcgttaccgaagattgcggcaacagagggccctccctgcgcaccacaaccgctagcggaaagctcattacggagtggtgctgtcggtcttgcacactgcctccgcttagatatcggggcgaggacggctgttggtacgggatggaaatccgccccctgaaagagaaggaagagaatctcgtgaactccctggtgaccgccggacacggccaggtcgataattttagcctgggggtgcttggaatggccctcttcctggaagagatgctgagaacacgggttggcaccaaacatgctatcctcctggtggcggtctcctttgtgacacttattaccgggaacatgtctttcaaggacctgggaagagttgtggtcatggtgggcgccacgatggctgatgacatcggcatgggggttacctatctcgccctgctggccgcttttaaagtgcgccctacattcgccgcgggacttctgctccggaagctgaccagcaaggagctcatgatgacaaccattggcatcgtcctgctttcccaatctacgattcccgaaacagtgctggagctcaccgatgctctggccctggggatgatggtgcttaaaatcgtcagaaatatggaaaagtaccagctggccgttacaatcatggctattctctgcgtgcctaacgccgtgatcctgcagaatgcgtggaaagtcagctgtaccattctcgctgtggtttccgtgtctcccctgcttctgaccagctcccagcaaaagacagactggatccctctcgccctgacgattaaaggactgaaccccaccgccatctttcttacaaccctgagccgcacaaataagaaaagatcttggccgctcaacgaggctatcatggccgtcggcatggtgtccattctggctagctctctcctgaagaatgacatccctatgaccgggccccttgttgccggaggcctgctgacggtgtgctatgtcctcacaggccggtccgcggatctggaacttgagcgcgccaccgacgtgaagtgggaggatcaggctgaaattagcgggtcttcccctatcctgagcattaccatctccgaggacggaagcatgtctattaaaaacgaagaggaggaacagacactcaccatcctgatcagaacaggcctcctggtcattagcgggcttttccccatctccattccgatcacggccgctgcctggtacctgtgggaggtgaagaaacagcgggccggagttctgtgggatgtgccttctccccctcccatgggcaaggctgaactcgaggacggggcgtatcgcattaaacaaaagggaatcctgggctacagccagatcggcgccggggtctacaaggaaggaacctttcacacaatgtggcatgtgaccagaggcgctgttcttatgcacaaagggaagcggattgagccctcctgggccgatgtgaaaaaggacctgatctcttatggaggcgggtggaaactcgagggagaatggaaggagggcgaagaggtccaggtgctggccctcgaacctggcaagaatccgcgcgctgtgcagacaaaacccgggctgttcaagaccaacacgggaaccattggcgccgttagccttgatttttcccctgggacatctggaagccccatcattgacaaaaagggcaaagtcgtggggctgtacggaaacggcgtggtcaccagatccggcgcgtatgtgagcgctatcgcccaaacagagaagtctatcgaggataatcctgaaattgaggacgatatcttccggaagcgcagactgaccattatggacctccaccccggggccggaaaaacaaagcggtacctgcctgctatcgttagagaagccattaaacgcggccttcggacgctgatcctcgcgccgaccagagtggtcgctgccgagatggaagaggccctgcgcgggctccccattcggtatcagacccctgctatcagagccgagcataccggacgcgaaatcgtggacctgatgtgtcacgctaccttcacaatgcggcttctgtcccccgttagagtgcctaactacaatctgattatcatggatgaggcccattttacggaccccgcgagcattgccgctcgcggctatatctctacccgggtcgaaatgggggaggccgctggcattttcatgacagccaccccgcctggatccagagatccctttccccagagcaacgcccctatcatcgacgaggaacgggagattcccgaacgctcctggaactctggccacgagtgggtgacagatttcaaggggaaaaccgtttggtttgtgcctagcatcaaggctggaaacgacattgcggcctgcctcagaaagaatggcaaaaaggtcatccaactgtcccggaaaacgttcgatagcgaatacgtgaagacacgcaccaacgactgggattttgtggtcaccacagacatttctgagatgggggctaatttcaaagccgagagagttatcgatccgcggagatgtatgaagcccgtgatccttaccgacggagaggaacgcgtgattctggccggccctatgcccgtcacacattccagcgctgcccagcggagagggcgcatcggccggaaccctaaaaatgaaaacgaccagtacatttatatgggagagcccctcgaaaatgatgaggactgcgcgcactggaaggaggctaagatgctgctggataacatcaataccccggaaggcattatcccttctatgtttgagcccgaaagagagaaagtggacgccattgatggggaataccgcctccggggagaggccagaaagacgttcgttgaccttatgcgcagaggcgatctgcctgtgtggctggcttataaagtcgccgcggaggggatcaactacgccgaccggcgctggtgttttgatggaatcaagaacaatcagattctcgaagagaacgtggaagttgagatctggacaaaagagggcgaaagaaagaagctgaaaccccggtggcttgacgctcgcatttatagcgatcctctggccctcaaggagttcaaagagttcgctgccgggagaaagtccctgaccctgaatctcatcacagagatgggccggcttcccacctttatgacgcagaagaccagagacgctctggataacctggccgtgctccacacagcggaagccggaggccgcgcttacaatcatgccctgtctgagcttccggagaccctggaaacactcctgctgctcacccttctggctacagtcaccgggggaattttcctgtttctcatgagcggccgggggatcggaaagatgacgctgggcatgtgctgcatcattacagcctccatccttctgtggtatgcccagattcagcctcactggatcgctgcgtctattatcctcgagttctttctgatcgtgctgctcattcccgaacccgagaagcagagaacccctcaagacaaccagcttacctacgtcgtgatcgccattctgacagttgtggctgccaccatggccaatgaaatgggcttcctggagaaaacaaagaaagacctcgggctgggaagcatcgctacgcagcagccggagtccaacattcttgatatcgacctgcgccccgccagcgcgtggaccctctacgccgtggctacaacctttgtcacacctatgctgcggcattctattgaaaattccagcgttaacgtgtccctgaccgccatcgctaatcaagccacggtgctcatgggccttgggaagggatggcccctgtctaaaatggatatcggcgtccctctgctcgcgattgggtgttatagccaggtgaaccccatcaccctgacagccgcccttctgctcctggttgcccactacgctattatcggacctggcctgcaggccaaggctaccagagaggcccagaagcgggcggccgctggcattatgaaaaatccgacagtggacgggatcaccgtcatcgatctcgaccccattccttatgatcccaagttcgaaaaacaacttggacaggtgatgctgctgatcctctgcgtcacgcaggtcctgatgatgcgcacaacctgggccctttgtgaggctctgacactcgccaccggccctatttccaccctgtgggaagggaaccccggaagattttggaatacaacgatcgccgtttctatggcgaacattttccggggcagctacctggctggggccggactcctcttttccatcatgaagaataccacaaacacccgcagaggcacaggcaacatcggggagaccctgggagagaaatggaaaagccggctgaatgctctcggcaaatctgagttccaaatttataagaagtccgggatccaggaggtggaccgcacgctggccaaagaaggaattaagagaggcgagacagatcaccatgccgtcagccgggggtctgctaaacttcgctggtttgtggagagaaacatggttaccccggaaggaaaggtggtcgacctgggctgcggcagagggggatggtcctactattgtggcgggctcaaaaatgtgagagaggtgaagggactgaccaagggcgggcctggacacgaagaacccatccccatgagcacatacggctggaacctggttcgcctccagtctggcgtcgatgtgttcttcattcctcccgaaaaatgcgacacccttctgtgtgatatcggggagagctcccctaatccgacagtggaggccggacggacgctgagagtcctcaacctggttgaaaattggcttaacaataacacccagttttgcatcaaggtgctgaatccctacatgccttctgtgattgagaaaatggaagcgctccaacgcaagtatggcggggccctggtccggaaccccctgagcagaaattccacacatgagatgtactgggtgagcaacgcttccggaaatatcgtttctagcgtgaacatgatttcccgcatgctcatcaaccggttcaccatgagacacaaaaaggccacatatgaacctgacgtcgaccttggctctgggacccgcaatattggaatcgagagcgagacgcccaacctggatattatcggcaagcggatcgagaagattaaggaggaacatgagacctcctggcactacgaccaggatcacccgtataaaacatgggcttaccatggctcttatgaaaccaagcagacagggagcgcctccagcatggtgaatggagttgtgagactgctcaccaaaccttgggacgtcctgcccacagtgacccagatggcgatgacggatacaaccccttttggccaacagcgcgtgttcaaggagaaggtcgacacccggacacaggagcccaaagaagggacgaagaaacttatgaagatcaccgccgagtggctgtggaaagaactcggaaagaaaaagacacctagaatgtgtacccgcgaggagtttacaagaaaggttcggtctaacgctgccctgggcgctattttcaccgatgaaaataaatggaagtccgcccgcgaggctgtggaagacagcagattttgggagctggtggataaagaacggaacctccacctggaggggaagtgcgagacatgtgtctacaatatgatgggaaaaagagaaaagaaacttggcgagttcggcaaagccaaggggtctcgggcgatctggtacatgtggctgggagcccgctttctcgagttcgaggctctgggctttcttaacgaagaccattggttctccagagagaatagcctgtctggggtggagggagaaggcctccacaaactggggtatattctgcgggatgtttccaagaaagagggcggagccatgtacgctgacgacaccgccggctgggatacgcgcatcaccctcgaagacctgaagaacgaggaaatggtgacaaatcacatggagggggagcataagaaacttgccgaagcgatctttaagctgacctatcagaacaaagtcgtgagagttcaacggcccacaccgcgcggaaccgtgatggatattatcagcagacgggaccagcgcggctccgggcaggtcggaacgtacggcctcaatacattcaccaacatggaggctcaactgattagacagatggaaggggagggcgtgttcaagaatatccagcaccttacagttaccgaggaagccgccgtgcagaactggctggctcgggtcggacgcgagagactcagccggatggccatttctggcgatgactgcgtggtcaaacctctggatgaccgctttgctaacgccctgacggcgctcaatgatatggggaagatcagaaaggacatccaacagtgggaacccagcaaaggatggaacgattggacccaggtgcccttctgctcccatcactttcatgagctgattatgaaggacggccgggttcttgtggtcccttgtagaaatcaggatgaactgatcgggcgcgcccggatttctcaaggagctggctggagcctcagagagacagcctgcctggggaaatcctatgctcagatgtggtctcttatgtacttccaccgccgggacctgagactcgccgcgaacgccatctgtagcgctgtgccgtcccactgggtgcccacctctcgcacaacctggagcattcatgccaagcacgagtggatgacaaccgaagacatgctgacggtttggaatcgggtgtggatcagagagaacccttggatggaagataaaacacccgtcgagtcctgggaagagattccttatctgggcaagcgcgaggaccagtggtgcggaagcctcatcggcctgacctctcgggctacctgggccaagaatatccaggctgccattaaccaagtgagatcccttatcgggaatgaagagtacacagattacatgcccagcatgaaacgctttcggagagaagaggaagaggcgggagttctgtggtga

SEQ ID NO: 19715 - RNA, 9876 nt, synthetic construct
  misc_feature 1..9876: note = derived and/or modified CDS sequence (opt5) from DENV-2__JF730047__SS-prME
  source 1..9876: mol_type = other RNA
tccgctggaatgatcattatgctgatccccacagtgatggctttccacctcacaacgagaaacggggagcctcatatgattgtcgggatccaggaaaagggcaagtccctgctttttaagaccgaggacggggttaatatgtgcacactgatggccatggatctcggagaactgtgtgaggacaccattacatacaagtgcccgcttctgcggcaaaacgaacccgaggatatcgactgttggtgcaattctaccagcacatgggtgacctatggcacgtgtaccacaaccggggagcacagaagagaaaagcggtccgtggcgctcgttcctcatgtgggaatgggcctggagacacgcaccgaaacgtggatgtcttccgagggcgcttggaaacacgcccagagaatcgagacatggattctgcggcatcccgggttcaccatcatggccgctattctcgcctacacaatcggaaccacccactttcagcgcgctctgattttcatccttctgacagccgttgcgccttccatgacgatgagatgcattggcatctctaaccgggattttgtggaaggggtcagcggaggctcctgggtggacatcgttctcgagcacgggagctgtgtgaccacaatggccaagaataagcccaccctggatttcgaacttattaaaacagaggctaagcagcctgccaccctgcgcaaatattgcatcgaagctaagctcacgaacacaaccaccgagtctagatgtccgacacaaggagagccctccctgaaagaggaacaagacaagcggtttgtctgcaagcatagcatggtggatcgcggctggggcaatgggtgtggactgttcggcaaagggggaattgtgacctgcgccatgtttacatgcaagaaaaacatggaaggcaagatcgtccagcctgagaatctcgaatacacgattgttgtgacaccccactctggggaggagcatgcggtgggaaacgacacaggcaaacacggcaaggaaatcaaagtcacccctcagtccagcatcacagaggccgaactgaccgggtatggaacggtgaccatggagtgttctcccagaacaggccttgatttcaatgaaatggttctgctccaaatggagtccaaggcttggctggtgcaccggcagtggtttcttgacctgccgctcccttggctgcccggggccgataagcagggaagcaactggattcagaaagagaccctggtcacattcaagaatcctcatgctaaaaagcaagacgtggttgtgctcggctcccaggaaggggccatgcacaccgccctgacgggcgctacagagatccagatgtctagcggaaaccttctgtttaccggccatctcaaatgccgcctgagaatggacaaacttcaactgaaggggatgtcctacagcatgtgtacaggaaaattcaaggtcgtgaaagaaattgcggagacccagcacggcaccatcgtcattcgggtgcagtatgagggggatggatctccctgcaagatccccttcgaaatcatggacctcgagaaaagatacgttctgggccgcctgattacagtgaatcctatcgtcacggaaaaggattccccggtgaacattgaggccgaacccccttttggggacagctacatcattatcggcgttgagcccggacagctcaagctgaactggttcaaaaagggctctagcattgggcaaatgtttgagaccacaatgcggggagctaaaagaatggccatccttggcgataccgcctgggacttcgggtccctgggaggcgtgtttacatctatcgggaaggctctccatcaggtcttcggcgccatttatggagcggcttttagcggcgtgtcctggaccatgaaaatcctgattggggtgatcattacgtggatcggaatgaatagccgctctacatccctgagcgtttctcttgtcctcgtgggcatcgtgaccctgtacctgggggtcatggtgcaggccgattccggatgtgttgtgagctggaagaacaaggaactcaaatgcggctccgggattttcatcaccgacaatgtccacacatggaccgagcagtataagtttcaacctgaatctcccagcaaactggcctccgctattcagaaggcccaggaggaaggcatctgtggcattcggtctgtgacaagacttgagaacctgatgtggaaacagatcacgccggagctcaatcacatcctggctgaaaacgaggttaagctgaccattatgacaggcgatatcaaagggattatgcaagccggaaagcgcagccttcggcctcagcccaccgaactcaagtactcctggaaaacatggggcaaggcgaaaatgctgagcaccgagtctcataatcagacgttcctgatcgacgggcctgaaaccgccgagtgccccaacacaaatagagcttggaactccctcgaggtggaagattatggatttggcgtcttcaccacaaatatttggctgaaacttaaagagaagcaggacgccttttgtgacagcaagctgatgtctgctgccatcaaagataaccgcgcggtgcacgccgacatgggctactggatcgaatccgctctcaatgatacctggaagattgagaaagccagcttcatcgaggttaagaactgccattggcctaaatctcacacactgtggagcaatggggtgctggaatccgagatgattatccccaagaaccttgctggaccggtcagccaacacaactatcggcctggctaccatacccagacggccgggccctggcacctcggaaagctggaaatggacttcgatttttgtgacggcacaaccgtgattgtgaccgaggattgcgggaatagaggaccctctctgcgcacaaccacggcctccggcaaactcatcacagaatggtgctgtcggagctgcaccctgcctccgcttagataccggggcgaggacgggtgttggtatggaatggagattcgccccctgaaggaaaaagaggaaaacctcgtcaattccctggttacagctggccatggacaggtggataacttctctctgggagtgcttggcatggcgctctttctggaggaaatgctgagaacccgggtcgggacaaagcacgccatcctcctggtggctgttagcttcgtgacccttatcacgggaaatatgtcctttaaagacctgggcagagtcgtggttatggtgggcaccacaatgaccgatgacattgggatgggagtcacatacctcgccctgctggccgctttcaaggtgcgccctacctttgccgcgggccttctgctccggaagctgacgtctaaagagctcatgatgacaaccatcgggattgttctgcttagccaatccacaatccccgagaccattctggaactcaccgatgctctggccctgggaatgatggtgcttaagatcgtcagagacatggagaaatatcagctggccgtgacaatcatggctattctctgcgtgcctaacgccgtcatcctgcagaatgcgtggaaggtttcttgtacgattctcgctgtggtgagcgtcagccccctgcttctgaccagctctcagcagaagacagactggatccctctcgccctgaccattaagggcctgaaccccacagccatcttccttaccacgctgtcccgcacaaataaaaagagaagctggccgctcaacgaagctatcatggccgtggggatggtttctattctggcttccagcctcctgaagaatgatatccctatgaccggaccccttgtggccggcggcctgctgaccgtctgctacgtgctcacagggcggtctgcggacctggagcttgaacgcgccaccgatgttaaatgggaggaccaggctgagatttccggaagctcccctatcctgagcattacaatctctgaagatggcagcatgtccattaagaacgaggaagaggagcagacgctcaccatcctgatcagaacagggctcctggtgatttctggactttttcccgtcagcatcccgattaccgccgctgcctggtatctgtgggaagtgaaaaagcagcgggccggcgtcctgtgggacgtgccttctccccctcccatggggaaagctgagctcgaagatggagcgtaccgcatcaagcaaaagggcattctgggctatagccagatcggggccggagtttacaaagagggcacattccataccatgtggcacgtgacgagaggggctgtccttatgcacaagggaaaacggatcgaacccagctgggccgacgtgaagaaagatctgatttcctacggcgggggatggaagctcgagggcgagtggaaggaaggcgaggaagttcaggtgctggccctcgagcctgggaaaaatccgcgcgctgtccagaccaagcccggactgtttaaaacaaacaccggcacaatcggggccgtgtctcttgacttcagccctggaacctccggcagccccattatcgataagaaagggaaggtggttggactgtatggcaatggcgtcgtgacaagatctggggcgtacgtgtccgctattgcccaaacggaaaagagcatcgaggacaaccctgagatcgaagatgacatttttcggaaacgcagactgaccatcatggacctccatcccggagccggcaagacaaaacggtatctgcctgctattgtcagagaggccatcaagcgcgggcttcggaccctgattctcgcgccgaccagagtggttgctgccgaaatggaggaagccctgcgcggactccccatccggtaccagacccctgctattagagccgagcacacgggccgcgagatcgtggatctgatgtgtcatgctaccttcacaatgcggcttctgtctcccgtcagagtgcctaactataatctgatcattatggacgaagcccacttcaccgatcccgcgtccatcgccgctcgcgggtacattagcacacgggttgagatgggcgaagccgctggaatctttatgaccgccacgccgcctggctccagagaccccttcccccagtctaacgcccctattatcgatgaggagcgggaaatccccgagcgcagctggaatacagggcatgaatgggtgaccgactttaaaggaaagaccgtctggttcgtgccttccattaaggctggcaacgatatcgcggcctgcctccgcaagaatgggaagaaagttattcaactgagccggaagacatttgactctgagtatgtgaaaacccgcacaaacgattgggacttcgtcgtgaccacggatatctccgaaatgggagctaattttaaggccgagagagtgattgacccgcggagatgtatgaaacccgtcatccttacagacggcgaggaacgcgttatcctggccgggcctatgcccgtgacccacagctctgctgcccagcggagaggccgcattggacggaaccctaagaatgagaacgatcagtacatctacatgggcgaacccctcgagaatgacgaagattgcgcgcactggaaggaggctaaaatgctgctggacaacattaatacaccggaggggatcattcctagcatgttcgaacccgagagagaaaaggtggatgccatcgacggagagtatcgcctccggggcgaagccagaaaaacctttgtcgatcttatgcgcagaggggacctgcctgtgtggctggcttacaaggttgccgcggagggaattaactatgccgatcggcgctggtgtttcgacggcatcaaaaataaccagatcctcgaggaaaacgtggaggtcgaaatttggacgaaggagggggagagaaagaaactgaagccccggtggcttgatgctcgcatctactccgaccctctggccctcaaagaatttaaggagttcgctgccggcagaaaatctctgaccctgaatctcattacagaaatgggacggcttcccaccttcatgacacaaaagaccagagatgctctggacaacctggccgtgctccatacagcggaggccggcgggcgcgcttataatcacgccctgagcgaacttccggagaccctggagacgctcctgctgctcacacttctggctaccgttaccggaggcatctttctgttcctcatgtccgggcggggaattggcaagatgacactgggcatgtgctgcatcatcaccgcctctattcttctgtggtacgcccagatccagcctcattggattgctgcgagcatcattctcgaatttttcctgatcgtgctgctcatccccgagcccgaaaaacagagaacacctcaagacaaccagcttacgtatgtcgtgattgccatcctgaccgtcgtggctgccacaatggccaatgagatggggtttctggaaaagaccaaaaaggatctcggactgggctccattgctacacagcagccggagagcaacatccttgacattgatctgcgccccgcctctgcgtggaccctctacgccgttgctacgaccttcgtgacacctatgctgcggcactccatcgagaatagctccgtgaacgtctctctgaccgccattgctaatcaagccacagttctcatggggcttggaaaaggctggcccctgagcaagatggacatcggggtgcctctgctcgcgatcggatgttactcccaggtgaaccccattaccctgacggccgcccttctgctcctggtcgcccactatgctatcattggccctggcctgcaggccaaggctacaagagaagcccagaaacgggcggccgctgggatcatgaagaatccgaccgtggatggaattacagttatcgacctcgatcccatcccttacgaccccaaatttgagaagcaacttggccaggtgatgctgctgattctctgcgtcacccaggtgctgatgatgcgcaccacatgggccctttgtgaagctctgacgctcgccaccgggcctatctctacactgtgggagggaaaccccggcagattctggaataccacaattgccgtcagcatggcgaacatctttcgggggtcctatctggctggagccggcctccttttcagcattatgaaaaataccacgaacacacgcagaggcaccgggaatatcggagaaaccctgggcgagaagtggaaatctcggctgaacgctctcgggaagtccgagtttcaaacatacaagaaaagcggaatccaggaagtggatcgcaccctggccaaggagggcattaaaagaggggaaacagaccatcacgccgtttctcggggatccgctaaacttcgctggttcgtggagagaaacatggtcacgccggagggcaaagtggttgatctgggctgcgggcggggaggctggagctattactgtgggggactcaagaatgtgagagaagtcaagggcctgaccaaagggggacctggccatgaggaacccatccccatgtctacatatggctggaacctggtgcgcctccagagcggggtggacgtctttttcattcctcccgagaagtgcgatacccttctgtgtgacatcggagaatcctctcctaatccgacagtcgaggccggccggaccctgagagtgctcaacctggtggagaattggcttaacaataacacgcagttctgcattaaagtcctgaatccctacatgcctagcgttatcgaaaagatggaggcgctccaacgcaaatacgggggagccctggtgcggaaccccctgtccagaaatagcacccacgaaatgtattgggtgtccaacgcttctggcaatatcgtcagctccgtgaacatgatttctcgcatgctcatcaatcggtttacaatgagacataagaaggccacctacgagcctgacgttgatcttgggagcggaacacgcaacattggcatcgaatccgagattcccaacctggacatcattggcaaacggatcgagaagatcaaacaggaacacgagacctcttggcactatgatcaggaccatccgtacaagacatgggcttatcacgggagctacgaaaccaaacagacgggatccgccagctctatggtgaatggcgtcgtgagactgctcacaaagccttgggatgttctgcccaccgtgacccaaatggcgatgacagacacgacccctttcgggcagcagcgcgtctttaaggagaaagtggatacacggacccaggaacccaaggagggaaccaagaaacttatgaaaattaccgccgagtggctgtggaaggaactcggcaaaaagaagacacctagaatgtgtacccgcgaggagttcatcagaaaagtgcggtccaacgctgccctgggggctatttttacggacgagaataagtggaaaagcgcccgcgaggctgtcgaagattctagattctgggagctggttgacaaggaacggaacctccatctggagggaaaatgcgaaacctgtgtgtataatatgatgggcaagagagagaagaaacttggcgagtttgggaaggccaaaggatcccgggcgatctggtacatgtggctgggcgcccgcttcctcgaatttgaggctctggggttccttaacgaagatcactggtttagcagagaaaattctctgtccggagtggaaggcgaggggctccacaagctgggctacattctgcgggacgtcagcaaaaaggagggaggcgccatgtatgctgacgatacagccgggtgggacacccgcatcacactcgaagatctgaagaacgaggaaatggtgaccaatcatatggagggagaacacaagaaacttgccgaggcgatcttcaaactgacgtaccaaaacaaagttgtgagagtccagcggcccacaccgcgcggcaccgtgatggacattatctccagacgggatcagcgcgggagcggacaagttggcacatatgggctcaatacctttacgaacatggaggctcagctgattagacagatggaaggcgagggagtgttcaaaaatatccagcatcttaccgccacagaagaggtcgccgtgaagaactggctggctcgggttggccgcgagagactctctcggatggccattagcggggacgattgcgtggtcaagcctctggacgatcgcttcgctaatgccctgaccgcgctcaacgacatgggaaaaatcagaaaggatatccaacagtgggaaccctccaaaggctggaacgactggacacaggtgcccttttgctctcaccatttccacgagctgattatgaaggatgggcgggtccttgtggttccttgtagaaatcaggacgaactgatcggacgcgcccggattagccaaggcgctgggtggtccctcagagagaccgcctgcctgggcaaatcttacgctcagatgtggagccttatgtattttcaccgccgggacctgagactcgccgcgaacgccatctgttccgctgtgccgtctcattgggtccccacaagccgcaccacgtggtccattcacgccaagcatgaatggatgacaaccgaggatatgctgaccgtgtggaatcgggtgtggatcagagagaacccttggatggaagacaagacacccgttgagagctgggaagagattccttacctgggaaaacgcgaagatcagtggtgcggctctctcatcgggctgacctcccgggctacatgggccaagaatatccaggctgccattaaccaagtgagaagccttatcggaaatgaggagtatacggactacatgccctctatgaaacgcttccggagagaagaggaagaggcgggcgtcctgtggtga

SEQ ID NO: 19716 - RNA, 9876 nt, synthetic construct
  misc_feature 1..9876: note = derived and/or modified CDS sequence (opt5) from DENV-2__JF730048__SS-prME
  source 1..9876: mol_type = other RNA
agcgctggaatgatcattatgctgatccccaccgtgatggctttccacctcacaacgagaaacggggagcctcatatgattgtcgggatccaggagaagggcaagtccctgctttttaagaccgaggacggggttaatatgtgcacactgatggccatggatctcggagaactgtgtgaggacaccattacatacaagtgcccgcttctgcggcaaaacgaacccgaggatatcgactgttggtgcaattctacctccacatgggtgacctatggcacgtgtaccacaaccggggagcaccgcagagaaaagcggtccgtggcgctcgttcctcatgtgggaatgggcctggagacacgcaccgaaacgtggatgtctagcgagggcgcttggaaacacgcccagagaatcgagacatggattctgcggcatcccgggttcaccatcatggccgctattctcgcctacacaatcggaaccacccactttcagcgcgctctgattttcatccttctgacagccgttgcgccttccatgacgatgagatgcattggcatctctaaccgggattttgtggaaggggtcagcggaggctcctgggtggacatcgttctcgagcacgggagctgtgtgaccacaatggccaagaataagcccaccctggatttcgaacttattaaaacagaggctaagcagcctgccaccctgcgcaaatattgcatcgaagctaagctcacgaacacaaccaccgagtctagatgtccgacacaaggagagccctccctgaaagaggaacaagacaagcggtttgtctgcaagcatagcatggtggatcgcggctggggcaatgggtgtggactgttcggcaaagggggaattgtgacctgcgccatgtttacatgcaagaaaaacatggaaggcaagatcgtccagcctgagaatctcgaatacacgattgttgtgacaccccactctggggaggagcatgcggtgggaaacgacacaggcaaacacggcaaggaaatcaaagtcacccctcagtccagcatcacagaggccgaactgaccgggtatggaacggtgaccatggagtgttctcccagaacaggccttgatttcaatgaaatggttctgctccaaatggagtccaaggcttggctggtgcaccggcagtggtttcttgacctgccgctcccttggctgcccggggccgataagcagggaagcaactggattcagaaagagaccctggtcacattcaagaatcctcatgctaaaaagcaagacgtggttgtgctcggctcccaggaaggggccatgcacaccgccctgacgggcgctacagagatccagatgtctagcggaaaccttctgtttaccggccatctcaaatgccgcctgagaatggacaaacttcaactgaaggggatgtcctacagcatgtgtacaggaaaattcaaggtcgtgaaagaaattgcggagacccagcacggcaccatcgtcattcgggtgcagtatgagggggatggatctccctgcaagatccccttcgaaatcatggacctcgagaaaagatacgttctgggccgcctgattacagtgaatcctatcgtcacggaaaaggattccccggtgaacattgaggccgaacccccttttggggacagctacatcattatcggcgttgagcccggacagctcaagctgaactggttcaaaaagggctctagcattgggcaaatgtttgagaccacaatgcggggagctaaaagaatggccatccttggcgataccgcctgggacttcgggtccctgggaggcgtgtttacatctatcgggaaggctctccatcaggtcttcggcgccatttatggagcggcttttagcggcgtgtcctggaccatgaaaatcctgattggggtgatcattacgtggatcggaatgaatagccgctctacatccctgagcgtttctcttgtcctcgtgggcatcgtgaccctgtacctgggggtcatggtgcaggccgattccggatgtgttgtgagctggaagaacaaggaactcaaatgcggctccgggattttcatcaccgacaatgtccacacatggaccgagcagtataagtttcaacctgaatctcccagcaaactggcctccgctattcagaaggcccaggaggaaggcatctgtggcattcggtctgtgacaagacttgagaacctgatgtggaaacagatcacgccggagctcaatcacatcctggctgaaaacgaggttaagctgaccattatgacaggcgatatcaaagggattatgcaagccggaaagcgcagccttcggcctcagcccaccgaactcaagtactcctggaaaacatggggcaaggcgaaaatgctgagcaccgagtctcataatcagacgttcctgatcgacgggcctgaaaccgccgagtgccccaacacaaatagagcttggaactccctcgaggtggaagattatggatttggcgtcttcaccacaaatatttggctgaaacttaaagagaagcaggacgccttttgtgacagcaagctgatgtctgctgccatcaaagataaccgcgcggtgcacgccgacatgggctactggatcgaatccgctctcaatgatacctggaagattgagaaagccagcttcatcgaggttaagaactgccattggcctaaatctcacacactgtggagcaatggggtgctggaatccgagatgattatccccaagaaccttgctggaccggtcagccaacacaactatcggcctggctaccatacccagacggccgggccctggcacctcggaaagctggaaatggacttcgatttttgtgacggcacaaccgtgattgtgaccgaggattgcgggaatagaggaccctctctgcgcacaaccacggcctccggcaaactcatcacagaatggtgctgtcggagctgcaccctgcctccgcttagataccggggcgaggacgggtgttggtatggaatggagattcgccccctgaaggaaaaagaggaaaacctcgtcaattccctggttacagctggccatggacaggtggataacttctctctgggagtgcttggcatggcgctctttctggaggaaatgctgagaacccgggtcgggacaaagcacgccatcctcctggtggctgttagcttcgtgacccttatcacgggaaatatgtcctttaaagacctgggcagagtcgtggttatggtgggcaccacaatgaccgatgacattgggatgggagtcacatacctcgccctgctggccgctttcaaggtgcgccctacctttgccgcgggccttctgctccggaagctgacgtctaaagagctcatgatgacaaccatcgggattgttctgcttagccaatccacaatccccgagaccattctggaactcaccgatgctctggccctgggaatgatggtgcttaagatcgtcagagacatggagaaatatcagctggccgtgacaatcatggctattctctgcgtgcctaacgccgtcatcctgcagaatgcgtggaaggtttcttgtacgattctcgctgtggtgagcgtcagccccctgcttctgaccagctctcagcagaagacagactggatccctctcgccctgaccattaagggcctgaaccccacagccatcttccttaccacgctgtcccgcacaaataaaaagagaagctggccgctcaacgaagctatcatggccgtggggatggtttctattctggcttccagcctcctgaagaatgatatccctatgaccggaccccttgtggccggcggcctgctgaccgtctgctacgtgctcacagggcggtctgcggacctggagcttgaacgcgccaccgatgttaaatgggaggaccaggctgagatttccggaagctcccctatcctgagcattacaatctctgaagatggcagcatgtccattaagaacgaggaagaggagcagacgctcaccatcctgatcagaacagggctcctggtgatttctggactttttcccgtcagcatcccgattaccgccgctgcctggtatctgtgggaagtgaaaaagcagcgggccggcgtcctgtgggacgtgccttctccccctcccatggggaaagctgagctcgaagatggagcgtaccgcatcaagcaaaagggcattctgggctatagccagatcggggccggagtttacaaagagggcacattccataccatgtggcacgtgacgagaggggctgtccttatgcacaagggaaaacggatcgaacccagctgggccgacgtgaagaaagatctgatttcctacggcgggggatggaagctcgagggcgagtggaaggaaggcgaggaagttcaggtgctggccctcgagcctgggaaaaatccgcgcgctgtccagaccaagcccggactgtttaaaacaaacaccggcacaatcggggccgtgtctcttgacttcagccctggaacctccggcagccccattatcgataagaaagggaaggtggttggactgtatggcaatggcgtcgtgacaagatctggggcgtacgtgtccgctattgcccaaacggaaaagagcatcgaggacaaccctgagatcgaagatgacatttttcggaaacgcagactgaccatcatggacctccatcccggagccggcaagacaaaacggtatctgcctgctattgtcagagaggccatcaagcgcgggcttcggaccctgattctcgcgccgaccagagtggttgctgccgaaatggaggaagccctgcgcggactccccatccggtaccagacccctgctattagagccgagcacacgggccgcgagatcgtggatctgatgtgtcatgctaccttcacaatgcggcttctgtctcccgtcagagtgcctaactataatctgatcattatggacgaagcccacttcaccgatcccgcgtccatcgccgctcgcgggtacattagcacacgggttgagatgggcgaagccgctggaatctttatgaccgccacgccgcctggctccagagactctttcccccagagcaacgcccccattatcgatgaggagcgggaaatccctgagcgctcctggaatacagggcatgaatgggtgaccgactttaaaggaaagaccgtctggttcgtgcccagcattaaggctggcaacgatatcgcggcctgcctccgcaagaatgggaagaaagttattcaactgtctcggaagacatttgactccgagtatgtgaaaacccgcacaaacgattgggacttcgtcgtgaccacggatatcagcgaaatgggagctaattttaaggccgagagagtgattgaccctcggagatgtatgaaaccggtcatccttacagacggcgaggaacgcgttatcctggccgggcccatgcctgtgacccactctagcgctgcccagcggagaggccgcattggacggaaccccaagaatgagaacgatcagtacatctacatgggcgaacctctcgagaatgacgaagattgcgcgcactggaaggaggctaaaatgctgctggacaacattaatacacccgaggggatcattccgtccatgttcgaacctgagagagaaaaggtggatgccatcgacggagagtatcgcctccggggcgaagccagaaaaacctttgtcgatcttatgcgcagaggggacctgcccgtgtggctggcttacaaggttgccgcggagggaattaactatgccgatcggcgctggtgtttcgacggcatcaaaaataaccagatcctcgaggaaaacgtggaggtcgaaatttggacgaaggagggggagagaaagaaactgaagcctcggtggcttgatgctcgcatctactctgaccccctggccctcaaagaatttaaggagttcgctgccggcagaaaaagcctgaccctgaatctcattacagaaatgggacggcttcctaccttcatgacacaaaagaccagagatgctctggacaacctggccgtgctccatacagcggaggccggcgggcgcgcttataatcacgccctgtccgaacttcccgagaccctggagacgctcctgctgctcacacttctggctaccgttaccggaggcatctttctgttcctcatgtctgggcggggaattggcaagatgacactgggcatgtgctgcatcatcaccgccagcattcttctgtggtacgcccagatccagccgcattggattgctgcgtccatcattctcgaatttttcctgatcgtgctgctcatccctgagcccgaaaaacagagaacaccccaagacaaccagcttacgtatgtcgtgattgccatcctgaccgtcgtggctgccacaatggccaatgagatggggtttctggaaaagaccaaaaaggatctcggactgggcagcattgctacacagcagcctgagtctaacatccttgacattgatctgcgcccggcctccgcgtggaccctctacgccgttgctacgaccttcgtgacacccatgctgcggcacagcatcgaaaattcctctgtgaacgtcagcctgaccgccattgctaatcaagccacagttctcatggggcttggaaaaggctggcctctgtccaagatggacatcggggtgcccctgctcgcgatcggatgttactctcaggtgaaccctattaccctgacggccgcccttctgctcctggtcgcccactatgctatcattggccccggcctgcaggccaaggctacaagagaagcccagaaacgggcggccgctgggatcatgaagaatcctaccgtggatggaattacagttatcgacctcgatccgatcccctacgaccctaaatttgagaagcaacttggccaggtgatgctgctgattctctgcgtcacccaggtgctgatgatgcgcaccacatgggccctttgtgaagctctgacgctcgccaccgggcccatcagcacactgtgggagggaaaccctggcagattctggaataccacaattgccgtctccatggcgaacatctttcgggggagctatctggctggagccggcctccttttctctattatgaaaaataccacgaacacacgcagaggcaccgggaatatcggagaaaccctgggcgagaagtggaaatcccggctgaacgctctcgggaagtccgagtttcaaacatacaagaaatctggaatccaggaagtggatcgcaccctggccaaggagggcattaaaagaggggaaacagaccatcacgccgtttcccggggaagcgctaaacttcgctggttcgtggagagaaacatggtcacgcccgagggcaaagtggttgatctgggctgcgggcggggaggctggtcttattactgtgggggactcaagaatgtgagagaagtcaagggcctgaccaaagggggaccgggccatgaggaacctatccccatgagcacatatggctggaacctggtgcgcctccagtccggggtggacgtctttttcattccccctgagaagtgcgatacccttctgtgtgacatcggagaatctagccccaatcctacagtcgaggccggccggaccctgagagtgctcaacctggtggagaattggcttaacaataacacgcagttctgcattaaagtcctgaatccgtacatgccctccgttatcgaaaagatggaggcgctccaacgcaaatacgggggagccctggtgcggaaccctctgagcagaaattccacccacgaaatgtattgggtgtctaacgctagcggcaatatcgtctcctctgtgaacatgattagccgcatgctcatcaatcggtttacaatgagacataagaaggccacctacgagcccgacgttgatcttgggtccggaacacgcaacattggcatcgaatctgagattcctaacctggacatcattggcaaacggatcgagaagatcaaacaggaacacgagaccagctggcactatgatcaggaccatccctacaagacatgggcttatcacgggtcctacgaaaccaaacagacgggaagcgcctcttccatggtgaatggcgtcgtgagactgctcacaaagccgtgggatgttctgcctaccgtgacccaaatggcgatgacagacacgacccccttcgggcagcagcgcgtctttaaggagaaagtggatacacggacccaggaacctaaggagggaaccaagaaacttatgaaaattaccgccgagtggctgtggaaggaactcggcaaaaagaagacacccagaatgtgtacccgcgaggagttcacgagaaaagtgcggagcaacgctgccctgggggctatctttaccgacgagaataagtggaaatctgcccgcgaggctgtcgaagattccagattctgggagctggttgacaaggaacggaacctccatctggagggaaaatgcgaaacatgtgtgtataatatgatgggcaagagagagaagaaacttggcgagtttgggaaggccaaaggaagccgggcgatttggtacatgtggctgggcgcccgcttcctcgaatttgaggctctggggttccttaacgaagatcactggttttctagagaaaattccctgagcggagtggaaggcgaggggctccacaagctgggctacatcctgcgggacgtctccaaaaaggagggaggcgccatgtatgctgacgataccgccgggtgggacacacgcattaccctcgaagatctgaagaacgaggaaatggtgacgaatcatatggagggagaacacaagaaacttgccgaggcgatcttcaaactgacataccaaaacaaagttgtgagagtccagcggcctacacccagaggcacagtgatggacatcattagcagacgggatcagcgcgggtctggacaagttggcacctatgggctcaatacgtttaccaacatggaggctcagctgatcagacagatggaaggcgagggagtgttcaaaaatattcagcatcttacagccaccgaagaggtcgccgtgaagaactggctggctcgggttggccgcgagagactcagccggatggccatctccggggacgattgcgtggtcaagccgctggacgatcgcttcgctaatgccctgacagcgctcaacgacatgggaaaaattagaaaggatatccaacagtgggaaccttctaaaggctggaacgactggacccaggtgcccttttgcagccaccatttccacgagctgatcatgaaggatgggcgggtccttgtggttccctgtagaaatcaggacgaactgattggacgcgcccggatctcccaaggcgctgggtggtctctcagagagacagcctgcctgggcaaaagctacgctcagatgtggtcccttatgtattttcaccgccgggacctgagactcgccgcgaacgccatttgttctgctgtgcctagccattgggtcccgacctcccgcacgacatggagcatccacgccaagcatgaatggatgaccaccgaggatatgctgacagtgtggaatcgggtgtggattagagagaacccctggatggaagacaagacccctgttgagtcttgggaagagatcccctacctgggaaaacgcgaagatcagtggtgcggctccctcattgggctgacaagccgggctacgtgggccaagaatatccaggctgccatcaaccaagtgagatctcttattggaaatgaggagtataccgactacatgccttccatgaaacgcttccggagagaagaggaagaggcgggcgtcctgtggtga

SEQ ID NO: 19717 - RNA, 9876 nt, synthetic construct
  misc_feature 1..9876: note = derived and/or modified CDS sequence (opt5) from DENV-2__KF955402__SS-prME
  source 1..9876: mol_type = other RNA
agcgccggcatgatcattatgctgatccccaccgtgatggctttccacctgacaacgcggaatggggagcctcatatgattgtgggaatccaggaaaagggcaagagcctgctttttaagaccgaggacggggttaatatgtgcacactgatggccatggatctcggagaactgtgtgaggacaccattacatacaaatgcccgcttctgcggcaaaacgaacccgaggatatcgactgttggtgcaattctaccagcacatgggtgacctatggcacgtgtaccacaaccggggagcaccgcagagaaaagcggtccgtggcgctcgtccctcatgtgggaatgggcctggagacacgcaccgaaacgtggatgtctagcgagggcgcttggaaacacgcccagagaatcgagacatggattctgcggcatcccgggttcaccatcatggccgctattctcgcctacacaatcggaaccacccactttcagcgcgttctgattttcatccttctgacagctgtggccccttccatgacgatgagatgcattggcatctctaaccgggtctttgtggaaggggttagcggaggctcctgggtggatatcgtcctcgagcacgggagctgtgtgaccacaatggcgaagaataagcccaccctggacttcgaacttattaaaacagaggccaagcagcctgctaccctgcgcaaatattgcatcgaagccaagctcacgaacacaaccaccgagtctagatgtccgacacaaggagagccctccctgaaagaggaacaagataagcggtttgtgtgcaagcatagcatggtcgaccgcggctggggcaatgggtgtggactgttcggcaaagggggaattgttacctgcgctatgtttacatgcaagaaaaacatggaaggcaagatcgtgcagcctgagaatctcgaatacacgattgtggtcacaccccactctggggaggagcatgccgtgggaaacgatacaggcaaacacggcatggaaatcaaggttacccctcagtccagcatcacagaggcggaactgaccgggtatggaacggtgaccatggagtgttctcccagaacaggccttgacttcaatgaaatggtcctgctccaaatggagaacaaagcctggctggtgcaccggcagtggtttcttgatctgccgctcccttggctgcccggggctgacaagcaggagtccaattggattcagaaggaaaccctggttacattcaaaaaccctcatgccaagaaacaagatgtggtcgtgctcggaagccaggagggcgctatgcacaccgccctgacgggggccacagaaatccagatgtcctctggcaatcttctgtttaccggacatctcaagtgccgcctgagaatggacaaacttcaactgaagggcatgagctactccatgtgtacagggaagttcaaagtcgtgaaggagattgctgagacccagcacggaaccatcgttattcgggtgcagtatgaaggcgacgggagcccctgcaaaatccccttcgagatcatggatctcgaaaagagatacgtcctgggacgcctgattacagtgaaccctatcgttacggagaaagactctccggtgaacattgaagcggagcccccttttggcgattcctacatcattatcggggtcgagcccggccagctcaagctgaattggttcaagaaaggaagctctattggccaaatgtttgaaaccacaatgagaggggctaagagaatggctatccttggagacaccgcctgggatttcggcagcctcggcggggtgtttacatccatcgggaaagccctccatcaggtgttcggggctatttatggcgttgccttttctggagtcagctggaccatgaagatcctgattggcgtgatcattacgtggatcgggatgaactcccgcagcacatctctgtccgtgagccttgtcctcgtgggaatcgttaccctgtacctgggcgtgatggtccaggcggactctgggtgtgtggtttcctggaaaaataaggagctcaagtgcggaagcggcattttcatcaccgataacgtgcacacatggaccgaacagtataaatttcaacctgagtccccctctaagctggctagcgccattcagaaagcccaggaagaggggatctgtggcattcggtccgtcacaagacttgagaatctgatgtggaagcagatcacgccggaactcaaccacatcctggctgagaatgaagtgaaactgaccattatgacaggagacatcaagggcattatgcaagccgggaaacgctctcttcggcctcagcccaccgagctcaagtacagctggaagacatggggaaaagctaagatgctgtccaccgaaagctataaccagacgttcctgatcgatggccctgagaccgccgagtgccccaatacaaacagagcgtggaactctctcgaagttgaggactacgggtttggagtgttcaccacaaacatttggctgaaacttaaggaaaaacaggatgccttttgtgactccaagctgatgagcgctgccatcaaggacaatcgcgctgtccatgccgatatgggctattggatcgagtctgcgctcaacgacacctggaaaattgagaaggcctccttcatcgaagtgaaaaattgccactggcctaagagccatacactgtggtctaacggcgtgctggagagcgaaatgattatccccaaaaaccttgctgggccggtctcccaacacaattaccggcctggataccacacccagattgccggcccctggcatctcgggaagctggagatggatttcgacttttgtgatggaacgacagttatcgtgaccgaagactgcggcaacagagggcccagcctgcgcaccacaaccgcttctggaaagctcattacggagtggtgctgtcggtcctgcacactgcctccgcttagatatcggggcgaggatggctgttggtacgggatggaaatccgccccctgaaagagaaggaagagaatctcgtgaacagcctggtcaccgccggacacggccaggtggacaatttctccctgggggttcttggaatggccctctttctggaagagatgctgagaacacgggtgggcaccaaacatgctatcctcctggtcgcggtgtctttcgttacacttattaccgggaacatgagctttaaggatctgggaagagtggtcgtgatggttggcgccacgatggctgacgatatcggcatgggggtgacctatctcgccctgctggccgctttcaaagtccgccctacatttgccgcgggacttctgctccggaagctgacctccaaggagctcatgatgacaaccattggcatcgtgctgctttctcaaagcacgattcccgaaacagtgctggagctcaccgacgctctggccctggggatgatggtccttaaaatcgttagaaatatggaaaagtaccagctggccgtgacaatcatggctattctctgcgtgcctaacgccgtcatcctgcagaatgcgtggaaagtgtcctgtaccattctcgctgttgtgtctgtcagccccctgcttctgacctccagccagcaaaagacagattggatccctctcgccctgacgattaaaggactgaaccccaccgccatcttccttacaaccctgtctcgcacaaataagaaaagatcctggccgctcaacgaggctatcatggccgtgggcatggttagcattctggcttcttccctcctgaagaatgacatccctatgaccgggccccttgtggccggaggcctgctgacggtctgctatgtgctcacaggccggagcgcggacctggaacttgagcgcgccaccgatgtcaagtgggaggaccaggctgaaatttctgggtccagccctatcctgtccattaccatcagcgaggatggatctatgagcattaaaaacgaagaggaggaacagacactcaccatcctgatcagaacaggcctcctggtgatttccgggctttttcccatctctattccgatcacggccgctgcctggtacctgtgggaggttaagaaacagcgggccggagtgctgtgggacgtcccttctccccctcccatgggcaaggctgaactcgaggatggggcgtatcgcattaaacaaaagggaatcctgggctactcccagatcggcgccggggtgtacaaggaaggaaccttccacacaatgtggcatgttaccagaggcgctgtgcttatgcacaaagggaagcggattgagccctcctgggccgacgtcaaaaaggatctgatcagctatggaggcgggtggaaactcgagggagaatggaaggagggcgaagaggtccaggtgctggccctcgaacctggcaagaatccgcgcgctgttcagacaaaacccgggctgtttaagaccaacacgggaaccattggcgccgtctcccttgacttctctcctgggacaagcggatcccccatcattgataaaaagggcaaagtggtggggctgtacggaaacggcgtcgtgaccagaagcggcgcgtatgtttctgctatcgcccaaacagagaagtccatcgaggacaatcctgaaattgaggatgacatctttcggaagcgcagactgaccattatggatctccaccccggggccggaaaaacaaagcggtacctgcctgctatcgtgagagaagccattaaacgcggccttcggacgctgatcctcgcgccgaccagagtcgtggctgccgagatggaagaggccctgcgcgggctccccattcggtatcagacccctgctatcagagccgagcataccggacgcgaaatcgttgacctgatgtgtcacgctaccttcacaatgcggcttctgagccccgtgagagtccctaactacaatctgattatcatggacgaggcccatttcacggatcccgcgtctattgccgctcgcggctatatctccacccgggtggaaatgggggaggccgctggcatttttatgacagccaccccgcctggaagcagagaccccttcccccagtccaacgcccctatcatcgatgaggaacgggagattcccgaacgctcttggaatagcggccacgagtgggttacagactttaaggggaaaaccgtgtggttcgtcccttccatcaaggctggaaacgatattgcggcctgcctcagaaagaatggcaaaaaggtgatccaactgagccggaaaacgtttgactctgaatacgtgaagacacgcaccaacgattgggacttcgtcgttaccacagatatttccgagatgggggctaattttaaagccgagagagtgatcgacccgcggagatgtatgaagcccgtgatccttaccgatggagaggaacgcgtcattctggccggccctatgcccgtgacacatagctctgctgcccagcggagagggcgcatcggccggaaccctaaaaatgaaaacgaccagtacatttatatgggagagcccctcgaaaatgacgaggattgcgcgcactggaaggaggctaagatgctgctggacaacatcaataccccggaaggcattatccctagcatgttcgagcccgaaagagagaaagttgatgccattgacggggaataccgcctccggggagaggccagaaagacgtttgtggatcttatgcgcagaggcgacctgcctgtctggctggcttataaagtggccgcggaggggatcaactacgccgatcggcgctggtgtttcgacggaatcaagaacaatcagattctcgaagagaacgttgaagtggagatctggacaaaagagggcgaaagaaagaagctgaaaccccggtggcttgatgctcgcatttattccgaccctctggccctcaaggagtttaaagagttcgctgccgggagaaagtctctgaccctgaatctcatcacagagatgggccggcttcccaccttcatgacgcagaagaccagagatgctctggacaacctggccgtcctccacacagcggaagccggaggccgcgcttacaatcatgccctgagcgagcttccggagaccctggaaacactcctgctgctcacccttctggctacagtgaccgggggaatttttctgttcctcatgtccggccgggggatcggaaagatgacgctgggcatgtgctgcatcattacagcctctatccttctgtggtatgcccagattcagcctcactggatcgctgcgagcattatcctcgagtttttcctgatcgtcctgctcattcccgaacccgagaagcagagaacccctcaagataaccagcttacctacgtggttatcgccattctgacagtggtggctgccaccatggccaatgaaatgggctttctggagaaaacaaagaaagacctcgggctgggatccatcgctacgcagcagccggagagcaacattcttgacatcgatctgcgccccgcctctgcgtggaccctctacgccgtcgctacaaccttcgttacacctatgctgcggcattccattgaaaatagctccgtgaacgtgtctctgaccgccatcgctaatcaagccacggtcctcatgggccttgggaagggatggcccctgagcaaaatggacatcggcgtgcctctgctcgcgattgggtgttattcccaggttaaccccatcaccctgacagccgcccttctgctcctggtggcccactacgctattatcggacctggcctgcaggccaaggctaccagagaggcccagaagcgggcggccgctggcattatgaaaaatccgacagtcgatgggatcaccgtgatcgacctcgatcccattccttatgaccccaagtttgaaaaacaacttggacaggtcatgctgctgatcctctgcgtgacgcaggttctgatgatgcgcacaacctgggccctttgtgaggctctgacactcgccaccggccctatttctaccctgtgggaagggaaccccggaagattctggaatacaacgatcgccgtgagcatggcgaacatttttcggggctcctacctggctggggccggactccttttcagcatcatgaagaataccacaaacacccgcagaggcacaggcaacatcggggagaccctgggagagaaatggaagtctcggctgaatgctctcggcaaatccgaatttcaaatttataaaaagagcgggatccaggaggtcgatcgcacgctggccaaagaaggaattaagagaggcgagacagaccaccatgccgtgtctcgggggtccgctaaacttcgctggttcgttgagagaaacatggtgaccccggaaggaaaggtcgtggatctgggctgcggcagagggggatggagctactattgtggcgggctcaaaaatgtgcgggaggttaagggactgaccaagggcgggcctggacacgaagaacccatccccatgtctacatacggctggaacctggtccgcctccagagcggcgtggacgtgtttttcattcctcccgaaaaatgcgatacccttctgtgtgacatcggggagtcctctcctaatccgacagtcgaggccggacggacgctgagagttctcaacctggtggaaaattggcttaacaataacacccagttctgcatcaaggtgctgaatccctacatgcctagcgtcattgagaaaatggaagcgctccaacgcaagtatggcggggccctggtgcggaaccccctgtccagaaatagcacacatgagatgtactgggtttccaacgcttctggaaatatcgtgagctccgtcaacatgatttctcgcatgctcatcaaccggtttaccatgagacacaaaaaggccacatatgaacctgatgtggaccttggcagcgggacccgcaatattggaatcgagtccgagacgcccaacctggacattatcggcaagcggatcgagaagattaaggaggaacatgagacctcttggcactacgatcaggaccacccgtataaaacatgggcttaccatggcagctatgaaaccaagcagacagggtccgccagctctatggttaatggagtggtcagactgctcaccaaaccttgggatgtgctgcccacagtgacccagatggcgatgacggacacaacccctttcggccaacagcgcgtctttaaggagaaggttgatacccggacacaggagcccaaagaagggacgaagaaacttatgaagatcaccgccgagtggctgtggaaagaactcggaaagaaaaagacacctagaatgtgtacccgcgaggagttcacaagaaaggtgcggtccaacgctgccctgggcgctatttttaccgacgaaaataaatggaaaagcgcccgcgaggctgtggaagattctagattctgggagctggtcgacaaagaacggaacctccacctggaggggaagtgcgagacatgtgtgtacaatatgatgggaaaaagagaaaagaaacttggcgagtttggcaaagccaaggggtcccgggcgatctggtacatgtggctgggagcccgcttcctcgaatttgaggctctgggcttccttaacgaagatcattggtttagcagagaaaattctctgtccggggttgagggagaaggcctccacaaactggggtatattctgcgggacgtgagcaagaaagagggcggagccatgtacgctgatgacaccgccggctgggacacgcgcatcaccctcgaagatctgaagaacgaggaaatggtcacaaatcacatggagggggagcataagaaacttgccgaagcgatcttcaagctgacctatcagaacaaagtggttagagtgcaacggcccacaccgcgcggaaccgtcatggacattatctccagacgggatcagcgcggcagcggacaggtgggaacgtacggcctcaatacatttaccaacatggaggctcaactgattagacagatggaaggggagggcgttttcaagaatatccagcaccttacagtgaccgaggaagccgccgtccagaactggctggctcgggtgggacgcgagagactctctcggatggccattagcggcgacgattgcgtcgtgaaacctctggacgatcgcttcgctaacgccctgacggcgctcaatgacatggggaagatcagaaaggatatccaacagtgggaaccctccaaaggatggaacgactggacccaggttcccttttgctctcatcacttccatgagctgattatgaaggatggccgggtgcttgtcgtgccttgtagaaatcaggacgaactgatcgggcgcgcccggattagccaaggagctggctggtccctcagagagacagcctgcctggggaaatcttatgctcagatgtggagccttatgtactttcaccgccgggatctgagactcgccgcgaacgccatctgttccgctgtgccgtctcactgggttcccaccagccgcacaacctggtccattcatgccaagcacgagtggatgacaaccgaagacatgctgacggtgtggaatcgggtctggatcagagagaacccttggatggaagacaaaacacccgtggagagctgggaagagattccttatctgggcaagcgcgaggatcagtggtgcggatctctcatcggcctgacctcccgggctacctgggccaagaatatccaggctgccattaaccaagttagaagccttatcgggaatgaagagtacacagactacatgccctctatgaaacgcttccggagagaagaggaagaggcgggagtgctgtggtga

SEQ ID NO: 19718 - RNA, 9876 nt, synthetic construct
  misc_feature 1..9876: note = derived and/or modified CDS sequence (opt5) from DENV-2__FJ898460__SS-prME
  source 1..9876: mol_type = other RNA
acagccggcgtgatcgtcatgctgattcccacagctatcgccttccacctcacgacccggaatggggagcctcatatgattgttggacggcaggaaaagggcaagagcctgctttttaagacagaggacggggtgaatatgtgcaccctgatggcgatcgatctcggagaactgtgtgaggacacaattacctacaaatgcccgcttctgcgccaaaatgaacccgaggatatcgactgttggtgcaattccacatctacctgggtgacgtatggcacctgtacaaccacaggggagcaccggcgggaaaagcgcagcgtcgctctcgtgcctcatgttggaatgggcctggagaccagaacggaaacatggatgtcctctgagggcgcctggaaacacgtgcagcggatcgagacctggattctgcgccatcccgggttcacaatcatggccgctattctcgcctacaccatcggaaccacacactttcagagagctctgattttcatccttctgacggccgtcgcgcctagcatgaccatgcggtgcattggcatctccaaccgcgattttgtggaaggggtttctggaggcagctgggtggacatcgtcctcgagcacgggtcctgtgtgacaaccatggccaagaataagcccacactggatttcgaacttattaaaaccgaggctaagcagcctgccacgctgagaaaatattgcatcgaagctaagctcacaaacaccaccacagagagccggtgtccgacccaaggagagccctctctgaatgaagaacaggacaaacgctttatttgcaagcattccatggtggatagaggctggggcaacgggtgtggactgttcggcaaagggggaatcgtcacatgcgccatgtttacgtgcaaaaagaatatggaaggcaaagttgtgcagcctgagaacctcgaatacaccattgtgatcacaccccacagcggggaggagcatgcggtcggaaatgacaccggcaagcacggcaaagaaatcaagattacacctcagtcttccatcaccgaggccgaactgacggggtatggaaccgtgacaatggagtgtagcccccggaccggccttgatttcaacgaaatggttctgctccaaatggaggacaaggcttggctggtgcaccgccagtggtttcttgatctgccgctcccttggctgcccggggccgacacacagggatctaattggattcagaaggagaccctggtcacgttcaagaaccctcatgctaaaaagcaagacgtggttgtgctcggctcccaggaaggggccatgcacacagccctgaccggcgctacagagatccagatgagctccggaaatcttctgtttaccggccatctcaaatgcagactgcggatggataaacttcaactgaaagggatgtcttacagcatgtgtaccggaaagttcaagattgtcaaagaaatcgcggagacacagcacggcacgatcgtgattagagtccagtatgagggggacggatccccctgcaagatccccttcgaaattaccgatctcgagaaacgccatgtgctgggccggctgatcacagttaaccctattgtgaccgaaaaggacagcccggtcaacatcgaggccgaacccccttttggggattcttacattatcatcggcgtggagcccggacagctcaaactgaattggttcaagaagggctccagcattgggcaaatgtttgagacaaccatgagaggagctaaacgcatggccatccttggcgacacggcctgggatttcgggtctctgggaggcgtttttacaagcattgggaaggctctccaccaggtgttcggcgccatctacggagcggcttttaacggcgtctcctggaccatgaaaattctgatcggggtgatcattacctggatcggaatgaactctcggagcacatccctgagcgtgtctcttgttctcgtcggcgtggtgaccctgtatctgggggccatggtccaggccgactccggatgtgtggttagctggaagaacaaagaactcaagtgcggctctgggattttcatcacagataatgtgcacacgtggaccgagcagtacaagtttcaacctgaatcccccagcaaactggcttccgccattcagaaggctcatgaggaaggcatctgtggaatcagatctgtcacacgccttgagaacctgatgtggaaacagattaccccggagctcaatcacatcctgagcgaaaacgaggtgaagctgacaattatgaccggcgacatcaaagggattatgcaggccggaaagcggtcccttagacctcaacccacggaactcaaatattcttggaagacctggggcaaggcgaaaatgctgagcacagagtcccataatcagaccttcctgatcgatgggcctgaaacagccgagtgccccaacaccaatcgcgcttggaacagcctcgaggttgaagactacggatttggcgtgttctctacaaatatctggctgaaacttcgggagaaacaggacgtcttttgtgattccaagctgatgagcgccgctattaaagacaacagagccgtgcacgcggatatgggctattggatcgaatctgccctcaatgacacctggaagatggagaaggcttccttcattgaggttaaaagctgccactggcctaagtctcatacgctgtggagcaacggggtgctggaatccgagatgatcattcccaagagcttcgccggaccggtctctcagcacaactaccgccctggctatcatacacaaaccgctgggccctggcaccttggaaagctcgaaatggattttgacttctgtgagggcaccacagtggtggtcaccgaagattgcgggaatcggggaccctccctgagaacgacaaccgccagcggcaaactgatcacagagtggtgctgtcggtcctgcaccctccctccgctgcgctacagaggcgaggacgggtgttggtacggaatggaaattcggccccttaaggagaaggaagagaacctggttaattctctcgtgacagccggccatgggcagatcgataactttagcctgggagtgctgggcatggctcttttcctcgaagagatgctgagaacccgcgtcgggacgaaacacgcgatcctgctcgtggccgtttcctttgtgaccctgattacaggaaatatgtctttccgggaccttggcagagtcatggtgatggttggcgctaccatgacagatgacatcgggatgggagtgacctatctggccctcctggccgcttttaaggtccgccctacgttcgccgcgggcctgcttctgagaaaactcacaagcaaggagctgatgatggctaccattgggatcgccctcctgtcccagtctacaatgcccgaaaccattcttgagctgaccgatgccctcgctctgggaatgatggtgctgaaaatcgttcggaacatggaaaagtaccaacttgccgtgacaatcatggcgattagctgcgtccctaatgctgtgatcctgcagaacgcctggaaggtgtcctgtacgattctcgccgctgtcagcgtttctcccctgctcctgacctccagccagcagaaagccgactggatccctcttgctctgacaattaagggcctcaatcccaccgccatctttctgacaaccctgtctcgcacgtccaaaaagagaagctggccgcttaacgaggcgatcatggccgtggggatggtgtctattctggcttccagcctcctgaaaaatgacatccctatgacaggacccctcgtcgccggcggcctgcttaccgtgtgctatgttctgaccgggcggtccgctgatctggaactcgagcgcgccgccgacgtgaagtgggaggatcaagctgaaattagcggatctagccctatcctgtccattacaatctctgaggacggcagcatgtccattaaaaacgaagaggaggaacagacccttacaatcctgatcagaacggggctcctggtcatttctggagtgttccccgttagcatcccgattaccgcggccgcttggtacctctgggaggtgaagaagcagcgggccggcgtcctgtgggatgtgccttctccccctcccgtcgggaaagccgaacttgaggacggagcttatcgcatcaagcagagaggcattctgggctacagccaaatcggggccggagtgtataaagaaggcacatttcacaccatgtggcatgttacaagaggggcggtgctgatgcaccgcggaaagagaatcgagcccagctgggctgatgtcaaaaaggacctcatttcctacggcgggggatggaagctggagggcgaatggaaagagggcgaagaggtgcaggttcttgccctggaacctgggaagaatccgcgggccgtgcagaccaaacccggaatcttcaagacgaacaccggcacaattggggctgtcagcctcgatttttctcctggaacctccggcagccccatcgtggacagaaaagggaaggtggttggactgtacggcaatggcgtcgtgacacgctctggggcctatgtgtccgcgattgctcagaccgaaaagtccatcgaggataaccctgaaatcgaggacgatattttccggaaaaagagactcacaatcatggacctgcatcccggagccggcaaaacgaagcgctaccttcctgccattgtccgggaagctatcaaaagagggctgcgcaccctgattctcgccccgacacgggtggttgctgccgagatggaagaggcgctgagaggacttcccatccgctatcaaacccctgccattcgggctgagcacaccggcagagaaatcgtggacctgatgtgtcatgccacattcacgatgcggctcctgtcccccgtccgcgtgcctaactacaatctcatcattatggatgaggctcactttaccgaccccgcctctatcgccgctagagggtatattagcacacgggttgaaatgggcgaggcggccggaatcttcatgaccgctacaccgcctggctcccgcgatccctttccccagagcaacgcccctattatggacgaggaaagagagatccccgaacggtcttggaactccgggcacgagtgggtgaccgatttcaagggaaagacggtctggtttgtgcctagcatcaaagccggcaacgacattgctgcctgcctgagaaagaatgggaaaaaggttatccagctttctcgcaaaacattcgatagcgaatacgtgaagacccgggcgaacgactgggattttgtcgtgaccacagacatttccgagatgggagctaatttcaaggccgagagagtgatcgatccgcgccggtgtatgaaacccgtcattctgaccgacggcgaagagagagttatcctggccgggcctatgcccgtgacacattctagcgctgcccaacgccggggcagaatcggacgcaaccctaagaatgaaaacgaccagtatatttacatgggcgagcccctcgaaaatgatgaggactgcgcgcactggaaagaggccaagatgctgcttgataacatcaataccccggaagggattatcccttccatgtttgagcccgaaagagagaaagtggacgctattgatggagaataccggctgcgcggcgaggccagaaagacgttcgtcgacctcatgcggcgcggggatctgcctgtgtggctggcttataaagttgccgctgagggaatcaactacgccgacagaaagtggtgttttgatggcattaagaataaccagatcctcgaagagaacgtggaagtcgagatctggacaaaagagggggaacggaagaaacttaagcccagatggctggacgcgcgcatttattctgatcctctggccctcaaagagttcaaggagttcgctgccggcagaaagagcctgacccttaatctgatcacagagatgggaagactccccacctttatgacgcagaaagctcgcaacgccctggacaatctggccgtgctccataccgctgaagcgggcgggcgggcctacaaccacgctctttccgagctgccggagacactggaaaccctcctgcttctgacactcctggccaccgttacaggaggcattttcctgtttctcatgagcgggaagggaatcggcaaaatgacccttggcatgtgctgcattatcacggcctctatcctgctgtggtatgctcaaattcagcctcactggatcgccgcgtccattatcctcgagttctttctgattgtgcttctgatccccgaacccgagaagcagagaacacctcaggataatcaactcacctacgtcgtgatcgccattctgaccgtcgtggctgccacaatggctaacgaaatggggttcctggagaaaaccaagaaggacctcggacttggcagcatcacaacgcaggagtccgaatctaatattctggacatcgatctgcggccggccagcgcgtggaccctctatgccgttgctacaacctttgtgacacccatgctgcgccattccattgagaactctagcgtgaatgtctcccttaccgccatcgctaaccaggccacggttctgatggggctcggaaaaggctggcctctgagcaagatggacattggggtgcccctgctcgctatcggatgttactctcaggtgaatcctatcacccttacagccgcgctgctgctcctggtcgcccactacgctattatcggccccggccttcaagccaaagctaccagagaagcccagaagcgggccgcggctgggattatgaaaaaccctacagtggatggaatcaccgttattgacctggagccgatcccctatgatcctaagttcgaaaagcagctcggccaggtgatgctgctgatcctctgcgtcacgcaagtgcttatgatgcgcacaacctgggccctgtgtgaggctctgacactcgccaccgggcccatttccaccctgtgggagggaaatcctggcagattttggaacacaacgatcgccgtcagcatggctaatattttccgggggtcttaccttgccggagcgggcctgctcttttccatcatgaaaaacaccacaaatacccgcagaggcacagggaacattggagaaaccctgggcgagaagtggaaaagccggctgaacgccctcgggaagtctgagttccagatctataaaaagagcggaatccaggaggtggaccgcacgcttgctaaagagggcattaagagaggggaaacagatcatcacgccgtttcccggggatctgctaagctgagatggtttgtggagcgcaatatggtcacccccgaaggcaaagtggttgacctgggctgcgggcggggaggctggagctactattgtgggggactcaagaacgtgagagaggtcaaaggcctgaccaaagggggaccgggccatgaagaacctgtgcccatgtccacatacggctggaatcttgtgcgcctgcaaagcggggttgatgtcttcttcacaccccctgagaaatgcgacaccctcctgtgtgatatcggagaatcctctcccaaccctacgattgaggccggccggaccctgagagtgctcaatcttgtggaaaactggctgaataacaatacacagttttgcatcaaggtcctgaacccgtatatgcccagcgttattgagaagatggaaaccctccagcgcaaatacgggggagcgctggtgcggaatcctctttccagaaactctacacacgagatgtactgggtgagcaatgccaccggcaacatcgtctcctctgtgaatatgatcagccgcatgctgattaaccggttcacgatgaagcacaaaaaggctacctatgagcccgacgttgatctcgggtccggaacaagaaacatcggcattgaaagcgagacccctaatctggacatcattggcaaacgcatcgaaaagattaagcaggagcatgaaacatcttggcactacgaccaagatcatccctataaaacctgggcctaccacgggtcctatgagacaaagcagaccggaagcgcttcttccatggtgaacggcgtcgtgcggctgctcacgaaaccgtgggacgttgtgcctatggtcacacagatggccatgaccgataccacaccctttgggcagcaaagagtgttcaaggagaaagtggacacgcgcacccaggaacctaaggagggaacaaagaaacttatgaagatcaccgctgaatggctgtggaaagagctgggcaagaaaaagacacccagaatgtgtacccgggaggaatttaccaagaaggtccgcagcaatgccgcgctcggggccatcttcaccgatgagaacaagtggaaatctgctagagaagccgttgaggacggacggttttgggaactggtggatagagagcggaatcttcacctggagggcaagtgcgaaacgtgtgtgtacaacatgatgggcaaacgcgagaagaaactcggggagttcggaaaggctaagggctccagagccatttggtatatgtggctgggggcccggtttctggagttcgaagcgctcggatttctgaatgaggaccattggttcagccgcggcaactcccttagcggggtcgagggcgaaggactgcacagactcggctacatcctgcgggaggtggggaaaaaggaaggaggcgctatgtacgccgatgacaccgccgggtgggatacacgcattacccttgaggacctgaaaaatgaagagatggttacaaaccatatgaagggagagcacaaaaagctcgctgaagccatctttaagctgacctatcagaataaagtggtcagagtgcagcggcctacgccccgcggcacagttatggacattatctctagacgggatcaacgcgggagcggccaggtgggaacctacggcctgaacacattcaccaatatggaggctcagctcatcagacaaatggaaggggagggaattttcaagtccatccagcatctgacggccaccgaggaaattgcggtccagaactggcttgcccgggtgggccgcgagagactgtctcggatggctatcagcggggacgattgcgttgtgaaaccgattgacgatagatttgcctccgctctcacagccctgaatgacatgggaaaggtccgcaaagatatccagcaatgggaaccttctcggggctggaacgactggacccaggtgcccttctgcagccaccactttcatgagcttgtcatgaaggatgggagagtgctggttgtgccctgtcgcaaccaggacgaactcatcggccgggcgagaatttcccagggagccggctggtctctgaaggagacagcttgcctggggaaaagctatgcccaaatgtggaccctcatgtacttccaccgccgggatctgagacttgctgccaatgctatctgttccgccgtccctagccattgggtgccgacatctcgcaccacgtggtccattcacgcgaagcacgagtggatgacaaccgaagacatgctggccgtgtggaaccgggtttggatccaggagaatccctggatggaagataaaacccctgtggagagctgggaagaggtcccctatctcggaaagagagaggaccagtggtgcggctctctgattgggcttacatcccgcgctacctgggccaaaaacatccagacagccattaatcaagtgcggagcctgatcggaaacgaagagtacacggactatatgccttccatgaagagatttcggagagaagaggaagaggctggcgttctctggtga

SEQ ID NO: 19719 - RNA, 9876 nt, synthetic construct
  misc_feature 1..9876: note = derived and/or modified CDS sequence (opt5) from DENV-2__FJ882602__SS-prME
  source 1..9876: mol_type = other RNA
accgccggcatgatcattatgctgatccccacggctatggccttccacctcacgaccagaaacggggagcctcatatgattgtgagccggcaggaaaagggaaaatccctgctttttaagacagaggacggcgttaatatgtgcaccctgatggcgatggatctcggggaactgtgtgaggacacaatcacctacaactgcccccttctgagacaaaatgaacccgaggatattgactgttggtgcaactctacaagcacctgggttacgtatggaacctgtacagctaccggcgagcacagacgggaaaaacgctccgtggccctcgtgcctcatgtggggatgggactggagacaagaaccgaaacgtggatgtctagcgagggcgcctggaagcacgctcagcggatcgagacatggatcctgcgccatcccggcttcaccattatggccgctatcctcgcctacacaattgggaccacctattttcagagagtgctgatcttcattcttctgacagcggttgccccttccatgacgatgcggtgcatcggaatttctaatcgcgattttgtggaaggcgtcagcgggggatcctgggtggacatcgttctcgagcacggcagctgtgtgaccacaatggctaaaaacaagcccaccctggatttcgaacttatcaagacagaggccaaacagcctgctaccctgagaaagtactgcattgaagccaaactcacgaatacaaccaccgcgtctcggtgtccgacacaaggggagccctccctgaacgaggaacaggacaagcgctttgtctgcaaacacagcatggtggatagaggatggggcaatggctgtgggctgttcggaaagggcgggatcgtgacctgcgccatgtttacatgcaagaaaaacatggagggaaagattgtccagcctgaaaatctcgagtatacgatcgttattacaccccattctggcgaagagaacgctgtggggaatgacacaggaaaacacggcaaggagatcaaagtgacccctcagtccagcatcacagaagccgagctgaccggctacgggacggtcaccatggaatgttctccccggacaggacttgatttcaacgagatggtgctgctccaaatggaaaataaggcttggctggttcatcgccagtggtttcttgacctgccgctcccttggctgcccggcgccgatacccaggggtccaactggattcagaaagagacactggtgaccttcaagaaccctcacgccaagaaacaagacgtcgtggttctcggaagccaggagggcgctatgcacacggcgctgacaggggccaccgaaatccagatgtcctctggcaatcttctgtttacaggacatctcaagtgcagactgcggatggacaaacttcaactgaagggcatgagctattccatgtgtaccgggaaattcaaggtggtcaaggagattgctgaaacccagcacggaacaatcgtgattagagtccagtacgagggcgatgggagcccctgcaaaatccccttcgagatcatggacctcgaaaagcgccatgtgctgggacggctgattacggttaaccctatcgtgaccgagaaagattctccggtcaatattgaagccgagcccccttttggcgactcctacatcattatcggggtggaacccggccagctcaagctgagctggttcaaaaagggatctagcattggccaaatgtttgagacaaccatgagaggggccaagcgcatggctatccttggagatacagcctgggacttcggctccctcggaggggtttttacctctatcggcaaagcgctccaccaggtgttcggggctatttatggcgccgcctttagcggagtctcctggacgatgaagatcctgattggcgtggtgatcacatggattgggatgaacagccggtctacctccctgagcgttgctcttgtcctcgtgggagtggtcaccctgtacctgggcgtgatggttcaggccgattctgggtgtgtggtctcctggaaaaataaggagctcaaatgcggaagcggcatcttcatcacagacaacgtgcatacctggacagaacagtataagtttcaacctgagtccccctctaagctggctagcgccattcagaaagcgcacgaagaggggatctgtggcattagatccgttacgcgccttgaaaatctgatgtggaagcagatcaccccggagctcaaccacattctgtctgagaatgaagtgaaactgacaatcatgaccggagatatcaagggcattatgcaggccgggaaacggagccttagacctcaacccacagagctcaagtactcctggaaaacctggggaaaggctaagatgctgagcacggaacctcataaccagaccttcctgatcgacggccccgagacagccgaatgccctaataccaaccgcgcttggaactctctcgaggtcgaggattatgggtttggagtgttcacaaccaacatttggctgaaacttaaggaacggcaggacgtcttttgtgactccaaactgatgagcgccgcgatcaaggataatagagccgtgcacgctgacatgggctactggattgagtctgccctcaacgatacatggaaaatcgaaaaggcttccttcatcgaggtcaagagctgccattggcccaaatctcacaccctgtggagcaacggcgtgctggagtccgaaatgattatcccgaagaatttcgccgggcctgtgagccagcacaactatcgccccggataccatacgcaaacagccggcccctggcaccttgggaaactcgagatggactttgatttctgtgaaggaaccaccgtcgttgtgacagaggactgcggcaatcgggggccttctctgagaaccacgacagcttccggaaagctgattaccgaatggtgctgtcggagctgcacactcccgcccctgcgctacagaggcgatgacggctgttggtatgggatggagatccggcctcttaaagagaaggaagagaacctggtcaattccctcgtcaccgcgggatacggccagattgataacttttctctgggggtgctgggaatggcccttttcctcgaagagatgctgagaacacgcgttggcaccaagcatgctgtgctgctcgtcgccgtgagctttatgacgctgatcaccgggaatatgtccttccgggaccttggaagagttgtggtcatggtgggcgccgctatgacagatgacattggcatgggggttacctatctggccctcctggcggcttttaaagtgcgccccacattcgccgccggactgcttctgagaaagctcacctctaaagaactgatgatgacgacaatcggcatcgtcctcctgagccagtccaccattcctgagacaatccttgagctgaccgatgctctcgccctggggatgatgattctgaagatcgtgcggaacatggaaaaataccaacttgcggtgaccattatggctatcctgtgcgtccccaatgccgttatcctccagaacgcctggaaggtgtcttgtacaattctggctgtggtcagcgtgtcccctctcctgcttacgagctctcagcagaaggccgactggatccccctggctctcaccattaaaggactgaatccgacagccatctttctgaccacactttcccgcaccaacaagaaaagaagctggcctctgaatgaggcgattatggccgttggcatggtgtctatcctcgcttccagcctgctcaagaacgacatccccatgacggggcctctggtcgccggaggccttctgacagtgtgctatgttctgaccggccggtctgctgatctcgaactggagcgcgccgccgacgtgagatgggaagatcaagctgagatttccgggagctcccccatccttagcattaccatctctgaggacggaagcatgtccattaaaaatgaagaggaggaacagacactgaccatcctcattcggacaggcctgctcgtcatctctgggctgttcccggtgagcatccctattacggcggccgcttggtacctttgggaggtcaagaaacagcgcgccggagtgctgtgggatgttccctcccctccgcccgtgggcaaggccgaactggaggacggggcttatagaatcaagcagaaagggattctgggctactctcaaatcggcgccggggtctacaaggaaggaacctttcacacaatgtggcatgtgacccggggcgcggttctgatgcacaaagggaagcgcattgagcctagctgggctgatgtgagaaaagaccttatctcctatggaggcgggtggaagctggaaggagagtggaaggagggcgaagaggtccaggtgctcgccctggaaccgggcaaaaacccccgggccgtgcagacaaagcctggactcttcaaaaccaacacgggaaccatcggcgctgtttctctggattttagccccgggacatccggaagccctattgtcgacaagaaaggcaaggtggtggggctttacggaaatggcgtcgtgaccagatctggcacatatgtttccgccatcgcgcagaccgaaaagagcattgaagataaccccgagatcgaggacgatattttccgcaaacggagactgacaatcatggacctgcaccctggggctggaaagacgaaacgctacctcccggccatcgtgcgggaagccattaagagaggcctgcgcacccttatcctggctcccacacgggtcgtggccgctgagatggaagaggccctcagagggctgcctattcgctatcaaacccccgcgatccgggccgaacataccggaagagagattgttgacctcatgtgtcacgctacattcacgatgcggctgctttctcctgtgcgcgtccccaattacaacctgatcattatggatgaggcccattttaccgacccggcttccatcgccgccagaggctatatcagcacacgggtggaaatgggggaggctgcgggcattttcatgaccgccacacctcccggatcccgcgatccctttcctcagtctaatgctcccatcatggacgaagagagagagattcctgaacggagctggaactccggccacgagtgggttaccgatttcaaagggaagacggtgtggtttgtcccgagcatcaaggccggaaatgacattgccgcttgcctgcgcaaaaatggcaagaaagtgatccagctctctcgcaagacattcgattccgaatacatcaaaacccggaccaatgactgggattttgtggtcacaaccgacattagcgagatgggggccaacttcaaggcggaaagagttatcgatccccgccggtgtatgaagcctgtgattctgacagacggagaggagagagtgatccttgctggccccatgcctgtcacccattctagcgccgcccaacgccgggggagaattggccgcaatcccaaaaacgaaaatgaccagtacatctatatgggagagccgctggaaaacgatgaggactgcgctcactggaaggaagccaaaatgctcctggataatatcaacacgcctgagggcattatcccctccatgtttgagcctgaaagagagaaggtggacgcgattgatggggaataccggctgcgcggagaggccagaaaaacattcgttgacctcatgcggcgcggcgatcttcccgtgtggctggcttatagagtcgccgctgaagggatcaactacgccgaccggagatggtgttttgatggaattaagaataaccagatcctggaggagaatgtggaagttgagatttggaccaaagaaggcgagcgcaagaagctcaaacctcggtggctggacgctagaatctattctgatccccttgccctgaaggagttcaaagagttcgcggccgggcgcaagagcctcacactgaacctgatcaccgagatgggccggctcccgacgtttatgacccagaaagctagaaatgcccttgacaacctggctgtgctgcacacagccgaagccggaggccgggcttacaatcatgcgctctccgagctgcctgaaacccttgagacactgctcctgctgaccctccttgccacagtcaccgggggaattttcctgtttctgatgtctggcaaggggatcggaaagatgacgctcggcatgtgctgcattatcacagctagcattctgctttggtatgcccaaatccagccccactggatcgccgcttccattatcctggagttctttctcattgtgctgctgatccccgaacctgagaaacagcgcaccccgcaggataaccaactcacctacgtcgtgattgccatccttacagttgtggcggccaccatggctaatgaaatgggcttcctggagaagaccaaaaaggacctggggctcggaagcatcgccacgcagcagcccgaatctaacattctggacatcgatcttagacctgcttccgcctggaccctgtacgcggtggccacaacctttattacacccatgctccggcatagcatcgaaaattcctctgtcaacgttagcctgaccgctattgccaatcaggctacggtgctgatgggcctcgggaaaggatggcctctttccaagatggacatcggcgtgcccctgctggccattgggtgttattctcaagtcaaccctatcaccctcacagctgccctgcttctgctcgtggcgcactacgccatcattggaccgggcctgcaggctaaggccacccgcgaggctcagaaaagagccgccgcgggcatcatgaagaatcccacagttgatgggattaccgtgatcgacctggatcctattccctatgaccctaaattcgaaaagcagctcggacaagtcatgcttctggtgctgtgcgtcacacaggtgctcatgatgcggacaacctgggctctgtgtgaggcccttacactggctaccggccccatcagcaccctctgggaagggaacccgggacgcttttggaatacaacgatcgccgtttccatggccaacattttcagaggcagctacctggctggggccggactgctcttttctatcatgaaaaacaccacaaatacccggcgcggcacaggcaacaccggggagacgcttggagaaaagtggaagaatagactgaacgcgctgggcaaatccgagttccagatttataagaaaagcgggatccaagaggtggatcggacactcgccaaggaaggaattaaaagaggcgagaccgaccaccatgctgtctctcgcgggtccgccaagctgcggtggtttgtggaaagaaatcttgttacccctgagggaaaagtggtcgatctgggctgcggccgcgggggatggagctactattgtggcgggctcaagaacgtgcgggaggtgaagggactgacaaaaggcgggcccggacacgaggagcccatccctatgtctacctacggctggaatctggttagactccagagcggcgtcgacgtgttcttcacaccccctgaaaagtgcgatacgcttctgtgtgacatcggggagtcctctccgaaccccaccgtggaagctggacgcacactgcgggtcctcaatctggttgagaactggcttaataacaatacccagttttgcattaaagtgctgaacccttacatgcccagcgtgatcgagaagatggaagccctccagagaaaatatggcggggcgctggtccgcaatcctctgtcccggaacagcacacatgagatgtactgggtgtccaacgcctctggaaatattgttagctccgtgaacatgatctctagaatgctcattaatcgcttcaccatgcggcacaagaaggctacgtatgaacccgatgtcgaccttggcagcgggaccagaaacatcggaatcgagtccgaaacaccgaatctggacattatcggcaaacgcattgagaagatcaaacaagagcatgaaacctcttggcactacgatcaggaccacccttataagacatgggcctaccatggcagctatgagaccaaacagacagggtccgctagctctatggtgaacggagttgtgagactgctcaccaagccctgggatgtcattcctatggtgacgcagatggccatgacagacaccaccccctttggccaacagcgggtgttcaaggaaaaagtcgatacacgcacgcaggagcctaaggaagggaccaaaaagctgatgaaaatcacagctgagtggctttggaaggagctgggaaagaaaaagacccccagaatgtgtacacgggaagagtttaccagaaaagttcggtccaatgccgcgctcggcgccattttcacagacgaaaacaagtggaaaagcgctcgcgaggccgtggaggattctagattttgggaactggtggacaaggagcggaatctgcacctcgaagggaaatgcgagacctgtgtctacaacatgatgggaaagcgcgaaaagaaactgggcgagttcggcaaggctaaagggtccagagccatctggtacatgtggcttggagcccggtttctggagttcgaagcgctcggctttctgaatgaggatcattggttcagccgcgaaaactctctttccggggtggagggagaaggcctgcacaagctcgggtatatcctgagagacgttagcaaaaaggagggcggagctatgtacgccgatgacacggccggctgggacacccggattacactggaggatctcaagaatgaagagatggtgaccaaccacatggaaggggagcataaaaagctggctgaagccatctttaaacttacatatcagaataaggtcgtgcgcgttcaaagaccgacccctcggggaacggtgatggacattatctcccgcagagatcagcggggcagcgggcaggtcggaacatacggcctgaacaccttcacaaacatgggggctcaactcattcgccagatggagggcgaggaagtgttcaaaggaatccagcacctgaccgccacggaggaaatcgcggttcagaattggcttgccagagtgggccgggagagactgtctcgcatggctattagcggggacgattgcgtcgtgaagcccctcgacgatcggtttgcctccgctctgaccgccctgaacgacatgggaaaggtcagaaaagatatccaacagtgggagccctctcgcggctggaatgactggacacaggtgcctttctgcagccatcactttcatgaactcattatgaaggatgggcgggttctggtggtcccgtgtagaaaccaggacgagcttatcggacgcgcgcggatttcccaaggcgccgggtggtctctgagagaaaccgcttgcctcggcaaaagctatgcccagatgtggtccctgatgtacttccaccgccgggatcttagactggctgccaatgctatctgttctgccgtgcccagccactgggtgcctacatcccgcaccacatggagcatccatgcgcggcacgagtggatgaccacggaagacatgctcacagtttggaacagagtgtggattcaggagaatccctggatggaggacaagacccctgtcgaatcttgggaggaaatcccctatctgggaaaacgggaggatcagtggtgcggctccctgattgggctcaccagcagagccacatgggctaagaacatccaaaccgccattaatcaggtgcgctctctgatcggaaacgaagagtacacagactacatgccttccatgaagcggtttagacgcgaggaagaggaagccggcgttctttggtga

SEQ ID NO: 19720 - RNA, 9876 nt, synthetic construct
  misc_feature 1..9876: note = derived and/or modified CDS sequence (opt5) from DENV-2__GQ252676__SS-prME
  source 1..9876: mol_type = other RNA
accgccggagtgatcattatgctgatccccaccgctatggccttccacctcacgacccggaacggggagcctcatatgattgtcagcaagcaggaaaaaggaaagtccctgctttttaaaacggaggaaggcgttaatatgtgcaccctgatggcgatggacctcggggagctgtgtgaagatacaatcacctacaactgcccccttctgcggcaaaatgagcccgaggacattgattgttggtgcaactctacaagcacctgggtgacgtatggaacctgtacagctaccggcgaacacagaagagagaagcggtccgtggccctcgtccctcatgtggggatgggactggaaacacgcaccgagacgtggatgtctagcgagggcgcctggaaacacgctcagagaatcgaaacatggatcctgcggcatcccggcttcaccattatggccgctatcctcgcctacacaattgggaccacctattttcagcgcgttctgatcttcattcttctgacagcggtggccccttccatgacgatgagatgcatcggaatttctaatcgggactttgtcgagggcgtgagcgggggatcctgggttgatatcgtgctcgaacacggcagctgtgtcaccacaatggctaagaacaagcccaccctggacttcgagcttatcaaaacagaagccaagcagcctgctaccctgcgcaaatactgcattgaggccaagctcacgaatacaaccaccgcgtctagatgtccgacacaaggggagccctccctgaacgaagaacaggataaacggtttgtgtgcaagcacagcatggtggaccgcggatggggcaatggctgtgggctgttcggaaagggcgggatcgtgacatgcgccatgtttacatgcaaaaagaacatggaaggaaaaattgttcagcctgagaatctcgaatatacgatcgtggtgacaccccattctggcgaggagaacgctgtcgggaatgatacaggaaagcacggcaaagaaattaaggtgacccctcagtccagcatcacagaggccgaactgaccggctacgggacggttaccatggagtgttctcccagaacaggacttgacttcaacgaaatggtgctgctccaaatggagaataaggcttggctggtccatcggcagtggtttcttgatctgccgctcccttggctgcccggcgccgacatccaggggtccaactggattcagaaggagaccctggtgacattcaagaaccctcacgccaaaaagcaagatgttgtggtcctcggaagccaggaaggcgctatgcacaccgcgctgacgggggccacagagatccagatgtcctctggcaatcttctgtttaccggacatctcaaatgccgcctgagaatggacaaacttcaactgaaaggcatgagctattccatgtgtacagggaagttcaaggtggtcaaagaaattgctgagacccagcacggaaccatcgtggttcgggtgcagtacgagggcgacgggagcccctgcaagattcccttcgaaatcatggatctcgagaaaagacatgtcctgggacgcctgatcacagtgaaccctattgttacggaaaaggactctccggtgaatatcgaggccgaacccccttttggcgattcctacattatcattggggtcgagcccggccagctcaaactgagctggttcaagaagggatctagcatcggccaaatgtttgagaccacaatgagaggggccaaaagaatggctattcttggagacaccgcctgggatttcggctccctcggcggggtgtttacatctatcgggaaggcgctccaccaggtgttcggggctatctatggcgccgcctttagcggagtttcctggaccatgaaaattctgatcggcgtcgtgattacgtggatcgggatgaacagccgctctacatccctgagcgtgtctcttgtcctcgtgggagttgtgaccctgtacctgggcgtcatggtgcaggctgactccgggtgtgttgtgagctggaagaataaagaactcaagtgcggatccggcattttcatcaccgataacgtccatacatggaccgagcagtataagtttcaacctgaatctcccagcaaactggcctccgctatccagaaggcccacgaggaagggatttgtggcatccggtctgtgacaagacttgagaatctgatgtggaaacagattacgccggagctcaaccacatcctgagcgaaaatgaggttaagctgtccattatgaccggagacatcaaaggcatcatgcaggcggggaagcgcagccttcggcctcaacccacagaactcaaatactcttggaagacctggggaaaggccaaaatgctgtccacagagcctcataaccagaccttcctgattgatggccccgaaacggctgagtgccctaataccaacagagcctggaatagcctcgaggtggaagactatgggtttggagtcttcacaaccaacatctggctgaaacttaaagagcgccaggatgtgttttgtgactctaagctgatgtccgctgccattaaagacaatcgggcggtgcacgccgatatgggctactggatcgaaagcgctctcaacgacacatggaagattgagaaggcctctttcatcgaggtcaaaagctgccattggcccaagtcccacaccctgtggagcaacggcgttctggaatctgagatgatcattccgaaaaatttcgctgggcctgtgtcccagcacaactatagacccggataccatacacaaaccgccggcccctggcaccttgggaagctcgaaatggattttgacttctgtgagggaacgacagtggtcgtgaccgaagattgcggcaatcgcgggcctagcctgcggaccacaaccgcctccggaaaactgatcacggagtggtgctgtagatcttgcacactcccgcccctgcggtaccgcggcgaggacggctgttggtatgggatggaaattagacctcttaaggagaaggaagagaacctggttaatagcctcgtgaccgctggacatggccagatcgataacttttccctgggggtcctgggaatggcgcttttcctcgaagagatgctgcggacaagagtgggcaccaaacacgccgttctgctcgtggctgtctcttttatgacactgattaccgggaatatgagcttccgcgaccttggacgggtgatggttatggtgggcgccgccatgacggatgacatcggcatgggggtcacctacctggctctcctggccgcgtttaaggtgagacccacattcgctgccggactgcttctgcgcaaactcacctccaaggagctgatgatgacaaccattggcatcgtgctcctgtctcagagcacgatccctgaaacaattcttgagctgaccgatgccctcgctctggggatgatgatcctgaaaattgtcagaaacatggaaaagtatcaacttgccgttacaatcatggcgattctgtgcgtgcccaatgctgtgatcctccagaacgcctggaaggtctcctgtaccatcctggccgctgtgagcgtttctcctctcctgcttacctccagccagcagaaagccgactggattcccctggctctcacaatcaagggactgaatccgacggccatttttctgaccacactttctcggaccaacaaaaagcgctcctggcctctgaatgaggcgatcatggccgtgggcatggtcagcattctcgcttcttccctgctcaaaaacgatatccccatgacagggcctctggtggccggaggccttctgaccgtttgctacgtgctgacgggcagaagcgctgacctcgaactggagcgggccgccgacgtccgctgggaggatcaagctgaaatctccgggagctctcccattcttagcatcacaatttccgaggacggatctatgagcatcaagaatgaagaggaggaacagaccctgaccattctcatcagaacaggcctgctcgtgatttccgggctgttcccggtctctatccctatcaccgcggccgcttggtatctttgggaggtgaaaaagcagcgggccggagttctgtgggatgtgcccagccctccgcccgtcggcaaggccgaactggaggacggggcttaccgcattaaacagaagggaatcctcggctattcccaaattggcgccggggtgtacaaagaaggaacatttcatacgatgtggcacgttaccagaggcgcggtgctgatgcacaaggggaaacggatcgagccttcttgggctgatgtccgcaaggaccttattagctacggaggcgggtggaagctggagggagaatggaaagagggcgaagaggtccaggtgctcgccctggaaccgggcaagaaccccagagccgttcagacaaaacctgggctgttcaagaccaacacaggaaccatcggcgctgtctccctggattttagccccgggacgtctggatcccctatcgtggacaaaaagggcaaggtggtcgggctttatggaaatggcgtggttacccggagcggcacatacgtgtctgccattgcgcagaccgagaaatccatcgaggataaccccgaaattgaggacgatatcttcagaaagaaacgcctgacaattatggacctgcatcctggggctggaaagaccaaacggtatctcccggccatcgtcagagaagccatcaagcgcggcctgcggacacttattctggctcccacgagagtggttgccgctgagatggaagaggccctccgcgggctgcctatccggtaccaaacccccgcgattagagccgagcacacaggacgcgaaatcgtggatctcatgtgtcatgctaccttcaccatgcggctgcttagccctgtcagagtgcccaattataacctgattatcatggacgaggcccactttacagacccggcttccattgccgcccggggctacatctctacgcgcgttgaaatgggggaggctgcgggcatcttcatgaccgccacacctcccggaagcagagatccctttcctcagtccaatgctcccattatggacgaggaacgggagatccctgaacgcagctggaactctggccatgagtgggtgaccgatttcaaggggaaaacagtctggtttgtgccgtccattaaggccggaaatgacatcgccgcttgcctgcgcaaaaacggcaagaaagtgattcagctcagccggaagaccttcgattctgaatatatcaagacgagaacaaatgactgggattttgtcgttaccaccgacatcagcgagatgggggccaacttcaaagcggagcgcgtgattgatccccggagatgtatgaagcctgtgatcctgacagacggagaggaacgcgtcattcttgctggccccatgcctgtgacccactcctctgccgcccaacggagagggcgcatcggccggaatcccaaaaacgaaaatgatcagtacatttacatgggagagccgctggaaaacgacgaggactgcgctcactggaaggaggccaaaatgctcctggataatatcaacacacctgaaggcatcattcccagcatgtttgagcctgaaagagagaaggttgacgcgatcgatggggaatatcgcctgagaggagaggcccggaaaaccttcgtggacctcatgcgcagaggcgatcttcccgtctggctggcttaccgggtggccgctgaggggattaactatgccgaccgcagatggtgttttgatggaatcaagaataaccagattctggaagagaatgttgaagtggagatctggacgaaggagggcgaacggaaaaagctcaaacctagatggctggacgctcgcatttactccgatccccttgccctgaaggagttcaaagagttcgcggccgggcggaagtctctcacactgaacctgatcaccgagatgggcagactcccgacatttatgacccagaaggctcgcaatgcccttgacaacctggctgtcctgcatacggccgaagccggaggccgggcttataatcacgcgctcagcgagctgcctgagacccttgaaacactgctcctgctgaccctccttgccacagtgaccgggggaatcttcctgtttctgatgtccggcaaagggattggaaagatgacactcggcatgtgctgcatcattaccgctagcatcctgctttggtacgcccaaattcagccccattggatcgccgcttctatcattctggagttctttctcatcgtcctgctgattcccgaacctgagaaacagagaacgccgcaggataaccaactcacatatgtggttatcgccattcttaccgtggtggcggccaccatggctaatgaaatgggcttcctggagaagaccaagaaggactttgggctgggatccatcgccacccagcagcccgagagcaacatcctcgatattgacctgcggcctgcttccgcctggacactttacgcggtcgccacgaccttcatcacacccatgctgcgccactctattgaaaatagctccgttaacgtgtctctcaccgctatcgccaatcaggctacagtgctgatgggcctggggaagggatggcctctcagcaaaatggacattggcgtcccccttctggccatcgggtgttactcccaagtgaaccctattaccctgacggctgccctcctgcttctggttgcgcactatgccatcatcggaccgggcctccaggctaaggccaccagagaggctcagaaacgggccgccgcgggcattatgaagaatcccacagtggatgggatcaccgtcattgacctggatcctatcccctacgaccctaaatttgaaaagcagctgggacaagtgatgctccttgtcctgtgcgtgacacaggttctgatgatgcgcaccacgtgggctctctgtgaggccctgacacttgctaccggccccattagcacactgtgggaagggaacccgggaagattctggaataccaccatcgccgtgtctatggccaacatctttcggggctcctatctcgctggggccggactgctgttcagcattatgaagaacacaacgaatacccgcagaggcacaggcaacaccggggagacactcggagagaaatggaagaatcggcttaactctctgggcaaatccgaatttcagatctacaagcgcagcgggattcaagaggtcgatagaaccctggcgaaagaaggaatcaagcggggcgagacggaccatcacgccgtgtctagagggagcgctaaactccgctggttcgttgagcggaatctggtgacacctgaaggaaaggtcgtggatcttggctgcggcagagggggatggtcctattactgtggcgggctgaagaacgtgcgcgaggttaaaggactcaccaagggcgggcccggacatgaagaacccattcctatgtctacctatggctggaatctggtccggctgcagagcggcgtggacgtgttctttacaccccctgaaaaatgcgataccctcctttgtgacatcggggagtccagcccgaaccccacagtcgaggccggaagaacgctgcgcgttctgaatctcgtggaaaactggctgaataacaatacccagttctgcatcaaggtgcttaacccttacatgccctccgtcattgagaaaatggaaacactgcagcggaagtacggcggggctctcgtgagaaatcctctgtctcgcaacagcacccacgagatgtattgggtttccaacgcctctggaaatatcgtgagctccgtcaacatgatttctcggatgctgatcaatagatttacaatgcgccataagaaagcgacctacgaacccgatgtggacctcggcagcgggacgcggaacattggaatcgagtccgagaccccgaatcttgatatcattggcaagagaatcgagaagattaagcaagagcacgaaacaagctggcactatgaccaggaccatccttacaaaacctgggcctatcacggctcttacgagacaaagcagaccgggtccgctagctctatggttaacggagtggtccgcctgctgacaaagccctgggatgtgatccctatggtgacccagatggccatgacggacacaacccccttcggccaacagagagtctttaaagaaaaggttgatacccggacacaggagcctaaagaggggacgaagaaactcatgaagattaccgctgaatggctgtggaaggagcttggcaaaaagaaaacaccccgcatgtgtaccagagaagagttcgcccggaaggtgagatccaatgctgccctgggcgcgatctttacagacgagaacaaatggaaaagcgcccgggaagctgtggaggattctcgcttctgggaactcgtcgacaaagagagaaatctgcatctggaagggaagtgcgagacctgtgtgtataacatgatgggaaagcgggagaaaaagattggcgaatttggcaaagccaaggggtcccgcgctatctggtacatgtggctcggagccagattcctggagtttgaagcccttggcttcctgaatgaggatcactggtttagccgggaaaactccctcagcggggttgagggagagggcctgcacaaacttgggtacatcctgcgcgaagtgtctaagaaggagggcggagcgatgtatgctgacgatacagccggctgggacaccagaattacgctcgaagatctgaaaaatgaggaaatggtcaccaaccatatggagggggagcacaagaaactggccgaagctatcttcaagctcacataccagaataaagtggttcgggtgcaacgcccgacccctagaggaacagtcatggacattatcagccggcgcgaccagagaggctccggacaggtgggaacctatggcctgaacacgttcacaaacatgggggcccaacttattcggcagatggagggcgaaggagtttttaagggcatccagcatctgaccgctacagaggaggtggccgtccaggattggctcgcgcgcgtggggagagaacggctgtctagaatggccatcagcggagacgattgcgtcgtgaagccccttgacgatcgcttcgcttccgccctgaccgctctcaatgacatgggcaaagttcggaaggatattcaacagtgggagccctctagagggtggaacgactggacacaggtgcctttttgcagccaccatttccacgaactgatcatgaaagatggacgcgtcctggtggtgccgtgtcggaatcaggacgagctcattggcagagcccgcatctcccaaggggcgggctggtctctgcgggaaaccgcctgccttggaaagagctacgctcagatgtggtccctgatgtattttcacagacgcgatctccggctggccgctaacgccatttgtagcgctgttccctctcattgggtgcctacatccagaaccacatggagcatccacgcccgccatgagtggatgaccacagaggacatgcttaccgtctggaatcgggtgtggatccaggaaaacccctggatggaggataaaacgcctgttgaatcttgggaggaaattccctacctgggcaagagagaggaccagtggtgcgggtccctcatcggactgacaagccgggcgacctgggccaagaatattcaaaccgctatcaaccaggtgagatccctgattggctctgaggaatatacagactacatgcctagcatgaaacgcttccggagagaggaagaggaagccggggtcctctggtga

SEQ ID NO: 19721 - RNA, 9876 nt, synthetic construct
  misc_feature 1..9876: note = derived and/or modified CDS sequence (opt5) from DENV-2__GQ252677__SS-prME
  source 1..9876: mol_type = other RNA
accgccggcgtgatcattatgctgatccccaccgctatggccttccacctcacgacccggaacggggagcctcatatgattgtcagcaagcaggaaaaaggaaagtccctgctttttaaaacggaggaaggcgttaatatgtgcaccctgatggcgatggacctcggggagctgtgtgaagatacaatcacctacaactgcccccttctgcggcaaaatgagcccgaggacattgattgttggtgcaactctacaagcacctgggtgacgtatggaacctgtacagctaccggcgaacacagaagagagaagcggtccgtggccctcgtccctcatgtggggatgggactggaaacacgcaccgagacgtggatgtctagcgagggcgcctggaaacacgctcagagaatcgaaacatggatcctgcggcatcccggcttcaccattatggccgctatcctcgcctacacaattgggaccacctattttcagcgcgttctgatcttcattcttctgacagcggtggccccttccatgacgatgagatgcatcggaatttctaatcgggactttgtcgagggcgtgagcgggggatcctgggttgatatcgtgctcgaacacggcagctgtgtcaccacaatggctaagaacaagcccaccctggacttcgagcttatcaaaacagaagccaagcagcctgctaccctgcgcaaatactgcattgaggccaagctcacgaatacaaccaccgcgtctagatgtccgacacaaggggagccctccctgaacgaggaacaggataaacggtttgtgtgcaagcacagcatggtggaccgcggatggggcaatggctgtgggctgttcggaaagggcgggatcgtgacatgcgccatgtttacatgcaaaaagaacatggaaggaaaaattgttcagcctgagaatctcgaatatacgatcgtggtgacaccccattctggcgaggagaacgctgtcgggaatgatacaggaaagcacggcaaagaaattaaggtgacccctcagtccagcatcacagaggccgaactgaccggctacgggacggttaccatggagtgttctcccagaacaggacttgacttcaacgaaatggtgctgctccaaatggagaataaggcttggctggtccatcggcagtggtttcttgatctgccgctcccttggctgcccggcgccgacatccaggggtccaactggattcagaaggagaccctggtgacattcaagaaccctcacgccaaaaagcaagatgttgtggtcctcggaagccaggaaggcgctatgcacaccgcgctgacgggggccacagagatccagatgtcctctggcaatcttctgtttaccggacatctcaaatgccgcctgagaatggacaaacttcaactgaaaggcatgagctattccatgtgtacagggaagttcaaggtggtcaaagaaattgctgagacccagcacggaaccatcgtggttcgggtgcagtacgagggcgacgggagcccctgcaagattcccttcgaaatcatggatctcgagaaaagacatgtcctgggacgcctgatcacagtgaaccctattgttacggaaaaggactctccggtgaatatcgaggccgaacccccttttggcgattcctacattatcattggggtcgagcccggccagctcaaactgagctggttcaagaagggatctagcatcggccaaatgtttgagaccacaatgagaggggccaaaagaatggctattcttggagacaccgcctgggatttcggctccctcgggggagtgtttacatctatcggcaaggcgctccaccaggtgttcggggctatctatggcgccgcctttagcggagtttcctggaccatgaaaattctgatcggcgtcgtgattacgtggatcgggatgaacagccgctctacatccctgagcgtgtctcttgtcctcgtgggagttgtgaccctgtacctgggcgtcatggtgcaggctgactccgggtgtgttgtgagctggaagaataaagaactcaagtgcggatccggcattttcatcaccgataacgtccatacatggaccgagcagtataagtttcaacctgaatctcccagcaaactggcctccgctatccagaaggcccacgaggaagggatttgtggcatccggtctgtgacaagacttgagaatctgatgtggaaacagattacgccggagctcaaccacatcctgagcgaaaatgaggttaagctgtccattatgaccggagacatcaaaggcatcatgcaggcggggaagcgcagccttcggcctcaacccacagaactcaaatactcttggaagacctggggaaaggccaaaatgctgtccacagagcctcataaccagaccttcctgattgatggccccgaaacggctgagtgccctaataccaacagagcctggaatagcctcgaggtggaagactatgggtttggagtcttcacaaccaacatctggctgaaacttaaagagcgccaggatgtgttttgtgactctaagctgatgtccgctgccattaaagacaatcgggcggtgcacgccgatatgggctactggatcgaaagcgctctcaacgacacatggaagattgagaaggcctctttcatcgaggtcaaaagctgccattggcccaagtcccacaccctgtggagcaacggcgttctggaatctgagatgatcattccgaaaaatttcgctgggcctgtgtcccagcacaactatagacccggataccatacacaaaccgccggcccctggcaccttgggaagctcgaaatggattttgacttctgtgagggaacgacagtggtcgtgaccgaagattgcggcaatcgcgggcctagcctgcggaccacaaccgcctccggaaaactgatcacggagtggtgctgtagatcttgcacactcccgcccctgcggtaccgcggcgaggacggctgttggtatgggatggaaattagacctcttaaggagaaggaagagaacctggttaatagcctcgtgaccgctggacatggccagatcgataacttttccctgggggtcctgggaatggcgcttttcctcgaagagatgctgcggacaagagtgggcaccaaacacgccgttctgctcgtggctgtctcttttatgacactgattaccgggaatatgagcttccgcgaccttggacgggtgatggttatggtgggcgccgccatgacggatgacatcggcatgggggtcacctacctggctctcctggccgcgtttaaggtgagacccacattcgctgccggactgcttctgcgcaaactcacctccaaggagctgatgatgacaaccattggcatcgtgctcctgtctcagagcacgatccctgaaacaattcttgagctgaccgatgccctcgctctggggatgatgatcctgaaaattgtcagaaacatggaaaagtatcaacttgccgttacaatcatggcgattctgtgcgtgcccaatgctgtgatcctccagaacgcctggaaggtctcctgtaccatcctggccgctgtgagcgtttctcctctcctgcttacctccagccagcagaaagccgactggattcccctggctctcacaatcaagggactgaatccgacggccatttttctgaccacactttctcggaccaacaaaaagcgctcctggcctctgaatgaggcgatcatggccgtgggcatggtcagcattctcgcttcttccctgctcaaaaacgatatccccatgacagggcctctggtggccggaggccttctgaccgtttgctacgtgctgacgggcagaagcgctgacctcgaactggagcgggccgccgacgtccgctgggaggatcaagctgaaatctccgggagctctcccattcttagcatcacaatttccgaggacggatctatgagcatcaagaatgaagaggaggaacagaccctgaccattctcatcagaacaggcctgctcgtgatttccgggctgttcccggtctctatccctatcaccgcggccgcttggtatctttgggaggtgaaaaagcagcgggccggagttctgtgggatgtgcccagccctccgcccgtcggcaaggccgaactggaggacggggcttaccgcattaaacagaagggaatcctcggctattcccaaattggcgccggggtgtacaaagaaggaacatttcatacgatgtggcacgttaccagaggcgcggtgctgatgcacaaggggaaacggatcgagccttcttgggctgatgtccgcaaggaccttattagctacggaggcgggtggaagctggagggagaatggaaagagggcgaagaggtccaggtgctcgccctggaaccgggcaagaaccccagagccgttcagacaaaacctgggctgttcaagaccaacacaggaaccatcggcgctgtctccctggattttagccccgggacgtctggatcccctatcgtggacaaaaagggcaaggtggtcgggctttatggaaatggcgtggttacccggagcggcacatacgtgtctgccattgcgcagaccgagaaatccatcgaggataaccccgaaattgaggacgatatcttcagaaagaaacgcctgacaattatggacctgcatcctggggctggaaagaccaaacggtatctcccggccatcgtcagagaagccatcaagcgcggcctgcggacacttattctggctcccacgagagtggttgccgctgagatggaagaggccctccgcgggctgcctatccggtaccaaacccccgcgattagagccgagcacacaggacgcgaaatcgtggatctcatgtgtcatgctaccttcaccatgcggctgcttagccctgtcagagtgcccaattataacctgattatcatggacgaggcccactttacagacccggcttccattgccgcccggggctacatctctacgcgcgttgaaatgggggaggctgcgggcatcttcatgaccgccacacctcccggaagcagagatccctttcctcagtccaatgctcccattatggacgaggaacgggagatccctgaacgcagctggaactctggccatgagtgggtgaccgatttcaaggggaaaacagtctggtttgtgccgtccattaaggccggaaatgacatcgccgcttgcctgcgcaaaaacggcaagaaagtgattcagctcagccggaagaccttcgattctgaatatatcaagacgagaacaaatgactgggattttgtcgttaccaccgacatcagcgagatgggggccaacttcaaagcggagcgcgtgattgatccccggagatgtatgaagcctgtgatcctgacagacggagaggaacgcgtcattcttgctggccccatgcctgtgacccactcctctgccgcccaacggagagggcgcatcggccggaatcccaaaaacgaaaatgatcagtacatttacatgggagagccgctggaaaacgacgaggactgcgctcactggaaggaggccaaaatgctcctggataatatcaacacacctgaaggcatcattcccagcatgtttgagcctgaaagagagaaggttgacgcgatcgatggggaatatcgcctgagaggagaggcccggaaaaccttcgtggacctcatgcgcagaggcgatcttcccgtctggctggcttaccgggtggccgctgaggggattaactatgccgaccgcagatggtgttttgatggaatcaagaataaccagattctggaagagaatgttgaagtggagatctggacgaaggagggcgaacggaaaaagctcaaacctagatggctggacgctcgcatttactccgatccccttgccctgaaggagttcaaagagttcgcggccgggcggaagtctctcacactgaacctgatcaccgagatgggcagactcccgacatttatgacccagaaggctcgcaatgcccttgacaacctggctgtcctgcatacggccgaagccggaggccgggcttataatcacgcgctcagcgagctgcctgagacccttgaaacactgctcctgctgaccctccttgccacagtgaccgggggaatcttcctgtttctgatgtccggcaaagggattggaaagatgacactcggcatgtgctgcatcattaccgctagcatcctgctttggtacgcccaaattcagccccattggatcgccgcttctatcattctggagttctttctcatcgtcctgctgattcccgaacctgagaaacagagaacgccgcaggataaccaactcacatatgtggttatcgccattcttaccgtggtggcggccaccatggctaatgaaatgggcttcctggagaagaccaagaaggactttgggctgggatccatcgccacccagcagcccgagagcaacatcctcgatattgacctgcggcctgcttccgcctggacactttacgcggtcgccacgaccttcatcacacccatgctgcgccactctattgaaaatagctccgttaacgtgtctctcaccgctatcgccaatcaggctacagtgctgatgggcctggggaagggatggcctctcagcaaaatggacattggcgtcccccttctggccatcgggtgttactcccaagtgaaccctattaccctgacggctgccctcctgcttctggttgcgcactatgccatcatcggaccgggcctccaggctaaggccaccagagaggctcagaaacgggccgccgcgggcattatgaagaatcccacagtggatgggatcaccgtcattgacctggatcctatcccctacgaccctaaatttgaaaagcagctgggacaagtgatgctccttgtcctgtgcgtgacacaggttctgatgatgcgcaccacgtgggctctctgtgaggccctgacacttgctaccggccccattagcacactgtgggaagggaacccgggaagattctggaataccaccatcgccgtgtctatggccaacatctttcggggctcctatctcgctggggccggactgctgttcagcattatgaagaacacaacgaatacccgcagaggcacaggcaacaccggggagacactcggagagaaatggaagaatcggcttaactctctgggcaaatccgaatttcagatctacaagcgcagcgggattcaagaggtcgatagaaccctggcgaaagaaggaatcaagcggggcgagacggaccatcacgccgtgtctagagggagcgctaaactccgctggttcgttgagcggaatctggtgacacctgaaggaaaggtcgtggatcttggctgcggcagagggggatggtcctattactgtggcgggctgaagaacgtgcgcgaggttaaaggactcaccaagggcgggcccggacatgaagaacccattcctatgtctacctatggctggaatctggtccggctgcagagcggcgtggacgtgttctttacaccccctgaaaaatgcgataccctcctttgtgacatcggggagtccagcccgaaccccacagtcgaggccggaagaacgctgcgcgttctgaatctcgtggaaaactggctgaataacaatacccagttctgcatcaaggtgcttaacccttacatgccctccgtcattgagaaaatggaaacactgcagcggaagtacggcggggctctcgtgagaaatcctctgtctcgcaacagcacccacgagatgtattgggtttccaacgcctctggaaatatcgtgagctccgtcaacatgatttctcggatgctgatcaatagatttacaatgcgccataagaaagcgacctacgaacccgatgtggacctcggcagcgggacgcggaacattggaatcgagtccgagaccccgaatcttgatatcattggcaagagaatcgagaagattaagcaagagcacgaaacaagctggcactatgaccaggaccatccttacaaaacctgggcctatcacggctcttacgagacaaagcagaccgggtccgctagctctatggttaacggagtggtccgcctgctgacaaagccctgggatgtgatccctatggtgacccagatggccatgacggacacaacccccttcggccaacagagagtctttaaagaaaaggttgatacccggacacaggagcctaaagaggggacgaagaaactcatgaagattaccgctgaatggctgtggaaggagcttcgcaaaaagaaaacacccagaatgtgtacccgggaagagttcgccagaaaggtgcggtccaatgctgccctgggagcgatctttacagacgagaacaaatggaaaagcgcccgcgaagctgtggaggattctagattctgggaactcgtcgacaaagagcggaatctgcatctggaaggcaagtgcgagacctgtgtgtataacatgatggggaagcgcgagaaaaagattggagaatttggcaaagccaagggctccagagctatctggtacatgtggctcggggcccggttcctggagtttgaagcccttggattcctgaatgaggatcactggtttagccgcgaaaactccctcagcggcgttgagggggagggactgcacaaacttggctacatcctgagagaagtgtctaagaaggaagggggcgcgatgtatgctgacgatacagccggatgggacacccggattacgctcgaagatctgaaaaatgaggaaatggtcaccaaccatatggagggcgagcacaagaaactggccgaagctatcttcaagctcacataccagaataaagtggttcgcgtgcaaagaccgacccctcgggggacagtcatggacattatcagccgcagagaccagcggggatccggccaggtggggacctatggactgaacacgttcacaaacatgggcgcccaacttattcgccagatggagggggaaggcgtttttaagggaatccagcatctgaccgctacagaggaggtggccgtccaggattggctcgcgagagtgggccgggaaagactgtctcgcatggccatcagcggggacgattgcgtcgtgaagccccttgacgatcggttcgcttccgccctgaccgctctcaatgacatgggaaaagttagaaaggatattcaacagtgggagccctctcgcggctggaacgactggacacaggtgcctttttgcagccaccatttccacgaactgatcatgaaagatgggcgggtcctggtggtgccgtgtagaaatcaggacgagctcattggacgcgcccggatctcccaaggcgcggggtggtctctgagagaaaccgcctgccttggcaagagctacgctcagatgtggtccctgatgtattttcaccgccgggatctcagactggccgctaacgccatttgtagcgctgttccctctcattgggtgcctacatcccgcaccacatggagcatccacgcccggcatgagtggatgaccacagaggacatgcttaccgtctggaatagagtgtggatccaggaaaacccctggatggaggataaaacgcctgttgaatcttgggaggaaattccctacctgggaaagcgggaggaccagtggtgcggctccctcatcgggctgacaagcagagcgacctgggccaagaatattcaaaccgctatcaaccaggtgcgctccctgattggatctgaggaatatacagactacatgcctagcatgaaacggttcagacgcgaggaagaggaagccggcgtcctctggtga

SEQ ID NO: 19722 - RNA, 9876 nt, synthetic construct
  misc_feature 1..9876: note = derived and/or modified CDS sequence (opt5) from DENV-2__FJ898438__SS-prME
  source 1..9876: mol_type = other RNA
accgtgggcgtcatcgttatgctgattcccacagccatggctttccacctcacgaccagaaacggggagcctcatatgatcgtgggacggcaggaaaagggcaaaagcctgctttttaagacagaggacggggtgaatatgtgcaccctgatggccattgatctcggagaactgtgtgaggacacaatcacctacaaatgcccgcttctgcgccaaaacgaacccgaggatattgactgttggtgcaattccacatctacctgggtcacgtatggcacctgtagcacaaccggggagcacagacgggaaaagcgctccgtggcgctcgttcctcatgtgggaatgggcctggagacaagaaccgaaacgtggatgtctagcgagggcgcttggaaacacgtccagcggatcgagacatggatcctgcgccatcccgggttcaccattatggccgccatcctcgcttacacaattggaaccacccactttcagagagccctgatcttcattcttctgacagctgtggccccttccatgacgatgcggtgcatcggcatttctaaccgcgattttgttgaaggggtgagcggaggctcctgggtcgacatcgtgctcgagcacgggagctgtgtgaccacaatggcgaagaataagcccaccctggatttcgaacttatcaaaacagaggccaagcagcctgctaccctgagaaaatattgcattgaagccaagctcacgaacacaaccaccgagtctcggtgtccgacacaaggagagccctccctgaatgaagagcaggacaaacgctttatctgcaagcatagcatggtcgatagaggctggggcaacgggtgtggactgttcggcaaggggggaattgttacctgcgctatgtttacatgcaaaaagaatatggaaggcaaagtggtgcagcctgagaacttcgaatacacgatcgtcattaccccccactctggggaggagcatgccgtgggaaatgacacaggcaagcacggcaaagaaatcaagatcacccctcagtccagcattacagaggcggaactcaccgggtatggaacggttaccatggagtgttctccccggacaggcctggattttaacgaaatggtgcttctgcaaatggaggacaaagcctggctcgtccaccgccagtggttcctggatcttccgctgccttggctccccggggctgacacccagggatccaattggatccagaaggagacactggtgacctttaagaaccctcatgccaaaaagcaagacgttgtggtcctgggcagccaggaaggggctatgcacacggccctcacaggcgccaccgagattcagatgtcctctggaaatctgcttttcacaggccatctgaaatgcagactccggatggataagctgcaacttaaagggatgagctactccatgtgtaccggaaagttcaagatcgtgaaagaaattgctgagacccagcacggcacaatcgtcatcagagtgcagtatgagggggacggaagcccctgcaagattccctttgaaatcacggatctggagaaacgccatgttctcggccggctgattaccgtgaaccctatcgtcacagaaaaggactctccggtgaacattgaggcggaaccccctttcggggattcctacatcattatcggcgttgagcccggacagctgaaactcaattggtttaagaagggcagctctatcgggcaaatgttcgagaccacaatgagaggagccaaacgcatggctattctgggcgacaccgcctgggattttgggagccttggaggcgtgttcacgtccatcgggaaggccctgcaccaggtctttggcgctatttacggagccgcgttctctggcgtgagctggacaatgaaaatcctcattggggtgatcatcacctggattggaatgaactcccggagcacctctctgtccgttagcctggtccttgtgggcgtggtcacactctatctgggggctatggtgcaggccgactctggatgtgttgtgtcctggaagaataaagaactgaagtgcggcagcgggatctttattaccgataacgtccacacatggacggagcagtacaagttccaacctgaatccccctctaaactcgccagcgctatccagaaggcccatgaggaaggcatttgtggaatcagatccgtgacccgcctggagaatcttatgtggaaacagatcacaccggagctgaaccacattctctctgaaaatgaggttaagctgaccatcatgacaggcgacattaaagggatcatgcaggctggaaagcggagcctgagacctcaacccaccgaacttaaatattcctggaagacgtggggcaaggccaaaatgctcagcaccgagtctcataaccagacatttctgattgatgggcctgaaaccgcggagtgccccaattccaaccgcgcctggaatagcctggaggtggaagactacggattcggcgtctttacaaccaacatctggctcaagctgcgggagaaacaggacgtgttctgtgattctaagcttatgtccgctgccatcaaagacaatagagctgttcacgccgatatgggctattggattgaaagcgcgctgaacgacacatggaagatggagaaggcctctttcatcgaggtgaaaagctgccactggcctaagtcccataccctctggagcaatggggtcctggaatctgagatgattatccccaaaaactttgctggaccggtgtcccagcacaactaccgccctggctatcatacgcaaacagccgggccctggcacctgggaaagcttgaaatggatttcgacttttgtgagggcaccaccgtggtcgttacagaagattgcgggaatcggggacccagcctcagaaccacgacagcttccggcaaactgattaccgagtggtgctgtcggtcttgcacactgcctccgctccgctacagaggcgaggacgggtgttggtacggaatggaaatccggcccctgaaggagaaggaagagaaccttgtgaatagcctggtgaccgccggccatgggcagattgataacttctccctcggagtcctgggcatggccctgtttcttgaagagatgctcagaacacgcatcgggaccaaacacgctatcctgctggtggcggcctctttcgttacgctcattaccggaaatatgagctttcgggacctgggcagagtgatggtcatggtgggcgctacaatgaccgatgacatcgggatgggagttacatatcttgccctgctcgccgctttcaaggtgcgccctacctttgccgcgggcctgctgcttagaaaactgacgtccaaggagctcatgatggctacaattgggatcgccctgctctctcagagcaccattcccgaaacaatcctggagcttaccgatgccctggctctcggaatgatggtcctgaaaatcgtgcggaacatggaaaagtaccaactggccgttaccattatggcgatctcctgcgtgcctaatgctgtcattcttcagaacgcctggaaggtgagctgtacaatcctggccgctgtgtctgtctcccccctcctgctcacgagctctcagcagaaagccgactggattcctctggctcttaccatcaagggcctgaatcccacagccatcttcctcaccacactgtcccgcaccagcaaaaagagatcttggccgctgaacgaggcggttatggccgtggggatggtgtccattcttgctagctccctgctcaaaaatgacatccctatgacgggacccctggtcgccggcggcctcctgacagtgtgctatgttcttaccgggcggagcgctgatctggaactggagcgcgccgccgacgtgaagtgggaggatcaagctgaaatttctggaagctcccctatcctctctattaccatcagcgaggacggctccatgtctattaaaaacgaagaggaggaacagacactgaccatccttatcagaacagggctgctcgtcattagcggagtgtttcccgtttccatcccgattacggcggccgcttggtacctgtgggaggtgaagaagcagcgggccggcgtcctctgggatgtgccttctccccctcccgtcgggaaagccgaactggaggacggagcttatcgcatcaagcagagaggcattcttggctacagccaaatcggggccggagtgtataaagaaggcaccttccacacaatgtggcatgttacccggggggcggtgctgatgcaccgcggaaagagaatcgagccctcctgggctgatgtcaaaaaggacctgattagctacggcgggggatggaagctcgagggcgaatggaaagagggcgaagaggtgcaggttctggcccttgaacctgggaagaatccgcgggccgtgcagacaaaacccggaatctttaagaccaacacgggcaccattggggctgtctctctggatttctcccctggaacaagcggctctcccatcgtggacagaaaagggaaggtggttggactctacggcaatggcgtcgtgacccgctccggggcctatgtgagcgcgattgctcagacagagaagtccatcgaggataaccctgaaatcgaggacgatattttccggaaaaagagactgaccatcatggacctccatcccggagccggcaaaacaaagcgctacctgcctgccattgtccgggaagctatcaaaagagggcttcgcacgctgattctggccccgacccgggtggttgctgccgagatggaagaggcgctcagaggactgcccatccgctatcaaacacctgccattaagaccgagcacaccggccgggaaatcgtggaccttatgtgtcatgctacatttacgatgagactgctctctcccgtccgggtgcctaactacaatctgatcattatggatgaggcccacttcaccgaccccgctagcatcgccgcccgcgggtatatttccacaagagttgaaatgggcgaggctgcgggaatctttatgaccgccacaccgcctggcagccgggatcccttcccccagtctaacgctcctattatggacgaggaacgcgagatccccgaaagatcctggaatagcgggcacgagtgggtgaccgattttaagggaaaaacggtctggttcgtgccttctatcaaggccggcaacgacattgccgcttgcctccggaaaaatgggaagaaagttatccagctgagcagaaagacatttgattccgaatacgtgaagacccgcgccaacgactgggatttcgtcgtgaccacagacatttctgagatgggagcgaattttaaagctgagcgggtgatcgatccgagacgctgtatgaagcccgtcattcttaccgacggcgaagagcgggttatcctggccgggcctatgcccgtgacacatagctccgccgctcaaagacgcggccggatcggaagaaaccctaaaaatgaaaacgaccagtatatttacatgggcgagcccctggaaaatgatgaggactgcgcccactggaaggaggcgaaaatgctcctggataacatcaataccccggaagggattatcccttctatgttcgagcccgaacgcgagaaggtggacgccattgatggagaatacagacttcggggcgaggctcgcaaaacgtttgtcgacctgatgagacggggggatctccctgtgtggctggcctataaggttgctgccgagggaatcaactacgctgaccgcaagtggtgtttcgatggcattaaaaataaccagatcctggaagagaacatggaagtggagatctggacaaaggagggggaaagaaaaaagctcaaaccccggtggcttgacgccagaatttatagcgatcctctggcgctgaaggagttcaaggaatttgccgctggccgcaaatccctcaccctgaatcttatcacagagatgggacggctgcccaccttcatgacgcagaaggccagaaacgctctcgacaatctggccgtcctgcataccgccgaagctggcgggcgcgcgtacaaccacgccctcagcgagcttccggagacactggaaaccctgctcctgcttacactgctcgctaccgtgacaggaggcatttttctgttcctgatgtctgggaaaggaatcggcaagatgaccctcggcatgtgctgcattatcacggcctccatccttctgtggtatgcccaaattcagcctcactggatcgctgccagcattatcctggagtttttcctcattgttctgcttatccccgaacccgagaaacagcggacacctcaggataatcaactgacctacgtggtcatcgcgattctcaccgtggtcgccgctacaatggccaacgaaatggggtttctggagaagaccaagaaagacctgggactcggctccatcacaacgcaggagtctgaaagcaatattcttgacatcgatctgagaccggcttccgcctggaccctgtatgcggtggccacaaccttcgttacacccatgctccggcattctattgagaacagctccgtgaatgtgagcctgaccgctatcgccaaccaggctacggtccttatggggctgggaaagggctggcctctctctaaaatggacattggggttcccctgctggccatcggatgttactcccaggtgaatcctatcaccctcacagctgcccttctgctgctcgtggcgcactacgccattatcggccccggcctgcaagctaaggccacccgcgaagctcagaaaagagccgccgcggggattatgaagaaccctacagtcgatggaatcaccgtgattgaccttgagccgatcccctatgatcctaagtttgaaaaacagctgggccaggttatgctcctgatcctgtgcgtgacgcaagtcctcatgatgcggacaacctgggctctttgtgaggccctgacactggctaccgggcccattagcaccctctgggagggaaatcctggccgcttctggaacacaacgatcgccgtgtctatggccaatatttttagagggtcctacctggctggagccggccttctgttcagcatcatgaagaacaccacaaatacccggcgcggcacagggaacattggagaaaccctcggcgagaaatggaagtctagactgaacgcgctggggaaaagcgaatttcagatctataagaaatccggaatccaggaggtcgaccggacgctcgccaaggagggcattaagcgcggggaaacagatcatcacgctgtgtctagaggaagcgccaaacttcggtggttcgttgagagaaatatggtgacccccgaaggcaaggtcgtggacctgggctgcgggcgcggaggctggtcctactattgtgggggactgaaaaacgttcgggaggtgaagggcctcaccaaagggggaccgggccatgaagagcctatccccatgagcacatacggctggaatctggtcagacttcaatccggggtggatgtgttctttaccccccctgagaagtgcgacacactgctctgtgatattggagaatctagccccaaccctacgatcgaggctggccgcaccctgcgggttctgaatctcgtcgaaaactggcttaataacaatacacagttctgcattaaggtgctgaacccgtatatgccctccgtgatcgagaaaatggaaaccctgcagagaaagtacgggggagccctcgtccgcaatcctctgtctcggaacagcacacacgagatgtactgggtttccaatgcgaccggcaacatcgtgtctagcgtgaatatgatttccagaatgcttatcaaccgctttacgatgaaacacaagaaagccacctatgagcccgacgtcgatctggggagcggaacacggaacattggcatcgaatctgagattcctaatctcgacatcattggcaagagaatcgaaaagatcaaacaggagcatgaaacctcctggcactacgaccaagatcatccctataagacatgggcttaccacgggagctatgagaccaaacagacaggatctgcctccagcatggtgaacggcgttgtgcgcctgctgaccaagccgtgggacgtcgtgcctatggttacgcagatggctatgacagataccacccccttcgggcagcaacgggtgtttaaagagaaggtcgacacaagaacgcaggaacctaaggagggaaccaaaaagctcatgaaaattacagccgaatggctttggaaggagctgggcaaaaagaaaaccccccgcatgtgtacaagagaggaattcacccggaaggtgcgctctaatgctgccctgggggcgatctttacagatgagaacaagtggaaatccgccagagaagctgtggaggacggacggttctgggaactcgtcgatagagagcggaatctgcaccttgagggcaagtgcgaaacctgtgtttacaacatgatgggcaaacgcgagaagaaactgggggaatttggaaaggccaagggcagcagagctatttggtatatgtggctcggggcccggttcctggagtttgaagccctgggattcctcaatgaggaccattggttttcccgcggcaacagcctgtctggggtggagggcgaaggacttcacagactgggctacatcctccgggatgtggggaaaaaggagggaggcgcgatgtacgctgacgatacggccgggtgggacacccgcattacactggaagaccttaaaaatgaggaaatggtcaccaaccatatgaagggagagcacaaaaagctggccgaggctatcttcaagctcacatatcagaataaagtggttagagtgcagcggcctaccccccgcggcacggtcatggatatcattagcagacgggaccaacgcgggtccggccaggtgggaacatacggcctgaacaccttcacaaatatggaagcccagctgatcagacaaatggagggggaaggaatttttaagtctatccagcatctcaccgctacggaggagattgccgttcagaactggctggcgcgggtgggccgcgaaagacttagccggatggccatctccggggatgactgcgtcgtgaaaccgatcgatgacagattcgcttctgccctgaccgctctcaatgatatgggaaaggttcgcaaagacattcagcaatgggagcctagccggggctggaacgattggacacaggtgcccttttgctcccaccacttccatgaactggtcatgaaggacgggagagtgcttgtcgtgccctgtcgcaaccaggatgagctgatcggccgggccagaatttctcagggagcgggctggagcctcaaggaaaccgcctgcctggggaaatcctatgctcaaatgtggacactgatgtactttcaccgccgggacctcagactggccgctaatgccatctgtagcgctgttccttctcattgggtgccgacctcccgcacaacctggagcattcacgccaagcacgagtggatgacgacagaggatatgcttgcggtctggaaccgggtgtggatccaggaaaatccctggatggaggacaaaacccctgtggaatcttgggaggaagttccctatctgggaaagagagaggaccagtggtgcggctccctcattgggctgaccagccgcgccacatgggctaaaaacatccagaccgccatcaatcaagtgcggtcccttattggaaacgaggaatacacagattatatgccttctatgaagagattccggagagaggaagaggaagccggcgtcctgtggtga

SEQ ID NO: 19723 - RNA, 9876 nt, synthetic construct
  misc_feature 1..9876: note = derived and/or modified CDS sequence (opt5) from DENV-2__GQ199893__SS-prME
  source 1..9876: mol_type = other RNA
accgccggcgtgatcgtcatgctgattcccacggctatggccttccacctcacgaccagaaatggggagcctcatatgatcgttggacggcaggaaaagggcaaaagcctgctttttaagacagaggacggggtgaatatgtgcaccctgatggcgattgatctcggagaactgtgtgaggacacaatcacctacaaatgcccgcttctgcgccaaaatgaacccgaggatattgactgttggtgcaattccacatctacctgggtgacgtatggcacctgtacaaccacaggggagcacagacgggaaaagcgcagcgtcgctctcgtgcctcatgttggaatgggcctggagaccagaacggaaacatggatgtcctctgagggcgcctggaaacacgtgcagcggatcgagacctggatcctgcgccatcccgggttcacaattatggccgctatcctcgcctacaccattggaaccacacactttcagaaggctctgatcttcattcttctgacggccgtcgcgcctagcatgaccatgagatgcatcggcatttccaaccgggattttgtggaaggggtttctggaggcagctgggtggacatcgtcctcgagcacgggtcctgtgtgacaaccatggccaagaataaacccacactggatttcgaacttatcaagaccgaggctaaacagcctgccacgctgcgcaagtattgcattgaagctaaactcacaaacaccaccacagagagcagatgtccgacccaaggagagccctctctgaatgaggaacaggacaagcggtttatctgcaagcattccatggtggatcgcggctggggcaacgggtgtggactgttcggcaaagggggaattgtcacatgcgccatgtttacgtgcaagaaaaatatggaaggcaaggttgtgcagcctgagaacctcgaatacaccatcgtgattacaccccacagcggggaggagcatgcggtcggaaatgacaccggcaaacacggcaaggaaatcaaaatcacacctcagtcttccattaccgaggccgaactgacggggtatggaaccgtgacaatggagtgtagccccagaaccggccttgatttcaacgaaatggttctgctccaaatggaggacaaggcttggctggtgcaccggcagtggtttcttgatctgccgctcccttggctgcccggggccgacacacagggatctaattggatccagaaggagaccctggtcacgttcaaaaaccctcatgctaagaaacaagacgtggttgtgctcggctcccaggaaggggccatgcacacagccctgaccggcgctacagagattcagatgagctccggaaatcttctgtttaccggccatctcaagtgccgcctgagaatggataaacttcaactgaaggggatgtcttacagcatgtgtaccggaaagttcaaaatcgtcaaggaaattgcggagacacagcacggcacgatcgtgatccgggtccagtatgagggggacggatccccctgcaaaattcccttcgaaatcaccgatctcgagaagagacatgtgctgggccgcctgattacagttaaccctatcgtgaccgaaaaagacagcccggtcaacattgaggccgaacccccttttggggattcttacatcattatcggcgtggagcccggacagctcaagctgaattggttcaagaaaggctccagcatcgggcaaatgtttgagacaaccatgcggggagctaagagaatggccattcttggcgacacggcctgggatttcgggtctctgggaggcgtttttacaagcatcgggaaagctctccaccaggtgttcggcgccatttacggagcggctttttccggcgtctcttggaccatgaagatcctgattggggtgatcatcacctggattggaatgaacagccgctccacaagcctgtctgtgtcccttgttctcgtcggcgtggtgaccctgtatctgggggccatggtccaggccgacagcggatgtgtggtttcttggaaaaataaggaactcaagtgcggctccgggatcttcattacagataacgtgcacacgtggaccgagcagtacaaatttcaacctgaaagcccctccaagctggcttctgccatccagaaagctcatgaggaaggcatttgtggaatccggagcgtcacaagacttgagaatctgatgtggaagcagatcaccccggagctcaaccacattctgtccgaaaatgaggtgaaactgacaatcatgaccggcgacattaaggggatcatgcaggccggaaaacgctctcttcggcctcaacccacggaactcaagtatagctggaagacctggggcaaagcgaagatgctgtccacagagagccataaccagaccttcctgattgatgggcctgaaacagccgagtgccccaataccaacagagcttggaactctctcgaggttgaagactacggatttggcgtgttcacaaccaacatctggctgaaacttcgcgagaagcaggacgtcttttgtgattccaaactgatgagcgccgctatcaaggacaatcgggccgtgcacgcggatatgggctattggattgaatctgccctcaacgacacgtggaagatggagaaggctagcttcatcgaggttaagagctgccactggcctaaatctcatacactgtggagcaatggggtgctggaatccgagatgattatccccaagaacttcgccggaccggtcagccagcacaactacagacctggctatcatacccaaaccgctgggccctggcaccttggaaaactcgaaatggattttgacctgtgtgagggcacaaccgtggtggtcacggaagattgcgggaatcgcggaccctctctgcggacaaccacagcctccggcaagctcattaccgagtggtgctgtagaagctgcacactgcctccgcttcggtaccgcggcgaggacgggtgttggtacggaatggaaatcagacccctgaaggagaaagaagagaacctcgttaattccctggtgaccgccggccatgggcagattgataacttctctctgggagtgcttggcatggctctctttctggaagagatgctgcggacgagaatcgggaccaagcacgcgatcctcctggtcgccgtgagcttcgttacacttattaccggaaatatgtcctttcgcgacctgggccgggtgatggtcatggtgggcgctacaatgaccgatgacatcgggatgggagttacgtatctcgccctgctggccgctttcaaagtgagacctacatttgccgcgggccttctgctccgcaagctgacctctaaagagctcatgatggctacaattgggatcgccctgcttagccagtccaccattcccgaaaccatcctggagctcacagatgccctggctctgggaatgatggtccttaagatcgtgagaaacatggaaaagtaccaactggccgttacgattatggcgatctcttgcgtgcctaatgctgtcattctccagaacgcctggaaagtgagctgtaccatcctggccgctgtgtccgtcagccccctcctgcttacatcttcccagcagaaggccgactggattcctctggctctcaccatcaaaggcctgaatcccacagccatcttcctgaccacgcttagccggacatctaagaaacgctcctggccgctgaacgaggcgattatggccgttgggatggtgagcatcctcgcttcttccctgctcaagaatgacattcctatgaccggacccctggtggccggcggccttctgaccgtctgctatgtgctgacagggagaagcgctgatctcgaactggagcgggccgccgacgttaaatgggaggatcaagctgaaatctccggaagctctcctattcttagcatcaccatttccgaggacggctctatgagcatcaagaacgaagaggaggaacagacactgacgatcctcattcgcaccgggctgctcgtgatctccggagtctttcccgtgtctattccgatcacagcggccgcttggtacctgtgggaggttaagaaacagagagccggcgtgctttgggatgtcccttctccccctcccgtggaaaaggccgagctggaagacggggcttatcggattaaacagcgcggaatcctgggctactcccaaatcggcgccggggtctataaggagggaaccttccacacaatgtggcatgtgaccagaggcgcggttctcatgcaccgggggaaacgcattgagccctcctgggctgatgtgaagaaggacctgatcagctacggaggcgggtggaaacttgaaggagagtggaaggaaggcgaggaagtccaggtgctggccctcgagcctggcaaaaatccgagagccgttcagacgaagcccgggatttttaaaaccaacacaggaaccatcggcgctgtgtccctggatttcagccctgggacatctggatcccccattgtcgaccggaagggcaaggtggtggggctctacggaaatggcgttgtcaccagaagcggcgcctatgtgtctgcgatcgctcagacagagaaatccatcgaagataaccctgagattgaagacgatatctttcgcaagaaacggctgacgattatggaccttcatcccggggccggaaagaccaaaagatacctgcctgccatcgtgcgcgaggctattaagcggggcctgagaacactcatcctggccccgacccgcgtcgtggctgccgaaatggaggaggcgcttcgggggctgcccattagatatcaaacccctgccatcaagacagaacacacgggacgcgagatcgttgacctcatgtgtcatgctaccttcacaatgcggctgctcagccccgtgagagtccctaactacaatctgattatcatggatgaagcccacttcaccgaccccgcttccattgccgcccggggctatatctctacacgcgtggagatgggggaggctgcgggcatttttatgaccgccacgccgcctggaagcagagatcccttcccccagtccaacgctcctatcatggacgaagaacgggaaatccccgagcgcagctggaactctggccacgaatgggttacagattttaaagggaagaccgtgtggttcgtcccttccattaaagccggaaacgacatcgccgcttgccttagaaagaatggcaaaaaggtgattcagctgagccggaagacctttgattctgagtacgttaaaacaagagccaacgactgggatttcgtggtcaccacagacatcagcgagatgggggcgaattttaaggctgaacgcgtgattgatccgcggagatgtatgaaacccgtgatcctgaccgacggagaggaacgcgtcatcctcgccggccctatgcccgttacgcattcctctgccgctcaacggagagggcgcattggccggaaccctaagaatgagaacgaccagtatatctacatgggagaacccctggagaatgatgaggactgcgcccactggaaagaagcgaagatgcttctggataacattaatacaccggagggcatcattcctagcatgttcgaacccgagagagaaaaagtggacgccatcgatggggagtaccgcctcagaggagaggctcggaagacctttgtggacctgatgcgcagaggcgatctgcctgtctggctcgcctataaggtggctgccgaagggattaactacgctgaccggaaatggtgtttcgatggaatcaagaataaccagatccttgaggaaaacattgaggttgagatctggacaaaagaaggcgagcgcaagaaactgaagcccagatggctggacgcccggatttattccgatcctctcgcgctgaaggaatttaaagagttcgccgctgggagaaagtctcttaccctgaatctcatcacggaaatgggccgcctgcccaccttcatgacacagaaagcccggaacgctctggacaatctcgccgtgcttcataccgccgaggctggaggcagagcgtacaaccacgccctgagcgagctgccggaaacactcgagaccctgcttctgctcacactgctggctaccgtcacaggcgggatttttctcttccttatgtccgggaaggggatcggaaaaatgacactgggcatgtgctgcatcattaccgccagcatcctgctctggtatgcccaaattcagcctcactggatcgctgcctctattatcctggaatttttccttatcgtgctgctcattcccgagcccgaaaagcagcgcacccctcaggataatcaactgacatacgttgtgatcgcgattctgaccgtcgtggccgctacaatggccaacgagatgggctttctcgagaagacgaaaaaggaccttgggctgggatccatcaccacacaggaaagcgagtccaatattctggacatcgatctccggccggcttctgcctggaccctgtatgcggtcgccacaaccttcgtgacgcccatgcttagacatagcattgaaaactcctctgttaatgtgagcctgaccgctatcgccaaccaggctacagtgctcatgggcctggggaaaggatggcctctgtccaagatggacatcggcgtccccctccttgccattgggtgttacagccaggttaatcctatcaccctgacagctgccctgctcctgcttgtggcgcactacgccattatcggacccggcctgcaagctaaagccacccgggaggctcagaagcgcgccgccgcgggcattatgaagaaccctacggtggatgggatcacagtcatcgacctcgaaccgattccctatgatcctaaatttgagaagcagctgggacaggtgatgctgctcatcctttgcgttacccaagtgctgatgatgagaacaacctgggctctgtgtgaggccctcaccctggctacaggccccatttctacgctttgggaagggaatcctggacggttctggaacaccacaatcgccgtctccatggccaatatttttcgcggcagctacctggctggggccggactcctgttctctatcatgaaaaacaccacaaataccagacggggcacgggcaacatcggggagacactgggagaaaagtggaaatcccgcctcaacgcgcttggcaagagcgagtttcaggtgtataaaaagtctgggattcaggaggtcgacagaaccctggccaaggaaggaatcaaacggggcgagaccgatcatcacgctgtgagccgcgggtccgccaagctgagatggttcgttgaacggaatatggtgacacccgagggaaaagtcgtggacctcggctgcggcagagggggatggtcttactattgtggcgggctgaagaacgttcgcgaagtgaaaggacttaccaagggcgggccgggacatgaggagcctattcccatgagcacatacggctggaatctggtccggctccaatccggcgtggatgtgtttttcacgccccctgaaaagtgcgacaccctgctgtgtgatatcggggagagctcccccaaccctacaattgaagctggaagaaccctccgcgttcttaatctggtcgagaactggctgaataacaatacacagttctgcatcaaagtgctcaacccgtatatgccctctgtgatcgaaaagatggaggccctgcagcggaaatacggcggggcgcttgtcagaaatcctctgagccgcaactccacccacgagatgtactgggtttctaatgccacgggaaacattgtgagctccgtgaatatgatctctcggatgctcattaacagatttaccatgaagcacaaaaaggctacatatgaacccgacgtcgatctgggcagcgggacccgcaacatcggaattgagtccgaaatccctaatctggacattatcggcaagcggatcgagaaaattaagcaggaacatgagacaagctggcactacgaccaagatcatccctataaaacctgggcctaccacggctcttatgagacaaagcagaccgggtccgctagctctatggtgaacggagttgtgagactccttacgaaaccgtgggacgtcgtgcctatggttacacagatggccatgaccgataccacacccttcggccagcaacgcgtgtttaaggaaaaggtcgacacgcggacccaggagcctaaagaagggacaaagaaactgatgaagatcaccgctgagtggctgtggaaagagctcggaaagaaaaagacacccagaatgtgtacccgcgaagagttcacaagaaaggtgcggtccaatgccgcgctgggcgccatttttaccgatgaaaacaaatggaaaagcgctcgcgaggccgtggaagacgggagattctgggagcttgtcgatcgggagagaaatctgcacctcgaaggaaaatgcgagacgtgtgtttacaacatgatgggcaagcgggagaaaaagctgggcgagtttgggaaggctaaaggatctcgcgccatctggtatatgtggctgggcgccagattcctcgaatttgaggcgctggggttccttaatgaggaccattggttttcccggggaaacagcctgtccggcgtggaaggggagggcctccaccgcctgggatacattcttagagatgtgggcaagaaagaagggggagctatgtacgccgacgataccgccggctgggacacacggatcaccctggaggacctcaagaatgaagagatggtcacaaaccatatgaaaggggagcacaagaagctggctgaagccatcttcaaactgacctatcagaataaggtggttcgcgtgcagagacctacgccccggggaacagtcatggatattatcagccgcagagaccaacggggctctggacaggtgggcacctacggactcaacacatttaccaatatggaggctcagctgattcgccaaatggaaggcgaggggatcttcaaaagcattcagcatcttacggccaccgaggaaatcgcggttcagaactggctggccagagtgggacgggagcgcctctccagaatggctatctctggcgatgactgcgtcgtgaagccgattgatgaccggttcgccagcgctctgacagcccttaatgatatggggaaagttagaaaggacatccagcaatgggaaccttcccgcggatggaacgattggacccaggtgcccttttgctctcaccacttccatgagctggtcatgaaggacggccgggtgctcgtcgtgccctgtagaaaccaggatgaactgattgggcgcgcgcggatcagccagggcgccggatggtccctgaaagagacagcttgcctcggcaagtcttatgcccaaatgtggaccctgatgtactttcacagacgcgaccttcggctggctgccaatgctatttgtagcgccgttcctccgcattgggtgcccacatccagaaccacgtggagcatccacgcgaaacacgagtggatgacaaccgaagatatgctcgccgtctggaaccgcgtgtggattcaggagaatccttggatggaagacaagacccccgtggagtcttgggaagaggttccttatctggggaaacgggaggaccagtggtgcggatcccttatcggcctgacaagcagagctacctgggccaagaacatccagacagccattaatcaagtgcgctctctcatcgggaacgaagagtacacggattatatgccctccatgaagcggttcagacgggaagaggaagaggctggagtcctgtggtga

SEQ ID NO: 19724 - RNA, 9876 nt, synthetic construct
  misc_feature 1..9876: note = derived and/or modified CDS sequence (opt5) from DENV-2__GQ199894__SS-prME
  source 1..9876: mol_type = other RNA
accgccggcgtgatcgtcatgctgattcccacggctatggccttccacctcacgaccagaaatggggagcctcatatgatcgttggacggcaggaaaagggcaaaagcctgctttttaagacagaggacggggtgaatatgtgcaccctgatggcgattgatctcggagaactgtgtgaggacacaatcacctacaaatgcccgcttctgcgccaaaacgaacccgaggatattgactgttggtgcaattccacatctacctgggtgacgtatggcacctgtacaaccacaggggagcacagacgggaaaagcgcagcgtcgctctcgtgcctcatgttggaatgggcctggagaccagaacggaaacatggatgtcctctgagggcgcctggaaacacgtgcagcggatcgagacctggatcctgcgccatcccgggttcacaattatggccgctatcctcgcctacaccattggaaccacacactttcagaaggctctgatcttcattcttctgacggccgtcgcgcctagcatgaccatgagatgcatcggcatttccaaccgggattttgtggaaggggtttctggaggcagctgggtggacatcgtcctcgagcacgggtcctgtgtgacaaccatggccaagaataaacccacactggatttcgaacttatcaagaccgaggctaaacagcctgccacgctgcgcaagtattgcattgaagctaaactcacaaacaccaccacagagagcagatgtccgacccaaggagagccctctctgaatgaggaacaggacaagcggtttatctgcaagcattccatggtggatcgcggctggggcaacgggtgtggactgttcggcaaagggggaattgtcacatgcgccatgtttacgtgcaagaaaaatatggaaggcaaggttgtgcagcctgagaacctcgaatacaccatcgtgattacaccccacagcggggaggagcatgcggtcggaaatgacaccggcaaacacggcaaggaaatcaaaatcacacctcagtcttccattaccgaggccgaactgacggggtatggaaccgtgacaatggagtgtagccccagaaccggccttgatttcaacgaaatggttctgctccaaatggaggacaaggcttggctggtgcaccggcagtggtttcttgatctgccgctcccttggctgcccggggccgacacacagggatctaattggatccagaaggagaccctggtcacgttcaaaaaccctcatgctaagaaacaagacgtggttgtgctcggctcccaggaaggggccatgcacacagccctgaccggcgctacagagattcagatgagctccggaaatcttctgtttaccggccatctcaagtgccgcctgagaatggataaacttcaactgaaggggatgtcttacagcatgtgtaccggaaagttcaaaatcgtcaaggaaattgcggagacacagcacggcacgatcgtgatccgggtccagtatgagggggacggatccccctgcaaaattcccttcgaaatcaccgatctcgagaagagacatgtgctgggccgcctgattacagttaaccctatcgtgaccgaaaaagacagcccggtcaacattgaggccgaacccccttttggggattcttacatcattatcggcgtggagcccggacagctcaagctgaattggttcaagaaaggctccagcatcgggcaaatgtttgagacaaccatgcggggagctaagagaatggccattcttggcgacacggcctgggatttcgggtctctgggaggcgtttttacaagcatcgggaaagctctccaccaggtgttcggcgccatttacggagcggctttttccggcgtctcttggaccatgaagatcctgattggggtgatcatcacctggattggaatgaacagccgctccacaagcctgtctgtgtcccttgttctcgtcggcgtggtgaccctgtatctgggggccatggtccaggccgacagcggatgtgtggtttcttggaaaaataaggaactcaagtgcggctccgggatcttcattacagataacgtgcacacgtggaccgagcagtacaaatttcaacctgaaagcccctccaagctggcttctgccatccagaaagctcatgaggaaggcatttgtggaatccggagcgtcacaagacttgagaatctgatgtggaagcagatcaccccggagctcaaccacattctgtccgaaaatgaggtgaaactgacaatcatgaccggcgacattaaggggatcatgcaggccggaaaacgctctcttcggcctcaacccacggaactcaagtatagctggaagacctggggcaaagcgaagatgctgtccacagagagccataaccagaccttcctgattgatgggcctgaaacagccgagtgccccaataccaacagagcttggaactctctcgaggttgaagactacggatttggcgtgttcacaaccaacatctggctgaaacttcgcgagaagcaggacgtcttttgtgattccaaactgatgagcgccgctatcaaggacaatcgggccgtgcacgcggatatgggctattggattgaatctgccctcaacgacacgtggaagatggagaaggctagcttcatcgaggttaagagctgccactggcctaaatctcatacactgtggagcaatggggtgctggaatccgagatgattatccccaagcacttcgccggaccggtcagccagcataactacagacctggctatcacacccaaaccgctgggccctggcatcttggaaaactcgaaatggattttgacctgtgtgagggcacaaccgtggtggtcacggaagattgcgggaaccgcggaccctctctgcggacaaccacagcctccggcaagctcattaccgagtggtgctgtagaagctgcacactgcctccgcttcggtaccgcggcgaggacgggtgttggtacggaatggaaatcagacccctgaaggagaaagaagagaatctcgttaactccctggtgaccgccggccacgggcagattgataatttctctctgggagtgcttggcatggctctctttctggaagagatgctgcggacgagaatcgggaccaagcacgcgatcctcctggtcgccgctagcttcgtgacacttattaccggaaacatgtcctttcgcgacctgggccgggttatggtgatggtcggcgccacaatgaccgatgacatcgggatgggagtgacgtatctcgccctgctggctgccttcaaagttagacctacatttgcggctggccttctgctccgcaagctgacctctaaagagctcatgatggccacaattgggatcgccctgcttagccagtccaccattcccgaaaccatcctggagctcacagatgctctggccctgggaatgatggtgcttaagatcgtcagaaatatggaaaagtaccaactggcggtgacgattatggctatctcttgcgttcctaacgccgtgattctccagaatgcctggaaagtcagctgtaccatcctggctgccgtgtccgtgagccccctcctgcttacatcttcccagcagaaggctgactggattcctctggccctcaccatcaaaggcctgaaccccacagcgatcttcctgaccacgcttagccggacatctaagaaacgctcctggccgctgaatgaggccattatggctgtcgggatggttagcatcctcgcctcttccctgctcaagaacgacattcctatgaccggacccctggtggctggcggccttctgaccgtgtgctatgtcctgacagggagaagcgccgatctcgaactggagcgggccgctgacgtgaaatgggaggatcaagcggaaatctccggaagctctcctattcttagcatcaccatttccgaggacggctctatgagcatcaagaatgaagaggaggaacagacactgacgatcctcattcgcaccgggctgctcgttatctccggagtgtttcccgtctctattccgatcacagccgctgcctggtacctgtgggaggtgaagaaacagagagccggcgttctttgggatgtgccttctccccctcccgtcgaaaaggctgagctggaagacggggcctatcggattaaacagcgcggaatcctgggctactcccaaatcggcgcgggggtgtataaggagggaaccttccatacaatgtggcacgtcaccagaggcgctgtgctcatgcatcgggggaaacgcattgagccctcctgggccgatgttaagaaggacctgatcagctacggaggcgggtggaaacttgaaggagagtggaaggaaggcgaggaagtgcaggtcctggccctcgagcctggcaaaaacccgagagctgtgcagacgaagcccgggatttttaaaaccaatacaggaaccatcggcgccgtttccctggatttcagccctgggacatctggatcccccattgtggaccggaagggcaaggtcgtggggctctacggaaacggcgtggttaccagaagcggcgcgtatgtctctgctatcgcccagacagagaaatccatcgaagataatcctgagattgaagacgatatctttcgcaagaaacggctgacgattatggaccttcaccccggggccggaaagaccaaaagatacctgcctgctatcgtgcgcgaggccattaagcggggcctgagaacactcatcctggctccgacccgcgtggtcgccgcggaaatggaggaggcccttcgggggctgcccattagatatcaaacccctgctatcaagacagaacatacgggacgcgagatcgtggacctcatgtgtcacgccaccttcacaatgcggctgctcagccccgttagagtgcctaactacaacctgattatcatggatgaagctcacttcaccgaccccgcctccattgccgctcggggctatatctctacacgcgtcgagatgggggaggcggccggcatttttatgaccgctacgccgcctggaagcagagatcccttcccccagtccaatgcccctatcatggacgaagaacgggaaatccccgagcgcagctggaactctggccatgaatgggtgacagattttaaagggaagaccgtttggttcgtgccttccattaaagccggaaatgacatcgctgcctgccttagaaagaacggcaaaaaggtcattcagctgagccggaagacctttgattctgagtacgtgaaaacaagagcgaatgactgggatttcgttgtgaccacagacatcagcgagatgggggctaactttaaggccgaacgcgtcattgatccgcggagatgtatgaaacccgtgatcctgaccgacggagaggaacgcgtgatcctcgccggccctatgcccgtcacgcactcctctgctgcccaacggagagggcgcattggccggaatcctaagaacgagaatgaccagtatatctacatgggagaacccctggagaacgatgaggactgcgcgcattggaaagaagccaagatgcttctggataatattaacacaccggagggcatcattcctagcatgttcgaacccgagagagaaaaagttgacgctatcgatggggagtaccgcctcagaggagaggcccggaagacctttgtggacctgatgcgcagaggcgatctgcctgtgtggctcgcttataaggtcgccgctgaagggattaattacgccgaccggaaatggtgtttcgatggaatcaagaacaatcagatccttgaggaaaacattgaggtggagatctggacaaaagaaggcgagcgcaagaaactgaagcccagatggctggacgcgcggatttattccgatcctctcgccctgaaggaatttaaagagttcgctgccgggagaaagtctcttaccctgaacctcatcacggaaatgggccgcctgcccaccttcatgacacagaaagctcggaatgccctggacaacctcgccgttcttcacaccgctgaggcgggaggcagagcctacaatcacgctctgagcgagctgccggaaacactcgagaccctgcttctgctcacactgctggccaccgtgacagggggaatttttctcttccttatgtccggcaaggggatcggaaaaatgacactgggcatgtgctgcatcattaccgccagcatcctgctctggtatgctcaaattcagcctcattggatcgccgcgtctattatcctggaatttttccttatcgtcctgctcattcccgagcccgaaaagcagcgcacccctcaggataaccaactgacatacgtggttatcgccattctgaccgtggtcgctgccacaatggctaatgagatgggctttctcgagaagacgaaaaaggaccttgggctgggatccatcaccacacaggaaagcgagtccaacattctggacatcgatctccggccggcctctgcgtggaccctgtatgccgtggctacaaccttcgtcacgcccatgcttagacacagcattgaaaattcctctgtgaacgttagcctgaccgccatcgctaatcaggccacagtgctcatgggcctggggaaaggatggcctctgtccaagatggacatcggcgtgcccctccttgctattgggtgttacagccaggtcaaccctatcaccctgacagccgcgctgctcctgcttgttgcccattacgctattatcggacccggcctgcaagccaaagctacccgggaggcccagaagcgcgccgcggctggcattatgaagaatcctacggtggatgggatcacagtgatcgacctcgaaccgattccctatgatcctaaatttgagaagcagctgggacaggtcatgctgctcatcctttgcgtgacccaagttctgatgatgagaacaacctgggccctgtgtgaggctctcaccctggccacaggccccatttctacgctttgggaagggaaccctggacggttctggaataccacaatcgccgtgtccatggctaacatttttcgcggcagctacctggccggggcgggactcctgttctctatcatgaaaaataccacaaacaccagacggggcacgggcaatatcggggagacactgggagaaaagtggaaatcccgcctcaacgcccttggcaagagcgagtttcaggtctataaaaagtctgggattcaggaggtggacagaaccctggctaaggaaggaatcaaacggggcgagaccgatcaccatgccgtcagccgcgggtccgctaagctgagatggttcgtggaacggaacatggttacacccgagggaaaagtggtcgacctcggctgcggcagagggggatggtcttactattgtggcgggctgaagaatgtgcgcgaagttaaaggacttaccaagggcgggccgggacacgaggagcctattcccatgagcacatacggctggaacctggtgcggctccaatccggcgtcgatgtgtttttcacgccccctgaaaagtgcgacaccctgctgtgtgatatcggggagagctcccccaatcctacaattgaagccggaagaaccctccgcgtgcttaacctggttgagaattggctgaacaataacacacagttctgcatcaaagtcctcaatccgtatatgccctctgtgatcgaaaagatggaggcgctgcagcggaaatacggcggggcccttgtgagaaaccctctgagccgcaattccacccacgagatgtactgggtctctaacgctacgggaaatattgttagctccgtgaacatgatctctcggatgctcattaatagatttaccatgaagcataaaaaggccacatatgaacccgacgtggatctgggcagcgggacccgcaacatcggaattgagtccgaaatccctaacctggacattatcggcaagcggatcgagaaaattaagcaggaacacgagacaagctggcattacgaccaagatcacccctataaaacctgggcttaccacggctcttatgagacaaagcagaccgggtccgccagctctatggtcaatggagtggttagactccttacgaaaccgtgggacgtggtccctatggtgacacagatggctatgaccgataccacacccttcggccagcaacgcgtttttaaggaaaaggtggacacgcggacccaggagcctaaagaagggacaaagaaactgatgaagatcaccgccgagtggctgtggaaagagctcggaaagaaaaagacacccagaatgtgtacccgcgaagagttcacaagaaaggtccggtccaacgcggccctgggcgctatttttaccgatgaaaataaatggaaaagcgcccgcgaggctgtggaagacgggagattctgggagcttgtggatcgggagagaaacctgcatctcgaaggaaaatgcgagacgtgtgtctacaatatgatgggcaagcgggagaaaaagctgggcgagtttgggaaggccaaaggatctcgcgccatctggtatatgtggctgggcgcgagattcctcgaatttgaggctctggggttccttaacgaggaccactggttttcccggggaaatagcctgtccggcgttgaaggggagggcctccatcgcctgggatacattcttagagatgtgggcaagaaagaagggggagccatgtacgccgacgataccgctggctgggacacacggatcaccctggaggacctcaagaacgaagagatggtgacaaatcacatgaaaggggagcataagaagctggccgaagctatcttcaaactgacctatcagaacaaggtcgtgcgcgttcagagacctacgccccggggaacagtgatggatattatcagccgcagagaccaacggggctctgggcaggtcggcacctacggactcaatacatttaccaacatggaggcccagctgattcgccaaatggaaggcgaggggatcttcaaaagcattcagcaccttacggcgaccgaggaaatcgccgtgcagaattggctggctagagttggacgggagcgcctctccagaatggccatctctggcgatgactgcgtggtcaagccgattgatgaccggttcgctagcgccctgacagcgcttaacgatatggggaaagtgagaaaggacatccagcaatgggaaccttcccgcggatggaatgattggacccaggttcccttttgctctcaccatttccacgagctggtgatgaaggacggccgggtcctcgtggtcccctgtagaaaccaggatgaactgattgggcgcgcccggatcagccagggcgctggatggtccctgaaagagacagcctgcctcggcaagtcttatgctcaaatgtggaccctgatgtactttcatagacgcgaccttcggctggccgctaacgccatttgtagcgcggtgcctccgcactgggttcccacatccagaaccacgtggagcatccacgccaaacatgagtggatgacaaccgaagatatgctcgctgtgtggaatcgcgtctggattcaggagaacccttggatggaagacaagacccccgtggagtcttgggaagaggtgccttatctggggaaacgggaggaccagtggtgcggatcccttatcggcctgacaagcagagccacctgggccaagaatatccagacagctattaaccaagttcgctctctcatcgggaatgaagagtacacggattatatgccctccatgaagcggttcagacgggaagaggaagaggccggagtgctgtggtga

SEQ ID NO: 19725 - RNA, 9876 nt, synthetic construct
  misc_feature 1..9876: note = derived and/or modified CDS sequence (opt5) from DENV-2__FJ898439__SS-prME
  source 1..9876: mol_type = other RNA
accgccggagtcatcgtcatgctgattcccaccgctatggccttccacctcacgacccggaatggggagcctcatatgatcgttggacggcaggaaaagggcaagtccctgctttttaagacagaggacggggtgaatatgtgcaccctgatggcgattgatctcggagaactgtgtgaggacacaatcacctacaagtgcccgcttctgcgccaaaatgaacccgaggatattgactgttggtgcaattccacatctacctgggtgacgtatggcacctgtagcacaaccggggagcaccggcgggaaaagcgctccgtcgctctcgtgcctcatgttggaatgggcctggagacacggaccgaaacgtggatgtctagcgagggcgcctggaaacacgtgcagcggatcgagacatggatcctgcgccatcccgggttcaccattatggccgctatcctcgcctacacaattggaaccacccactttcagagagctctgatcttcattcttctgacagccgtcgcgccttccatgacgatgcggtgcatcggcatttctaaccgcgattttgtggaaggggttagcggaggctcctgggtggacatcgtcctcgagcacgggagctgtgtgaccacaatggccaagaataagcccaccctggatttcgaacttatcaaaacagaggctaagcagcctgccaccctgagaaaatattgcattgaagctaagctcacgaacacaaccaccgagtctcggtgtccgacacaaggagagccctccctgaatgaagaacaggacaaacgctttatctgcaagcatagcatggtggatagaggctggggcaacgggtgtggactgttcggcaaagggggaattgtgacctgcgccatgtttacatgcaaaaagaatatggaaggcaaagttgtgcagcctgagaacctcgaatacacgatcgtgattacaccccactctggggaggagcatgcggtcggaaatgacacaggcaagcacggcaaagaaatcaagatcacccctcagtccagcattacagaggccgaactgaccgggtatggaacggtgaccatggagtgttctccccggacaggccttgatttcaacgaaatggttctgctccaaatggaggacaaggcttggctggtgcaccgccagtggtttcttgatctgccgctcccttggctgcccggggccgacacccagggatccaattggatccagaaggagacactggtcaccttcaagaaccctcatgctaaaaagcaagacgtggttgtgctcggcagccaggaaggggccatgcacacggccctgacaggcgctaccgagattcagatgtcctctggaaatcttctgtttacaggccatctcaaatgcagactgcggatggataaacttcaactgaaagggatgagctactccatgtgtaccggaaagttcaagatcgtcaaagaaattgcggagacccagcacggcacaatcgtgatcagagtccagtatgagggggacggaagcccctgcaagattcccttcgaaatcacggatctcgagaaacgccatgtgctgggccggctgattaccgttaaccctatcgtgacagggaaggactctccggtcaacattgaagccgagcccccttttggcgattcctacatcattatcggagtggaacccggccagctcaaactgaattggttcaagaaggggagctctatcggacaaatgtttgagaccacaatgagaggcgctaaacgcatggccattcttggggacaccgcctgggatttcggaagcctgggcggggtttttacgtccatcggcaaggctctccaccaggtgttcggagccatttacggcgcggctttttctggggtcagctggacaatgaaaatcctgattggagtgatcatcacctggattggcatgaactcccggagcacctctctgtccgtgagccttgttctcgtcggggtggtgacactgtatctgggagccatggtccaggccgactctggctgtgtggtttcctggaagaataaagagctcaagtgcgggagcggcatcttcattaccgataacgtgcacacatggacggaacagtacaagtttcaacctgagtccccctctaaactggctagcgccatccagaaggctcatgaagagggaatttgtggcatcagatccgtcacccgccttgaaaatctgatgtggaaacagatcacaccggagctcaaccacattctgtctgagaatgaagtgaagctgaccatcatgacaggggacattaaaggaatcatgcaggccggcaagcggagccttagacctcaacccaccgagctcaaatattcctggaagacgtgggggaaggcgaaaatgctgagcaccgaatctcataaccagacattcctgattgatggacctgagaccgccgaatgccccaatacaaaccgcgcttggaactccctcgaggttgaggactacggctttggcgtgttcaccacaaacatctggctgaaacttcgggaaaaacaggacgtcttttgtgatagcaagctgatgtctgccgctatcaaagacaatagagccgtgcacgcggatatggggtattggattgagtccgccctcaacgacacctggaagatggaaaaggctagcttcatcgaggttaaatcttgccactggcctaagagccatacgctgtggtccaatggagtgctggagagcgaaatgattatccccaaaaacttcgccggcccggtctctcagcacaactaccgccctgggtatcatacacaaaccgctggaccctggcaccttggcaagctcgagatggattttgacctgtgtgaagggaccacagtggtggtcaccgaggattgcggaaatcggggcccctccctgagaacgacaaccgccagcggcaaactcattacagaatggtgctgtcggtcctgcaccctgcctccgcttcgctacagaggggaggacggatgttggtacggcatggagatccggcccctgaaggaaaaggaggaaaacctcgttaattctctggtgacagccgggcatggacaggtggataacttcagcctgggcgtccttgggatggctctctttctggaggaaatgctgagaacccgcattggaacgaaacacgcgatcctcctggtggccgcttccttcgttacccttatcacaggcaatatgtcttttcgggacctgggcagagtgatggtcatggtgggggccaccatgacagatgacattggaatgggcgttacctatctcgccctgctggctgccttcaaggtgcgccctacgtttgcggctgggcttctgctcagaaaactgacaagcaaggagctcatgatggccaccatcggaattgccctgctttcccagtctacaatccccgagaccattctggaactcaccgatgctctggccctgggcatgatggtccttaaaatcgtgcggaacatggagaagtaccaactggcggttacaatcatggctattagctgcgtgcctaatgccgtcatcctccagaacgcctggaaggtgtcctgtacgattctggctgccgtgagcgtctctcccctcctgcttacctccagccagcagaaagctgactggatccctctggccctcacaattaaggggctgaatcccaccgcgatcttcctgacaaccctttctcgcacgtccaaaaagagaagctggccgctgaacgaagccgttatggctgtgggaatggtgtctatcctcgcctccagcctgctcaaaaatgacattcctatgacaggccccctggtcgctggcgggcttctgaccgtgtgctatgttctgaccggacggtccgccgatctcgagctggaacgcgccgctgacgtgaagtgggaggatcaagcggagatcagcggctctagccctattctttccatcacaatttctgaagacgggagcatgtccatcaaaaacgaggaagaggagcagaccctgacaattctcatcagaacgggactgctcgtcatctctggcgtgtttcccgttagcattccgatcaccgccgctgcctggtacctgtgggaagtgaagaagcagcgggccggggtcctttgggatgtgccttctccccctcccgtcgagaaagctgaactggaggacggagcctatcgcattaagcagagaggcatcctgggctacagccaaattggggcgggagtgtataaagaaggcacattccacaccatgtggcatgttacaagaggggctgtgctcatgcaccgcggaaagagaatcgagcccagctgggccgatgtcaaaaaggacctgatctcctacggcgggggatggaaacttgagggcgaatggaaagagggcgaagaggtgcaggttctggccctcgaacctgggaagaatccgcgggctgtgcagaccaaacccggaatttttaagacgaacaccggcacaatcggggccgtcagcctggatttctctcctggaacctccggcagccccattgtggacagaaaagggaaggtggttggactctacggcaatggcgtcgtgacacgctctggggcgtatgtgtccgctatcgcccagaccgaaaagagcattgaggataaccctgaaatcgaggacgatatctttcggaaaaagagactgacaattatggaccttcatcccggagccggcaaaacgaagcgctacctgcctgctatcgtccgggaagccattaaaagagggctgcgcaccctcatcctggctccgacacgggtggttgccgcggagatggaagaggcccttagaggactgcccattcgctatcaaacccctgctatcaagaccgagcacacaggccgggaaattgtggacctcatgtgtcatgccacgttcaccatgagactgctctcccccgtccgggtgcctaactacaatctgatcatcatggatgaggctcacttcacagaccccgcctctattgccgctcgcgggtatatcagcaccagagttgaaatgggcgaggcggccggaatttttatgacagctaccccgcctggctcccgggatcccttcccccagagcaacgcccctatcatggacgaggaacgcgagattcccgaaagatcttggaactccgggcacgagtgggtgacggattttaagggaaaaacagtctggttcgtgcctagcatcaaggccggcaacgacatcgctgcctgccttcggaaaaatgggaagaaagttattcagctgtctagaaagacctttgatagcgaatacgtgaagacccgcgcgaacgactgggatttcgtcgtgacaaccgacatctccgagatgggagctaattttaaagccgagcgggtgattgatccgagacgctgtatgaagcccgtcatcctgacagacggcgaagaacgggttattctcgccgggcctatgcccgtgacccattctagcgctgcccaaagacgcggccggatcggaagaaaccctaaaaatgaaaacgaccagtatatctacatgggcgagcccctggaaaatgatgaggactgcgcgcactggaaggaggccaaaatgcttctggataacattaatacgccggaagggatcattccttccatgttcgagcccgaacgcgagaaggtggacgctatcgatggagaatacagactccggggcgaggcccgcaaaacatttgtcgacctgatgagaagaggggatctgcctgtgtggctcgcttataaggttgccgctgagggaattaactacgccgaccgcaagtggtgtttcgatggcatcaaaaataaccagattcttgaagagaacatggaagtggagatctggaccaaggagggggaacgcaagaagctgaaaccccggtggctggacgcgagaatctattctgatcctctcgccctgaaggagtttaaggagttcgctgccggccgcaaaagccttacactgaatctcattaccgagatgggacggctgcccacgttcatgacccagaaggctagaaacgccctggacaatctcgccgtccttcatacagctgaaaccggcgggaaagcgtacaaccacgccctgtccgagctgccggagacactcgaaaccctgcttctgctcacactgctggctaccgtgacgggaggcatctttctcttccttatgagcgggaagggaattggcaaaatgacactgggcatgtgctgcatcattaccgcctctatcctgctctggtatgcccaaatccagcctcactggattgctgcctccatcattctggagtttttccttatcgttctgctcattcccgaacccgagaagcagcgcacccctcaggataatcaactgacatacgtggtcatcgcgatcctgaccgtggtcgccgctacaatggccaacgaaatggggtttctcgagaagacgaaaaaggaccttggattcggcagcattaccacacaggagtccgaatctaatatcctggacattgatctgcggccggctagcgcctggaccctctatgcggtggccacaacctttgttacgcccatgctgagacattccatcgagaactctagcgtgaatgtgtcccttaccgctattgccaaccaggctacagtcctgatggggctcggaaaaggctggcctctgagcaagatggacatcggggttcccctgctcgccattggatgttactctcaggtgaatcctatcacccttacagctgccctgctgctcctggtggcgcactacgccatcgtcggccccggccttcaagctaaagccacccgggaagctcagaagcgcgccgccgcggggattatgaagaaccctacggtggatggaatcacagttattgacctggagccgatcccctatgatcctaaattcgaaaagcagctcggccaggtgatgctgctgattctctgcgtcacccaagtgcttatgatgagaacaacctgggctctgtgtgaggccctgaccctcgctacagggcccatctccacgctgtgggagggaaatcctggccggttttggaacaccacaatcgccgtcagcatggccaatattttccgcgggtcttaccttgctggagccggcctgctcttttccatcatgaaaaacaccacaaataccagacggggcacggggaacattggagaaacactgggcgagaagtggaaaagccgcctgaacgcgctcgggaagtctgagttccagatctataaaaagagcggcattcaggaggtggacagaacccttgccaaggagggcatcaaaagaggggaaaccgatcatcacgctgtttcccgcggatctgccaagctgagatggtttgtggagcggaatatggtcacacccgaaggcaaagtggttgacctgggctgcgggagaggaggctggagctactattgtgggggactcaagaacgtgcgcgaggtcaaaggcctgaccaaagggggaccgggccatgaagaacctatccccatgtccacatacggctggaatcttgtgcggctgcaaagcggggtggatgttttcttcacgccccctgagaagtgcgacaccctcctgtgtgatattggagaatcctctcccaaccctacaatcgaggctggcagaaccctgcgcgtcctcaatcttgtggaaaactggctgaataacaatacacagttttgcattaaagtgctgaacccgtatatgcccagcgtcatcgagaagatggaaaccctccagcggaaatacgggggagccctggttagaaatcctctttcccgcaactctacgcacgagatgtactgggtgagcaatgcgaccggcaacattgtgtcctctgtcaatatgatcagccggatgctgatcaacagattcacaatgaagcacaaaaaggccacctatgagcccgacgtggatctcgggtccggaacacgcaacattggcatcgaaagcgagattcctaatctggacatcattggcaagcggatcgagaagattaagcaggagcatgaaacctcttggcactacgaccaagatcatccctataaaacatgggcttaccacgggtcctatgagaccaagcagacgggaagcgcctcttccatggttaacggcgtggtcagactgctcacaaaaccgtgggacgtggttcctatggtgacccagatggctatgaccgatacaacgccctttgggcagcaacgcgtcttcaaggagaaggtggacacccggacacaggaacctaaagagggaaccaagaaacttatgaagatcacagccgaatggctgtggaaagagctgggcaagagaaaaacccccagaatgtgtacaagagaggaatttacccggaaggtgcgcagcaatgctgccctcggggcgatcttcacggatgagaacaagtggaaatctgccagagaagctgtcgaggacggacggttttgggaactggttgatagagagcggaatcttcacctggagggcaagtgcgaaacctgtgtgtacaacatgatgggcaaacgcgagaagaaactcggggagttcggaaaggccaagggctccagagctatttggtatatgtggctgggggcccggtttctggagttcgaagccctcggatttctgaatgaggaccattggttcagccgcggcaactcccttagcggggtggagggcgaaggactgcacagactcggctacatcctgcgggatgtcgggaaaaaggagggaggcgcgatgtacgctgacgatacagccgggtgggacacccgcattacacttgaagacctgaaaaatgaggaaatggtgaccaaccatatgaagggagagcacaaaaagctcgccgaggctatctttaagctgacgtatcagaataaagttgtgagagtccagcggcctacaccccgcggcaccgtgatggatattatctctagacgggaccaacgcgggagcggccaggttggaacatacggcctgaacaccttcacgaatatggaagcccagctcatcagacaaatggagggggaaggaattttcaagtccatccagcatctgaccgctacagaggaggtggccgtccagaactggcttgcgcgggtgggccgcgaaagactgtctcggatggccattagcggggatgactgcgttgtgaaaccgatcgatgacagatttgcttccgccctcaccgctctgaatgatatgggaaaggtccgcaaagacattcagcaatgggagccttctcggggctggaacgattggacacaggtgcccttctgcagccaccactttcatgaacttgtcatgaaggacgggagagtgctggttgtgccctgtcgcaaccaggatgagctcatcggccgggccagaatctcccagggagcgggctggtctctgaaggaaaccgcctgcctggggaaaagctatgctcaaatgtggacactcatgtacttccaccgccgggacctgagacttgccgctaatgccatttgttccgctgtccctagccattgggtgccgacctctcgcacgacatggtccatccacgccaagcacgagtggatgaccaccgaggatatgctggcggtgtggaaccgggtttggattcaggaaaatccctggatggaggacaaaacacctgtggaaagctgggaggaagtcccctatctcggaaagagagaggaccagtggtgcggctctctgatcgggcttacctcccgcgccacatgggctaaaaacattcagacggccatcaatcaagtgcggagcctgattggaaacgaggaatacaccgattatatgccttccatgaagagatttcggagagaggaagaggaagccggcgttctctggtga

SEQ ID NO: 19726 - RNA, 9876 nt, synthetic construct
  misc_feature 1..9876: note = derived and/or modified CDS sequence (opt5) from DENV-2__GQ868588__SS-prME
  source 1..9876: mol_type = other RNA
accgccggcatgatcattatgctgatccccaccgtgatggctttccacctgacgacccggaacggggagcctcatatgattgtcagccggcaggaaaagggaaagtccctgcttttcaagaccaaggacggcaccaatatgtgcacactgatggccctcgatctgggggagctttgtgaagacaccatcacatacaagtgcccgttcctgaaacaaaacgagcccgaagatattgactgttggtgcaattctaccagcacgtgggttacctatggaacatgtaccacaaccggcgagcacagaagagagaagcggtccgtggcgctcgtgcctcatgtcgggatgggactggaaacgcgcacagagacctggatgtctagcgaaggcgcttggaagcacgcccagagaatcgagacatggatcctgcggcatcccggctttaccattatggccgctatcctcgcctacaccattgggacaacgcacttccagcgcgtgctgatctttattcttctgaccgctatcgccccttccatggcgatgagatgcattggaatctctaaccgggatttcgttgagggcgtgagcgggggatcctgggtcgacatcgtgctcgaacacggcagctgtgttacaaccatggccaaaaataagcccacactggattttgagcttattaaaaccgaagctaagcagcctgccacgctgcgcaaatattgcatcgaggctaagctcacaaacaccaccacagactctagatgtccgacccaaggggaacccacactgaatgaggagcaggataagcggttcgtgtgcaaacattccatggtcgaccgcggatggggcaacggctgtgggctgtttggaaagggcgggattgtgacgtgcgccatgtttacctgcaaaaagaatatggaaggaaaaatcgtgcagcctgagaacctcgaatacacagtcgttattacaccccacagcggcgaggaacatgcggtggggaatgatacaggaaagcacggcaaagaggtgaagatcacccctcagtcttccatcacggaggccgaactgaccggctatgggacagtcaccatggagtgtagccccagaacaggacttgactttaacgaaatggtgctgctccaaatggaggataaggcttggctggttcaccggcagtggttccttgacctgccgctcccttggctgcccggcgccgacacccaggggtctaattggattcagaaagaaacgctggtgacatttaagaaccctcatgctaaaaagcaagatgtcgtggttctcggatcccaggagggcgccatgcacaccgccctgacaggggctaccgagatccagatgagctccggcaatcttctgttcaccggacatctcaaatgccgcctgagaatggacaaacttcaactgaagggcatgtcttacagcatgtgtacagggaaattcaagattgtgaaagaaatcgcggagacgcagcacggaaccattgtcatccgggtgcagtatgaaggcgatgggtccccctgcaagatcccctttgagattatggacctcgagaaaagacatgtcctgggacgcctgatcacagtgaaccctattgttaccgaaaaggatagcccggtgaacatcgaggccgaaccccctttcggcgactcttacattatcattggggtcgagcccggccagctcaagctggattggtttcggaaaggatccagcatcggccaaatgttcgaaacaaccatgagaggggctaagcgcatggccatccttggagacacggcctgggattttggctctctcgggggagtgttcacaagcattggcaaagctctccaccaggtttttggggccatctacggcgcggctttctccggagtgtcttggaccatgaagattctgatcggcgtcattatcacctggatcgggatgaatagccggtccacaagcctgtctgtgtcccttgtgctcgttggaattgtcaccctgtatctgggcgtgatggtgcaggccgacagcgggtgtgtcgtgtcttggaaaaacaaggagctcaagtgcggatccggcatctttgttacagataatgtgcacacgtggaccgagcagtacaaattccaacctgaaagcccctccaagctggcctctgctattcagaaagcccatgaggaagggatctgtggcattagaagcgtcacacgccttgagaacctgatgtggaagcagatcacctccgaactcaatcacatcctgtctgagaacgaggtgaaactgacaattatgaccggagacatcaagggcattatgcaggttgggaaacggagccttagaccgcaacctacggaactccgctattcctggaagacctggggaaaggctaaaatgctgagcacagagctgcataatcagacctttctcatcgacggccccgaaacagccgagtgccctaacaccaatcgggcgtggaactctctggaagtggaggattacgggttcggagtctttacaaccaatatttggcttagactgcgcgagaagcaggacgtgttctgtgattccaaactcatgagcgccgctatcaaggacaaccgggccgttcacgctgatatgggctattggatcgaatctgccctgaatgacacgtggaaaattgagaaggcgtccttcatcgaagtcaagagctgccactggcccaaatctcatacactgtggagcaacggcgtgcttgagtccgagatggtgattcctaagaattttgccgggcccgtgagccagcacaacaacagaccgggataccatacccaaaccgctggcccttggcacctcgggaaactggaaatggatttcgacttttgtgagggaacaaccgtcgttgtgacggaagagtgcggcaatcgggggccctctctgcgcacaaccacagcctccggaaagctcatcaccgaatggtgctgtagaagctgcacactgccccctcttcggtatagaggcgaggatggctgttggtacgggatggagattcgcccgctgaaagaaaaggaggaaaacctcgtgtcctctctggtcaccgctggacatggccagatcgacaatttcagcctggggattcttggaatggccctctttctggaggaaatgctgcggacgagagtgggcaccaagcacgccatcctcctggttgctgtgtccttcgtcacacttatcaccgggaacatgtcttttcgcgatctgggaagagtgatggttatggtgggcgcgacaatgaccgacgatattggcatgggggtcacgtacctcgccctgctggctgccttcaaagtgcggcccacatttgccgctggacttctgctccgcaagctgaccagcaaagagctcatgatgacaaccatcggcattgttctgctttcccagtctagcatccctgagaccattctggaactcacagacgccctggcgctggggatgatggtgcttaagatggtcagaaatatggagaaatatcaactggctgtgacgatcatggccatcctctgcgtgcccaacgccgtcattctgcagaatgcttggaaggtttcctgtaccatcctcgccgtggtgagcgtctctcctctgcttctgacatccagccagcagaaggcggactggattcccctcgctctgaccatcaaaggactgaaccctacagccattttccttaccacgctgtctcggacatccaagaaacgcagctggcccctcaatgaagccatcatggctgtgggcatggtttctatcctggcctccagcctcctgaagaacgatattccgatgaccgggcctcttgtggctggaggcctgctgaccgtctgctacgtgctcacaggcagatccgccgacctggagcttgaacgggcgaccgatgttaaatgggacgatcaagccgagatcagcgggtctagccccattctgtccatcacaatttctgaggacggaagcatgtccatcaagaatgaagaggaggaacagacgctcaccattctgatccgcacaggcctcctggtgatctctgggctttttcctgtcagcattcccatcaccgctgccgcttggtatctgtgggaggtgaaaaagcagagagccggagtcctgtgggatattccgtcccctccccctgtgggcaaggccgaactcgaggacggggcttaccggatcaaacagaagggcattctgggatattctcaaatcggcgcgggggtttacaaagaaggaacattccacaccatgtggcatgtgacgcgcggcgccgtccttatgcacaaggggaaaagaatcgagcccagctgggctgatgtgaagaaggacctgatttcctatggaggcgggtggaaactcgaaggagagtggaaggagggcgaagaggttcaggtgctggccctcgaacccggcaaaaaccctcgggccgtccagaccaagccggggctgtttagaacaaataccggaacaatcggcgctgtgagccttgatttctctcccgggacctccggaagccctattgtggacaaaaagggcaaggttgtcgggctgtacggaaacggcgtggtgacacgctctggcgcctacgtctccgcgatcgctcagacggagaaaagcattgaagataatcccgagatcgaggacgacatcttccggaagagacgcctgaccattatggatctccatcctggggccggaaaaacaaagaaatatctgcccgccatcgtgcgggaagctattaagagaggccttcgcaccctgatcctcgcccctacccgggttgtggcggctgagatggaagaggccctgagagggctcccgattcgctaccaaacacccgccatccgggctgaacacacgggaagagagattgtcgacctgatgtgtcatgccacctttacaatgcggcttctgtcccctatccgcgtgcccaactataacctgatcattatggatgaggctcacttcaccgaccctgcctctatcgcggccagaggctacattagcacacgggttgaaatgggggaggctgccggcatctttatgaccgctacgcccccgggatcccgcgatcctttcccccagagcaatgcccccattatggacgaagagagagagatccctgaacggtcttggaactccggccacgagtgggtgacagattttaaggggaaaaccgtctggttcgtgcccagcatcaagaccggaaatgacattgccgcttgcctccgcaagaacggcaagcgcgttatccagctgtctcggaaaacatttgatagcgaatatgtgaagaccagaacaaatgactgggatttcgtcgtgaccacggacatttccgagatgggggcgaactttaaggccgaacgcgtgatcgaccctcggagatgtatgaaaccggtcattcttacagatggagaggagcgcgttatcctggctggccccatgcctgtgacccattctagcgccgcccaacggagagggcgcatcggcagaaatccccggaacgaaaatgaccagtacatttatatgggagagcctctcgaaaacgatgaggactgcgctcactggaaggaagccaaaatgctgctggataatatcaacacacccgagggcattatcccgtccatgttcgagcctgaacgcgagaaggtggacgcgattgatggggaatacagactccggggagaggctcgcaaaacctttgtcgaccttatgagacggggcgatctgcccgtgtggctggcctacaaggttgcctctgaagggatcaattatgctgacagacgctggtgtttcgatggaacgcggaacaatcagattctcgaggagaacgtggaagtcgagatctggaccaaagaaggcgagagaaagaagctgaaacctcgctggcttgacgcccggatctacagcgatcccctggcgctcaaggagttcaaagaatttgccgctgggagaaagtccctgacactgaacctcattaccgagatgggccggcttcctacattcatgacccagaaagcccgcgacgctctggacaatctggccgtgctccatacagctgaagccggaggcaaggcgtataaccacgccctgagcgagcttcccgaaaccctggagacgctcctgctgctcacacttctggctaccgttaccgggggaatctttctgttcctcatgtctggcagagggattggaaagatgacactgggcatgtgctgcatcattaccgcctccatccttctgtggtacgctcaaatccagccgcactggattgccgccagcatcattctcgagtttttcctgatcgtgctgctcattcctgaacccgagaaacagcggacaccccaggataatcaacttacgtatgtcatcatcgctattctgaccgtggtcgcggccacaatggctaacgaaatgggctttctggagaagaccaaaaaggacctcgggctgggacatatcgccacacagcagcctgaatccaatattcttgatatcgacctgcgcccggcctctgcttggaccctctacgccgtggcgacgaccttcattacacccatgctgagacacagcatcgagaactcctctgttaatgtgagcctgaccgccattgctaaccaggccacagtgctcatgggccttgggaaaggatggcctctgtccaagatggatatcggcgtccccctgctcgctatcgggtgttatagccaagttaatcctattaccctgacggccgcgcttctgctcctggtggcccattacgctatcattggacccggcctgcaggccaaggctacacgggaggcccagaaacgcgctgccgcgggcatcatgaagaaccctaccgtggacgggattacagtcatcgatctcgacccgatcccctacgatcctaaatttgaaaagcagcttggacaagtgatgctgctggttctctgcgtgacccaggtcctgatgatgagaaccacatgggccctttgtgaggctctgacgctcgccaccggccccgtgtctacactgtgggaagggaatcctggacggttctggaacaccacaattgctgtctccatggccaatatctttcgcggcagctatctggccggggcgggactccttttctctattatgaaaaacaccacgtccacaagacggggcaccggcaatatcggggagaccctgggagaaaagtggaaaagcagactgaacgctctcggcaaatctgagtttcagatttacaagaaaagcgggatccaagaggtggaccgcacactggccaaggaaggaatcaaacggggcgagaccgatcaccatgctgtttccagagggtctgccaaacttcgctggttcgtggaacggaatctggtcacacccgagggaaaagtggttgacctcggctgcggcagagggggatggagctattactgtggcgggctgaagaacgtgcgcgaggtcaagggactgacgaaaggcgggccgggacacgaggaacctattcccatgtccacctatggctggaacctcgtgcggcttcagagcggcgtggatgttttctttgtgccccctgaaaagtgcgacacactgctgtgtgacatcggggagtcctctcccaatcctaccgtggaagccggaagaacactccgcgtgctgaaccttgtcgagaattggctgaacaataacacccagttctgcgttaaagtgctcaatccgtacatgcccagcgtgattgagcggatggaaacgctgcagagaaagtatggcggggctctggtccgcaaccctctctccagaaattctacccacgagatgtactgggtgagcaacgcctccggaaatatcgtttctagcgtgaacatgatttccagaatgcttatcaatcgctttacaatgagacataaaaaggcgacctacgaacccgatgtcgacctgggcagcgggacacggaacatcggaattgagtctgaaacccctaatctggatatcattggcaagcgcatcgagaaaattaagcaagagcacgaagcctcctggcattatgaccaggatcacccctacaaaacatgggcttatcacggcagctacgagaccaagcagacggggtctgcctccagcatggtgaacggagttgtgagactcctgacaaaaccgtgggacgtcgtgcctatggtgacccagatggctatgaccgatacaacgcccttcggccaacagcgggtctttaaggaaaaggttgacaccagaacacaggagcctaaagaagggaccaagaaacttatgaagatcacagccgagtggctgtggaaagagctcggaaagaagaaaacaccccggatgtgtacacgcgaagagttcaccaagaaagtgagatctaacgcggccctgggcgctatttttacggatgaaaataagtggaaatccgcccgggaggctgtggaggacaaccgcttctgggaactggtcgataaggagagaaatctccatctggaagggaaatgcgagacctgtatctataacatgatgggaaagcgggaaaagaaacttggcgagtttggcaaggccaaagggagccgcgctatctggtacatgtggctgggagccagattcctcgagtttgaagcgctgggcttccttaatgaggaccactggttttcccgggaaaacagcctgtctggggtggagggagaaggcctccataagctggggtatattctgcgcgaggttagcaaaaaggagggcggagccatgtacgctgacgatacagccggctgggacaccagaatcacaattgaagatctcaagaatgaggaaatgatcaccaaccacatggctggggagcataaaaagctggccgaagccattttcaaacttacgtaccagaataaggtggtccgggtgcaacgccctacacccagaggaaccgttatggacatcatctcccggcgcgatcagagaggctctgggcaggtcggaacatatggcctgaacaccttcacgaatatggaggcgcaactcattcggcagatggagggggaaggcatctttaaaagcattcagcacctgaccgcttccgaggaaatcgccgtccaggactggcttgtgagagttggacgcgagcggctgtctagaatggccattagcggcgatgactgcgtggtcaagccgctcgatgaccgcttcgctcgggccctgacagctctgaacgatatggggaaggtgagaaaagacatccaacagtgggagccttcccgcggatggaatgattggacccaggtccccttttgctctcaccatttccacgaactcatcatgaaggacggccggattctggtggttccctgtagaaaccaggacgagcttatcgggcgcgcccggattagccaaggagcgggctggtccctgagagaaacagcctgcctcgggaaaagctacgctcagatgtggtctctgatgtattttcatcgccgggatcttagactggccgctaatgccatctgttccgcggtgcctagccactgggtcccgacctctcggacaacctggtccattcacgccagccatgagtggatgacgacagaagacatgctcaccgtgtggaacagagtgtggatcctggagaacccctggatggaggataagacccctgttgaatcctgggaggaaattccctacctgggcaaacgcgaggaccagtggtgcggatctctcatcggcctgacaagccgggctacctgggccaagaatatccagacagctattaaccaagtgagatcccttatcgggaatgaagagtatacggattacatgcctagcatgaagcgcttcagacgggaggaagaggaagccggagtcctgtggtga

SEQ ID NO: 19727 - RNA, 9876 nt, synthetic construct
  misc_feature 1..9876: note = derived and/or modified CDS sequence (opt5) from DENV-2__GQ868590__SS-prME
  source 1..9876: mol_type = other RNA
accgccggcatgatcattatgctgatccccacagtgatggctttccacctcacgaccagaaacggggagcctcatatgattgtcagccggcaggaaaagggaaaatccctgctttttaagacaaaagacggcaccaatatgtgcacactgatggccatggatctcggggagctgtgtgaagacaccatcacatacaagtgcccgttccttaaacaaaacgagcccgaagatattgactgttggtgcaattctaccagcacgtgggttacctatggaacatgtaccacaaccggcgagcaccgcagagagaagcggtccgtggcgctggtgcctcatgtcgggatgggactcgaaacgcgcacagagacctggatgtctagcgaaggcgcttggaagcacgcccagagaatcgagacatggatcctgcggcatcccggctttaccattatggccgctatcctggcctacaccattgggacaacgcacttccagcgcgtgctcatctttattctgcttaccgctatcgccccttccatgacaatgagatgcattggaatctctaaccgggatttcgttgagggcgtgagcgggggatcctgggtcgacatcgtgctggaacacggcagctgtgttaccacaatggcgaaaaataagcccaccctcgattttgagctgattaaaacggaagccaagcagcctgctacacttcgcaaatattgcatcgaggccaagctgaccaacaccacaaccgactctagatgtccgacacaaggggaacccacgctcaatgaggagcaggataagcggttcgtgtgcaaacattccatggtcgaccgcggatggggcaacggctgtgggctgtttggaaagggcgggattgtgacctgcgctatgttcacatgcaaaaagaatatggaaggaaaaatcgtgcagcctgagaacctggaatacaccgtcgttattacaccccacagcggcgaggaacatgccgtggggaatgataccggaaagcacggcaaagaggtgaagatcacgcctcagtcttccatcaccgaggcggaactcacaggctatgggaccgtcacaatggagtgtagccccagaaccggactggactttaacgaaatggtgcttctgcaaatggaggataaggcctggctcgttcaccggcagtggttcctggaccttccgctgccttggctccccggcgctgacacgcaggggtctaattggattcagaaagaaacactggtgacctttaagaaccctcatgccaaaaagcaagatgtcgtggttctgggatcccaggagggcgctatgcacacagccctcaccggggccaccgagatccagatgagctccggcaatctgcttttcacaggacatctgaaatgccgcctcagaatggacaagctgcaacttaagggcatgtcttacagcatgtgtacggggaaattcaagattgtgaaagaaatcgctgagacccagcacggaacaattgtcatccgggtgcagtatgaaggcgatgggtccccctgcaagatcccctttgagattatggacctggagaaaagacatgtcctcggacgcctgatcaccgtgaaccctattgttacagaaaaggatagcccggtgaacatcgaggcggaaccccctttcggcgactcttacattatcattggggtcgagcccggccagctgaagctcgattggtttaaaaagggatccagcatcggccaaatgttcgaaaccacgatgcggggggccaaaagaatggctatcctgggagacacagcctgggattttggctctcttgggggaatgttcaccagcattggcaaggccctgcaccaggtgtttggggctatctacggcgccgcgttctccggagtttcttggaccatgaaaattctcatcggcgtgattatcacatggatcgggatgaatagccgctccaccagcctgtctgtctccctggtgcttgtgggaattgttacactctatctgggcgtcatggtgcaggctgacagcgggtgtgtggtctcttggaagaacaaggagctgaaatgcggatccggcatctttgtgacggataatgttcacacctggacagagcagtacaagttccaacctgaaagcccctccaaactcgcctctgccattcagaaggctcatgaggaagggatctgtggcattcggagcgtgaccagactggagaaccttatgtggaaacagatcacaccggaactgaatcacatcctctccgagaacgaggtcaagctgaccattatgacgggagacaccaaaggcatcatgcaggtggggaagcgctctctgcggcctcaacccacagaacttagatatagctggaagacctggggaaaagccaagatgctccctacagagctgcataatcagacctttctgattgacggccccgaaacagctgagtgccctaacaccaatcgcgcctggaactccctcgaagttgaggattacgggttcggagtgtttacgacaaatatctggctgcggcttagagagaaacaggacgtcttctgtgatagcaagctgatgtctgcggccattaaagacaaccgcgctgtgcacgccgatatgggctattggatcgaatccgctctcaatgacacctggaagatcgagaaggccagcttcattgaagttaaatcttgccactggcccaagtcccataccctgtggagcaacggcgtgctggagtctgagatggtcatcccgaaaaatcttgcggggcctgtgagccagcacaacaaccggcccggataccatacacaaaccgccggcccctggcacctcgggaagctggaaatggattttaatttctgtgagggaacgacagtggtcgttaccgaagagtgcggcaacagagggccttccctgcggacaaccacagctagcggaaaactcattaccgaatggtgctgtcgctcttgcacgctgccgccccttagatatcggggcgaggacggctgttggtacgggatggagatcagacctctgaaggaaaaggaggaaaatctcgtgtccagcctggtgaccgccggacatggccagattgataacttttccctggggatccttggaatggctctcttcctggaggaaatgctgcgcacacgggtcggcaccaaacacgccattctcctggtggccgtttcttttgtgacacttatcaccgggaatatgagcttcagagacctgggacgcgtcatggtgatggttggcgctacgatgacagatgacatcggcatgggggtgacctacctcgcgctgctggccgcttataaggtcagacccacatttgccgccggacttctgctccggaaactgacctccaaggagctcatgatgaccacaattggcatcgtgctgctttctcagagctccattcctgagacgatcctggaactcaccgatgctctggccctggggatgatggttcttaaaatggtgcgcaacatggagaagtaccaactggcggtcacaattatggctatcctctgcgtgcccaatgccgtgatcctgcagaacgcctggaaggtctcttgtaccattctcgctgttgtgagcgtgtcccctctgcttctgacaagctctcagcagaaagccgactggatccccctcgcgctgaccattaagggactgaatccgacggctatcttccttacaaccctgtccagaaccagcaaaaagcggtcttggcctctcaacgaagccattatggccgtcggcatggtgtccatcctggctagctctctcctgaaaaatgacatccccatgacagggcctcttgttgccggaggcctgctgaccgtgtgctatgtcctcacaggccgctccgctgatctggagcttgaaaaggccacggacgtgaaatgggatgaccaagcggagattagcgggtccagccccatcctgtctattaccatcagcgaggatggatccatgtctattaagaacgaagaggaagagcagacactcaccatcctgattagaacaggcctcctggttatcagcgggctttttccggtgtccatccctattaccgccgctgcctggtacctgtgggaggtcaagaaacagcgggctggagtgctgtgggacgtcccctctcctccccccgtgggcaaggccgaactcgaggatggggcctatcgcatcaaacagaagggaattctgggctacagccaaatcggcgctggggtttataaagaaggaacgttccacaccatgtggcatgtgacaagaggcgcggtccttatgcacaaggggaagcggattgagccttcctgggccgacgtgaaaaaggatctgatctcttacggaggcgggtggaaactcgaaggagagtggaaggagggcgaagaggttcaggtgctggctctcgaaccgggcaaaaatccccgcgccgtccagaccaagcctgggctgtttagaacaaacaccggaacaatcggcgccgtgagccttgacttctcccccgggacgagcggatctcctattgtggataagaaaggcaaggttgtcgggctgtacggaaatggcgtggtgacccggtccggcgcttatgtcagcgccatcgcgcagacagagaaatctattgaagacaaccccgagatcgaggatgacatttttagaaagcgccggctgaccatcatggacctccatcctggggctggaaaaaccaagaagtacctgccggccatcgtgagagaagccattaaacgcggccttcggacactgatcctcgctcccacgagagttgtggccgcggagatggaagaggctctgcgcgggctccctattcggtatcaaacccccgccatcagagccgaacacacaggacgcgagattgtcgatctgatgtgtcatgctaccttcacaatgcggcttctgtcccctatcagagtgcccaactacaatctgattatcatggacgaggcccacttcaccgatccggctagcatcgccgcgcggggctatatttccacgcgcgttgaaatgggggaggccgctggcatctttatgacagccacccctcccggatctagagaccccttccctcagagcaacgctcccattatggatgaagagcgggagatccctgaacgctcctggaatagcggccacgagtgggtgaccgactttaaggggaaaacagtctggttcgtgccgtctattaagaccggaaacgatatcgccgcctgcctcagaaaaaatggcaagcgggttatccagctgtccagaaagacatttgacagcgaatacgtgaaaacccgcacgaacgattgggacttcgtcgtgacaaccgatatttctgagatgggggctaattttaaggcggaacgggtgatcgaccccagacgctgtatgaaacctgtcattcttacagacggagaggagcgggttatcctggccggccccatgcctgtgacccatagctccgctgcccaaagacgcgggcggattggcagaaacccccgcaatgaaaacgatcagtatatctacatgggagagccgctcgaaaatgacgaggattgcgcccactggaaggaagctaaaatgctgctggacaacatcaatacgcctgagggcattatcccctctatgttcgggcctgagagagaaaaggtggatgccattgacggagagtaccggctccgcggcgaagcgagaaaaacctttgtcgagcttatgcggcgcggggatctgcccgtgtggctggcttataaggttgccagcgaaggaatcaactacgccgacagacggtggtgtttcgatggcacaagaaataaccagattctcgaggagaacgtggaagtcgagatctggaccaaggaaggggagcgcaaaaagctgaaacctcggtggcttgacgctagaatttattccgatcccctggccctcaaggagtttaaagaattcgcggccggccgcaagtctctgacactgaatctcatcaccgagatgggacggcttccgacattcatgacccagaaggctagagacgccctggataacctggctgtgctccatacggccgaagctggcgggaaagcctacaatcacgcgctgagcgagcttcctgaaacactggagaccctcctgctgctcacccttctggccacagttaccggaggcatctttctgttcctcatgtccgggcggggaattggcaagatgacactgggcatgtgctgcatcattacggctagcatccttctgtggtatgcccaaattcagccccactggatcgctgcctctatcattctcgagtttttcctgatcgtgctgctcattcccgaacctgagaaacagcgcaccccgcaggacaaccaacttacatacgtcatcattgccatcctgaccgtggtcgctgcgacaatggccaatgaaatggggtttctggagaagaccaaaaaggacctcggactgggccatatcgctacgcagcagcccgaatccaacattcttgatatcgacctgagacctgccagcgcctggaccctctatgctgtggccacaaccttcattacacccatgctgcggcactccatcgagaattctagcgttaacgtgtccctgaccgcgattgccaatcaggctacggtgctcatggggcttggaaagggctggcctctgtctaaaatggatatcggggtccccctgctcgccattggatgttacagccaagttaaccctatcacactgaccgctgcccttctgctcctggtggcgcattacgccatcattggcccgggcctgcaggctaaggccacacgcgaggctcagaaaagagccgctgccgggatcatgaagaatcccaccgtggacggaattaccgtcatcgatctcgaccctattccctatgatcctaaatttgaaaagcagcttggccaagtgatgctgctggttctctgcgtgacacaggtcctgatgatgcggacgacctgggcgctttgtgaggccctgacactcgctaccgggcccgtgtccacactgtgggaaggaaacccgggccgcttctggaataccacgatcgccgtcagcatggctaacatctttagagggtcttacctggccggagccggcctccttttctccattatgaagaatacaaccagcacccggcgcggcacagggaacatcggagagaccctgggcgaaaaatggaagtctagactgaatgcgctcgggaaatccgagtttcagatttataagaaaagcggaatccaagaggtggaccggacactggctaaggaaggcattaaaagaggggagacggatcaccatgccgtttctcgcggaagcgctaagcttcggtggttcgtggaaagaaacctggtcacccctgagggcaaggtggttgacctcggctgcgggcgcggaggctggtcctactattgtgggggactgaaaaacgtgcgggaggtcaagggcctgacaaaagggggacccggccacgaagagcccatccctatgtctacctacggctggaatctcgtgagacttcagagcggggtggatgtttttttcatcccccctgaaaagtgcgacacactgctgtgtgatattggagagtccagcccgaaccccaccgtcgaagccggccgcacgctccgggtgctgaatcttgtggagtcctggctgaacaataacacccagttctgcgtcaaagttctcaatccttatatgccctctgtgatcgagagaatggaaacactgcagcgcaagtacgggggagccctggtgcggaaccctctcagcagaaattccacccacgagatgtactgggtctctaacgctagcggcaatgtggtttcctctgtgaacatgattagccgcatgcttatcaatcggtttacaatgagacataagaaagccacctatgaacccgacgtcgacctggggtccggaacacgcaacattggcatcgagagcgaaaccccgaatctggatatcattggcaagagaatcgagaaaattaagcaagagcacgaagcgtcttggcattacgaccaggatcacccttataaaacgtgggcctaccacgggtcctatgagacaaagcagaccggaagcgcttcttccatggtgaacggcgttgtgcggctcctgaccaagccctgggacgtcgtgcctatggtgacacagatggccatgacggataccacacccttcgggcaacagcgcgtctttaaagaaaaggttgacaccagaacacaggagcctaaagaaggaaccaagaaacttatgaagatcacagctgagtggctgtggaaggagctcggcaaaaagaaaaccccccggatgtgtacgagagaagagttcaccaagaaagtgcggagcaacgccgcgctgggggccatttttacagatgaaaataagtggaaatctgctcgcgaggccgtggaggacaacagattctgggaactggtcgataaggagcggaatctccatctggaaggaaagtgcgagacctgtgtgtacaacatgatgggcaaacgcgaaaagaaacttggcgagtttgggaaggctaaaggatccagagccatctggtatatgtggctgggcgctcggttcctcgagtttgaagccctggggttccttaatgaggaccactggtttagccgcgaaaactccctgagcggagttgagggcgaagggctccataagctgggctacattctgagagaggtgtctaagaaagagggaggcgcgatgtacgccgatgacacagctgggtgggacacccggatcacgatcgaagatctcaagaatgaggaaatgattacaaaccacatggccggagagcataaaaagctggctgaagccatcttcaaacttacctatcagaataaggtcgtgcgcgttcaaagaccgacacctattggcaccgtgatggacatcattagccggcgcgatcagagagggtccggacaggtcggcacgtacgggctgaacacctttacaaatatggaggcccaactcatccggcagatggagggcgaaggaatcttcaagtctattcagcacctgaccgcgagcgaggaaatcgctgtgcaggactggcttgttcgcgtgggcagagagcggctgtccagaatggccatttctggggatgactgcgtcgtgaaacccctcgatgaccgcttcgcccgggctctgacagccctgaacgatatgggaaaggtcagaaaagacatccaacagtgggagcccagccgcggctggaatgattggacccaggtgcctttttgctcccaccatttccacgaactcattatgaaggacgggcggacactggttgtgccgtgtagaaaccaggatgagcttatcggacgcgctcggatctctcaaggcgccgggtggagcctgagagaaaccgcgtgcctcggcaaatcctatgcccagatgtggagcctgatgtactttcatcgccgggaccttagactggctgccaatgctatttgttctgccgtcccctcccactgggtgcctacgagccgcacaacctggtctatccacgcgtcccatgagtggatgaccacagaagacatgctcaccgtgtggaaccgggtttggattctggagaacccctggatggaggataagacacctgtggaaagctgggaggaaatcccctatctgggaaagagagaggaccagtggtgcggctccctcattgggctgacgtctcgggccacctgggctaaaaatatccagacagccattaaccaagtcagaagccttatcggaaatgaagagtacaccgattatatgccttccatgaagcgcttccggagagaggaagaggaagctggcgtgctgtggtga

SEQ ID NO: 19728 - RNA, 9876 nt, synthetic construct
  misc_feature 1..9876: note = derived and/or modified CDS sequence (opt5) from DENV-2__GQ868497__SS-prME
  source 1..9876: mol_type = other RNA
accgccagcgtgatcgtcatgctgattcccacagttatggctttccacctcacgaccagaaacggcgagcctcatatgatcgtggggcggcaggaaaagggaaaatccctgctttttaagacagaggacggcgtgaatatgtgcaccctgatggccattgatctcggggaactgtgtgaggacacaatcacctacaaatgcccgcttctgcgccaaaacgaacccgaggatattgactgttggtgcaattctacaagcacctgggtcacgtatggaacctgttccacaaccggcgagcacagacgggaaaagcgctctgtggcgctcgttcctcatgtggggatgggactggagacaagaaccgaaacgtggatgagctccgagggcgcttggaaacacgtccagcggatcgagacatggatcctgcgccatcccggcttcaccattatggccgccatcctcgcttacacaattgggaccacccactttcagagagccctgatcttcattcttctgacagctgtggccccttctatgacgatgcggtgcatcggaattagcaaccgcgattttgttgaaggcgtgtccgggggaagctgggtcgacatcgtgctcgagcacggctcttgtgtgaccacaatggcgaagaataagcccaccctggatttcgaacttatcaaaacagaggccaagcagcctgctaccctgagaaaatattgcattgaagccaagctcacgaacacaaccaccgagtcccggtgtccgacacaaggggagcccagcctgaatgaagagcaggacaaacgctttatctgcaagcattctatggtcgatagaggatggggcaacggctgtgggctgttcggaaagggcgggattgttacctgcgctatgtttacatgcaaaaagaatatggaaggaaaagtgatgcagcctgagaacctcgaatacacgatcgtgattaccccccactccggcgaggagcatgccgtcgggaatgacacaggaaagcacggcaaagaaatcaagatcacccctcagagctctattacagaggcggaactgaccggctatgggacggtgaccatggagtgttccccccggacaggacttgatttcaacgaaatggttctgctccaaatggaggacaaagcctggctggtgcaccgccagtggtttcttgatctgccgctcccttggctgcccggcgctgacacccaggggagcaattggatccagaaggagacactggtcaccttcaagaaccctcatgccaaaaagcaagacgtggttgtgctcggatcccaggaaggcgctatgcacacggccctgacaggggccaccgagattcagatgtctagcggcaatcttctgtttacaggacatctcaaatgcagactgcggatggataagcttcaactgaaaggcatgtcctacagcatgtgtaccgggaagttcaagatcgtcaaagaaattgctgagacccagcacggaacaatcgtgatcagagtccagtatgagggcgacgggtctccctgcaagattcccttcgaaatcacggatctcgagaaacgccatgtgctgggacggctgattaccgttaaccctatcgtgacagaaaaggactccccggtcaacattgaggcggaacccccttttggcgatagctacatcattatcggggtggagcccggccagctcaaactgaattggttcaagaagggatctagcatcggccaaatgtttgagaccacaatgagaggggccaaacgcatggctattcttggagacaccgcctgggatttcggctccctggggggagtttttacgtctatcggcaaggccctccaccaggtgttcggggctatttacggcgccgcgtttagcggagtctcctggacaatgaaaatcctgattggcgtgatcatcacctggattgggatgaacagccggtctacctccctgagcgtgtctcttgttctcgtcggagtggtgacactgtatctgggcgctatggtccaggccgactccgggtgtgtggttagctggaagaataaagaactcaagtgcggatccggcatcttcattaccgataacgtgcacacatggacggagcagtacaagtttcaacctgaatctcccagcaaactggcctccgctatccagaaggcccatgaggaagggatttgtggcatcagatctgtcacccgccttgagaatctgatgtggaaacagatcacaccggagctcaaccacattctgagcgaaaatgaggtgaagctgaccatcatgacaggagacattaaaggcatcatgcaggctgggaagcggtcccttagacctcaacccaccgaactcaaatatagctggaagacgtggggaaaggccaaaatgctgtctaccgagtcccataaccagacattcctgattgatggccctgaaaccgcggagtgccccaatacaaaccgcgcctggaatagcctcgaggttgaagactacgggtttggagtgttcaccacaaacatctggctgaagcttcgggagaaacaggacgtcttttgtgattctaagctgatgtccgctgccatcaaagacaatagagctgtgcacgccgatatgggctattggattgaaagcgcgctcaacgacacctggaagatggagaaggcctctttcatcgaggttaaaagctgccactggcctaagtcccatacgctgtggagcaatggcgtgctggaatctgagatgattatccccaaaaacttcgctgggccggtctcccagcacaactaccgccctggatatcatacacaaaccgccggcccctggcaccttgggaagctcgaaatggattttgacttctgtgagggaaccacagtggtggtcaccgaagattgcggcaatcgggggcccagcctgagaacgacaaccgcttccggaaaactgattacagagtggtgctgtcggtcttgcaccctccctccgctgcgctacagaggcgaggacggctgttggtacgggatggaaatccggccccttaaggagaaggaagagaacctggttaatagcctcgtgacagccggacatggccagattgataacttttccctgggggtgctgggaatggcccttttcctcgaagagatgctgagaacccgcatcggcacgaaacacgctatcctgctcgtcgcggcctcttttgtgaccctgattacagggaatatgagcttccgggaccttggaagagttatggtgatggtcggcgctaccatgacagatgacatcggcatgggggtgacctatctggccctcctggccgcttttaaggttcgccctacgttcgccgcgggactgcttctgagaaaactcacatccaaggagctgatgatggctaccattggcatcgccctcctgtctcagagcacaattcccgaaaccatccttgagctgaccgatgccctcgctctggggatgatggtgctgaaaatcgtccggaacatggaaaagtaccaacttgccgtgacaattatggcgatctcctgcgttcctaatgctgtgattctgcagaacgcctggaaggtcagctgtacgatcctcgccgctgtgtctgtgtcccccctgctcctgaccagctctcagcagaaagccgactggattcctcttgctctgacaatcaagggactcaatcccaccgccatctttctgacaaccctgtcccgcacgagcaaaaagagatcttggccgcttaacgaggcggtcatggccgttggcatggtgtccattctggctagctccctcctgaaaaatgacatccctatgacagggcccctcgtggccggaggcctgcttaccgtctgctatgtgctgaccggccggagcgctgatctggaactcgagcgcgccgccgacgttaagtgggaggatcaagctgaaatttctgggagctcccctatcctgtctattacaatcagcgaggacggatccatgtctgtgaaaaacgaagaggaggaacagacccttacaattctgatcagaacgggcctcctggtcatcagcggggtgttccccgtttccattccgatcaccgcggccgcttggtacctctgggaggtgaagaagcagcgggccggagtcctgtgggatgtgccttctccccctcccgtcgaaaaagccgagcttgaagacggcgcttatcgcattaagcagagagggatcctgggatacagccaaattggcgccggcgtgtataaagaggggacatttcacaccatgtggcatgttacacggggagcggtgctgatgcaccgcggcaagagaatcgagccctcctgggctgatgtcaaaaaggacctcatcagctacgggggaggctggaagctggaaggggagtggaaagaaggagaggaagtgcaggttcttgccctggagcctggcaagaatccgcgggccgtgcagaccaaacccggcattttcaagacgaacaccgggacaatcggagctgtctctctcgatttttcccctggcaccagcgggtctcccattgtggacagaaaaggaaaggtggttggcctgtacgggaatggagtcgtgacacgctccggcgcctatgtgagcgcgatcgctcagaccgagaagtccattgaagataaccctgagatcgaagacgatatcttccggaaaaagagactcacaattatggacctgcatcccggcgccgggaaaacgaagcgctaccttcctgccatcgtccgggaggctattaaaagaggactgcgcaccctgatcctcgccccgacacgggtggttgctgccgaaatggaggaggcgctgagaggccttcccattcgctatcaaacccctgccatcaagaccgaacacacagggcgggagattgtggacctgatgtgtcatgctacgttcaccatgagactcctgtctcccgtccgggtgcctaactacaatctcatcatcatggatgaagcccactttacagaccccgctagcattgccgcccgcggatatatctccaccagagttgagatgggcgaggctgcggggattttcatgacagccaccccgcctggcagccgggatccctttccccagtctaacgctcctatcatggacgaagagcgcgaaattcccgagagatcctggaatagcggacacgaatgggtgacggatttcaagggcaaaacagtctggtttgtgccttctatcaaggccgggaacgacatcgccgcttgcctgcggaaaaatggaaagaaagttattcagcttagcagaaagaccttcgattccgagtacgtgaagacccgcgccaacgactgggattttgtcgtgacaaccgacatctctgagatgggcgcgaatttcaaagctgaacgggtgattgatccgagacgctgtatgaagcccgtcatcctgacagacggggaggaacgggttattctggccggacctatgcccgtgacccatagctccgccgctcaaagacgcggccggatcgggagaaaccctaaaaatgagaacgaccagtatatctacatgggcgaacccctcgagaatgatgaggactgcgcccactggaaggaagcgaaaatgctgcttgataacattaatacgccggagggaatcattccttctatgtttgaacccgagcgcgaaaaggtggacgccatcgatggcgagtacagactgcggggggaggctcgcaaaacattcgtcgacctcatgagacggggagatctgcctgtgtggctggcctataaggttgctgccgaaggcattaactacgctgaccgcaagtggtgttttgatgggatcaaaaataaccagattctcgaggaaaacatggaggtggagatctggaccaaggaaggagagagaaaaaagcttaaaccccggtggctggacgccagaatctatagcgatcctctggcgctcaaggaattcaaggagttcgccgctggccgcaaatccctgacacttaatctgattaccgaaatggggcggctccccacgtttatgacccagaaggccagaaacgctctggacaatctggccgtcctccatacagccgaggctggcggacgcgcgtacaaccacgcccttagcgagctgccggaaaccctggagacactcctgcttctgaccctcctggctacagtgaccggcgggatcttcctgtttctcatgtctggaaaaggcattgggaagatgacgcttggaatgtgctgcatcattacagcctccatcctgctgtggtatgcccaaatccagcctcactggattgctgccagcatcattctcgaattctttctgatcgttcttctgattcccgagcccgaaaaacagcggacccctcaggataatcaactcacctacgtggtcatcgcgatcctgacagtggtcgccgctaccatggccaacgagatgggcttcctggagaagacaaagaaagacctcggccttgggtccattacgacccaggaatctgagagcaatatcctggacattgatctgagaccggcttccgcctggacactctatgcggtggccaccacatttgttacccccatgctgcggcattctatcgaaaacagctccgtgaatgtgagccttacggctattgccaaccaggctaccgtcctgatgggactcggcaaggggtggcctctgtctaaaatggacatcggagttcccctgctcgccattggctgttactcccaggtgaatcctatcacacttaccgctgccctgctgctcctggtggcgcactacgccatcattgggcccggacttcaagctaaggccacacgcgaggctcagaaaagagccgccgcgggcatcatgaagaaccctaccgtcgatggcattacggtgatcgacctggaaccgattccctatgatcctaagttcgagaaacagctcgggcaggttatgctgctgatcctctgcgtgacacaagtccttatgatgcggaccacatgggctctgtgtgaggccctgaccctcgctaccggacccatcagcacactgtgggaaggcaatcctgggcgcttttggaacacgaccattgccgtgtctatggccaatatcttcagaggatcctaccttgctggcgccgggctgctctttagcattatgaagaacacaaccaatacacggcgcggaaccggcaacatcggcgagacgctgggggaaaaatggaagtctagactgaacgcgctcggaaaaagcgagttccagatttataagaaatccggcatccaggaggtcgaccggacacttgccaaggaagggatcaagcgcggagagaccgatcatcacgctgtgtctagaggcagcgccaaactgcggtggtttgttgaaagaaatatggtgacccccgaggggaaggtcgtggacctgggatgcggccgcggcgggtggtcctactattgtggaggcctcaaagatgttcgggaagtgaaggggctgacaaaaggaggcccggggcatgaggagcctattcccatgagcacctacggatggaaccttgtcagactgcaatccggcatcgacgtgttcttcacaccccctgaaaagtgcgatacgctcctgtgtgacattggcgagtctagccccaatcctaccatcgaagctgggcgcacactgcgggtgctcaaccttgttgagaattggctgaacaataacacccagttttgcattaaggtcctgaatccgtatatgccctccgtgatcgaaaaaatggagacactccagagaaagtacggaggcgccctggtgcgcaaccctctttctcggaatagcacccacgagatgtactgggtctccaacgcgacggggaatatcgtttctagcgtgaacatgatttccagaatgctgatcaatcgcttcaccatgaaacacaagaaagccacatatgaacccgatgtggacctcggaagcggcacccggaacattgggatcgagtctgaaattcctaacctggacatcattggaaagagaatcgagaagatcaaacgcgaacatgagacatcctggcactacgatcaggaccatccctataagacctgggcttaccacggcagctatgagacaaaacaaaccggctctgcctccagcatggtcaatggggtggttcggctgctcacgaagccgtgggatgtggtccctatggtgacacagatggctatgaccgacaccacaccctttggacagcagagagttttcaaagaaaaggtggatacgcgcacccaagagcctaaggaaggcacaaaaaagcttatgaaaattaccgccgagtggctgtggaaggagctggggaaaaagaaaacacccagaatgtgtacccgggaagagtttacacgcaaggtcagatctaacgctgccctcggagcgatcttcaccgacgaaaataagtggaaatccgcccgggaggctgtggaagatggcagattttgggagctggtggaccgggagcgcaaccttcacctggaagggaagtgcgagacgtgtgtctacaatatgatgggaaaaagagaaaagaaactcggcgagttcggcaaggccaaggggagccgggctatttggtatatgtggctgggagcccgctttctggaattcgaggccctcggctttctgaacgaggatcattggttctccagagggaatagcctttctggagttgaaggcgaggggctgcaccggctcggctacatcctgcgcgacgtgggaaaaaaggaaggcggggcgatgtacgctgatgacaccgccggatgggacacaagaattacccttgaggatctgaaaaacgaagagatggtgacaaatcatatgaagggcgagcacaaaaagctcgccgaagctatctttaagctgacctatcagaacaaagtcgtgcgggttcagcgccctacgcccagagggacagtgatggacatcattagccggcgcgatcagagaggatccggccaagtcgggacctacggcctgaatacattcaccaacatggaggcccagctcatccggcagatggaaggagagggcattttcaagtctatccaacatctgacggctaccgaggaaattgccgtgcagaattggcttgcgcgcgttgggagagagcggctgagcagaatggccatctccggagacgattgcgtggtcaaaccgatcgacgatcgctttgcttctgccctcacagctctgaacgacatgggcaaggtgcggaaagatattcagcagtgggaacctagcagagggtggaatgactggacccaagttcccttctgctcccaccactttcatgagcttgtgatgaaggatggacgcgtcctggtggtcccctgtcggaaccaggacgaactcatcggcagagcccgcatttctcagggggcgggctggagcctgaaggagacagcctgcctgggaaaatcctatgctcagatgtggaccctcatgtacttccaccggagagatctgcgccttgccgctaacgccatctgtagcgctgtgccttctcattgggttccgacatcccggaccacgtggagcattcacgccaagcacgagtggatgacaaccgaagacatgctggcggtgtggaatagagtctggatccaagagaacccctggatggaagacaaaacccctgtggagtcttgggaagaggtgccctatctcggcaagcgcgaggatcagtggtgcgggtccctgattggacttacaagccgggccacctgggctaaaaatatccagacagccatcaaccaggttagatccctgattggcaatgaagagtacacggactatatgccttctatgaagcggtttagaaaggaagaggaagaggccggggtgctctggtga

SEQ ID NO: 19729 - RNA, 9876 nt, synthetic construct
  misc_feature 1..9876: note = derived and/or modified CDS sequence (opt5) from DENV-2__GU131959__SS-prME
  source 1..9876: mol_type = other RNA
accgccggagtgatcgtcatgctgattcccaccgttatggctttccacctcacgacccggaatggggagcctcatatgatcgtgggacggcaggaaaagggcaagagcctgctttttaagacggaggacggggtgaatatgtgcaccctgatggccattgatctcggagaactgtgtgaggacacaatcacctacaagtgcccgcttctgcgccaaaatgaacccgaggatattgactgttggtgcaattccacatctacctgggtcacgtatggcacctgtagcacaaccggggagcacagacgggaaaagcgctccgtggcgctcgttcctcatgtgggaatgggcctggagacaagaaccgaaacgtggatgtctagcgagggcgcttggaaacacgtccagcggatcgagacatggatcctgcgccatcccgggttcaccattatggccgccatcctcgcttacacaattggaaccacccactttcagagagccctgatcttcattcttctgacagctgtggccccttccatgacgatgcggtgcatcggcatttctaaccgcgattttgttgaaggggtgagcggaggctcctgggtcgacatcgtgctcgagcacgggagctgtgtgaccacaatggcgaagaataagcccaccctggatttcgaacttatcaaaacagaggccaagcagcctgctaccctgagaaaatattgcattgaagccaagctcacgaacacaaccaccgagtctcggtgtccgacacaaggagagccctccctgaatgaggaacaggacaaacgctttatctgcaagcatagcatggtcgatagaggctggggcaacgggtgtggactgttcggcaaagggggaattgttacctgcgctatgtttacatgcaaaaagaatatggaaggcaaagtggtgcagcctgagaacctcgaatacacgatcgtcattacaccccactctggggaggagcatgccgtgggaaatgacacaggcaagcacggcaaagaaatcaagatcacccctcagtccagcattacagaggcggaactgaccgggtatggaacggttaccatggagtgttctccccggacaggccttgatttcaacgaaatggtgctgctccaaatggaggacaaagcctggctggtccaccgccagtggtttcttgatctgccgctcccttggctgcccggggctgacacccagggatccaattggatccagaaggagacactggtgaccttcaagaaccctcatgccaaaaagcaagacgttgtggtcctcggcagccaggaaggggctatgcacacggccctgacaggcgccaccgagattcagatgtcctctggaaatcttctgtttacaggccatctcaaatgcagactgcggatggataaacttcaactgaaagggatgagctactccatgtgtaccggaaagttcaagatcgtgaaagaaattgctgagacccagcacggcacaatcgtcatcagagtgcagtatgagggggacggaagcccctgcaagattcccttcgaaatcacggatctcgagaaacgccatgttctgggccggctgattaccgtgaaccctatcgtcacagaaaaggactctccggtgaacattgaggcggaacccccttttggggattcctacatcattatcggcgttgagcccggacagctcaaactgaattggttcaagaagggcagctctatcgggcaaatgtttgagaccacaatgagaggagccaaacgcatggctattcttggcgacaccgcctgggatttcgggagcctgggaggcgtgtttacgtccatcgggaaggccctccaccaggtcttcggcgctatttacggagccgcgttttctggcgtgagctggacaatgaaaatcctgattggggtgatcatcacctggattggaatgaacacccggtccacaagcctgtctgtttcccttgtcctcgtgggcgtggtcaccctgtatctgggggctatggtgcaggccgacagcggatgtgttgtgtcttggaagaataaagaactcaagtgcggctccgggatcttcattacagataacgtccacacgtggaccgagcagtacaagtttcaacctgaaagcccctccaaactggcctctgctatccagaaggcccatgaggaaggcatttgtggaatcagaagcgtgacacgccttgagaatctgatgtggaaacagatcaccccggagctcaaccacattctgtccgaaaatgaggttaagctgacaatcatgaccggcgacattaaagggatcatgcaggctggaaagcggtctcttagacctcaacccacggaactcaaatatagctggaagacctggggcaaggccaaaatgctgtccacagagagccataaccagaccttcctgattgatgggcctgaaacagcggagtgccccaataccaaccgcgcctggaactctctcgaggtggaagactacggatttggcgtcttcacaaccaacatctggctgaaacttcgggagaaacaggacgtgttttgtgattccaagctgatgagcgctgccatcaaagacaatagagctgttcacgccgatatgggctattggattgaatctgcgctcaacgagacgtggaagatggagaaggcctccttcatcgaagtgaaaagctgctactggcctaagtctcacacactgtggagcaatggggtcctggagtccgaaatgattatccccaaaaacttcgctggaccggtgagccagcataactatcgccctggctaccacacccaaaccgccgggccctggcatcttggaaagctcgagatggactttgatctgtgtgaaggcacaaccgtggtcgttacggaggactgcgggaatcggggaccctctctgagaacaaccacagcttccggcaaactcattaccgagtggtgctgtcggagctgcacactgcctccgcttcgctacagaggcgaagatgggtgttggtatggaatggagatccggcccctgaaggaaaaggaggaaaacctcgtgaatagcctggtgaccgccggccacgggcagattgacaacttctctctgggagtccttggcatggccctctttctggaggagatgctgagaacgcgcatcgggaccaaacatgctatcctcctggtggcggccagcttcgttacacttattaccggaaatatgtcctttcgggatctgggcagagtgatggtcatggtgggcgctacaatgaccgacgatatcgggatgggagttacgtacctcgccctgctggccgctttcaaggtgcgccctacatttgccgcgggccttctgctcagaaaactgacctctaaggaactcatgatggctacaattgggatcgccctgcttagccagtccaccattcccgagaccatcctggaactcacagacgccctggctctgggaatgatggtccttaaaatcgtgcggaacatggagaagtatcaactggccgttacgattatggcgatctcttgcgtgcctaatgctgtcattctccagaacgcctggaaggtgagctgtaccatcctggccgctgtgtccgtcagccccctcctgcttacatcttcccagcagaaagccgattggattcctctggctctcaccatcaagggcctgaatcccacagccatcttcctgaccacgcttagccgcacatctaaaaagagatcctggccgctgaacgaagcggttatggccgtggggatggtgagcattctcgcttcttccctgctcaaaaatgacatccctatgaccggacccctggtcgccggcggccttctgaccgtgtgctacgttctgacagggcggagcgctgacctcgagctggagcgcgccgccgatgtgaagtgggaagaccaagctgagatttccggaagctctcctatccttagcattaccatctccgaagatggctctatgagcattaaaaacgaggaggaagaacagacactgacgatcctcatcagaaccgggctgctcgtcatttccggagtgtttcccgtttctatcccgattacagcggccgcttggtatctgtgggaagtgaagaagcagcgggccggcgtcctttgggacgtgccttctccccctcccgtcgagaaagccgaactggaggatggggcttaccgcatcaagcagagaggcattctgggatattcccaaatcggcgccggggtgtacaaagagggaaccttccacacaatgtggcacgttacccggggcgcggtgctcatgcatcgcgggaagagaatcgaaccctcctgggctgacgtcaaaaaggatctgattagctacggaggcgggtggaaacttgagggagaatggaaagagggcgaagaggtgcaggttctggccctcgagcctggcaagaatccgcgggccgtgcagacgaaacccgggatctttaagaccaacacaggaaccattggcgctgtctccctggacttcagccctgggacatctggatcccccatcgtggatagaaaaggcaaggtggttgggctctatggaaatggcgtcgtgacccgcagcggcgcctacgtgtctgcgattgctcagacagaaaagtccatcgaggacaaccctgaaatcgaggatgacatttttcggaaaaagagactgacgatcatggatcttcaccccggggccggaaaaaccaagcgctatctgcctgccattgtccgggaagctatcaaaagaggcctgcgcacactcattctggccccgacccgggtggttgctgccgagatggaggaagcgcttagagggctgcccatccgctaccaaacccctgccattaagacagagcatacgggacgggaaatcgtggacctcatgtgtcacgctaccttcacaatgagactgctcagccccgtccgggtgcctaactataatctgatcattatggacgaggcccatttcaccgatcccgcttccatcgccgcccgcggctacatttctacaagagttgagatgggggaagctgcgggcatctttatgaccgccacgccgcctggaagccgggaccccttcccccagtccaacgctcctattatggatgaggaacgcgagatccccgaaagaagctggaactctggccacgagtgggtgacagactttaaggggaaaaccgtctggttcgtgccttccatcaaggccggaaacgatattgccgcttgccttcggaaaaatggcaagaaagttatccagctgagcagaaagacctttgactctgagtatgtgaagacacgcgccaacgattgggacttcgtcgtgaccacagatattagcgaaatgggggcgaattttaaagctgagcgggtgatcgacccgagacgctgtatgaagcccgtcattctgaccgatggagaggaacgggttatcctcgccggccctatgcccgtgacgcactcctctgccgctcaaagacgcgggcggatcggcagaaaccctaaaaatgaaaacgaccagtacatttacatgggagagcccctggagaatgacgaagattgcgcccattggaaggaggcgaaaatgcttctggacaacatcaatacaccggaaggcattatccctagcatgttcgagcccgaacgcgagaaggtggatgccattgacggggagtatagactccggggagaagctcgcaaaacctttgtcgatctgatgagacggggcgacctgcctgtgtggctcgcctacaaggttgctgccgaggggatcaactatgctgatcgcaagtggtgtttcgacggaattaaaaataaccagatccttgaagagaacatggaggtggaaatctggacaaaggagggcgaacgcaagaagctgaaaccccggtggctggatgccagaatttactccgaccctctcgcgctgaaggagtttaaggagttcgccgctgggcgcaaatctcttaccctgaatctcatcacggagatgggccggctgcccaccttcatgacacagaaggccagaaacgctctggataatctcgccgtccttcacaccgccgaggctggaggccgcgcgtataaccatgccctgagcgaactgccggagacactcgaaaccctgcttctgctcacactgctggctaccgtgacagggggaatttttctcttccttatgtccggcaaagggatcggaaagatgacactgggcatgtgctgcattatcaccgccagcatcctgctctggtacgcccaaattcagcctcactggatcgctgcctctattatcctggagtttttccttattgttctgctcatccccgaacccgagaaacagcggacccctcaggacaatcaactgacatatgtggtcatcgcgattctgaccgtggtcgccgctacaatggccaacgagatgggctttctcgaaaagacgaagaaagatcttgggctgggatccatcaccacacaggagagcgaatccaatattctggacatcgacctcagaccggcttctgcctggaccctgtacgcggtggccacaaccttcgttacgcccatgcttcggcacagcattgagaactcctctgtgaatgtgagcctgaccgctatcgccaaccaggctacagtcctcatgggcctggggaagggatggcctctgtccaaaatggatattggcgttcccctccttgccatcgggtgttacagccaggtgaatcctatcaccctgacagctgccctgctcctgcttgtggcgcattatgccattatcggacccggcctgcaagctaaggccacccgcgaagctcagaaaagagccgccgcgggcattatgaagaaccctacggtcgacgggatcacagtgattgatctcgagccgatcccctacgaccctaagtttgagaaacagctgggacaggttatgctgctcatcctttgcgtgacccaagtcctgatgatgcggacaacctgggctctgtgtgaagccctcaccctggctacaggccccatttctacgctttgggaggggaatcctggacgcttctggaacaccacaatcgccgtgtccatggccaatatttttagaggcagctatctggctggggccggactcctgttctctatcatgaagaacaccacaaatacccggcgcggcacgggcaacattggggaaacactgggagagaaatggaagtccagactcaacgcgcttggcaaaagcgagtttcagatctacaagaaatctgggatccaggaagtcgatcggaccctggccaaggagggaattaagcgcggcgaaaccgaccaccatgctgtgagcagagggtccgccaaactgcggtggttcgttgagagaaatatggtgacacccgaaggaaaggtcgtggatctcggctgcggccgcgggggatggtcttattactgtggcgggctgaaagacgttcgggaggtgaagggacttaccaaaggcgggccgggacacgaggaacctatccccatgagcacatatggctggaacctggtcagactccaatccggcattgatgtgtttttcacgccccctgagaagtgcgacaccctgctgtgtgatatcggggaaagctcccccaatcctacaattgaggctggacgcaccctccgggtgcttaacctggttgaaaattggctgaacaataacacacagttctgcatcaaggtcctcaatccgtacatgccctctgtgatcgagaaaatggagaccctgcagagaaagtacggcggggcccttgtgcgcaaccctctgagcagaaattccacgcatgaaatgtattgggtctctaacgcgaccggaaatattgttagctccgtgaacatgatctctagaatgctcattaatcgctttacaatgaaacacaagaaagccacctacgagcccgacgtggatctgggcagcgggacacggaacatcggaattgaatccgagatccctaacctggacattatcggcaagagaatcgaaaagattaaacaggagcacgagaccagctggcattatgaccaagatcacccctacaagacatgggcttatcatggctcttacgaaaccaaacagacggggtccgccagctctatggtcaatggagtggttcgcctccttacaaagccgtgggacgtggtccctatggtgacccagatggctatgaccgatacaacgcccttcggccagcaacgggtttttaaagagaaggtggacaccagaacacaggaacctaaggaggggaccaaaaagctgatgaaaatcacagccgagtggctgtggaaggaactcggcaagaagaaaacccccagaatgtgtacaagagaggagttcacccggaaggtccgctccaacgctgccctgggcgcgatttttacggatgagaataagtggaaaagcgccagagaagctgtggaggacgggcggttctgggagcttgtggatagagaacggaacctgcacctcgagggaaagtgcgaaacctgtgtctataatatgatgggcaaacgcgagaagaaactgggcgaatttgggaaggccaagggatctagagctatctggtacatgtggctgggcgcccggttcctcgagtttgaggccctggggttccttaacgaagaccactggttttcccgcggaaatagcctgtccggcgttgagggggaaggcctccatagactgggatacattcttcgggatgtgggcaaaaaggaagggggagcgatgtatgctgacgatacagccggctgggacacccgcatcacactggaagacctcaaaaacgaggagatggtgaccaatcacatgaagggggaacataaaaagctggccgaggctatcttcaagctgacgtaccagaacaaagtcgtgagagttcagcggcctacaccccgcggaaccgtgatggatattatcagcagacgggaccaacgcggctctgggcaggtcggcacatatggactcaatacctttacgaacatggaagcccagctgattagacaaatggagggcgaggggatcttcaagagcattcagcaccttaccgctacagaagagatcgccgtgcagaattggctggcgcgggttggacgcgaaagactctcccggatggccatctctggcgatgactgcgtggtcaaaccgattgatgacagattcgctagcgccctgaccgctcttaacgatatggggaaggtgcgcaaagacatccagcaatgggagccttcccggggatggaatgattggacacaggttcccttttgctctcatcacttccacgaactggtgatgaaggacggcagagtcctcgtggtcccctgtcgcaaccaggatgagctgattgggcgggccagaatcagccagggcgcgggatggtccctgaaggagaccgcctgcctcggcaaatcttacgctcaaatgtggacactgatgtattttcatcgccgggaccttagactggccgctaacgccatttgtagcgctgtgccttcccactgggttccgaccagccgcacgacatggtctatccatgccaagcacgaatggatgaccaccgaggatatgctcgcggtgtggaatcgggtctggattcaggaaaacccctggatggaggacaaaacacctgtggaatcctgggaggaggtgccctacctggggaagagagaagaccagtggtgcggaagccttatcggcctgacctctcgcgccacatgggctaaaaatatccagacggccattaaccaagttcggtccctcatcgggaatgaggaatataccgattacatgcctagcatgaagagattccggaaggaggaagaggaggccggagtgctgtggtga

SEQ ID NO: 19730 - RNA, 9876 nt, synthetic construct
  misc_feature 1..9876: note = derived and/or modified CDS sequence (opt5) from DENV-2__GQ868515__SS-prME
  source 1..9876: mol_type = other RNA
accgccggagtcatcgtcatgctgattcccaccgttatggctttccacctcacgaccagaaatggggagcctcatatgatcgtgggacggcaggaaaagggcaagagcctgctttttaagacagaggacggggtgaatatgtgcaccctgatggccattgatctcggagaactgtgtgaggacacaatcacctacaagtgcccgcttctgagacaaaacgaacccgaggatattgactgttggtgcaatagcacatctacctggatcacgtatggcacctgtagcacaaccggggagcaccggcgggaaaagcgctccgtcgcgctcgtgcctcatgttggaatgggcctggagacaagaaccgaaacgtggatgtctagcgagggcgcttggaagcacgtgcagcggatcgagacatggattctgcgccatcccgggttcaccatcatggccgccattctcgcttacacaatcggaaccacccactttcagagagccctgattttcatccttctgacagctgtcgccccttccatgacgatgcggtgcattggcatctctaaccgcgattttgtggaaggggttagcggaggctcctgggtggacatcgtcctcgagcacgggagctgtgtgaccacaatggcgaagaataagcccaccctggatttcgaacttattaaaacagaggccaagcagcctgctaccctgagaaaatattgcatcgaagccaagctcacgaacacaaccaccgagtctcggtgtccgacacaaggagagccctccctgaatgaagaacaggacaaacgctttatttgcaagcatagcatggtggatagaggctggggcaacgggtgtggactgttcggcaaagggggaatcgtgacctgcgctatgtttacatgcaaaaagaatatggaaggcaaagttgtgcagcctgagaacctcgaatacacgattgtgatcacaccccactctggggaggagcatgccgtcggaaatgacacaggcaagcacggcaaagaaatcaagattacccctcagtccagcatcacagaggcggaactgaccgggtatggaacggtgaccatggagtgttctccccggacaggccttgatttcaacgaaatggttctgctccaaatggaggacaaagcctggctggtgcaccgccagtggtttcttgatctgccgctcccttggctgcccggggctgacacccagggatccaattggattcagaaggagacactggtcaccttcaagaaccctcatgccaaaaagcaagacgtggttgtgctcggcagccaggaaggggctatgcacacggccctgacaggcgccaccgagatccagatgtcctctggaaatcttctgtttacaggccatctcaaatgcagactgcggatggataaacttcaactgaaagggatgagctactccatgtgtaccggaaagttcaagattgtcaaagaaatcgctgagacccagcacggcacaatcgtgattagagtccgctatgagggggacggaagcccctgcaagatccccttcgaaattacggattctgagaaacggcatgtgctcggcagactgatcaccgttaaccctattgtgacagaaaaggactccccggtcaacatcgaggcggaacccccttttggggatagctacattatcatcggcgtggagcccggacagctgaaactcaattggttcaagaagggctctagcattgggcagatgtttgagaccacaatgcgcggagccaaacggatggctatcctgggcgacaccgcctgggatttcgggtcccttggaggcgtttttacgtctattgggaaggccctgcaccaagtgttcggcgctatctacggagccgcgtttagcggcgtctcctggacaatgaaaattctcatcggggtgatcattacctggatcggaatgaacagcagatctacctccctgagcgtgtctctggttcttgtcggcgtggtgattctctatctgggggctatggtccaggccgactccggatgtgtggttagctggaagaataaagaactgaagtgcggctccgggatcttcattacagataacgtgcacacctggacagagcagtacaagtttcagcctgaatctcccagcaaactcgcctccgctatccaaaaggcccatgaggaaggcatctgtggaattagatctgtcacgcggctggagaatcttatgtggaaacagatcaccccggagctgaaccacattctcagcgaaaatgaggtgaagctgacaatcatgaccggcgacattaaagggatcatgcaggctggaaagagatccctgcgccctcagcccacagaacttaaatatagctggaagacctggggcaaggccaaaatgctctctacggagtcccataaccaaaccttcctgatcgatgggcctgaaacagcggagtgccccaataccaaccgggcctggaatagcctggaggttgaagactacggatttggcgtgttcacaaccaacatttggctcaagctgagagagaaacaggacgtcttttgtgattctaaacttatgtccgctgccatcaaagacaatcgcgctgtgcacgccgatatgggctattggattgaaagcgcgctgaacgacacatggaagatggagaaggcctctttcatcgaggttaaaagctgccactggcctaagtcccataccctctggagcaatggggtgctggaatctgagatgattatccccaaaaacttcgctggaccggtctcccagcacaactaccggcctggctatcatacgcagacagccgggccctggcacctgggaaaacttgaaatggattttgacctctgtgagggcaccaccgtggtggtcacagaagattgcgggaatagaggacccagcctgcggaccacgacagcttccggcaaactgattaccgagtggtgctgtcgctcttgcacactccctccgctgagataccggggcgaggacgggtgttggtacggaatggaaatcagaccccttaaggagaaggaagagaacctggttaatagcctcgtgaccgccggccatgggcaaatcgataacttctccctgggagtgctgggcatggccctttttctcgaagagatgctgcgcacacggattgggaccaaacacgctatcctgctcgtcgcggcctctttcgtgacgctgattaccggaaatatgagctttagagaccttggccgcgttatggtgatggtcggcgctacaatgaccgatgacatcgggatgggagtgacatatctggccctcctggccgctttcaaggttagacctacctttgccgcgggcctgcttctgcggaaactcacgtccaaggagctgatgatggctacaattgggatcgccctcctgtctcagagcaccatccccgaatccattcttgagctgacagatgccctcgctctgggaatgatggtgctgaaaatcgtccgcaacatggaaaagtaccagcttgccgtgaccattatggcgatcagctgcgttcctaatgctgtgattctgcaaaacgcctggaaggtctcttgtaccatcctcgccgctgtgtccgtgagccccctgctcctgacatcttcccagcagaaagccgactggatccctcttgctctgacgattaagggcctcaatcccaccgccatcttcctgacaaccctgagcagaacatctaaaaagcggtcctggccgcttaacgaggcggtcatggccgttgggatggtgagcattctggcttccagcctcctgaaaaatgacatccctatgaccggacccctcgtggccggcggcctgcttacggtctgctatgtgctgacagggcgctctgctgatctggaactcgagagagccgccgacgttaagtgggaggatcaggctgaaattagcggatcctctcctatcctgagcattaccatctccgaggacggctctatgagcatcaaaaacgaagaggaggaacaaacccttacaattctgatccggaccgggctcctggtgatttccggagtctttcccgtgtctatcccgattacagcggccgcttggtacctctgggaggttaagaagcagcgcgccggcgtgctgtgggatgtccctagccctcctcccgtggaaaaagccgagcttgaagacggggcttatagaatcaagcagcggggaatcctgggctactcccagattggcgccggggtctataaagagggaacgttccacaccatgtggcatgtgacacgcggcgcggttctgatgcacagagggaagcggatcgagccctcctgggctgatgtgaaaaaggacctcatttcttacggaggcgggtggaagctggaaggagagtggaaagaaggcgaggaagtccaagtgcttgccctggagcccggcaagaatccgagagccgttcagaccaaacccgggatctttaagacaaacaccggaacgattggcgctgtgtccctcgatttcagccctgggacctctggatcccccatcgtcgaccgcaaaggcaaggtggtggggctgtacggaaatggcgttgtcacacggagcggcgcctatgtgtccgcgatcgctcagaccgagaagtctattgaagataaccctgagatcgaagacgatatttttcgcaagaagcgcctcacaatcatggacctgcatcccggggccggaaaaaccaagcggtaccttcctgccattgtgagagaggctatcaaacgcggcctgcggacactgattctcgccccgacgagagtcgtggctgccgaaatggaggaggcgctgcgcgggcttcccatccggtatcagacccctgccatcaagacagaacacaccggaagagagattgttgacctgatgtgtcatgctaccttcacaatgcggctcctgagccccgtgcgcgtccctaactacaatctcatcattatggatgaagcccacttcacggaccccgcttccatcgccgccagaggctatattagcacccgggtggagatgggggaggctgcgggcatctttatgacagccaccccgcctggatctcgcgatcccttcccccaatccaacgctcctatcatggacgaagagagagaaattcccgagcggagctggaactctggccacgaatgggttacagattttaaggggaaaaccgtgtggttcgtccctagcatcaaggccggaaacgacattgccgcttgcctgcgcaagaatggcaagaaagtgatccagctttcccgcaagacgtttgattctgagtacgttaagacacgggccaacgactgggatttcgtggtcaccaccgacattagcgagatgggggcgaattttaaagctgaaagagtgatcgatccgcgccggtgtatgaagcccgtgatcctgacagacggagaggaaagagtcattctggccggccctatgcccgttacccattcctctgccgctcagcgccgggggagaatcggccgcaaccctaaaaatgagaacgaccaatatatttacatgggagaacccctcgagaatgatgaggactgcgcccactggaaggaagcgaaaatgctgcttgataacatcaatacaccggagggcattatccctagcatgttcgaacccgagagagaaaaggtggacgccattgatggggagtaccggctgcgcggagaggctagaaaaacctttgtggacctcatgcggcgcggcgatctgcctgtctggctggcctataaggtggctgccgaagggatcaactacgctgacagaaagtggtgtttcgatggaatcaaaaataaccagattctcgaggaaaacatggaggttgagatctggacgaaggaaggcgagcggaagaaacttaaacccagatggctggacgcccgcatttattccgatcctctggcgctcaaagaatttaaggagttcgccgctgggcggaaaagcctgacacttaatctgatcaccgaaatgggcagactccccacattcatgacccagaaggcccgcaacgctctggacaatctggccgtgctccatacggccgaggctggaggccgggcgtacaaccacgccctttctgagctgccggaaaccctggagacactcctgcttctgaccctcctggctacagtcaccgggggaatttttctgttcctcatgtccggcaaagggatcggaaagatgacacttggcatgtgctgcatcattaccgccagcatcctgctgtggtatgcccagattcaacctcactggatcgctgcctccattatcctcgaatttttcctgatcgtgcttctgattcccgagcccgaaaaacagagaacgcctcaggataatcagctcacatacgttgtgatcgcgattctgaccgtcgtggccgctaccatggccaacgagatgggctttctggagaagacaaagaaagacctcgggcttggatctatcaccacacaagaaagcgagtccaatattctggacatcgatctgcggccggcttctgcctggacgctctatgcggtcgccaccacattcgtgacccccatgctgcgccatagcattgaaaactccagcgttaatgtgtctcttacagctatcgccaaccaggctaccgtgctgatgggcctcgggaagggatggcctctgtccaaaatggacatcggcgtccccctgctcgccattgggtgttacagccaggttaatcctatcacgcttaccgctgccctgctgctcctggtggcgcactacgccattatcggacccggccttcaggctaaggccacaagagaggctcaaaaacgggccgccgcgggcattatgaagaaccctaccgtggatgggatcacagtcatcgacctggaaccgattccctatgatcctaagtttgagaaacagctcggacaggtgatgctgctgatcctctgcgttacccaggtgcttatgatgcgcacgacatgggctctgtgtgaggccctgaccctcgctacaggccccatttctaccctgtgggaagggaatcctggaagattctggaacaccacaatcgccgtctccatggccaatatttttcggggcagctaccttgctggggccggactcctgttctctatcatgaagaacacgaccaatacacgcagaggcaccggcaacatcggggagacactgggagaaaaatggaaaagccggctgaacgcgctcggcaaatccgagtttcaaatttataagaaatctgggatccaggaggtggaccgcacccttgccaaggaaggaattaagagaggcgagacggatcatcacgctgtcagccgggggtccgccaaactgagatggttcgtggaacgcaatatggttacacccgagggaaaggtggtcgacctgggctgcggcagagggggatggagctactattgtggcgggctcaaagatgtgagagaagttaagggactgaccaaaggcgggccgggacatgaggagcctatccccatgtccacctacggctggaaccttgtgcgcctgcagtctggcattgacgtctttttcacaccccctgaaaagtgcgataccctcctgtgtgacatcggggagagctcccccaatcctacaatcgaagctggacggacgctgagagtgctcaaccttgtggagaattggctgaacaataacacccaattctgcattaaggttctgaatccgtatatgccctctgtcatcgagaagatggagacactccagcgcaagtacggcggggccctggtgcggaaccctcttagcagaaattccacccacgagatgtactgggtgtctaacgcgacaggaaatattgtcagctccgttaacatgatcagccgcatgctgattaatcggtttaccatgaaacacaagaaagccacgtatgaacccgatgtggacctcggctctgggaccagaaacatcggaattgagtccgaaatccctaacctggacatcattggcaagcgcatcgagaagattaaacaggaacatgagacaagctggcactacgatcaggaccatccctataagacctgggcttaccacggctcttatgagacaaaacaaaccgggtccgccagctctatggtgaatggagtcgtgcggctgctcacaaagccgtgggatgttgtgcctatggtcacccagatggctatgacggacacaacccccttcggccagcagagagtgtttaaagaaaaggttgatacccgcacacaagagcctaaggaagggacgaagaaacttatgaaaatcaccgccgagtggctgtggaaagagctgggcaagaagaaaacacccagaatgtgtacccgggaagagttcacacgcaaggtgagatccaacgctgccctcggcgcgatttttaccgacgaaaataagtggaaaagcgcccgggaggctgtcgaagatgggagattctgggagctggtggaccgggagcgcaaccttcacctggaaggaaagtgcgagacatgtgtgtacaatatgatgggcaaaagagaaaagaaactcggcgagtttgggaaggccaagggatcccgggctatctggtatatgtggctgggcgcccgcttcctggaatttgaggccctcgggttcctgaacgaggatcattggtttagcagaggaaattctcttagcggcgtcgaaggggagggcctgcaccggctcggatacatcctgcgcgacgttggcaaaaaggaagggggagcgatgtacgctgatgacaccgccggctgggacacgagaattacccttgaggatctgaaaaacgaagagatggtgacaaatcatatgaagggggagcacaaaaagctcgccgaagctatcttcaagctgacctatcagaacaaagtggtccgggtgcagcgccctacacccagaggaaccgttatggacattatctcccggcgcgatcagagaggctctgggcaagtgggcacgtacggactgaatacatttaccaacatggaggcccagctcattcggcagatggaaggcgaggggatcttcaagaatatccaacatctgacagctaccgaggaaattgccgtccagaactggcttgcgcgcgtgggaagagagcggctgagcagaatggccatctccggcgacgattgcgttgtgaaaccgattgacgatcgcttcgcttctgccctcacggctctgaatgacatggggaaggtccggaaagatatccagcagtgggaacctagcagaggatggaacgactggacccaagtgcccttttgctcccaccacttccatgagcttgttatgaaggatggccgcgtgctggtcgtgccctgtcggaaccaggacgaactcattgggagagcccgcatctctcagggcgcgggatggagcctgaaggagacagcctgcctgggcaaatcctatgctcagatgtggaccctcatgtactttcaccggagagatctgcgccttgccgctaatgccatttgtagcgctgtcccttctcattgggtgccgacatcccggaccacatggagcatccacgccaagcacgagtggatgaccacggaagacatgctggcggtttggaacagagtgtggatccaagagaatccctggatggaagacaaaacacctgtcgagtcttgggaagaggtgccctatctcgggaagcgcgaggatcagtggtgcggatccctgattggccttaccagccgggccacctgggctaaaaacatccagacagccattaatcaggtgagatccctgatcgggaacgaagagtacaccgactatatgccttctatgaagcggttcagaaaggaagaggaagaggccggagttctctggtga

SEQ ID NO: 19731 - RNA, 9876 nt, synthetic construct
  misc_feature 1..9876: note = derived and/or modified CDS sequence (opt5) from DENV-2__GQ868516__SS-prME
  source 1..9876: mol_type = other RNA
accgccggcgtgatcgtcatgctgattcccacagttatggctttccacctcacgaccagaaacggggagcctcatatgatcgtgggacggcaggaaaagggcaaaagcctgctttttaagacagaggacggggtgaatatgtgcaccctgatggccattgatctcggagaactgtgtgaggacacaatcacctacaaatgcccgcttctgcgccaaaacgaacccgaggatattgactgttggtgcaattccacatctacctggatcacgtatggcacctgtagcacaaccggggagcacagacgggaaaagcgctccgtcgcgctcgtgcctcatgttggaatgggcctggagacaagaaccgaaacgtggatgtctagcgagggcgcttggaaacacgtgcagcggatcgagacatggattctgcgccatcccgggttcaccatcatggccgccattctcgcttacacaatcggaaccacccactttcagagagccctgattttcatccttctgacagctgtcgccccttccatgacgatgcggtgcattggcatctctaaccgcgattttgtggaaggggttagcggaggctcctgggtggacatcgtcctcgagcacgggagctgtgtgaccacaatggcgaagaataagcccaccctggatttcgaacttattaaaacagaggccaagcagcctgctaccctgagaaaatattgcatcgaagccaagctcacgaacacaaccaccgagtctcggtgtccgacacaaggagagccctccctgaatgaagagcaggacaaacgctttatttgcaagcatagcatggtggatagaggctggggcaacgggtgtggactgttcggcaaggggggaatcgtcacctgcgctatgtttacatgcaaaaagaatatggaaggcaaagttgtgcagcctgagaacctcgaatacacgattgtgatcaccccccactctggggaggagcatgccgtcggaaatgacacaggcaagcacggcaaagaaatcaagattacccctcagtccagcatcacagaggcggaactgaccgggtatggaacggtgaccatggagtgttctccccggacaggccttgatttcaacgaaatggttctgctccaaatggaggacaaagcctggctggtgcaccgccagtggtttcttgatctgccgctcccttggctgcccggggctgacacccagggatccaattggattcagaaggagacactggtcaccttcaagaaccctcatgccaaaaagcaagacgtggttgtgctcggcagccaggaaggggctatgcacacggccctgacaggcgccaccgagatccagatgtcctctggaaatcttctgtttacaggccatctcaaatgcagactgcggatggataagcttcaactgaaagggatgagctactccatgtgtaccggaaagttcaagattgtcaaagaaatcgctgagacccagcacggcacaatcgtgattagagtccagtatgagggggacggaagcccctgcaagatccccttcgaaattacggatctcgagaaacgccatgtgctgggccggctgatcaccgttaaccctattgtgacagaaaaggactctccggtcaacatcgaggcggaacccccttttggggattcctacattatcatcggcgtggagcccggacagctcaaactgaattggttcaagaagggcagctctattgggcaaatgtttgagaccacaatgagaggagccaaacgcatggctatccttggcgacaccgcctgggatttcgggagcctgggaggcgtttttacgtccattgggaaggccctccaccaggtgttcggcgctatctacggagccgcgttttctggcgtcagctggacaatgaaaattctgatcggggtgatcattacctggatcggaatgaactcccggagcacctctctgtccgtgagccttgttctcgtcggcgtggtgattctgtatctgggggctatggtccaggccgactctggatgtgtggtttcctggaagaataaagaactcaagtgcggcagcgggatcttcattacagataacgtgcacacctggacagagcagtacaagtttcaacctgaatccccctctaaactggccagcgctatccagaaggcccatgaggaaggcatctgtggaattagatccgtcacgcgccttgagaatctgatgtggaaacagatcaccccggagctcaaccacattctgtctgaaaatgaggtgaagctgacaatcatgaccggcgacattaaagggatcatgcaggctggaaagcggagccttagacctcaacccacagaactcaaatattcctggaagacctggggcaaggccaaaatgctgagcacggagtctcataaccagaccttcctgatcgatgggcctgaaacagcggagtgccccaataccaaccgcgcctggaattccctcgaggttgaagactacggatttggcgtgttcacaaccaacatttggctgaagcttcgggagaaacaggacgtcttttgtgatagcaagctgatgtctgctgccatcaaagacaatagagctgtgcacgccgatatgggctattggattgaatccgcgctcaacgacacatggaagatggagaaggccagcttcatcgaggttaaatcttgccactggcctaagagccataccctgtggtccaatggggtgctggaaagcgagatgattatccccaaaaacttcgctggaccggtctctcagcacaactaccgccctggctatcatacgcaaacagccgggccctggcaccttggaaagctcgaaatggattttgacctgtgtgagggcaccaccgtggtggtcacagaagattgcgggaatcggggaccctccctgagaaccacgacagctagcggcaaactcattaccgagtggtgctgtcggtcctgcacactgcctccgcttcgctacagaggcgaggacgggtgttggtacggaatggaaatccggcccctgaaggagaaggaagagaacctcgttaattctctggtgaccgccggccatgggcagatcgataacttcagcctgggagtgcttggcatggccctctttctggaagagatgctgagaacacgcattgggaccaaacacgctatcctcctggtcgcggcctccttcgtgacgcttattaccggaaatatgtcttttcgggacctgggcagagttatggtgatggtcggcgctacaatgaccgatgacatcgggatgggagtgacatatctcgccctgctggccgctttcaaggttcgccctacctttgccgcgggccttctgctcagaaaactgacgagcaaggagctcatgatggctacaattgggatcgccctgctttcccagtctaccatccccgaaagcattctggagctcacagatgccctggctctgggaatgatggtgcttaaaatcgtccggaacatggaaaagtaccaactggccgtgaccattatggcgatctcctgcgttcctaatgctgtgattctccagaacgcctggaaggtcagctgtaccatcctggccgctgtgtctgtgtcccccctcctgcttacaagctctcagcagaaagccgactggatccctctggctctcacgattaagggcctgaatcccaccgccatcttcctgacaaccctttcccgcacaagcaaaaagagatcttggccgctgaacgaggcggtcatggccgttgggatggtgtccattctcgctagctccctgctcaaaaatgacatccctatgaccggacccctggtggccggcggccttctgacggtctgctatgtgctgacagggcggagcgctgatctcgaactggagcgcgccgccgacgttaagtgggaggatcaagctgaaatttctggaagctcccctatcctttctattaccatcagcgaggacggctccatgtctatcaaaaacgaagaggaggaacagaccctgacaattctcatcagaaccgggctgctcgtgattagcggagtctttcccgtgtccatcccgattacagcggccgcttggtacctgtgggaggttaagaagcagcgggccggcgtgctttgggatgtcccttctccccctcccgtggaaaaagccgagctggaagacggggcttatcgcatcaagcagagaggaatcctgggctacagccaaattggcgccggggtctataaagagggaacgttccacaccatgtggcatgtgacacggggcgcggttctcatgcaccgcgggaagagaatcgagccctcctgggctgatgtgaaaaaggacctgattagctacggaggcgggtggaagcttgaaggagagtggaaagaaggcgaggaagtccaggtgctggccctcgagcctggcaagaatccgcgggccgttcagaccaaacccgggatctttaagacaaacaccggaacgattggcgctgtgtctctggatttctcccctgggaccagcggatctcccatcgtcgacagaaaaggcaaggtggtggggctctacggaaatggcgttgtcacacgctccggcgcctatgtgagcgcgatcgctcagaccgagaagtccattgaagataaccctgagatcgaagacgatatttttcggaaaaagagactgacaatcatggaccttcatcccggggccggaaaaaccaagcgctacctgcctgccattgtgcgggaggctatcaaaagaggcctgcgcacactcattctggccccgacgcgggtcgtggctgccgaaatggaggaggcgcttagagggctgcccatccgctatcaaacccctgccatcaagacagaacacaccggacgggagattgttgacctcatgtgtcatgctaccttcacaatgagactgctctctcccgtgcgggtccctaactacaatctgatcattatggatgaagcccacttcacggaccccgctagcatcgccgcccgcggctatatttccaccagagtggagatgggggaggctgcgggcatctttatgacagccaccccgcctggaagccgggatcccttcccccagtctaacgctcctatcatggacgaagagcgcgaaattcccgagagatcctggaatagcggccacgaatgggttacagattttaaggggaaaaccgtgtggttcgtcccttctatcaaggccggaaacgacattgccgcttgccttcggaaaaatggcaagaaagtgatccagctgagcagaaagacgtttgattccgagtacgttaagacacgcgccaacgactgggatttcgtggtcaccaccgacatttctgagatgggggcgaattttaaagctgaacgggtgatcgatccgagacgctgtatgaagcccgtgatcctgacagacggagaggaacgggtcattctcgccggccctatgcccgttacccatagctccgccgctcaaagacgcgggcggatcggcagaaaccctaaaaatgagaacgaccagtatatttacatgggagaacccctggagaatgatgaggactgcgcccactggaaggaagcgaaaatgcttctggataacatcaatacaccggagggcattatcccttctatgttcgaacccgagcgcgaaaaggtggacgccattgatggggagtacagactccggggagaggctcgcaaaacctttgtggacctgatgagacggggcgatctgcctgtctggctcgcctataaggtggctgccgaagggatcaactacgctgaccgcaagtggtgtttcgatggaatcaaaaataaccagattcttgaggaaaacatggaggttgagatctggacgaaggaaggcgagagaaaaaagctgaaaccccggtggctggacgccagaatttatagcgatcctctcgcgctgaaggaatttaaggagttcgccgctgggcgcaaatcccttacactgaatctcatcaccgaaatgggccggctgcccacattcatgacccagaaggccagaaacgctctggacaatctcgccgtgcttcatacggccgaggctggaggccgcgcgtacaaccacgccctgagcgagctgccggaaaccctcgagacactgcttctgctcaccctgctggctacagtcaccgggggaatttttctcttccttatgtctggcaaagggatcggaaagatgacactgggcatgtgctgcatcattaccgcctccatcctgctctggtatgcccaaattcagcctcactggatcgctgccagcattatcctggaatttttccttatcgtgctgctcattcccgagcccgaaaaacagcggacgcctcaggataatcaactgacatacgttgtgatcgcgattctgaccgtcgtggccgctaccatggccaacgagatgggctttctcgagaagacaaagaaagaccttgggctgggatccatcaccacacaggaatctgagagcaatattctggacatcgatctcagaccggcttccgcctggacgctgtatgcggtcgccaccacattcgtgacccccatgcttcggcattctattgaaaacagctccgttaatgtgagcctgacagctatcgccaaccaggctaccgtgctcatgggcctggggaagggatggcctctgtctaaaatggacatcggcgtccccctccttgccattgggtgttactcccaggttaatcctatcacgctgaccgctgccctgctcctgcttgtggcgcactacgccattatcggacccggcctgcaagctaaggccacacgcgaggctcagaaaagagccgccgcgggcattatgaagaaccctaccgtggatgggatcacagtcatcgacctcgaaccgattccctatgatcctaagtttgagaaacagctgggacaggtgatgctgctcatcctttgcgttacccaagtgctgatgatgcggacgacatgggctctgtgtgaggccctcaccctggctacaggccccattagcaccctttgggaagggaatcctggacgcttctggaacaccacaatcgccgtctctatggccaatatttttagaggctcctacctggctggggccggactcctgttcagcatcatgaagaacacgaccaatacacggcgcggcaccggcaacatcggggagacactgggagaaaaatggaagtctagactcaacgcgcttggcaaaagcgagtttcagatttataagaaatccgggatccaggaggtggaccggaccctggccaaggaaggaattaagcgcggcgagacggatcatcacgctgtctctagagggagcgccaaactgcggtggttcgtggaaagaaatatggttacacccgagggaaaggtggtcgacctcggctgcggccgcgggggatggtcctactattgtggcgggctgaaagatgtgcgggaagttaagggacttaccaaaggcgggccgggacatgaggagcctatccccatgagcacctacggctggaacctggtgagactccaatccggcattgacgtctttttcacaccccctgaaaagtgcgataccctgctgtgtgacatcggggagtctagccccaatcctacaatcgaagctggacgcacgctccgggtgcttaacctggtggagaattggctgaacaataacacccagttctgcattaaggttctcaatccgtatatgccctccgtcatcgaaaaaatggagacactgcagagaaagtacggcggggcccttgtgcgcaaccctctgtctcggaatagcacccacgagatgtactgggtgtccaacgcgacaggaaatattgtctctagcgttaacatgatctccagaatgctcattaatcgctttaccatgaaacacaagaaagccacgtatgaacccgatgtggacctgggcagcgggacccggaacatcggaattgagtctgaaatccctaacctggacatcattggcaagagaatcgagaagattaaacaggaacatgagacatcctggcactacgatcaagaccatccctataagacctgggcttaccacggcagctatgagacaaaacagaccgggtctgcctccagcatggtgaatggagtcgtgcgcctccttacaaagccgtgggatgttgtgcctatggtcacccagatggctatgacggacacaacccccttcggccagcaacgggtgtttaaagaaaaggttgataccagaacacaggagcctaaggaagggacgaaaaagctgatgaaaatcaccgccgagtggctgtggaaggagctcggaaaaaagaaaacaccccgcatgtgtaccagagaagagttcacacggaaggtgcgctctaacgctgccctgggcgcgatttttaccgacgaaaataagtggaaatccgccagagaggctgtcgaagatgggcggttctgggagcttgtggacagagagcggaacctgcacctcgaaggaaagtgcgagacatgtgtgtacaatatgatgggcaaacgcgaaaagaaactgggcgagtttgggaaggccaagggaagcagagctatctggtatatgtggctgggcgcccggttcctcgaatttgaggccctggggttccttaacgaggatcattggttttcccgcggaaatagcctgtctggcgtcgaaggggagggcctccacagactgggatacatccttcgggacgttggcaaaaaggaagggggagcgatgtacgctgatgacaccgccggctgggacacgcgcattaccctggaggatctcaaaaacgaagagatggtgacaaatcatatgaagggggagcacaaaaagctggccgaagctatcttcaagctgacctatcagaacaaagtggtcagagtgcagcggcctacaccccgcggaaccgttatggacattatcagcagacgggatcaacgcggctccgggcaggtgggcacgtacggactcaatacatttaccaacatggaggcccagctgattagacaaatggaaggcgaggggatcttcaagaatatccagcatcttacagctaccgaggaaattgccgtccagaactggctggcgcgggtgggacgcgagagactctctcggatggccatcagcggcgacgattgcgttgtgaaaccgattgacgatagattcgcttccgccctgacggctcttaatgacatggggaaggtccgcaaagatatccagcaatgggaaccttctcggggatggaacgactggacccaggtgcccttttgcagccaccacttccatgagctggttatgaaggatggcagagtgctcgtcgtgccctgtcgcaaccaggacgaactgattgggcgggccagaatctcccagggcgcgggatggtctctgaaggagacagcctgcctcggcaaaagctatgctcaaatgtggaccctgatgtactttcaccgccgggatcttagactggccgctaatgccatttgttccgctgtccctagccattgggtgccgacatctcgcaccacatggtccatccacgccaagcacgagtggatgaccacggaagacatgctcgcggtttggaaccgggtgtggatccaggagaatccctggatggaagacaaaacacctgtcgagagctgggaagaggtgccctatctggggaagagagaggatcagtggtgcggatctcttattggcctgacctcccgcgccacctgggctaaaaacatccagacagccattaatcaagtgcggagcctcatcgggaacgaagagtacaccgactatatgccttccatgaagagattccggaaggaagaggaagaggccggagttctgtggtga

SEQ ID NO: 19732 - RNA, 9876 nt, synthetic construct
  misc_feature 1..9876: note = derived and/or modified CDS sequence (opt5) from DENV-2__GU131975__SS-prME
  source 1..9876: mol_type = other RNA
accgccggcgtgatcgtcatgctgattcccacagttatggctttccacctcacgaccagaaacggggagcctcatatgatcgtgggacggcaggaaaagggcaaaagcctgctttttaagacagaggacggggtgaatatgtgcaccctgatggccattgatctcggagaactgtgtgaggacacaatcacctacaaatgcccgcttctgcgccaaaacgaacccgaggatattgactgttggtgcaattccacatctacctggatcacgtatggcacctgtagcacaaccggggagcacagacgggaaaagcgctccgtcgcgctcgtgcctcatgttggaatgggcctggagacaagaaccgaaacgtggatgtctagcgagggcgcttggaaacacgtgcagcggatcgagacatggattctgcgccatcccgggttcaccatcatggccgccattctcgcttacacaatcggaaccacccactttcagagagccctgattttcatccttctgacagctgtcgccccttccatgacgatgcggtgcattggcatctctaaccgcgattttgtggaaggggttagcggaggctcctgggtggacatcgtcctcgagcacgggagctgtgtgaccacaatggcgaagaataagcccaccctggatttcgaacttattaaaacagaggccaagcagcctgctaccctgagaaaatattgcatcgaagccaagctcacgaacacaaccaccgagtctcggtgtccgacacaaggagagccctccctgaatgaagagcaggacaaacgctttatttgcaagcatagcatggtggatagaggctggggcaacgggtgtggactgttcggcaaggggggaatcgtcacctgcgctatgtttacatgcaaaaagaatatggaaggcaaagttgtgcagcctgagaacctcgaatacacgattgtgatcaccccccactctggggaggagcatgccgtcggaaatgacacaggcaagcacggcaaagaaatcaagattacccctcagtccagcatcacagaggcggaactgaccgggtatggaacggtgaccatggagtgttctccccggacaggccttgatttcaacgaaatggttctgctccaaatggaggacaaagcctggctggtgcaccgccagtggtttcttgatctgccgctcccttggctgcccggggctgacacccagggatccaattggattcagaaggagacactggtcaccttcaagaaccctcatgccaaaaagcaagacgtggttgtgctcggcagccaggaaggggctatgcacacggccctgacaggcgccaccgagatccagatgtcctctggaaatcttctgtttacaggccatctcaaatgcagactgcggatggataagcttcaactgaaagggatgagctactccatgtgtaccggaaagttcaagattgtcaaagaaatcgctgagacccagcacggcacaatcgtgattagagtccagtatgagggggacggaagcccctgcaagatccccttcgaaattacggatctcgagaaacgccatgtgctgggccggctgatcaccgttaaccctattgtgacagaaaaggactctccggtcaacatcgaggcggaacccccttttggggattcctacattatcatcggcgtggagcccggacagctcaaactgaattggttcaagaagggcagctctattgggcaaatgtttgagaccacaatgagaggagccaaacgcatggctatccttggcgacaccgcctgggatttcgggagcctgggaggcgtttttacgtccattgggaaggccctccaccaggtgttcggcgctatctacggagccgcgttttctggcgtcagctggacaatgaaaattctgatcggggtgatcattacctggatcggaatgaactcccggagcacctctctgtccgtgagccttgttctcgtcggcgtggtgattctgtatctgggggctatggtccaggccgactctggatgtgtggtttcctggaagaataaagaactcaagtgcggcagcgggatcttcattacagataacgtgcacacctggacagagcagtacaagtttcaacctgaatccccctctaaactggccagcgctatccagaaggcccatgaggaaggcatctgtggaattagatccgtcacgcgccttgagaatctgatgtggaaacagatcaccccggagctcaaccacattctgtctgaaaatgaggtgaagctgacaatcatgaccggcgacattaaagggatcatgcaggctggaaagcggagccttagacctcaacccacagaactcaaatattcctggaagacctggggcaaggccaaaatgctgagcacggagtctcataaccagaccttcctgatcgatgggcctgaaacagcggagtgccccaataccaaccgcgcctggaattccctcgaggttgaagactacggatttggcgtgttcacaaccaacatttggctgaagcttcgggagaaacaggacgtcttttgtgatagcaagctgatgtctgctgccatcaaagacaatagagctgtgcacgccgatatgggctattggattgaatccgcgctcaacgacacatggaagatggagaaggccagcttcatcgaggttaaatcttgccactggcctaagagccataccctgtggtccaatggggtgctggaaagcgagatgattatccccaaaaacttcgctggaccggtctctcagcacaactaccgccctggctatcatacgcaaacagccgggccctggcaccttggaaagctcgaaatggattttgacctgtgtgagggcaccaccgtggtggtcacagaagattgcgggaatcggggaccctccctgagaaccacgacagctagcggcaaactcattaccgagtggtgctgtcggtcctgcacactgcctccgcttcgctacagaggcgaggacgggtgttggtacggaatggaaatccggcccctgaaggagaaggaagagaacctcgttaattctctggtgaccgccggccatgggcagatcgataacttcagcctgggagtgcttggcatggccctctttctggaagagatgctgagaacacgcattgggaccaaacacgctatcctcctggtcgcggcctccttcgtgacgcttattaccggaaatatgtcttttcgggacctgggcagagttatggtgatggtcggcgctacaatgaccgatgacatcgggatgggagtgacatatctcgccctgctggccgctttcaaggttcgccctacctttgccgcgggccttctgctcagaaaactgacgagcaaggagctcatgatggctacaattgggatcgccctgctttcccagtctaccatccccgaaagcattctggagctcacagatgccctggctctgggaatgatggtgcttaaaatcgtccggaacatggaaaagtaccaactggccgtgaccattatggcgatctcctgcgttcctaatgctgtgattctccagaacgcctggaaggtcagctgtaccatcctggccgctgtgtctgtgtcccccctcctgcttacaagctctcagcagaaagccgactggatccctctggctctcacgattaagggcctgaatcccaccgccatcttcctgacaaccctttcccgcacaagcaaaaagagatcttggccgctgaacgaggcggtcatggccgttgggatggtgtccattctcgctagctccctgctcaaaaatgacatccctatgaccggacccctggtggccggcggccttctgacggtctgctatgtgctgacagggcggagcgctgatctcgaactggagcgcgccgccgacgttaagtgggaggatcaagctgaaatttctggaagctcccctatcctttctattaccatcagcgaggacggctccatgtctatcaaaaacgaagaggaggaacagaccctgacaattctcatcagaaccgggctgctcgtgattagcggagtctttcccgtgtccatcccgattacagcggccgcttggtacctgtgggaggttaagaagcagcgggccggcgtgctttgggatgtcccttctccccctcccgtggaaaaagccgagctggaagacggggcttatcgcatcaagcagagaggaatcctgggctacagccaaattggcgccggggtctataaagagggaacgttccacaccatgtggcatgtgacacggggcgcggttctcatgcaccgcgggaagagaatcgagccctcctgggctgatgtgaaaaaggacctgattagctacggaggcgggtggaagcttgaaggagagtggaaagaaggcgaggaagtccaggtgctggccctcgagcctggcaagaatccgcgggccgttcagaccaaacccgggatctttaagacaaacaccggaacgattggcgctgtgtctctggatttctcccctgggaccagcggatctcccatcgtcgacagaaaaggcaaggtggtggggctctacggaaatggcgttgtcacacgctccggcgcctatgtgagcgcgatcgctcagaccgagaagtccattgaagataaccctgagatcgaagacgatatttttcggaaaaagagactgacaatcatggaccttcatcccggggccggaaaaaccaagcgctacctgcctgccattgtgcgggaggctatcaaaagaggcctgcgcacactcattctggccccgacgcgggtcgtggctgccgaaatggaggaggcgcttagagggctgcccatccgctatcaaacccctgccatcaagacagaacacaccggacgggagattgttgacctcatgtgtcatgctaccttcacaatgagactgctctctcccgtgcgggtccctaactacaatctgatcattatggatgaagcccacttcacggaccccgctagcatcgccgcccgcggctatatttccaccagagtggagatgggggaggctgcgggcatctttatgacagccaccccgcctggaagccgggatcccttcccccagtctaacgctcctatcatggacgaagagcgcgaaattcccgagagatcctggaatagcggccacgaatgggttacagattttaaggggaaaaccgtgtggttcgtcccttctatcaaggccggaaacgacattgccgcttgccttcggaaaaatggcaagaaagtgatccagctgagcagaaagacgtttgattccgagtacgttaagacacgcgccaacgactgggatttcgtggtcaccaccgacatttctgagatgggggcgaattttaaagctgaacgggtgatcgatccgagacgctgtatgaagcccgtgatcctgacagacggagaggaacgggtcattctcgccggccctatgcccgttacccatagctccgccgctcaaagacgcgggcggatcggcagaaaccctaaaaatgagaacgaccagtatatttacatgggagaacccctggagaatgatgaggactgcgcccactggaaggaagcgaaaatgcttctggataacatcaatacaccggagggcattatcccttctatgttcgaacccgagcgcgaaaaggtggacgccattgatggggagtacagactccggggagaggctcgcaaaacctttgtggacctgatgagacggggcgatctgcctgtctggctcgcctataaggtggctgccgaagggatcaactacgctgaccgcaagtggtgtttcgatggaatcaaaaataaccagattcttgaggaaaacatggaggttgagatctggacgaaggaaggcgagagaaaaaagctgaaaccccggtggctggacgccagaatttatagcgatcctctcgcgctgaaggaatttaaggagttcgccgctgggcgcaaatcccttacactgaatctcatcaccgaaatgggccggctgcccacattcatgacccagaaggccagaaacgctctggacaatctcgccgtgcttcatacggccgaggctggaggccgcgcgtacaaccacgccctgagcgagctgccggaaaccctcgagacactgcttctgctcaccctgctggctacagtcaccgggggaatttttctcttccttatgtctggcaaagggatcggaaagatgacactgggcatgtgctgcatcattaccgcctccatcctgctctggtatgcccaaattcagcctcactggatcgctgccagcattatcctggaatttttccttatcgtgctgctcattcccgagcccgaaaaacagcggacgcctcaggataatcaactgacatacgttgtgatcgcgattctgaccgtcgtggccgctaccatggccaacgagatgggctttctcgagaagacaaagaaagaccttgggctgggatccatcaccacacaggaatctgagagcaatattctggacatcgatctcagaccggcttccgcctggacgctgtatgcggtcgccaccacattcgtgacccccatgcttcggcattctattgaaaacagctccgttaatgtgagcctgacagctatcgccaaccaggctaccgtgctcatgggcctggggaagggatggcctctgtctaaaatggacatcggcgtccccctccttgccattgggtgttactcccaggttaatcctatcacgctgaccgctgccctgctcctgcttgtggcgcactacgccattatcggacccggcctgcaagctaaggccacacgcgaggctcagaaaagagccgccgcgggcattatgaagaaccctaccgtggatgggatcacagtcatcgacctcgaaccgattccctatgatcctaagtttgagaaacagctgggacaggtgatgctgctcatcctttgcgttacccaagtgctgatgatgcggacgacatgggctctgtgtgaggccctcaccctggctacaggccccattagcaccctttgggaagggaatcctggacgcttctggaacaccacaatcgccgtctctatggccaatatttttagaggctcctacctggctggggccggactcctgttcagcatcatgaagaacacgaccaatacacggcgcggcaccggcaacatcggggagacactgggagaaaaatggaagtctagactcaacgcgcttggcaaaagcgagtttcagatttataagaaatccgggatccaggaggtggaccggaccctggccaaggaaggaattaagcgcggcgagacggatcatcacgctgtctctagagggagcgccaaactgcggtggttcgtggaaagaaatatggttacacccgagggaaaggtggtcgacctcggctgcggccgcgggggatggtcctactattgtggcgggctgaaagatgtgcgggaagttaagggacttaccaaaggcgggccgggacatgaggagcctatccccatgagcacctacggctggaacctggtgagactccaatccggcattgacgtctttttcacaccccctgaaaagtgcgataccctgctgtgtgacatcggggagtctagccccaatcctacaatcgaagctggacgcacgctccgggtgcttaacctggtggagaattggctgaacaataacacccagttctgcattaaggttctcaatccgtatatgccctccgtcatcgaaaaaatggagacactgcagagaaagtacggcggggcccttgtgcgcaaccctctgtctcggaatagcacccacgagatgtactgggtgtccaacgcgacaggaaatattgtctctagcgttaacatgatctccagaatgctcattaatcgctttaccatgaaacacaagaaagccacgtatgaacccgatgtggacctgggcagcgggacccggaacatcggaattgagtctgaaatccctaacctggacatcattggcaagagaatcgagaagattaaacaggaacatgagacatcctggcactacgatcaagaccatccctataagacctgggcttaccacggcagctatgagacaaaacagaccgggtctgcctccagcatggtgaatggagtcgtgcgcctccttacaaagccgtgggatgttgtgcctatggtcacccagatggctatgacggacacaacccccttcggccagcaacgggtgtttaaagaaaaggttgataccagaacacaggagcctaaggaagggacgaaaaagctgatgaaaatcaccgccgagtggctgtggaaggagctcggaaaaaagaaaacaccccgcatgtgtaccagagaagagttcacacggaaggtgcgctctaacgctgccctgggcgcgatttttaccgacgaaaataagtggaaatccgccagagaggctgtcgaagatgggcggttctgggagcttgtggacagagagcggagcctgcacctcgaaggaaagtgcgagacatgtgtgtacaacatgatgggcaaacgcgaaaagaaactgggcgagtttgggaaggccaagggatccagagctatctggtatatgtggctgggcgcccggttcctcgaatttgaggccctggggttccttaatgaggatcattggtttagccgcggaaactctctgagcggcgtcgaaggggagggcctccacagactgggatacatccttcgggacgttggcaaaaaggaagggggagcgatgtacgctgatgacaccgccggctgggacacgcgcattaccctggaggatctcaaaaatgaagagatggtgacaaaccatatgaagggggagcacaaaaagctggccgaagctatcttcaagctgacctatcagaataaagtggtcagagtgcagcggcctacaccccgcggaaccgttatggacattatctccagacgggatcaacgcggctctgggcaggtgggcacgtacggactcaacacatttaccaatatggaggcccagctgattagacaaatggaaggcgaggggatcttcaagaacatccagcatcttacagctaccgaggaaattgccgtccagaattggctggcgcgggtgggacgcgagagactcagccggatggccatctccggcgacgattgcgttgtgaaaccgattgacgatagattcgcttctgccctgacggctcttaacgacatggggaaggtccgcaaagatatccagcaatgggaacctagccggggatggaatgactggacccaggtgcccttttgctcccaccacttccatgagctggttatgaaggatggcagagtgctcgtcgtgccctgtcgcaaccaggacgaactgattgggcgggccagaatctctcagggcgcgggatggagcctgaaggagacagcctgcctcggcaaatcctatgctcaaatgtggaccctgatgtactttcaccgccgggatcttagactggccgctaacgccatttgtagcgctgtcccttctcattgggtgccgacatcccgcaccacatggagcatccacgccaagcacgagtggatgaccacggaagacatgctcgcggtttggaatcgggtgtggatccaggagaacccctggatggaagacaaaacacctgtcgagtcttgggaagaggtgccctatctggggaagagagaggatcagtggtgcggatcccttattggcctgaccagccgcgccacctgggctaaaaatatccagacagccattaaccaagtgcggtccctcatcgggaatgaagagtacaccgactatatgccttctatgaagagattccggaaggaagaggaagaggccggagttctgtggtga

SEQ ID NO: 19733 - RNA, 9876 nt, synthetic construct
  misc_feature 1..9876: note = derived and/or modified CDS sequence (opt5) from DENV-2__JN819422__SS-prME
  source 1..9876: mol_type = other RNA
accgccggcgtgatcgtcatgctgattcccacggctatggccttccacctcacgaccagaaatggggagcctcatatgatcgttggacggcaggaaaagggcaaaagcctgctttttaagacagaggacggggtgaatatgtgcaccctgatggcgattgatctcggagaactgtgtgaggacacaatcacctacaaatgcccgcttctgcgccaaaatgaacccgaggatattgactgttggtgcaattccacatctacctgggtgacgtatggcacctgtacaaccacaggggagcacagacgggaaaagcgcagcgttgctctcgtgcctcatgttggaatgggcctggagaccagaacggaaacatggatgtcctctgagggcgcctggaaacacgtgcagcggatcgagacctggatcctgcgccatcccgggttcacaattatggccgctatcctcgcctacaccattggaaccacacactttcagaaggctctgatcttcattcttctgacggccgtcgcgcctagcatgaccatgagatgcatcggcatttccaaccgggattttgtggaaggggtttctggaggcagctgggtggacatcgtcctcgagcacgggtcctgtgtgacaaccatggccaagaataaacccacactggatttcgaacttatcaagaccgaggctaaacagcctgccacgctgcgcaagtattgcattgaagctaaactcacaaacaccaccacagagagcagatgtccgacccaaggagagccctctctgaatgaggaacaggacaagcggtttatctgcaagcattccatggtggatcgcggctggggcaacgggtgtggactgttcggcaaagggggaattgtcacatgcgccatgtttacgtgcaagaaaaatatggaaggcaaggttgtgcagcctgagaacctcgaatacaccatcgtgattacaccccacagcggggaggagcatgcggtcggaaatgacaccggcaaacacggcaaggaaatcaaaatcacacctcagtcttccattaccgaggccgaactgacggggtatggaaccgtgacaatggagtgtagccccagaaccggccttgatttcaacgaaatggttctgctccaaatggaggacaaggcttggctggtgcaccggcagtggtttcttgatctgccgctcccttggctgcccggggccgacacacagggatctaattggatccagaaggagaccctggtcacgttcaaaaaccctcatgctaagaaacaagacgtggttgtgctcggctcccaggaaggggccatgcacacagccctgaccggcgctacagagattcagatgagctccggaaatcttctgtttaccggccatctcaagtgccgcctgagaatggataaacttcaactgaaggggatgtcttacagcatgtgtaccggaaagttcaaaatcgtcaaggaaattgcggagacacagcacggcacgatcgtgatccgggtccagtatgagggggacggatccccctgcaaaattcccttcgaaatcaccgatctcgagaagagacatgtgctgggccgcctgattacagttaaccctatcgtgaccgaaaaagacagcccggtcaacattgaggccgaacccccttttggggattcttacatcattatcggcgtggagcccggacagctcaagctgaattggttcaagaaaggctccagcatcgggcaaatgtttgagacaaccatgcggggagctaagagaatggccattcttggcgacacggcctgggatttcgggtctctgggaggcgtttttacaagcatcgggaaagctctccaccaggtgttcggcgccatttacggagcggctttttccggcgtctcttggaccatgaagatcctgattggggtgatcatcacctggattggaatgaacagccgctccacaagcctgtctgtgtcccttgttctcgtcggcgtggtgaccctgtatctgggggccatggtccaggccgacagcggatgtgtggtttcttggaaaaataaggaactcaagtgcggctccgggatcttcattacagataacgtgcacacgtggaccgagcagtacaaatttcaacctgaaagcccctccaagctggcttctgccatccagaaagctcatgaggaaggcatttgtggaatccggagcgtcacaagacttgagaatctgatgtggaagcagatcaccccggagctcaaccacattctgtccgaaaatgaggtgaaactgacaatcatgaccggcgacattaaggggatcatgcaggccggaaaacgctctcttcggcctcaacccacggaactcaagtatagctggaagacctggggcaaagcgaagatgctgtccacagagagccataaccagaccttcctgattgatgggcctgaaacagccgagtgccccaataccaacagagcttggaactctctcgaggttgaagactacggatttggcgtgttcacaaccaacatctggctgaaacttcgcgagaagcaggacgtcttttgtgattccaaactgatgagcgccgctatcaaggacaatcgggccgtgcacgcggatatgggctattggattgaatctgccctcaacgacacgtggaagatggagaaggctagcttcatcgaggttaagagctgccactggcctaaatctcatacactgtggagcaatggggtgctggaatccgagatgattatccccaagaacttcgccggaccggtcagccagcacaactacagacctggctatcatacccaaaccgctgggccctggcaccttggaaaactcgaaatggattttgacctgtgtgagggcacaaccgtggtggtcacggaagattgcgggaatcgcggaccctctctgcggacaaccacagcctccggcaagctcattaccgagtggtgctgtagaagctgcacactgcctccgcttcggtaccgcggcgaggacgggtgttggtacggaatggaaatcagacccctgaaggagaaagaagagaacctcgttaattccctggtgaccgccggccatgggcagattgataacttctctctgggagtgcttggcatggctctctttctggaagagatgctgcggacgagaatcgggaccaagcacgcgatcctcctggtcgccgtgagcttcgttacacttattaccggaaatatgtcctttcgcgacctgggccgggtgatggtcatggtgggcgctacaatgaccgatgacatcgggatgggagttacgtatctcgccctgctggccgctttcaaagtgagacctacatttgccgcgggccttctgctccgcaagctgacctctaaagagctcatgatggctacaattgggatcgccctgcttagccagtccaccattcccgaaaccatcctggagctcacagatgccctggctctgggaatgatggtccttaagatcgtgagaaacatggaaaagtaccaactggccgttacgattatggcgatctcttgcgtgcctaatgctgtcattctccagaacgcctggaaagtgagctgtaccatcctggccgctgtgtccgtcagccccctcctgcttacatcttcccagcagaaggccgactggattcctctggctctcaccatcaaaggcctgaatcccacagccatcttcctgaccacgcttagccggacatctaagaaacgctcctggccgctgaacgaggcgattatggccgttgggatggtgagcatcctcgcttcttccctgctcaagaatgacattcctatgaccggacccctggtggccggcggccttctgaccgtctgctatgtgctgacagggagaagcgctgatctcgaactggagcgggccgccgacgttaaatgggaggatcaagctgaaatctccggaagctctcctattcttagcatcaccatttccgaggacggctctatgagcatcaagaacgaagaggaggaacagacactgacgatcctcattcgcaccgggctgctcgtgatctccggagtctttcccgtgtctattccgatcacagcggccgcttggtacctgtgggaggttaagaaacagagagccggcgtgctttgggatgtcccttctccccctcccgtggaaaaggccgagctggaagacggggcttatcggattaaacagcgcggaatcctgggctactcccaaatcggcgccggggtctataaggagggaaccttccacacaatgtggcatgtgaccagaggcgcggttctcatgcaccgggggaaacgcattgagccctcctgggctgatgtgaagaaggacctgatcagctacggaggcgggtggaaacttgaaggagagtggaaggaaggcgaggaagtccaggtgctggccctcgagcctggcaaaaatccgagagccgttcagacgaagcccgggatttttaaaaccaacacaggaaccatcggcgctgtgtccctggatttcagccctgggacatctggatcccccattgtcgaccggaagggcaaggtggtggggctctacggaaatggcgttgtcaccagaagcggcgcctatgtgtctgcgatcgctcagacagagaaatccatcgaagataaccctgagattgaagacgatatctttcgcaagaaacggctgacgattatggaccttcatcccggggccggaaagaccaaaagatacctgcctgccatcgtgcgcgaggctattaagcggggcctgagaacactcatcctggccccgacccgcgtcgtggctgccgaaatggaggaggcgcttcgggggctgcccattagatatcaaacccctgccatcaagacacagcacacgggacgcgaaatcgttgacctcatgtgtcatgctaccttcacaatgcggctgctcagccccgtgagagtccctaactacaatctgattatcatggatgaggcccacttcaccgaccccgcttccattgccgcccggggctatatctctacacgcgtggaaatgggggaggctgcgggcatttttatgaccgccacgccgcctggaagcagagatcccttcccccagtccaacgctcctatcatggacgaggaacgggagatccccgaacgcagctggaactctggccacgagtgggttacagattttaaagggaagaccgtgtggttcgtcccttccattaaagccggaaacgacatcgccgcttgccttagaaagaatggcaaaaaggtgattcaactgagccggaagacctttgattctgaatacgttaaaacaagagccaacgactgggatttcgtggtcaccacagacatcagcgagatgggggcgaattttaaggctgagcgcgtgattgatccgcggagatgtatgaaacccgtgatcctgaccgacggagaagaacgcgtcatcctcgccggccctatgcccgttacgcattcctctgccgctcagcggagagggcgcattggccggaaccctaagaatgaaaacgaccagtatatctacatgggagagcccctggaaaatgatgaggactgcgcccactggaaagaggcgaagatgcttctggataacattaatacaccggaaggcatcattcctagcatgttcgagcccgaaagagagaaagtggacgccatcgatggggaataccgcctcagaggagaggctcggaagacctttgtggacctgatgcgcagaggcgatctgcctgtctggctcgcctataaggtggctgccgaggggattaactacgctgaccggaaatggtgtttcgatggaatcaagaataaccagatccttgaagagaacattgaagttgagatctggacaaaagagggcgaacgcaagaaactgaagcccagatggctggacgcccggatttattccgatcctctcgcgctgaaggagtttaaagagttcgccgctgggagaaagtctcttaccctgaatctcatcacggagatgggccgcctgcccaccttcatgacacaaaaagcccggaacgctctggacaatctcgccgtgcttcataccgccgaagctggaggcagagcgtacaaccacgccctgagcgagctgccggagacactcgaaaccctgcttctgctcacactgctggctaccgtcacagggggaatttttctcttccttatgtccggcaagggggtgggaaaaatgacactgggcatgtgctgcatcatcaccgccagcattctgctctggtatgcccagatccagcctcactggattgctgcctctatcattctggagtttttccttatcgttctgctcatccccgaacccgagaagcagcgcacccctcaagataatcagctgacatacgtggtcattgcgatcctgaccgtggtcgccgctacaatggccaacgaaatgggctttctcgagaagacgaaaaaggaccttgggctgggatccattaccacacaggagagcgaatccaatatcctggacattgatctccggccggcttctgcctggaccctgtatgcggtggccacaaccttcgttacgcccatgcttagacatagcatcgagaactcctctgtgaatgtgagcctgaccgctattgccaaccaggctacagtcctcatgggcctggggaaaggatggcctctgtccaagatggacatcggcgttcccctccttgccatcgggtgttacagccaagtgaatcctattaccctgacagctgccctgctcctgcttgtggcgcactacgccatcattggacccggcctgcaggctaaagccacccgggaagctcagaagcgcgccgccgcgggcatcatgaagaaccctacggtcgatgggattacagtgatcgacctcgagccgatcccctatgatcctaaatttgaaaagcagctgggacaagttatgctgctcattctttgcgtgacccaggtcctgatgatgagaacaacctgggctctgtgtgaggccctcaccctggctacaggccccatctctacgctttgggaggggaatcctggacggttctggaacaccacaattgccgtgtccatggccaatatctttcgcggcagctacctggctggggccggactcctgttctctattatgaaaaacaccacaaataccagacggggcacgggcaacatcggggaaacactgggagagaagtggaaatcccgcctcaacgcgcttggcaagagcgaatttcaggtctataaaaagtctgggatccaagaggtggacagaaccctggccaaggagggaattaaacggggcgaaaccgatcatcacgctgttagccgcgggtccgccaagctgagatggttcgtggagcggaatatggtcacacccgaaggaaaagtggttgacctcggctgcggcagagggggatggtcttactattgtggcgggctgaagaacgtgcgcgaggtcaaaggacttaccaagggcgggccgggacatgaagaacctatccccatgagcacatacggctggaatctggtgcggctccagtccggcgtggatgtctttttcacgccccctgagaagtgcgacaccctgctgtgtgatattggggaaagctcccccaaccctacaatcgaggctggaagaaccctccgcgtccttaatctggtggaaaactggctgaataacaatacacagttctgcattaaagtgctcaacccgtatatgccctctgtcatcgagaagatggaagccctgcagcggaaatacggcggggcgcttgttagaaatcctctgagccgcaactccacccacgagatgtactgggtgtctaatgccacgggaaacatcgtgagctccgtcaatatgatttctcggatgctcatcaacagatttaccatgaagcacaaaaaggctacatatgagcccgacgtggatctgggcagcgggacccgcaacattggaatcgaatccgagattcctaatctggacatcattggcaagcggatcgagaaaatcaagcaagagcatgaaacaagctggcactacgaccaggatcatccctataaaacctgggcctaccacggctcttatgagacaaagcagaccgggtccgctagctctatggttaacggagtggtcagactccttacgaaaccgtgggacgtggttcctatggtgacacagatggccatgaccgataccacacccttcggccaacagcgcgtctttaaggagaaggtggacacgcggacccaggaacctaaagaggggacaaagaaactgatgaagattaccgctgaatggctgtggaaagagctcggaaagaaaaagacacccagaatgtgtacccgcgaggagttcacaagaaaggtgcggtccaatgccgcgctgggcgccatctttaccgatgagaacaaatggaaaagcgctcgcgaagccgtcgaggacgggagattctgggaacttgttgatcgggagagaaatctgcacctcgagggaaaatgcgaaacgtgtgtgtacaacatgatgggcaagcgggagaaaaagctgggcgaatttgggaaggctaaaggatctcgcgccatttggtatatgtggctgggcgccagattcctcgagtttgaagcgctggggttccttaatgaggaccattggttttcccggggaaacagcctgtccggcgtggagggggaaggcctccaccgcctgggatacatccttagagatgtcggcaagaaagaagggggagctatgtacgccgacgataccgccggctgggacacacggattaccctggaagacctcaagaatgaggaaatggtgacaaaccatatgaaaggggagcacaagaagctggctgaggccatcttcaaactgacctatcagaataaggttgtgcgcgtccaaagacctacgccccggggaacagtgatggatatcattagccgcagagaccagcggggctctgggcaggttggcacctacggactcaacacatttaccaatatggaagctcaactgatccgccagatggagggcgaagggattttcaaaagcatccagcatcttacggccaccgaggagattgcggtgcagaactggctggccagagtcggacgggaacgcctctccagaatggctatctctggcgatgactgcgtggttaagccgatcgatgaccggttcgccagcgctctgacagcccttaatgatatggggaaagtgagaaaggacattcaacagtgggagccttcccgcggatggaacgattggacccaggtccccttttgctctcaccacttccatgaactggtgatgaaggacggccgggtcctcgtggttccctgtagaaaccaggatgagctgatcgggcgcgcgcggattagccaaggcgccggatggtccctgaaagaaacagcttgcctcggcaagtcttatgcccagatgtggaccctgatgtactttcacagacgcgaccttcggctggctgccaatgctatctgtagcgccgtgcctccgcattgggtccccacatccagaaccacgtggagcattcacgcgaaacacgagtggatgacaaccgaggatatgctcgccgtgtggaaccgcgtgtggatccaggaaaatccttggatggaggacaagacccccgttgaatcttgggaggaagtgccttatctggggaaacgggaggaccagtggtgcggatcccttattggcctgacaagcagagctacctgggccaagaacatccaaacagccatcaatcaggtccgctctctcattgggaacgaggaatacacggattatatgccctccatgaagcggttcagacgggaggaagaggaagctggagtgctgtggtga

SEQ ID NO: 19734 - RNA, 9876 nt, synthetic construct
  misc_feature 1..9876: note = derived and/or modified CDS sequence (opt5) from DENV-2__GU131955__SS-prME
  source 1..9876: mol_type = other RNA
accgccggagtgatcgtgatgctgattcccacagttatggctttccacctcacgacccggaatggggagcctcatatgatcgtgggacggcaggaaaagggcaaaagcctgctttttaagacagaggacggggtgaatatgtgcaccctgatggccattgatctcggagaactgtgtgaggacacaatcacctacaaatgcccgcttctgcgccaaaatgaacccgaggatattgactgttggtgcaattccacatctacctgggtcacgtatggcacctgtagcacaaccggggagcacagacgggaaaagcgctccgtggcgctcgttcctcatgtgggaatgggcctggagacaagaaccgaaacgtggatgtctagcgagggcgcttggaaacacgtccagcggatcgagacatggatcctgcgccatcccgggttcaccattatggccgccatcctcgcttacacaattggaaccacccactttcagagagccctgatcttcattcttctgacagctgtggccccttccatgacgatgcggtgcatcggcatttctaaccgcgattttgttgaaggggtgagcggaggctcctgggtcgacatcgtgctcgagcacgggagctgtgtgaccacaatggcgaagaataagcccaccctggatttcgaacttatcaaaacagaggccaagcagcctgctaccctgagaaaatattgcattgaagccaagctcacgaacacaaccaccgagtctcggtgtccgacacaaggagagccctccctgaatgaagaacaggacaaacgctttatctgcaagcatagcatggtcgatagaggctggggcaacgggtgtggactgttcggcaaagggggaattgttacctgcgctatgtttacatgcaaaaagaatatggaaggcaaagtggtgcagcctgagaacctcgaatacacgatcgtcattacaccccactctggggaggagcatgccgtgggaaatgacacaggcaagcacggcaaagaaatcaagatcacccctcagtccagcattacagaggcggaactgaccgggtatggaacggttaccatggagtgttctccccggacaggccttgatttcaacgaaatggtgctgctccaaatggaggacaaagcctggctggtccaccgccagtggtttcttgatctgccgctcccttggctgcccggggctgacacccagggatccaattggatccagaaggagacactggtgaccttcaagaaccctcatgccaaaaagcaagacgttgtggtcctcggcagccaggaaggggctatgcacacggccctgacaggcgccaccgagattcagatgtcctctggaaatcttctgtttacaggccatctcaaatgcagactgcggatggataaacttcaactgaaagggatgagctactccatgtgtaccggaaagttcaagatcgtgaaagaaattgctgagacccagcacggcacaatcgtcatcagagtgcagtatgagggggacggaagcccctgcaagattcccttcgaaatcacggatctcgagaaacgccatgttctgggccggctgattaccgtgaaccctatcgtcacagaaaaggactctccggtgaacattgaggcggaacccccttttggggattcctacatcattatcggcgttgagcccggacagctcaaactgaattggttcaagaagggcagctctatcgggcaaatgtttgagaccacaatgagaggagccaaacgcatggctattcttggcgacaccgcctgggatttcgggagcctgggaggcgtgtttacgtccatcgggaaggccctccaccaggtcttcggcgctatttacggagccgcgttttctggcgtgagctggacaatgaaaatcctgattggggtgatcatcacctggattggaatgaactcccggagcacctctctgtccgttagccttgtcctcgtgggcgtggtcacactgtatctgggggctatggtgcaggccgactctggatgtgttgtgtcctggaagaataaagaactcaagtgcggcagcgggatcttcattaccgataacgtccacacatggacggagcagtacaagtttcaacctgaatccccctctaaactggccagcgctatccagaaggcccatgaggaaggcatttgtggaatcagatccgtgacccgccttgagaatctgatgtggaaacagatcacaccggagctcaaccacattctgtctgaaaatgaggttaagctgaccatcatgacaggcgacattaaagggatcatgcaggctggaaagcggagccttagacctcaacccaccgaactcaaatattcctggaagacgtggggcaaggccaaaatgctgagcaccgagtctcataaccagacattcctgattgatgggcctgaaaccgcggagtgccccaatacaaaccgcgcctggaactccctcgaggtggaagactacggatttggcgtcttcaccacaaacatctggctgaaacttcgggagaaacaggacgtgttttgtgatagcaagctgatgtctgctgccatcaaagacaatagagctgttcacgccgatatgggctattggattgaatccgcgctcaacgacacctggaagatggagaaggccagcttcatcgaggtgaaatcttgccactggcctaagagccatacgctgtggtccaatggggtcctggaaagcgagatgattatccccaaaaacttcgctggaccggtgtctcagcacaactaccgccctggctatcatacacaaaccgccgggccctggcaccttggaaagctcgaaatggattttgacctgtgtgagggcaccacagtggtcgttaccgaagattgcgggaatcggggaccctccctgagaacgacaaccgctagcggcaaactcattacagagtggtgctgtcggtcctgcaccctgcctccgcttcgctacagaggcgaggacgggtgttggtacggaatggaaatccggcccctgaaggagaaggaagagaacctcgtcaattctctggtgacagccggccatgggcagattgataacttcagcctgggagtccttggcatggccctctttctggaagagatgctgagaacccgcatcgggacgaaacacgctatcctcctggtggcggcctccttcgttacccttattacaggaaatatgtcttttcgggacctgggcagagtgatggtcatggtgggcgctaccatgacagatgacatcgggatgggagttacctatctcgccctgctggccgctttcaaggtgcgccctacgtttgccgcgggccttctgctcagaaaactgacaagcaaggagctcatgatggctaccattgggatcgccctgctttcccagtctacaattcccgaaaccatcctggagctcaccgatgccctggctctgggaatgatggtccttaaaatcgtgcggaacatggaaaagtaccaactggccgttacaattatggcgatcagctgcgtgcctaatgctgtcattctccagaacgcctggaaggtgtcctgtacgatcctggccgctgtgagcgtctctcccctcctgcttacctccagccagcagaaagccgactggattcctctggctctcacaatcaagggcctgaatcccaccgccatcttcctgacaaccctttctcgcacgtccaaaaagagaagctggccgctgaacgaggcggttatggccgtggggatggtgtctattctcgcttccagcctgctcaaaaatgacatccctatgacaggacccctggtcgccggcggccttctgaccgtgtgctatgttctgaccgggcggtccgctgatctcgaactggagcgcgccgccgacgtgaagtgggaggatcaagctgaaattagcggatctagccctatcctttccattacaatctctgaggacggcagcatgtccattaaaaacgaagaggaggaacagaccctgacaatcctcatcagaacggggctgctcgtcatttctggagtgtttcccgttagcatcccgattaccgcggccgcttggtacctgtgggaggtgaagaagcagcgggccggcgtcctttgggatgtgccttctccccctcccgtcgaaaaagccgagctggaagacggggcttatcgcatcaagcagagaggcattctgggatacagccaaatcggcgccggggtgtataaagagggaacattccacaccatgtggcatgttacacggggcgcggtgctcatgcaccgcgggaagagaatcgagcccagctgggctgatgtcaaaaaggacctgatttcctacggaggcgggtggaaacttgaaggagagtggaaagaaggcgaggaagtgcaggttctggccctcgagcctggcaagaatccgcgggccgtgcagaccaaacccgggatctttaagacgaacaccggaacaattggcgctgtcagcctggatttctctcctgggacctccggaagccccatcgtggacagaaaaggcaaggtggttgggctctacggaaatggcgtcgtgacacgctctggcgcctatgtgtccgcgattgctcagaccgaaaagagcatcgaggataaccctgagatcgaagacgatatttttcggaaaaagagactgacaatcatggaccttcatcccggggccggaaaaacgaagcgctacctgcctgccattgtccgggaggctatcaaaagaggcctgcgcaccctcattctggccccgacacgggtggttgctgccgaaatggaggaggcgcttagagggctgcccatccgctatcaaacccctgccattaagaccgaacacacaggacgggagatcgtggacctcatgtgtcatgctacgttcaccatgagactgctctcccccgtccgggtgcctaactacaatctgatcattatggatgaagcccacttcacagaccccgcttctatcgccgcccgcggctatattagcaccagagttgagatgggggaggctgcgggcatctttatgacagccaccccgcctggatcccgggatcccttcccccagagcaacgctcctattatggacgaagagagagaaatccccgagagatcttggaactccggccacgaatgggtgacggattttaaggggaaaacagtctggttcgtgcctagcatcaaggccggaaacgacattgccgcttgccttcggaaaaatggcaagaaagttatccagctgtctagaaagacctttgatagcgagtacgtgaagacccgcgccaacgactgggatttcgtcgtgacaaccgacatttccgagatgggggcgaattttaaagctgaacgggtgatcgatccgagacgctgtatgaagcccgtcattctgacagacggagaggaacgggttatcctcgccggccctatgcccgtgacccattctagcgccgctcaaagacgcgggcggatcggcagaaaccctaaaaatgagaacgaccagtatatttacatgggagaacccctggagaatgatgaggactgcgcccactggaaggaagcgaaaatgcttctggataacatcaatacgccggagggcattatcccttccatgttcgaacccgagcgcgaaaaggtggacgccattgatggggagtacagactccggggagaggctcgcaaaacatttgtcgacctgatgagacggggcgatctgcctgtgtggctcgcctataaggttgctgccgaagggatcaactacgctgaccgcaagtggtgtttcgatggaattaaaaataaccagatccttgaggaaaacatggaggtggagatctggaccaaggaaggcgagcgcaagaagctgaaaccccggtggctggacgccagaatttattctgatcctctcgcgctgaaggaatttaaggagttcgccgctgggcgcaaaagccttacactgaatctcatcaccgaaatgggccggctgcccacgttcatgacccagaaggccagaaacgctctggacaatctcgccgtccttcatacagccgaggctggaggccgcgcgtacaaccacgccctgtccgagctgccggaaaccctcgagacactgcttctgctcaccctgctggctacagtgaccgggggaatttttctcttccttatgagcggcaaagggatcggaaagatgacgctgggcatgtgctgcattatcacagcctctatcctgctctggtatgcccaaattcagcctcactggatcgctgcctccattatcctggaatttttccttattgttctgctcatccccgagcccgaaaaacagcggacccctcaggataatcaactgacctacgtggtcatcgcgattctgacagtggtcgccgctaccatggccaacgagatgggctttctcgagaagacaaagaaagaccttgggctgggaagcatcacgacccaggaatccgagtctaatattctggacatcgatctcagaccggctagcgcctggacactgtatgcggtggccaccacattcgttacccccatgcttcggcattccattgaaaactctagcgtgaatgtgtccctgacggctatcgccaaccaggctaccgtcctcatgggcctggggaagggatggcctctgagcaaaatggacattggcgttcccctccttgccatcgggtgttactctcaggtgaatcctatcacactgaccgctgccctgctcctgcttgtggcgcactacgccattatcggacccggcctgcaagctaaggccacacgcgaggctcagaaaagagccgccgcgggcattatgaagaaccctaccgtcgatgggatcacggtgattgacctcgaaccgatcccctatgatcctaagtttgagaaacagctgggacaggttatgctgctcatcctttgcgtgacacaagtcctgatgatgcggaccacatgggctctgtgtgaggccctcaccctggctaccggccccatttccacactttgggaagggaatcctggacgcttctggaacacgaccatcgccgtgagcatggccaatatttttagaggctcttacctggctggggccggactcctgttctccatcatgaagaacacaaccaatacacggcgcggcaccggcaacattggggagacgctgggagaaaaatggaagtccagactcaacgcgcttggcaaatctgagtttcagatctataagaaaagcgggatccaggaggtcgaccggacactggccaaggaaggaattaagcgcggcgagaccgatcatcacgctgtgtccagagggtctgccaaactgcggtggttcgttgaaagaaatatggtgacccccgagggaaaggtcgtggacctcggctgcggccgcgggggatggagctactattgtggcgggctgaaagatgttcgggaagtgaagggacttacaaaaggcgggccgggacatgaggagcctatccccatgtccacctacggctggaacctggtcagactccaaagcggcattgacgtgtttttcacaccccctgaaaagtgcgatacgctgctgtgtgacatcggggagtcctctcccaatcctaccattgaagctggacgcacactccgggtgcttaacctggttgagaattggctgaacaataacacccagttctgcatcaaggtcctcaatccgtatatgcccagcgtgatcgagaagatggagacactgcagagaaagtacggcggggcccttgtgcgcaaccctctgtccagaaattctacccacgagatgtactgggtcagcaacgcgacgggaaatattgtttcctctgtgaacatgatcagcagaatgctcattaatcgctttaccatgaaacacaagaaagccacatatgaacccgatgtggacctgggctccgggacccggaacatcggaattgagagcgaaatccctaacctggacattatcggcaagagaatcgagaagattaaacaggaacatgagacatcttggcactacgatcaagaccatccctataagacctgggcttaccacggctcctatgagacaaaacagaccgggagcgcctcttccatggtcaatggagtggttcgcctccttacgaagccgtgggatgtggtccctatggtgacacagatggctatgaccgacaccacacccttcggccagcaacgggtttttaaagaaaaggtggatacgagaacccaggagcctaaggaagggaccaagaagctgatgaaaatcaccgccgagtggctgtggaaggagctcggcaagaagaaaacaccccgcatgtgtaccagagaagagttcacacggaaggtccgcagcaacgctgccctgggcgcgatttttaccgacgaaaataagtggaaatctgccagagaggctgtggaagatgggcggttctgggagcttgtggacagagagcggaacctgcacctcgaaggaaagtgcgagacgtgtgtctacaatatgatgggcaaacgcgaaaagaaactgggcgagtttgggaaggccaagggatccagagctatctggtatatgtggctgggcgcccggttcctcgaatttgaggccctggggttccttaacgaggatcattggtttagccgcggaaattccctgagcggcgttgaaggggagggcctccacagactgggatacattcttcgggacgtgggcaaaaaggaagggggagcgatgtacgctgatgacaccgccggctgggacacacgcatcaccctggaggatctcaaaaacgaagagatggtgacaaatcatatgaagggggagcacaaaaagctggccgaagctatcttcaagctgacctatcagaacaaagtcgtgagagttcagcggcctacgccccgcggaacagtgatggacattatctctagacgggatcaacgcggcagcgggcaggtcggcacctacggactcaatacatttaccaacatggaggcccagctgattagacaaatggaaggcgaggggatcttcaagtccattcagcatcttacggctaccgaggaaatcgccgtgcagaattggctggcgcgggttggacgcgagagactctctcggatggccatcagcggcgacgattgcgtggtcaaaccgattgacgatagattcgcttccgccctgacagctcttaacgacatggggaaggtgcgcaaagatatccagcaatgggaaccttctcggggatggaatgactggacccaggttcccttttgcagccaccacttccatgagctggtgatgaaggatggcagagtcctcgtggtcccctgtcgcaaccaggacgaactgattgggcgggccagaatctcccagggcgcgggatggtctctgaaggagacagcctgcctcggcaaaagctatgctcaaatgtggaccctgatgtactttcaccgccgggatcttagactggccgctaacgccatttgttccgctgtgcctagccattgggttccgacatctcgcaccacgtggtccatccacgccaagcacgagtggatgacaaccgaagacatgctcgcggtgtggaatcgggtctggattcaggagaacccctggatggaagacaaaacccctgtggagagctgggaagaggtgccctatctggggaagagagaggatcagtggtgcggatctcttatcggcctgacatcccgcgccacctgggctaaaaatatccagacagccattaaccaagttcggagcctcatcgggaatgaagagtacacggactatatgccttccatgaagagattccggaaggaagaggaagaggccggagtgctgtggtga

SEQ ID NO: 19735 - RNA, 9876 nt, synthetic construct
  misc_feature 1..9876: note = derived and/or modified CDS sequence (opt5) from DENV-2__KJ189311__SS-prME
  source 1..9876: mol_type = other RNA
accgccggagtgatcgtcatgctgattcccaccgttatggctttccacctcacgaccagaaatggggagcctcatatgatcgtgggacggcaggaaaagggcaagtccctgctttttaagacagaggacggggtgaatatgtgcaccctgatggccattgatctcggagaactgtgtgaggacaccatcacctacaaatgcccgcttctgcgccaaaacgaacccgaggatattgactgttggtgcaattccacatctacctggatcacgtatggcacctgtagcacaaccggggagcacagacgggaaaagcgctccgtcgcgctcgtgcctcatgttggaatgggcctggagacaagaaccgaaacgtggatgtctagcgagggcgcttggaaacacgtgcagcggatcgagacatggattctgcgccatcccgggttcaccatcatggccgccattctcgcttacacaatcggaaccacccactttcagagagccctgattttcatccttctgacagctgtcgccccttccatgacgatgcggtgcattggcatctctaaccgcgattttgtggaaggggttagcggaggctcctgggtggacatcgtcctcgagcacgggagctgtgtgaccacaatggcgaagaataagcccaccctggatttcgaacttattaaaacagaggccaagcagcctgctaccctgagaaaatattgcatcgaagccaagctcacgaacacaaccaccgagtctcggtgtccgacacaaggagagccctccctgaatgaagaacaggacaaacgctttatttgcaagcatagcatggtggatagaggctggggcaacgggtgtggactgttcggcaaagggggaatcgtgacctgcgctatgtttacatgcaaaaagaatatggaaggcaaagttgtgcagcctgagaacctcgaatacacgattgtgatcacaccccactctggggaggagcatgccgtcggaaatgacacaggcaagcacggcaaagaaatcaagattacccctcagtccagcatcacagaggcggaactgaccgggtatggaacggtgaccatggagtgttctccccggacaggccttgatttcaacgaaatggttctgctccaaatggaggacaaagcctggctggtgcaccgccagtggtttcttgatctgccgctcccttggctgcccggggctgacacccagggatccaattggattcagaaggagacactggtcaccttcaagaaccctcatgccaaaaagcaagacgtggttgtgctcggcagccaggaaggggctatgcacacggccctgacaggcgccaccgagatccagatgtcctctggaaatcttctgtttacaggccatctcaaatgcagactgcggatggataaacttcaactgaaagggatgagctactccatgtgtaccggaaagttcaagattgtcaaagaaatcgctgagacccagcacggcacaatcgtgattagagtccagtatgagggggacggaagcccctgcaagatccccttcgaaattacggatctcgagaaacgccatgtgctgggccggctgatcaccgttaaccctattgtgacagaaaaggactctccggtcaacatcgaggcggaacccccttttggggattcctacattatcatcggcgtggagcccggacagctcaaactgaattggttcaagaagggcagctctattgggcaaatgtttgagaccacaatgagaggagccaaacgcatggctatccttggcgacaccgcctgggatttcgggagcctgggaggcgtttttacgtccattgggaaggccctccaccaggtgttcggcgctatctacggagccgcgttttctggcgtcagctggacaatgaaaattctgatcggggtgatcattacctggatcggaatgaactcccggagcacctctctgtccgtgagccttgttctcgtcggcgtggtgattctgtatctgggggctatggtccaggccgactctggatgtgtggtttcctggaagaataaagaactcaagtgcggcagcgggatcttcattacagataacgtgcacacctggacagagcagtacaagtttcaacctgaatccccctctaaactggccagcgctatccagaaggcccatgaggaaggcatctgtggaattagatccgtcacgcgccttgagaatctgatgtggaaacagatcaccccggagctcaaccacattctgtctgaaaatgaggtgaagctgacaatcatgaccggcgacattaaagggatcatgcaggctggaaagcggagccttagacctcaacccacagaactcaaatattcctggaagacctggggcaaggccaaaatgctgagcacggagtctcataaccagaccttcctgatcgatgggcctgaaacagcggagtgccccaataccaaccgcgcctggaactccctcgaggttgaagactacggatttggcgtgttcacaaccaacatttggctgaaacttcgggagaaacaggacgtcttttgtgatagcaagctgatgtctgctgccatcaaagacaatagagctgtgcacgccgatatgggctattggattgaatccgcgctcaacgacacatggaagatggagaaggccagcttcatcgaggttaaatcttgccactggcctaagagccataccctgtggtccaatggggtgctggaaagcgagatgattatccccaaaaacttcgctggaccggtctctcagcacaactaccgccctggctatcatacgcaaacagccgggccctggcaccttggaaagctcgaaatggattttgacctgtgtgagggcaccaccgtggtggtcacagaagattgcgggaatcggggaccctccctgagaaccacgacagctagcggcaaactcattaccgagtggtgctgtcggtcctgcacactgcctccgcttcgctacagaggcgaggacgggtgttggtacggaatggaaatccggcccctgaaggagaaggaagagaacctcgttaattctctggtgaccgccggccatgggcagatcgataacttcagcctgggagtgcttggcatggccctctttctggaagagatgctgagaacacgcattgggaccaaacacgctatcctcctggtcgcggcctccttcgtgacgcttattaccggaaatatgtcttttcgggacctgggcagagttatggtgatggtcggcgctacaatgaccgatgacatcgggatgggagtgacatatctcgccctgctggccgctttcaaggttcgccctacctttgccgcgggccttctgctcagaaaactgacgagcaaggagctcatgatggctacaattgggatcgccctgctttcccagtctaccatccccgaaagcattctggagctcacagatgccctggctctgggaatgatggtgcttaaaatcgtccggaacatggaaaagtaccaactggccgtgaccattatggcgatctcctgcgttcctaatgctgtgattctccagaacgcctggaaggtcagctgtaccatcctggccgctgtgtctgtgagccccctcctgcttacaagctctcagcagaaagccgactggatccctctggctctcacgattaagggcctgaatcccaccgccatcttcctgacaaccctttcccgcacaagcaaaaagagatcttggccgctgaacgaggcggtcatggccgttgggatggtgtccattctcgctagctccctgctcaaaaatgacatccctatgaccggacccctggtggccggcggccttctgacggtctgctatgtgctgacagggcggagcgctgatctcgaactggagcgcgccgccgacgttaagtgggaggatcaagctgaaatttctggaagctcccctatcctttctattaccatcagcgaggacggctccatgtctatcaaaaacgaagaggaggaacagaccctgacaattctcatcagaaccgggctgctcgtgattagcggagtctttcccgtgtccatcccgattacagcggccgcttggtacctgtgggaggttaagaagcagcgggccggcgtgctttgggatgtcccttctccccctcccgtggaaaaagccgagctggaagacggggcttatcgcatcaagcagagaggaatcctgggctacagccaaattggcgccggggtctataaagagggaacgttccacaccatgtggcatgtgacacggggcgcggttctcatgcaccgcgggaagagaatcgagccctcctgggctgatgtgaaaaaggacctgattagctacggaggcgggtggaaacttgaaggagagtggaaagaaggcgaggaagtccaggtgctggccctcgagcctggcaagaatccgcgggccgttcagaccaaacccgggatctttaagacaaacaccggaacgattggcgctgtgtctctggatttctcccctgggaccagcggatctcccatcgtcgacagaaaaggcaaggtggtggggctctacggaaatggcgttgtcacacgctccggcgcctatgtgagcgcgatcgctcagaccgagaagtccattgaagataacctggagatcgaagacgatatttttcggaaaaagagacttacaatcatggacctgcatcctggggccggaaaaaccaagcgctacctgcccgccattgtgcgggaggctatcaaaagaggcctccgcacactgattcttgcccctacgcgggtcgtggctgccgaaatggaggaggcgctgagagggctcccgatccgctatcaaacccccgccatcaagacagaacacaccggacgggagattgttgacctgatgtgtcatgctaccttcacaatgagactcctgtctcctgtgcgggtccccaactacaatcttatcattatggatgaagcccacttcacggaccctgctagcatcgccgcccgcggctatatttccaccagagtggagatgggggaggctgcgggcatctttatgacagccacacccccgggaagccgggatcctttcccccagtctaacgctcccatcatggacgaagagagagaaattcctgagagatcctggaatagcggccacgaatgggttacagattttaaggggaaaaccgtgtggttcgtcccctctatcaaggccggaaacgacattgccgcttgcctgcggaaaaatggcaagaaagtgatccagctgagcagaaagacgtttgattccgagtacgttaagacacgcgccaacgactgggatttcgtggtcaccaccgacatttctgagatgggggcgaattttaaagctgaacgggtgatcgatcctagacgctgtatgaagccggtgatcctcacagacggagaggaacgggtcattctggccggccccatgcctgttacccatagctccgccgctcaaagacgcgggcggatcggcagaaaccccaaaaatgagaacgaccagtatatttacatgggagaacctcttgagaatgatgaggactgcgcccactggaaggaagcgaaaatgctgctcgataacatcaatacacccgagggcattatcccgtctatgttcgaacctgagcgcgaaaaggtggacgccattgatggggagtacagactgcggggagaggctcgcaaaacctttgtggacctgatgagacggggcgatctccccgtctggcttgcctataaggtggctgccgaagggatcaactacgctgaccgcaagtggtgtttcgatggaatcaaaaataaccagattctggaggaaaacatggaggttgagatctggacgaaggaaggcgagcgcaagaagctgaaacctcggtggctcgacgccagaatttatagcgatcccctggcgcttaaggaatttaaggagttcgccgctgggcgcaaatccctgacactcaatctgatcaccgaaatgggccggctgcctacattcatgacccagaaggccagaaacgctctcgacaatcttgccgtgctgcatacggccgaggctggaggccgcgcgtacaaccacgccctgagcgagctccccgaaaccctggagacacttctgctcctgaccctgctcgctacagtcaccgggggaatttttcttttcctgatgtctggcaaagggatcggaaagatgacactgggcatgtgctgcatcattaccgcctccatcctcctgtggtatgcccaaattcagccgcactggatcgctgccagcattatccttgaatttttcctgatcgtgctcctgattcctgagcccgaaaaacagcggacgccccaggataatcaactgacatacgttgtgatcgcgattctcaccgtcgtggccgctaccatggccaacgagatgggctttcttgagaagacaaagaaagacctggggctgggatccatcaccacacaggaatctgagagcaatattctcgacatcgatctgagacctgcttccgcctggacgctttatgcggtcgccaccacattcgtgaccccgatgctgcggcattctattgaaaacagctccgttaatgtgagcctcacagctatcgccaaccaggctaccgtgctgatgggcctggggaagggatggcccctctctaaaatggacatcggcgtccctcttctggccattgggtgttactcccaggttaatcccatcacgctgaccgctgccctcctgcttctggtggcgcactacgccattatcggacctggcctccaagctaaggccacacgcgaggctcagaaaagagccgccgcgggcattatgaagaaccccaccgtggatgggatcacagtcatcgacctggaacctattccgtatgatcccaagtttgagaaacagctgggacaggtgatgctccttatcctgtgcgttacccaagtgctgatgatgcggacgacatgggctctctgtgaggccctgacccttgctacaggccctattagcaccctgtgggaagggaatcccggacgcttctggaacaccacaatcgccgtctctatggccaatatttttagaggctcctacctcgctggggccggactgctgttcagcatcatgaagaacacgaccaatacacggcgcggcaccggcaacatcggggagacactcggagaaaaatggaagtctagacttaacgcgctgggcaaaagcgagtttcagatttataagaaatccgggatccaggaggtggaccggaccctggccaaggaaggaattaagcgcggcgagacggatcatcacgctgtctctagagggagcgccaaactccggtggttcgtggaaagaaatatggttacacctgagggaaaggtggtcgacctgggctgcggccgcgggggatggtcctactattgtggcgggcttaaagatgtgcgggaagttaagggactgaccaaaggcgggcccggacatgaggagccgatccctatgagcacctacggctggaacctcgtgagactgcaatccggcattgacgtctttttcacacctcccgaaaagtgcgataccctgctctgtgacatcggggagtctagccccaatcccacaatcgaagctggacgcacgcttcgggtgctgaacctggtggagaattggctcaacaataacacccagttctgcattaaggttctgaatccttatatgccgtccgtcatcgagaagatggagacacttcagagaaagtacggcggggccctggtgcgcaaccccctctctcggaatagcacccacgagatgtactgggtgtccaacgcgacaggaaatattgtctctagcgttaacatgatctccagaatgctgattaatcgctttaccatgaaacacaagaaagccacgtatgaacctgatgtggacctgggcagcgggacccggaacatcggaattgagtctgaaatccccaacctcgacatcattggcaagagaatcgagaagattaaacaggaacatgagacatcctggcactacgatcaagaccatccttataagacctgggcttaccacggcagctatgagacaaaacagaccgggtctgcctccagcatggtgaatggagtcgtgcgccttctgacaaagccctgggatgttgtgccgatggtcacccagatggctatgacggacacaacccctttcggccagcaacgggtgtttaaagaaaaggttgataccagaacacaggagcccaaggaagggacgaaaaagctgatgaaaatcaccgccgagtggctctggaaggagctgggcaagaagaaaacacctcgcatgtgtaccagagaagagttcacacggaaggtgcgctctaacgctgcccttggcgcgatttttaccgacgaaaataagtggaaatccgccagagaggctgtcgaagatgggcggttctgggagctggtggacagagagcggagcctccacctggaaggaaagtgcgagacatgtgtgtacaacatgatgggcaaacgcgaaaagaaactgggcgagtttgggaaggccaagggatccagagctatctggtatatgtggctcggcgcccggttcctggaatttgaggcccttgggttcctgaatgaggatcattggtttagccgcggaaactctctcagcggcgtcgaaggggagggcctgcacagacttggatacatcctgcgggacgttggcaaaaaggaagggggagcgatgtacgctgatgacaccgccggctgggacacgcgcattaccctcgaggatctgaaaaatgaagagatggtgacaaaccatatgaagggggagcacaaaaagctggccgaagctatcttcaagctcacctatcagaataaagtggtcagagtgcagcggcccacacctcgcggaaccgttatggacattatctccagacgggatcaacgcggctctgggcaggtcggcacgtacggactgaacacatttaccaatatggaggcccagcttattagacaaatggaaggcgaggggatcttcaagaacatccagcatctgacagctaccgaggaaattgccgtccagaattggctcgcgcgggtgggacgcgagagactgagccggatggccatctccggcgacgattgcgttgtgaaacccattgacgatagattcgcttctgcccttacggctctgaacgacatggggaaggtccgcaaagatatccagcaatgggaaccgagccggggatggaatgactggacccaggtgcctttttgctcccaccacttccatgagctcgttatgaaggatggcagagtgctggtcgtgccctgtcgcaaccaggacgaactgattgggcgggccagaatctctcagggcgcgggatggagcctcaaggagacagcctgcctgggcaaatcctatgctcaaatgtggacccttatgtactttcaccgccgggatctgagactcgccgctaacgccatttgtagcgctgtcccctctcattgggtgcctacatcccgcaccacatggagcatccacgccaagcacgagtggatgaccacggaagacatgctggcggtttggaatcgggtgtggatccaggagaacccgtggatggaagacaaaacacccgtcgagtcttgggaagaggtgccttatcttgggaagagagaggatcagtggtgcggatccctgattggcctcaccagccgcgccacctgggctaaaaatatccagacagccattaaccaagtgcggtccctgatcgggaatgaagagtacaccgactatatgccctctatgaagagattccggaaggaagaggaagaggccggagttctgtggtga

SEQ ID NO: 19736 - RNA, 9876 nt, synthetic construct
  misc_feature 1..9876: note = derived and/or modified CDS sequence (opt5) from DENV-2__KJ189370__SS-prME
  source 1..9876: mol_type = other RNA
accgccggagtgatcgtcatgctgattcccacagctatggccttccacctgacgaccagaaatggggagcctcatatgatcgttagccggcaggaaaagggaaaatccctgctttttaagacagaggacggagtgaatatgtgcaccctgatggcgattgatctcggggaactgtgtgaggacacaatcacctacaaatgcccgcttctgcgccaaaatgaacccgaggatattgactgttggtgcaattctacatccacctgggtgacgtatggaacctgtacaaccacaggcgagcacagacgggaaaagcgctccgtcgctctcgtgcctcatgttgggatgggactggagaccagaacggaaacatggatgtctagcgagggcgcctggaaacacgtgcagcggatcgagacctggatcctgcgccatcccggcttcacaattatggccgctatcctcgcctacaccattgggaccacacactttcagagagctctgatcttcattcttctgacggccgtcgcgccttccatgaccatgcggtgcatcggaatttctaaccgcgattttgtggaaggcgttagcgggggatcctgggtggacatcgtcctcgagcacggcagctgtgtgacaaccatggccaagaataagcccacactggatttcgaacttatcaaaaccgaggctaagcagcctgccacgctgagaaaatattgcattgaagctaagctcacaaacaccaccacagagtctcggtgtccgacccaaggggagccctccctgaatgaagaacaggacaaacgctttatctgcaagcatagcatggtggatagaggatggggcaacggctgtgggctgttcggaaagggcgggattgtcacatgcgccatgtttacgtgcaaaaagaatatggaaggaaaagttgtgcagcctgagaacctcgaatacaccatcgtgattacaccccactctggcgaggagcatgcggtcgggaatgacaccggaaagcacggcaaagaaatcaagatcacacctcagtccagcattaccgaggccgaactgacgggctatgggaccgtgacaatggagtgttctccccggaccggacttgatttcaacgaaatggttctgctccaaatggaggacaaggcttggctggtgcaccgccagtggtttcttgatctgccgctcccttggctgcccggcgccgacacacaggggtccaattggatccagaaggagaccctggtcacgttcaagaaccctcatgctaaaaagcaagacgtggttgtgctcggaagccaggaaggcgccatgcacacagccctgaccggggctacagagattcagatgtcctctggcaatcttctgtttaccggacatctcaaatgcagactgcggatggataaacttcaactgaaaggcatgagctactccatgtgtaccgggaagttcaagatcgtcaaagaaattgcggagacacagcacggaacgatcgtgatcagagtccagtatgagggcgacgggagcccctgcaagattcccttcgaaatcaccgatctcgagaaacgccatgtgctgggacggctgattacagttaaccctatcgtgaccgaaaaggactctccggtcaacattgaggccgaacccccttttggcgattcctacatcattatcggggtggagcccggccagctcaaactgaattggttcaagaagggaagctctatcggccaaatgtttgagacaaccatgagaggggctaaacgcatggccattcttggagacacggcctgggatttcggcagcctcggcggggtttttacatccatcgggaaggctctccaccaggtgttcggggccatttacggcgcggctttttctggagtcagctggaccatgaaaatcctgattggcgtgatcatcacctggattgggatgaactcccggagcacatctctgtccgtgagccttgttctcgtcggagtggtgaccctgtatctgggcgccatggtccaggccgactctgggtgtgtggtttcctggaagaataaagaactcaagtgcggaagcggcatcttcattacagataacgtgcacacgtggaccgagcagtacaagtttcaacctgaatccccctctaaactggctagcgccatccagaaggctcatgaggaagggatttgtggcatcagatccgtcacacgccttgagaatctgatgtggaaacagatcaccccggagctcaaccacattctgtctgaaaatgaggtgaagctgacaatcatgaccggagacattaaaggcatcatgcaggccgggaagcggagccttagacctcaacccacggaactcaaatattcctggaagacctggggaaaggcgaaaatgctgagcacagagtctcataaccagaccttcctgattgatggccctgaaacagccgagtgccccaataccaaccgcgcttggaactccctcgaggttgaagactacgggtttggagtgttcacaaccaacatctggctgaaacttaaagagaagcaggacgtcttttgtgatagcaaactgatgtctgccgctatcaaggacaatcgggccgtgcacgcggatatgggctattggattgaatccgccctcaacgacacgtggaagatggagaaagctagcttcatcgaggttaagtcttgccactggcctaaaagccatacactgtggtccaatggcgtgctggaaagcgagatgattatccccaagaacttcgccgggccggtctctcagcacaactacagacctggatatcatacccaaaccgctggcccctggcaccttgggaaactcgaaatggattttgacctgtgtgagggaacaaccgtggtggtcacggaagattgcggcaatcgcgggccctccctgcggacaaccacagccagcggaaagctcattaccgagtggtgctgtagatcctgcacactgcctccgcttcggtaccgcggcgaggacggctgttggtacgggatggaaatcagacccctgaaggagaaagaagagaacctcgttaattctctggtgaccgccggacatggccagattgataacttcagcctgggggtgcttggaatggctctctttctggaagagatgctgcggacgagaatcggcaccaagcacgcgatcctcctggtcgccgtgtccttcgttacacttattaccgggaatatgtcttttcgcgacctgggacgggtgatggtcatggtgggcgctacaatgaccgatgacatcggcatgggggttacgtatctcgccctgctggccgctttcaaagtgagacctacatttgccgcgggacttctgctccgcaagctgaccagcaaagagctcatgatggctacaattggcatcgccctgctttcccagtctaccattcccgaaaccatcctggagctcacagatgccctggctctggggatgatggtccttaaggtggttagaaacatggaaaagtaccaactggccgtgacgatcatggcgattagctgcgtccctaatgctgtgatcctccagaacgcctggaaagtgtcctgtaccattctggccgctgtcagcgtttctcccctcctgcttacatccagccagcagaaggccgactggatccctctggctctcaccattaaaggactgaatcccacagccatcttcctgaccacgctttctcggacatccaagaaacgcagctggccgctgaacgaggcgatcatggccgtgggcatggtgtctattctcgcttccagcctgctcaagaatgacatccctatgaccgggcccctggtcgccggaggccttctgaccgtgtgctatgttctgacaggcagatccgctgatctcgaactggagcgggccgccgacgtgaaatgggaggatcaagctgaaattagcgggtctagccctatcctttccattaccatctctgaggacggaagcatgtccattaagaacgaagaggaggaacagacactgacgatcctcatccgcaccggcctgctcgtcatttctggggtgtttcccgttagcatcccgattacagcggccgcttggtacctgtgggaggtgaagaaacagagagccggagtcctttgggatgtgccttctccccctcccgtcgaaaaggccgagctggaagacggcgcttatcggatcaaacagcgcgggattctgggatacagccaaatcggcgccggcgtgtataaggaggggaccttccacacaatgtggcatgttaccagaggagcggtgctcatgcaccggggcaaacgcatcgagcccagctgggctgatgtcaagaaggacctgatttcctacgggggaggctggaaacttgaaggggagtggaaggaaggagaggaagtgcaggttctggccctcgagcctggcaaaaatccgagagccgtgcagacgaagcccggcatctttaaaaccaacacagggaccattggagctgtcagcctggatttctctcctggcacatccgggagccccatcgtggaccggaagggaaaggtggttggcctctacgggaatggagtcgtgaccagatctggcgcctatgtgtccgcgattgctcagacagagaaaagcatcgaagataaccctgagatcgaagacgatatttttcgcaagaaacggctgacgatcatggaccttcatcccggcgccgggaagaccaaaagatacctgcctgccattgtccgcgaggctatcaagcggggactgagaacactcattctggccccgacccgcgtggttgctgccgaaatggaggaggcgcttcggggcctgcccatcagatatcaaacccctgccattaaggctgaatacacagggcgcgagatcgtggacctcatgtgtcacgccacgttcaccatgcggctgctctcccccgtcagagtgcctaactataatctgatcattatggatgaagctcatttcacagaccccgcctctatcgccgctcggggatacattagcacccgcgttgagatgggcgaggcggccgggatctttatgacagctaccccgcctggctccagagatcccttcccccagagcaacgcccctattatggacgaagaacgggaaatccccgagcgctcttggaactccggacacgaatgggtgacggattttaaaggcaagacagtctggttcgtgcctagcatcaaagccgggaacgacattgctgcctgccttagaaagaatggcaagaaggttatccagctgtctcggaagacctttgatagcgagtatgtgaaaaccagagcgaacgactgggatttcgtcgtgacaaccgacatttccgagatgggcgctaattttaaggccgaacgcgtgatcgatccgcggagatgtatgaaacccgtcattctgacagacggggaggaacgcgttatcctcgccggacctatgcccgtgacccactctagcgctgcccaacggagaggccgcatcgggcggaaccctaagaatgagaacgaccagtacatttacatgggcgaacccctggagaatgatgaggactgcgcgcattggaaagaagccaagatgcttctggataacatcaatacgccggagggaattatcccttccatgttcgaacccgagagagaaaaagtggacgctattgatggcgagtatcgcctcagaggggaggcccggaagacatttgtcgacctgatgcgcagaggagatctgcctgtgtggctcgcttacaaggttgccgctgaaggcatcaactatgccgaccggaaatggtgtttcgatgggattaagaataaccagatccttgaggaaaacatggaggtggagatctggaccaaagaaggagagcgcaagaaactgaagcccagatggctggacgcgcggatttactctgatcctctcgccctgaaggaatttaaagagttcgctgccggcagaaagagccttacactgaatctcatcaccgaaatggggcgcctgcccacgttcatgacccagaaagctcggaacgccctggacaatctcgccgtccttcacacagctgaggcgggcggcagagcctataaccatgctctgtccgagctgccggaaaccctcgagacactgcttctgctcaccctgctggccacagtgaccggcgggatttttctcttccttatgagcggaaagggcatcgggaaaatgacgctgggaatgtgctgcattatcacagcctctatcctgctctggtacgctcaaattcagcctcactggatcgccgcgtccattatcctggaatttttccttattgttctgctcatccccgagcccgaaaagcagcgcacccctcaggataatcaactgacctatgtggtcatcgccattctgacagtggtcgctgccaccatggctaacgagatgggctttctcgagaagaccaaaaaggaccttggcctggggagcatcacgacccaggaatccgagtctaatattctggacatcgatctccggccggccagcgcgtggacactgtacgccgtggctaccacattccttacccccatgctgagacactccattgaaaactctagcgttaatgtgtccctcacggccatcgctaaccaggccaccgtgctgatgggactgggcaaagggtggcctctcagcaagatggacattggagtcccccttctggctatcggctgttactctcaggttaatcctatcacactgaccgccgcgctcctgcttctggtggcccattatgctattatcgggcccggactccaagccaaagctacacgggaggcccagaagcgcgccgcggctggcattatgaagaaccctaccgtggatggcatcacggtcattgacctggatccgatcccctacgaccctaaatttgaaaagcagctgggacaggtgatgctccttatcctgtgcgttacacaagtgctgatgatgagaaccacatgggccctctgtgaggctctgacccttgccaccggacccatttccacactgtgggagggcaatcctgggcggttctggaacacgaccatcgccgtcagcatggctaatatttttcgcggatcttatctcgccggcgcggggctgctgttctccatcatgaaaaacacaaccagcacaagacggggaaccggcaatattggcgaaacgctcggggagaagtggaaatctcgccttaacgccctgggaaagagcgaatttcagatctacaaaaagtccggcatccaggaggtggatagaacactggctaaggaggggattaaacggggagaaaccgaccaccatgccgtctctcgcggcagcgctaagctcagatggttcgtggagcggaacatggttacccccgaagggaaagtggtcgatctgggatgcggcagaggcgggtggtcctattactgtggaggccttaagaatgtgcgcgaggttaaagggctgacaaagggaggcccggggcacgaggaacctatccccatgagcacctatggatggaacctcgtgcggctgcaatccggcgtcgacgtgtttttcacaccccctgagaagtgcgatacgctgctctgtgacattggcgaatctagccccaatcctaccatcgaggccgggagaacacttcgcgtgctgaacctggttgaaaattggctcaacaataacacccagttctgcattaaagtcctgaatccgtacatgccctccgtgatcgagaagatggaagcgcttcagcggaaatacggaggcgccctggtgagaaaccctctctctcgcaatagcacacatgagatgtattgggtctccaacgctaccgggaatatcgtttctagcgtgaacatgatttcccggatgctgatcaatagatttacgatgaagcacaaaaaggccacctacgagcccgatgtggacctgggaagcggcacacgcaacattgggatcgaatctgaggtccctaacctcgacattatcggaaagcggattgagaaaatcaagcaggagcacgaaacctcctggcattatgatcaagaccacccctacaaaacatgggcttatcatggcagctacgagaccaagcagacaggctctgcctccagcatggtgaatggggttgtgagacttctgaccaaaccgtgggatgtcgtgcctatggttacgcagatggctatgacagacaccacccccttcggacagcaacgcgtgtttaaggagaaggtcgatacacggacgcaggaacctaaagagggcaccaagaaactgatgaagatcacagccgaatggctctggaaagagctggggaagaaaaagacccccagaatgtgtacacgcgaggagttcaccagaaaggtgcggtctaacgcggcccttggagctatttttacagacgagaataaatggaagtccgcccgcgaagctgtggaggatggcagattctgggaactggtcgaccgggagagaaacctccacctggaggggaaatgcgaaacctgtgtttataatatgatgggaaagcgggagaaaaagctgggcgaatttggcaaggccaaagggagccgcgccatctggtacatgtggctcggagcgagattcctggagtttgaagctcttggcttcctgaacgaggatcactggttttcccgggggaatagcctctctggagtggagggcgaagggctgcatcgccttggctacattctgagagaggtgggaaagaaagaaggcggggccatgtatgccgacgatacggctggatgggacacccggatcacactcgaggacctgaagaacgaagagatggtcaccaatcacatgaaaggcgagcataagaagctggccgaagctattttcaaactcacataccagaacaaggtggttcgcgtgcagagacctacaccccgggggacggtcatggatatcatcagccgcagagaccaacggggatccggccaggtggggacatatggcctgaatacctttacaaacatggaggcccagcttattcgccaaatggaaggagagggcatcttcaaatctattcagcacctgaccgcgacggaggaaatcgccgttcagaattggctcgtgagagtcgggcgggagcgcctgagcagaatggctatttccggagatgactgcgtggttaagccgatcgatgaccggttcgcctctgctcttaccgccctgaacgatatgggcaaagtgagaaaggacatccagcaatgggaacctagccgcgggtggaatgattggacacaggtccccttttgctcccatcacttccacgagctcgtgatgaaggacggacgggtcctggtggttccctgtagaaaccaggatgaactgattggccgcgcgcggatctctcagggggccggctggagcctcaaagagaccgcttgcctgggaaagtcctacgcccaaatgtggacacttatgtattttcatagacgcgacctgcggctcgctgccaacgctatttgtagcgccgtgccttctcactgggtcccgacctccagaacaacctggagcatccatgcgaaacacgagtggatgacgacagaagatatgctggccgtgtggaatcgcgtgtggattcaggagaacccctggatggaagacaagacccctgttgagtcttgggaagaggtgccctaccttggcaaacgggaggaccagtggtgcgggtccctgatcggactcaccagcagagctacatgggccaagaatattcagaccgccatcaaccaagtccgctccctgatcggcaatgaagagtatacagattacatgccttctatgaagcggttcagacgggaagaggaagaggctggggtgctgtggtga

SEQ ID NO: 19737 - RNA, 9876 nt, synthetic construct
  misc_feature 1..9876: note = derived and/or modified CDS sequence (opt5) from DENV-2__EU482620__SS-prME
  source 1..9876: mol_type = other RNA
accgccggcgtgatcgtcatgctgattcccacagctatggccttccacctcacgacccggaatggggaacctcatatgatcgttggacggcaggaaaagggcaagagcctgctttttaagacagaagacggggtgaatatgtgcaccctgatggcgattgatctcggagaactgtgtgaagacacaatcacctacaaatgcccgcttctgcgccaaaatgaacccgaggatattgactgttggtgcaattccacatctacctgggtgacgtatggcacctgtacaaccacaggggagcacagacgggaaaagcgcagcgtcgctctcgtgcctcatgttggaatgggcctggagaccagaacggaaacatggatgtcctctgagggcgcctggaaacacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaagaacaggacaaacgctttatctgcaagcattccatggtggatagaggctggggcaacgggtgtggactgttcggcaaaggcgggattgtcacatgcgccatgtttacgtgcaaaaagaatatggaagggaaagttgtgcagcctgagaacctcgaatacaccatcgtgattacaccccacagcggggaggagcatgcggtcggaaatgacaccggcaagcacggcaaagaaatcaagatcacacctcagtcttccattaccgaggccgaactgacggggtatggaaccgtgacaatggagtgtagcccccggaccggccttgatttcaacgaaatggttctgctccaaatggaggacaaggcttggctggtgcaccgccagtggtttcttgatctgccgctcccttggctgcccggggccgacacacagggatctaattggatccagaaggagaccctggtcacgttcaagaaccctcatgctaaaaagcaagacgtggttgtgctcggctcccaggaaggggccatgcacacagccctgaccggcgctacagagattcagatgagctccggaaatcttctgtttaccggccatctcaaatgcagactgcggatggataaacttcaactgaaagggatgtcttacagcatgtgtaccggaaagttcaagatcgtcaaagaaattgcggagacacagcacggcacgatcgtgatcagagtccagtatgagggggacggatccccctgcaagattcccttcgaaatcaccgatctcgagaaacgccatgtgctgggccggctgattacagttaaccctatcgtgaccgaaaaggacagcccggtcaacattgaggccgaacccccttttggggattcttacatcattatcggcgtggagcccggacagctcaaactgaattggttcaagaagggctccagcatcgggcaaatgtttgagacaaccatgagaggagctaaacgcatggccattcttggcgacacggcctgggatttcgggtctctgggaggcgtttttacaagcatcgggaaggctctccaccaggtgttcggcgccatttacggagcggctttttccggcgtctcttggaccatgaaaatcctgattggggtgatcatcacctggattggaatgaacagccggtccacaagcctgtctgtgtcccttgttctcgtcggcgtggtgaccctgtatctgggggccgtcgtgcaggccgacagcggatgtgttgtgtcttggaagaataaagaactcaagtgcggctccgggatcttcattacagataacgtccacacgtggaccgagcagtacaagtttcaacctgaaagcccctccaaactggcttctgccatccagaaggctcatgaggaaggcatttgtggaatcagaagcgtgacacgccttgagaatctgatgtggaaacagatcaccccggagctcaaccacattctgtccgaaaatgaggttaagctgacaatcatgaccggcgacattaaagggatcatgcaggccggaaagcggtctcttagacctcaacccacggaactcaaatatagctggaagacctggggcaaggcgaaaatgctgtccacagagagccataaccagaccttcctgattgatgggcctgaaacagccgagtgccccaataccaaccgcgcttggaactctctcgaggtggaagactacggatttggcgtcttcacaaccaacatctggctgaaacttcgggagaaacaggacgtgttttgtgattccaagctgatgagcgccgctatcaaagacaatagagccgttcacgcggatatgggctattggattgaatctgccctcaacgacacgtggaagatggagaaggcttccttcatcgaggtgaaaagctgccactggcctaagtctcatacactgtggagcaatggggtcctggaatccgagatgattatccccaaaaacttcgccggaccggtgagccagcacaactaccgccctggctatcatacccaaaccgctgggccctggcaccttggaaagctcgaaatggattttgacttctgtgagggcacaaccgtggtcgttacggaagattgcgggaatcggggaccctctctgagaacaaccacagcctccggcaaactgattaccgagtggtgctgtcggagctgcacactccctccgctgcgctacagaggcgaggacgggtgttggtacggaatggaaatccggccccttaaggagaaggaagagaacctggtgaatagcctcgtgaccgccggccatgggcagattgataacttttctctgggagtcctgggcatggctcttttcctcgaagagatgctgagaacgcgcatcgggaccaaacacgcgatcctgctcgtggccgttagctttgtgacactgattaccggaaatatgtccttccgggaccttggcagagtcatggtgatggttggcgctacaatgaccgatgacatcgggatgggagtgacgtatctggccctcctggccgcttttaaggtccgccctacattcgccgcgggcctgcttctgagaaaactcacctctaaggagctgatgatggctacaattgggatcgccctcctgagccagtccaccattcccgaaaccatccttgagctgacagatgccctcgctctgggaatgatggtgctgaaaatcgttcggaacatggaaaagtaccaacttgccgtgacgattatggcgatctcttgcgtccctaatgctgtgattctgcagaacgcctggaaggtgagctgtaccatcctcgccgctgtctccgttagccccctgctcctgacatcttcccagcagaaagccgactggattcctcttgctctgaccatcaagggcctcaatcccacagccatctttctgaccacgctgagccgcacatctaaaaagagatcctggccgcttaacgaggcgattatggccgtggggatggtgagcatcctggcttcttccctcctgaaaaatgacattcctatgaccggacccctcgtcgccggcggcctgcttaccgtgtgctatgttctgacagggcggagcgctgatctggaactcgagcgcgccgccgacgtgaagtgggaggatcaagctgaaatctccggaagctctcctattctgagcatcaccatttccgaggacggctctatgagcatcaaaaacgaagaggaggaacagacacttacgatcctgattagaaccgggctcctggtcatctccggagtgttccccgtttctattccgatcacagcggccgcttggtacctctgggaggtgaagaagcagcgggccggcgtcctgtgggatgtgccttctccccctcccgtcgaaaaagccgagcttgaagacggggcttatcgcattaagcagagaggaatcctgggctactcccaaatcggcgccggggtgtataaagagggaacctttcacacaatgtggcatgttacccggggcgcggtgctgatgcaccgcgggaagagaattgagccctcctgggctgatgtcaaaaaggacctcatcagctacggaggcgggtggaagctggaaggagagtggaaagaaggcgaggaagtgcaggttcttgccctggagcctggcaagaatccgcgggccgtgcagacgaaacccgggattttcaagaccaacacaggaaccatcggcgctgtctccctcgattttagccctgggacatctggatcccccattgtggacagaaaaggcaaggtggttgggctgtacggaaatggcgtcgtgacccgcagcggcgcctatgtgtctgcgatcgctcagacagagaagtccatcgaagataaccctgagattgaagacgatatcttccggaaaaagagactcacgattatggacctgcatcccggggccggaaaaaccaagcgctaccttcctgccatcgtccgggaggctattaaaagaggcctgcgcacactgatcctcgccccgacccgggtggttgctgccgaaatggaggaggcgctgagagggcttcccattcgctatcaaacccctgccatcaagacagaacacacgggacgggagatcgtggacctgatgtgtcatgctaccttcacaatgagactcctgagccccgtccgggtgcctaactacaatctcattatcatggatgaagcccactttaccgaccccgcttccattgccgcccgcggctatatctctacaagagttgagatgggggaggctgcgggcattttcatgaccgccacgccgcctggaagccgggatccctttccccagtccaacgctcctatcatggacgaagaaagagaaatccccgagagaagctggaactctggccacgaatgggtgacagatttcaaggggaaaaccgtctggtttgtgccttccattaaggccggaaacgacatcgccgcttgcctgcggaaaaatggcaagaaagttattcagcttagcagaaagaccttcgattctgagtacgtgaagacacgcgccaacgactgggattttgtcgtgaccacagacatcagcgagatgggggcgaatttcaaagctgaacgggtgattgatccgagacgctgtatgaagcccgtcatcctgaccgacggagaggaacgggttatcctggccggccctatgcccgtgacgcattcctctgccgctcaaagacgcgggcggattggcagaaaccctaaaaatgagaacgaccagtatatctacatgggagaacccctcgagaatgatgaggactgcgcccactggaaggaagcgaaaatgctgcttgataacattaatacaccggagggcatcattcctagcatgtttgaacccgagcgcgaaaaggtggacgccatcgatggggagtacagactgcggggagaggctcgcaaaaccttcgtcgacctcatgagacggggcgatctgcctgtgtggctggcctataaggttgctgccgaagggattaactacacagaccgcaagtggtgttttgatggaatcaaaaataaccagatcctcgaggaaaacatggaggtggagatttggaccaaggaaggcgagcgcaagaaacttaaaccccggtggctggacgctagaatctattccgatcctctggccctcaaggagttcaaggagttcgcggccgggcgcaaatctctgacgcttaatctgattaccgaaatgggccggctccccacatttatgacccagaaggctagaaacgccctggacaatctggctgtcctccatacagccgaggccggaggccgcgcttacaaccacgcgcttagcgagctgccggaaaccctggagacactcctgcttctgaccctcctggccacggtgacagggggaatcttcctgtttctcatgtccggcaaagggattggaaagatgacccttggcatgtgctgcatcatcaccgctagcattctgctgtggtatgcccaaatccagcctcactggattgccgcttctatcattctcgagttctttctgatcgttcttctgatccccgagcccgaaaaacagcggacacctcaggataatcaactcacctacgtggtcattgccatcctgacagtggtcgcggccacgatggctaacgagatgggcttcctggagaagaccaagaaagacctcgggcttggatccattacaacccaggaaagcgagtccaatatcctggacattgatctgagaccggcctctgcttggacactctatgccgtggcgaccacgtttgttacccccatgctgcggcatagcatcgaaaactcctctgtgaatgtgagccttacagccattgctaaccaggccaccgtcctgatgggcctcgggaagggatggcctctgtccaaaatggacatcggcgttcccctgctcgctatcgggtgttacagccaggtgaatcctattacacttaccgccgctctgctgctcctggtggcccactacgcgatcattggacccggccttcaagccaaggctacgcgcgaggcccagaaaagagctgccgccggcatcatgaagaaccctacagtcgatgggattaccgtgatcgacctggaaccgatcccctatgatcctaagttcgagaaacagctcggacaggttatgctgctgattctctgcgtgacacaagtccttatgatgcggaccacctgggcgctgtgtgaggctctgacactcgccacgggccccatctctaccctgtgggaagggaatcctggacgcttttggaacacaaccattgctgtgtccatggccaatatcttcagaggcagctaccttgccggggctggactgctcttttctattatgaagaacacaacctccacgcggcgcggcacaggcaatatcggggagaccctgggagaaaaatggaaaagcagactgaacgccctcggcaaatctgagttccagatctataagaaaagcgggattcaggaggtcgaccggacccttgcgaaggaaggaatcaagcgcggcgagacagatcatcacgccgtgtccagagggtctgctaaactgcggtggtttgttgaaagaaacatggtgacccccgagggaaaggtcgtggacctgggctgcggccgcgggggatggagctactattgtggcgggctcaaaaatgttcgggaagtgaagggactgacaaaaggcgggccgggacatgaggagcctattcccatgtccacgtacggctggaaccttgtcagactgcaaagcggcgtggatgtgttcttcacaccccctgaaaagtgcgacaccctcctgtgtgatatcggggagtcctctcccaatcctaccattgaagccggacgcacactgcgggttctcaaccttgtcgagaattggctgaacaataacacccagttttgcatcaaggtgctgaatccgtatatgcccagcgtgatcgagaagatggaggctctccagagacagtacggcggggccctggtccgcaaccctctttccagaaattctacgcacgagatgtactgggttagcaacgcgaccggaaatattgtgtcctctgtgaacatgatcagcagaatgctgattaatcgcttcacaatgaagcacaaaaaggccacctatgaacccgacgtcgatctcggctccgggacacggaacatcggaattgagagcgaaatccctaacctggacattatcggcaaaagaatcgagaagattaagcaagaacatgagatctcttggcactacgaccaggatcatccctataaaacctgggcttaccacggctcctatgagacaaagcagaccgggagcgcctcttccatggtgaatggagttgtgcgcctgctcacgaaaccgtgggacgtcgtgcctatggttacacagatggctatgaccgataccacaccctttggccaacagcgggtgttcaaggaaaaagtcgacacgagaacccaggagcctaaggaagggacaaagaaacttatgaagattaccgccgagtggctgtggaaagagctgggaaagaaaaagacaccccgcatgtgtaccagagaagagtttacacggaaagtgcgcagcaacgctgccctcggcgcgatcttcaccgatgaaaataagtggaagtctgccagagaggctgtggaagacgggcggttttgggagctggtcgatagagagcggaaccttcacctggaaggaaaatgcgagacgtgtgtttacaatatgatgggcaagcgcgagaagaagctcggcgagttcgggaaagccaagggatccagagctatttggtatatgtggctgggcgcccggtttctggagttcgaggccctcgggtttctgaacgaggaccattggttcagccgcggaaattcccttagcggcgtggaaggggagggcctgcacagactcggatacatcctgcgggatgtgggcaagaaagaagggggagcgatgtacgctgacgataccgccggctgggacacacgcatcacccttgaggacctgaagaacgaagagatggtcacaaatcatatgaaaggggagcacaagaaactcgccgaagctatttttaagctgacctatcagaacaaggtggttagagtgcaacggcctacgccccgcggaacagtcatggatatcatttctagacgggaccagcgcggcagcggacaggtgggcacctacggactgaatacattcaccaacatggaggcccaactcatcagacagatggaaggcgaggggattttcaaatccatccagcatctgacggctaccgaggaaatcgccgttcagaattggcttgcgcgggtgggacgcgagagactgtctcggatggccattagcggcgatgactgcgtcgtgaagccgatcgatgacagatttgcttccgccctcacagctctgaacgatatggggaaagttcgcaaggacattcaacagtgggaaccttctcggggatggaatgattggacccaggtgcccttctgcagccaccactttcatgagcttgtcatgaaagacggcagagtgctggtcgtgccctgtcgcaaccaggatgaactcatcgggcgggccagaatttcccaaggcgcgggatggtctctgaaggagacagcctgcctgggcaagagctatgctcagatgtggaccctcatgtacttccaccgccgggacctgagacttgccgctaacgccatctgttccgctgttcctagccattgggtgccgacatctcgcaccacgtggtccattcacgccaaacacgagtggatgacaaccgaagatatgctggcggtctggaatcgggtgtggatccaggagaacccctggatggaagacaagacccctgtggagagctgggaagaggttccctatctcgggaaaagagaggaccagtggtgcggatctctgatcggccttacatcccgcgccacctgggctaagaatattcaaacagccatcaaccaggtgcggagcctgattgggaatgaagagtacacggattatatgccttccatgaaaagatttcggagagaagaggaagaggccggagtcctctggtga

SEQ ID NO: 19738 - RNA, 9876 nt, synthetic construct
  misc_feature 1..9876: note = derived and/or modified CDS sequence (opt5) from DENV-2__FJ373300__SS-prME
  source 1..9876: mol_type = other RNA
acagccggcgtgatcgtcatgctgattcccacagctatggccttccacctcacgacacggaatggggaacctcatatgatcgttggacggcaggaaaagggcaagagcctgctttttaagacagaagacggggtgaatatgtgcaccctgatggcgattgatctcggagaactgtgtgaggacacaatcacctacaaatgcccgcttctgcgccaaaatgaacccgaggatattgactgttggtgcaattccacatctacctgggtgacgtatggcacctgtacaaccacaggggagcacagacgggaaaagcgcagcgtcgctctcgtgcctcatgttggaatgggcctggagaccagaacggaaacatggatgtcctctgagggcgcctggaaacacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaagaacaggacaaacgctttatctgcaagcattccatggtggatagaggctggggcaacgggtgtggactgttcggcaaagggggaattgtcacatgcgccatgtttacgtgcaaaaagaatatggaaggcaaagttgtgcagcctgagaacctcgaatacaccatcgtgattacaccccacagcggggaggagcatgcggtcggaaatgacaccggcaagcacggcaaagaaatcaagatcacacctcagtcttccattaccgaggccgaactgacggggtatggaaccgtgacaatggagtgtagcccccggaccggccttgatttcaacgaaatggttctgctccaaatggaggacaaggcttggctggtgcaccgccagtggtttcttgatctgccgctcccttggctgcccggggccgacacacagggatctaattggatccagaaggagaccctggtcacgttcaagaaccctcatgctaaaaagcaagacgtggttgtgctcggctcccaggaaggggccatgcacacagccctgaccggcgctacagagattcagatgagctccggaaatcttctgtttaccggccatctcaaatgcagactgcggatggataaacttcaactgaaagggatgtcttacagcatgtgtaccggaaagttcaagatcgtcaaagaaattgcggagacacagcacggcacgatcgtgatcagagtccagtatgagggggacggatccccctgcaagattcccttcgaaatcaccgatctcgagaaacgccatgtgctgggccggctgattacagttaaccctatcgtgaccgaaaaggacagcccggtcaacattgaggccgaacccccttttggggattcttacatcattatcggcgtggagcccggacagctcaaactgaattggttcaagaagggctccagcatcgggcaaatgtttgagacaaccatgagaggagctaaacgcatggccattcttggcgacacggcctgggatttcgggtctctgggaggcgtttttacaagcatcgggaaggctctccaccaggtgttcggcgccatttacggagcggctttttccggcgtctcttggaccatgaaaatcctgattggggtgatcatcacctggattggaatgaacagccggtccacaagcctgtctgtgtcccttgttctcgtcggcgtggtgaccctgtatctgggggccgtcgtgcaggccgacagcggatgtgttgtgtcttggaagaataaagaactcaagtgcggctccgggatcttcattacagataacgtccacacgtggaccgagcagtacaagtttcaacctgaaagcccctccaaactggcttctgccatccagaaggctcatgaggaaggcatttgtggaatcagaagcgtgacacgccttgagaatctgatgtggaaacagatcaccccggagctcaaccacattctgtccgaaaatgaggttaagctgacaatcatgaccggcgacattaaagggacgatgcaggccggaaagcggtctcttagacctcaacccaccgaactcaaatatagctggaagacatggggcaaggcgaaaatgctgtccaccgagagccataaccagacattcctgatcgatgggcctgaaaccgccgagtgccccaatacaaaccgcgcttggaactctctcgaggtggaagactacggatttggcgtcttcaccacgaacatttggctgaaacttcgggagaaacaggacgtgttttgtgattccaagctgatgagcgccgctatcaaagacaatagagccgttcacgcggatatgggctattggatcgaatctgccctcaacgacacatggaagatggagaaggcttccttcattgaggtgaaaagctgccactggcctaagtctcataccctgtggagcaatggggtcctggaatccgagatgatcattcccaaaaacttcgccggaccggtgagccagcacaactaccgccctggctatcatacccaaacagctgggccctggcaccttggaaagctcgaaatggattttgacttctgtgagggcaccacggtggtcgttacagaagattgcgggaatcggggaccctctctgagaaccacaaccgcctccggcaaactgatcacagagtggtgctgtcggagctgcaccctccctccgctgcgctacagaggcgaggacgggtgttggtacggaatggaaattcggccccttaaggagaaggaagagaacctggtgaatagcctcgtgacggccggccatgggcagatcgataacttttctctgggagtcctgggcatggctcttttcctcgaagagatgctgagaacccgcattgggacaaaacacgcgatcctgctcgtggccgttagctttgtgaccctgatcacaggaaatatgtccttccgggaccttggcagagtcatggtgatggttggcgctaccatgacggatgacattgggatgggagtgacatatctggccctcctggccgcttttaaggtccgccctaccttcgccgcgggcctgcttctgagaaaactcacatctaaggagctgatgatggctaccatcgggattgccctcctgagccagtccaccatccccgaaacaattcttgagctgacggatgccctcgctctgggaatgatggtgctgaaaatcgttcggaacatggaaaagtaccaacttgccgtgaccatcatggcgatttcttgcgtccctaatgctgtgatcctgcagaacgcctggaaggtgagctgtacagtcctcgccgctgtttccgtgagccccctgctcctgacctcttcccagcagaaagccgactggattcctcttgctctgacaatcaagggcctcaatcccaccgccatttttctgacgacactgagccgcacctctaaaaagagatcctggccgcttaacgaggcgatcatggccgtggggatggtcagcatcctggcttcttccctcctgaaaaatgacattcctatgaccggacccctcgtggccggcggcctgcttacagtttgctatgtgctgaccgggcggagcgctgatctggaactcgagcgcgccgccgacgtcaagtgggaggatcaagctgaaatctccggaagctctcctattctgagcatcacaatttccgaggacggctctatgagcatcaaaaacgaagaggaggaacagacgcttaccattctgatcagaacagggctcctggtgatctccggagttttccccgtgtctattccgatcaccgcggccgcttggtacctctgggaggtcaagaagcagcgggccggcgtgctgtgggatgtcccttctccccctcccgtggaaaaagccgagcttgaagacggggcttatcgcattaagcagagaggaatcctgggctactcccaaattggcgccggggtttataaagagggaacatttcacaccatgtggcatgtgacgcggggcgcggtcctgatgcaccgcgggaagagaatcgagccctcctgggctgatgtgaaaaaggacctcatcagctacggaggcgggtggaagctggaaggagagtggaaagaaggcgaggaagttcaggtgcttgccctggagcctggcaagaatccgcgggccgtccagaccaaacccgggattttcaagacaaacaccggaacaatcggcgctgtgtccctcgattttagccctgggacctctggatcccccattgtggacagaaaaggcaaggttgtcgggctgtacggaaatggcgtggtgacacgcagcggcgcctatgtctctgcgatcgctcagacggagaagtccattgaagataaccctgagatcgaagacgatatcttccggaaaaagagactcaccattatggacctgcatcccggggccggaaaaacaaagcgctaccttcctgccatcgtgcgggaggctattaaaagaggcctgcgcaccctgatcctcgccccgacccgggttgtggctgccgaaatggaggaggcgctgagagggcttcccattcgctatcaaacccctgccatcaagacggaacacaccggacgggagattgtcgacctgatgtgtcatgctacattcaccatgagactcctgagccccgtgcgggttcctaactacaatctcatcatcatggatgaagcccactttacagaccccgcttccattgccgcccgcggctatatctctaccagagtggagatgggggaggctgcgggcattttcatgacggccacaccgcctggaagccgggatccctttccccagtccaacgctcctatcatggacgaagaaagagaaattcccgagagaagctggaactctggccacgaatgggtcaccgatttcaaggggaaaaccgtgtggtttgttccttccatcaaggccggaaacgacatcgccgcttgcctgcggaaaaatggcaagaaagtgattcagcttagcagaaagacattcgattctgagtacgtcaagacccgcgccaacgactgggattttgtggtgacaaccgacatcagcgagatgggggcgaatttcaaagctgaacgggtcattgatccgagacgctgtatgaagcccgttatcctgacggacggagaggaacgggtgattctggccggccctatgcccgtgacacattcctctgccgctcaaagacgcgggcggatcggcagaaaccctaaaaatgagaacgaccagtatatctacatgggagaacccctcgagaatgatgaggactgcgcccactggaaggaagcgaaaatgctgcttgataacattaataccccggagggcatcattcctagcatgtttgaacccgagcgcgaaaaggtcgacgccatcgatggggagtacagactgcggggagaggctcgcaaaacattcgtggacctcatgagacggggcgatctgcctgtttggctggcctataaggtggctgccgaagggattaactacgctgaccgcaagtggtgttttgatggaatcaaaaataaccagattctcgaggaaaacatggaggtcgagatctggaccaaggaaggcgagcgcaagaaacttaaaccccggtggctggacgccagaatctattccgatcctctggcgctcaaggagttcaaggagttcgccgctgggcgcaaatctctgacgcttaatctgattaccgaaatgggccggctccccacatttatgacccagaaggccagaaacgctctggacaatctggccgtgctccatacagccgaggctggaggccgcgcgtacaaccacgcccttagcgagctgccggaaaccctggagacactcctgcttctgaccctcctggctacggttacagggggaatcttcctgtttctcatgtccggcaaagggattggaaagatgacccttggcatgtgctgcatcattaccgccagcatcctgctgtggtatgcccaaatccagcctcactggattgctgcctctatcattctcgagttctttctgatcgtgcttctgattcccgagcccgaaaaacagcggacacctcaggataatcaactcacctacgtcgtgatcgcgatcctgacagtcgtggccgctacgatggccaacgagatgggcttcctggagaagaccaagaaagacctcgggcttggatccattacaacccaggaaagcgagtccaatatcctggacattgatctgagaccggcttctgcctggacactctatgcggttgccaccacgtttgtgacccccatgctgcggcatagcatcgaaaactcctctgtgaatgtcagccttacagctattgccaaccaggctaccgttctgatgggcctcgggaagggatggcctctgtccaaaatggacatcggcgtgcccctgctcgccattgggtgttacagccaggtgaatcctatcacacttaccgctgccctgctgctcctggtcgcgcactacgccatcattggacccggccttcaagctaaggccacgcgcgaggctcagaaaagagccgccgcgggcatcatgaagaaccctacagtggatgggattaccgttatcgacctggaaccgattccctatgatcctaagttcgagaaacagctcggacaggtgatgctgctgatcctctgcgtcacacaagtgcttatgatgcggaccacctgggctctgtgtgaggccctgacactcgctacgggccccatctctaccctgtgggaagggaatcctggacgcttttggaacacaaccattgccgtctccatggccaatatcttcagaggcagctaccttgctggggccggactgctcttttctattatgaagaacacaacctccacgcggcgcggcacaggcaatatcggggagaccctgggagaaaaatggaaaagcagactgaacgcgctcggcaaatctgagttccagatttataagaaaagcgggatccaggaggtggaccggacccttgccaaggaaggaatcaagcgcggcgagacagatcatcacgctgtttccagagggtctgccaaactgcggtggtttgtggaaagaaacatggtcacccccgagggaaaggtggttgacctgggctgcggccgcgggggatggagctactattgtggcgggctcaaaaatgtgcgggaagtcaagggactgacaaaaggcgggccgggacatgaggagcctattcccatgtccacgtacggctggaaccttgtgagactgcaaagcggcgtggatgttttcttcacaccccctgaaaagtgcgacaccctcctgtgtgatatcggggagtcctctcccaatcctaccattgaagctggacgcacactgcgggtcctcaaccttgtggagaattggctgaacaataacacccagttttgcatcaaggtgctgaatccgtatatgcccagcgtcattgagaagatggaggccctccagagacagtacggcggggcgctggttcgcaaccctctttccagaaattctacgcacgagatgtactgggtgagcaacgccaccggaaatatcgtgtcctctgtcaacatgatcagcagaatgctgattaatcgcttcacaatgaagcacaaaaaggctacctatgaacccgacgtggatctcggctccgggacacggaacatcggaattgagagcgaaatccctaacctggacattatcggcaaaagaattgagaagatcaagcaagaacatgagatctcttggcactacgaccaggatcatccctataaaacctgggcctaccacggctcctatgagacaaagcagaccgggagcgcttcttccatggttaatggagtggtccgcctgctcacgaaaccgtgggacgtggttcctatggtgacacagatggccatgaccgataccacaccctttggccaacagcgggtcttcaaggaaaaagtggacacgagaacccaggagcctaaggaagggacaaagaaacttatgaagattaccgctgagtggctgtggaaagagctgggaaagaaaaagacaccccgcatgtgtaccagagaagagtttaccaagaaggtgcggagcaacgccgcgctcggcgccatcttcaccgatgaaaataagtggaaatctgctcgcgaggccgtcgaagacgggagattttgggagctggttgatcgggagagaaaccttcacctggaaggaaagtgcgagacgtgtgtgtacaatatgatgggcaaacgggaaaagaaactcggcgagttcgggaaggctaagggatcccgcgccatttggtatatgtggctgggcgccagatttctggagttcgaggcgctcgggtttctgaacgaggaccattggttcagccggggaaattcccttagcggcgtggaaggggagggcctgcaccgcctcggatacatcctgagagatgtcggcaaaaaggaagggggagctatgtacgccgacgataccgccggctgggacacacggattacccttgaggacctgaaaaacgaagagatggtgacaaatcatatgaagggggagcacaaaaagctcgctgaagccatctttaagctgacctatcagaacaaagttgtgcgcgtccaaagacctacgccccggggaacagtgatggatatcatttctcgcagagaccagcggggcagcgggcaggttggcacctacggactgaatacattcaccaacatggaggctcaactcatccgccagatggaaggcgaggggattttcaagtccatccagcatctgacggccaccgaggaaattgcggtgcagaattggcttgccagagtcggacgggagcgcctgtctagaatggctatcagcggcgatgactgcgtggttaaaccgatcgatgaccggtttgcctccgctctcacagccctgaacgatatggggaaggtgagaaaagacattcaacagtgggaaccttctcgcggatggaatgattggacccaggtccccttctgcagccaccactttcatgagcttgtgatgaaggacggccgggtcctggtggttccctgtagaaaccaggatgaactcatcgggcgcgcgcggatttcccaaggcgccggatggtctctgaaggagacagcttgcctgggcaaaagctatgcccagatgtggaccctcatgtacttccacagacgcgacctgcggcttgctgccaacgctatctgttccgccgtgcctagccattgggtcccgacatctagaaccacgtggtccattcacgcgaagcacgagtggatgacaaccgaagatatgctggccgtgtggaatcgcgtgtggatccaggagaacccctggatggaagacaaaacccctgttgagagctgggaagaggtgccctatctcgggaagcgggaggaccagtggtgcggatctctgattggccttacatccagagctacctgggccaaaaatatccaaacagccatcaaccaggtccgcagcctgattgggaatgaagagtacacggattatatgccttccatgaagcggtttagacgggaagaggaagaggctggagtgctctggtga

SEQ ID NO: 19739 - RNA, 9876 nt, synthetic construct
  misc_feature 1..9876: note = derived and/or modified CDS sequence (opt5) from DENV-2__EU596495__SS-prME
  source 1..9876: mol_type = other RNA
accgccggagtgatcgtcatgctgattcccaccgctatggccttccacctcacgacccggaatggggagcctcatatgatcgttggacggcaggaaaagggcaagagcctgctttttaagacagaggacggggtgaatatgtgcaccctgatggcgattgatctcggagaactgtgtgaggacacaatcacctacaagtgcccgcttctgcgccaaaatgaacccgaggatattgactgttggtgcaattccacatctacctgggtgacgtatggcacctgtacaaccacaggggagcaccggcgggaaaagcgcagcgtcgctctcgtgcctcatgttggaatgggcctggagacccggacggaaacatggatgtcctctgagggcgcctggaagcacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaagaacaggacaaacgctttatctgcaagcattccatggtggatagaggctggggcaacgggtgtggactgttcggcaaagggggaattgtcacatgcgccatgtttacgtgcaaaaagaatatggaaggcaaagttgtgcagcctgagaacctcgaatacaccatcgtgattacaccccacagcggggaggagcatgcggtcggaaatgacaccggcaagcacggcaaagaaatcaagatcacacctcagtcttccattaccgaggccgaactgacggggtatggaaccgtgacaatggagtgtagcccccggaccggccttgatttcaacgaaatggttctgctccaaatggaggacaaggcttggctggtgcaccgccagtggtttcttgatctgccgctcccttggctgcccggggccgacacacagggatctaattggatccagaaggagaccctggtcacgttcaagaaccctcatgctaaaaagcaagacgtggttgtgctcggctcccaggaaggggccatgcacacagccctgaccggcgctacagagattcagatgagctccggaaatcttctgtttaccggccatctcaaatgcagactgcggatggataaacttcaactgaaagggatgtcttacagcatgtgtaccggaaagttcaagatcgtcaaagaaattgcggagacacagcacggcacgatcgtgatcagagtccagtatgagggggacggatccccctgcaagattcccttcgaaatcaccgatctcgagaaacgccatgtgctgggccggctgattacagttaaccctatcgtgaccgggaaggacagcccggtcaacattgaagccgagcccccttttggcgattcttacatcattatcggagtggaacccggccagctcaaactgaattggttcaagaaggggtccagcatcggacaaatgtttgagacaaccatgagaggcgctaaacgcatggccattcttggggacacggcctgggatttcggatctctgggcggggtttttacaagcatcggcaaggctctccaccaggtgttcggagccatttacggcgcggctttttccggggtctcttggaccatgaaaatcctgattggagtgatcatcacctggattggcatgaacagccggtccacaagcctgtctgtgtcccttgttctcgtcggggtggtgaccctgtatctgggagccgtcgtgcaggccgacagcggctgtgttgtgtcttggaagaataaagagctcaagtgcgggtccggcatcttcattacagataacgtccacacgtggaccgaacagtacaagtttcaacctgagagcccctccaaactggcttctgccatccagaaggctcatgaagagggaatttgtggcatcagaagcgtgacacgccttgaaaatctgatgtggaaacagatcaccccggagctcaaccacattctgtccgagaatgaagttaagctgacaatcatgaccggggacattaaaggaatcatgcaggccggcaagcggtctcttagacctcaacccacggagctcaaatatagctggaagacctgggggaaggcgaaaatgctgtccacagaaagccataaccagaccttcctgattgatggacctgagacagccgaatgccccaataccaaccgcgcttggaactctctcgaggtggaggactacggctttggcgtcttcacaaccaacatctggctgaaacttcgggaaaaacaggacgtgttttgtgattccaagctgatgagcgccgctatcaaagacaatagagccgttcacgcggatatggggtattggattgagtctgccctcaacgacacgtggaagatggaaaaggcttccttcatcgaggtgaaaagctgccactggcctaagtctcatacactgtggagcaatggagtcctggagtccgaaatgattatccccaaaaacttcgccggcccggtgagccagcacaactaccgccctgggtatcatacccaaaccgctggaccctggcaccttggcaagctcgagatggattttgacttctgtgaagggacaaccgtggtcgttacggaggattgcggaaatcggggcccctctctgagaacaaccacagcctccggcaaactgattaccgaatggtgctgtcggagctgcacactccctccgctgcgctacagaggggaggacggatgttggtacggcatggagatccggccccttaaggaaaaggaggaaaacctggtgaatagcctcgtgaccgccgggcatggacagattgataacttttctctgggcgtcctggggatggctcttttcctcgaggaaatgctgagaacgcgcatcggaaccaaacacgcgatcctgctcgtggccgttagctttgtgacactgattaccggcaatatgtccttccgggaccttggcagagtcatggtgatggttggggctacaatgaccgatgacatcggaatgggcgtgacgtatctggccctcctggccgcttttaaggtccgccctacattcgccgcggggctgcttctgagaaaactcacctctaaggagctgatgatggctacaattggaatcgccctcctgagccagtccaccattcccgagaccatccttgaactgacagatgccctcgctctgggcatgatggtgctgaaaatcgttcggaacatggagaagtaccaacttgccgtgacgattatggcgatctcttgcgtccctaatgctgtgattctgcagaacgcctggaaggtgagctgtaccatcctcgccgctgtctccgttagccccctgctcctgacatcttcccagcagaaagccgactggattcctcttgctctgaccatcaaggggctcaatcccacagccatctttctgaccacgctgagccgcacatctaaaaagagatcctggccgcttaacgaagcgattatggccgtgggaatggtgagcatcctggcttcttccctcctgaaaaatgacattcctatgaccggccccctcgtcgccggcgggctgcttaccgtgtgctatgttctgacaggacggagcgctgatctggagctcgaacgcgccgccgacgtgaagtgggaggatcaagctgagatctccggcagctctcctattctgagcatcaccatttccgaagacgggtctatgagcatcaaaaacgaggaagaggagcagacacttacgatcctgattagaaccggactcctggtcatctccggcgtgttccccgtttctattccgatcacagcggccgcttggtacctctgggaagtgaagaagcagcgggccggggtcctgtgggatgtgccttctccccctcccgtcgagaaagccgaacttgaggacggagcttatcgcattaagcagagaggcatcctgggctactcccaaatcggggccggagtgtataaagaaggcacctttcacacaatgtggcatgttaccagaggggcggtgctgatgcaccgcggaaagagaattgagccctcctgggctgatgtcaaaaaggacctcatcagctacggcgggggatggaagctggagggcgaatggaaagagggcgaagaggtgcaggttcttgccctggaacctgggaagaatccgcgggccgtgcagacgaaacccggaattttcaagaccaacacaggcaccatcggggctgtctccctcgattttagccctggaacatctggctcccccattgtggacagaaaagggaaggtggttggactgtacggcaatggcgtcgtgacccgcagcggggcctatgtgtctgcgatcgctcagacagagaagtccatcgaggataaccctgaaattgaggacgatatcttccggaaaaagagactcacgattatggacctgcatcccggagccggcaaaaccaagcgctaccttcctgccatcgtccgggaagctattaaaagagggctgcgcacactgatcctcgccccgacccgggtggttgctgccgagatggaagaggcgctgagaggacttcccattcgctatcaaacccctgccatcaagacagagcacacgggccgggaaatcgtggacctgatgtgtcatgctaccttcacaatgagactcctgagccccgtccgggtgcctaactacaatctcattatcatggatgaggcccactttaccgaccccgcttccattgccgcccgcgggtatatctctacaagagttgaaatgggcgaggctgcgggaattttcatgaccgccacgccgcctggcagccgggatccctttccccagtccaacgctcctatcatggacgaggaacgcgagatccccgaaagaagctggaactctgggcacgagtgggtgacagatttcaagggaaaaaccgtctggtttgtgccttccattaaggccggcaacgacatcgccgcttgcctgcggaaaaatgggaagaaagttattcagcttagcagaaagaccttcgattctgaatacgtgaagacacgcgccaacgactgggattttgtcgtgaccacagacatcagcgagatgggagcgaatttcaaagctgagcgggtgattgatccgagacgctgtatgaagcccgtcatcctgaccgacggcgaagaacgggttatcctggccgggcctatgcccgtgacgcattcctctgccgctcaaagacgcggccggattggaagaaaccctaaaaatgaaaacgaccagtatatctacatgggcgagcccctcgaaaatgatgaggactgcgcccactggaaggaggcgaaaatgctgcttgataacattaatacaccggaagggatcattcctagcatgtttgagcccgaacgcgagaaggtggacgccatcgatggagaatacagactgcggggcgaggctcgcaaaaccttcgtcgacctcatgagaagaggggatctgcctgtgtggctggcctataaggttgctgccgagggaattaactacgctgaccgcaagtggtgttttgatggcatcaaaaataaccagatcctcgaagagaacatggaagtggagatttggacaaaggagggggaacgcaagaaacttaaaccccggtggctggacgccagaatctattccgatcctctggcgctcaaggagttcaaggagttcgccgctggccgcaaatctctgacccttaatctgattacggagatgggacggctccccacctttatgacacagaaggccagaaacgctctggacaatctggccgtcctccataccgccgaagctggcgggcgcgcgtacaaccacgcccttagcgagctgccggagacactggaaaccctcctgcttctgacactcctggctaccgtgacgggaggcatcttcctgtttctcatgtccgggaaaggaattggcaagatgacacttggcatgtgctgcatcatcaccgccagcattctgctgtggtatgcccaaatccagcctcactggattgctgcctctatcattctcgagttctttctgatcgttcttctgatccccgaacccgagaaacagcggacccctcaggataatcaactcacatacgtggtcattgcgatcctgaccgtggtcgccgctacaatggccaacgaaatggggttcctggagaagacgaagaaagacctcggacttggctccattaccacacaggagagcgaatccaatatcctggacattgatctgagaccggcttctgcctggaccctctatgcggtggccacaacctttgttacgcccatgctgcggcatagcatcgagaactcctctgtgaatgtgagccttaccgctattgccaaccaggctacagtcctgatggggctcggaaagggctggcctctgtccaaaatggacatcggggttcccctgctcgccatcggatgttacagccaggtgaatcctattacccttacagctgccctgctgctcctggtggcgcactacgccatcattggccccggccttcaagctaaggccacccgcgaagctcagaaaagagccgccgcggggatcatgaagaaccctacggtcgatggaattacagtgatcgacctggagccgatcccctatgatcctaagttcgaaaaacagctcggccaggttatgctgctgattctctgcgtgacccaagtccttatgatgcggacaacctgggctctgtgtgaggccctgaccctcgctacagggcccatctctacgctgtgggagggaaatcctggccgcttttggaacaccacaattgccgtgtccatggccaatatcttcagagggagctaccttgctggagccggcctgctcttttctattatgaagaacaccacatccacccggcgcggcacggggaatatcggagaaacactgggcgagaaatggaaaagcagactgaacgcgctcgggaaatctgagttccagatctataagaaaagcggcattcaggaggtcgaccggacccttgccaaggagggcatcaagcgcggggaaaccgatcatcacgctgtgtccagaggatctgccaaactgcggtggtttgttgagagaaacatggtgacacccgaaggcaaggtcgtggacctgggctgcgggcgcggaggctggagctactattgtgggggactcaaaaatgttcgggaggtgaagggcctgaccaaagggggaccgggccatgaagaacctattcccatgtccacatacggctggaaccttgtcagactgcaaagcggggtggatgtgttcttcacgccccctgagaagtgcgacaccctcctgtgtgatatcggagaatcctctcccaatcctacaattgaggctggccgcaccctgcgggttctcaaccttgtcgaaaattggctgaacaataacacacagttttgcatcaaggtgctgaatccgtatatgcccagcgtgatcgagaaaatggaagccctccagagacagtacgggggagcgctggtccgcaaccctctttccagaaattctacccacgagatgtactgggttagcaacgccacgggcaatattgtgtcctctgtgaacatgatcagcagaatgctgattaatcgcttcaccatgaagcacaaaaaggctacatatgagcccgacgtcgatctcgggtccggaacccggaacatcggcattgaaagcgagatccctaacctggacattatcggcaaaagaatcgaaaagattaagcaagagcatgaaatctcttggcactacgaccaggatcatccctataaaacatgggcctaccacgggtcctatgagaccaagcagacaggaagcgcttcttccatggtgaatggcgttgtgcgcctgctcaccaaaccgtgggacgtcgtgcctatggttacgcagatggccatgacagataccaccccctttgggcaacagcgggtgttcaaggagaaagtcgacacaagaacgcaggaacctaaggagggaaccaagaaacttatgaagattacagctgaatggctgtggaaagagctgggcaagaaaaagacccccagaatgtgtacaagagaggaatttaccaaaaaggtgcggagcaacgccgcgctcggggccatcttcacagatgagaataagtggaaatctgctcgcgaagccgtggaggacggaagattttgggaactggtcgatcgggagagaaaccttcacctggagggcaagtgcgaaacctgtgtttacaatatgatgggcaaacgggagaagaaactcggggagttcggaaaggctaagggctcccgcgccatttggtatatgtggctgggggccagatttctggagttcgaagcgctcggatttctgaacgaggaccattggttcagccggggcaattcccttagcggggtggagggcgaaggactgcaccgcctcggctacatcctgagagatgtggggaaaaaggagggaggcgctatgtacgccgacgatacggccgggtgggacacccggatcacacttgaagacctgaaaaacgaggaaatggtcaccaatcatatgaagggagagcacaaaaagctcgctgaggccatttttaagctgacatatcagaacaaagtggttcgcgtgcaaagacctacaccccggggcacggtcatggatatcatttctcgcagagaccagcgggggagcggccaggtgggaacatacggcctgaataccttcacaaacatggaagctcaactcatccgccagatggagggggaaggaattttcaagtccatccagcatctgaccgccacggaggagatcgcggttcagaattggcttgccagagtgggccgggaacgcctgtctagaatggctattagcggggatgactgcgtcgtgaaaccgatcgatgaccggtttgcctccgctctcaccgccctgaacgatatgggaaaggttagaaaagacattcaacagtgggagccttctcgcggctggaatgattggacacaggtgcccttctgcagccaccactttcatgaacttgtcatgaaggacgggcgggtgctggtcgtgccctgtagaaaccaggatgagctcatcggccgcgcgcggatttcccaaggagccggctggtctctgaaggaaaccgcttgcctggggaaaagctatgcccagatgtggacactcatgtacttccacagacgcgacctgcggcttgctgccaacgctatctgttccgccgttcctagccattgggtgccgacctctagaacaacctggtccattcacgcgaagcacgagtggatgacgacagaggatatgctggccgtctggaatcgcgtgtggatccaggaaaacccctggatggaggacaaaacccctgtggaaagctgggaggaagttccctatctcggaaagcgggaggaccagtggtgcggctctctgatcgggcttacctccagagctacatgggccaaaaatattcaaaccgccatcaaccaggtgcgcagcctgattggaaatgaggaatacacagattatatgccttccatgaagcggtttagacgggaggaagaggaagctggcgtcctctggtga

SEQ ID NO: 19740 - RNA, 9876 nt, synthetic construct
  misc_feature 1..9876: note = derived and/or modified CDS sequence (opt5) from DENV-2__EU596497__SS-prME
  source 1..9876: mol_type = other RNA
accgccggcgtgatcgtcatgctgattcccaccgctatggccttccacctcacgacccggaatggggaacctcatatgatcgttggacggcaggaaaagggcaagagcctgctttttaagacagaagacggggtgaatatgtgcaccctgatggcgattgatctcggagaactgtgtgaggacacaatcacctacaaatgcccgcttctgcgccaaaatgaacccgaggatattgactgttggtgcaattccacatctacctgggtgacgtatggcacctgtacaaccacaggggagcacagacgggaaaagcgcagcgtcgctctcgtgcctcatgttggaatgggcctggagaccagaacggaaacatggatgtcctctgagggcgcctggaaacacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccatcaccgagagccggtgtccgacacaaggagagccctctctgaatgaagaacaggacaaacgctttatttgcaagcattccatggtggatagaggctggggcaacgggtgtggactgttcggcaaaggcgggatcgtcacatgcgccatgtttacatgcaaaaagaatatggaagggaaagttgtgcagcctgagaacctcgaatacacgattgtgatcacaccccacagcggggaggagcatgcggtcggaaatgacacaggcaagcacggcaaagaaatcaagattacccctcagtcttccatcacagaggccgaactgaccgggtatggaacggtgaccatggagtgtagcccccggacaggccttgatttcaacgaaatggttctgctccaaatggaggacaaggcttggctggtgcaccgccagtggtttcttgatctgccgctcccttggctgcccggggccgacacccagggatctaattggattcagaaggagacactggtcaccttcaagaaccctcatgctaaaaagcaagacgtggttgtgctcggctcccaggaaggggccatgcacacggccctgacaggcgctaccgagatccagatgagctccggaaatcttctgtttacaggccatctcaaatgcagactgcggatggataaacttcaactgaaagggatgtcttacagcatgtgtaccggaaagttcaagattgtcaaagaaatcgcggagacccagcacggcacaatcgtgattagagtccagtatgagggggacggatccccctgcaagatccccttcgaaattacggatctcgagaaacgccatgtgctgggccggctgatcaccgttaaccctattgtgacagaaaaggacagcccggtcaacatcgaggccgaacccccttttggggattcttacattatcatcggcgtggagcccggacagctcaaactgaattggttcaagaagggctccagcattgggcaaatgtttgagaccacaatgagaggagctaaacgcatggccatccttggcgacaccgcctgggatttcgggtctctgggaggcgtttttacgagcattgggaaggctctccaccaggtgttcggcgccatctacggagcggctttttccggcgtctcttggacaatgaaaattctgatcggggtgatcattacctggatcggaatgaacagccggtccaccagcctgtctgtgtcccttgttctcgtcggcgtggtgacactgtatctgggggccgtcgtgcaggccgacagcggatgtgttgtgtcttggaagaataaagaactcaagtgcggctccgggattttcatcaccgataacgtccacacatggacggagcagtacaagtttcaacctgaaagcccctccaaactggcttctgccattcagaaggctcatgaggaaggcatctgtggaatcagaagcgtgacccgccttgagaatctgatgtggaaacagattacaccggagctcaaccacatcctgtccgaaaatgaggttaagctgaccattatgacaggcgacatcaaagggattatgcaggccggaaagcggtctcttagacctcaacccaccgaactcaaatatagctggaagacgtggggcaaggcgaaaatgctgtccaccgagagccataaccagacattcctgatcgatgggcctgaaaccgccgagtgccccaatacaaaccgcgcttggaactctctcgaggtggaagactacggatttggcgtcttcaccacaaacatctggctgaaacttcgggagaaacaggacgtgttttgtgattccaagctgatgagcgccgctattaaagacaatagagccgttcacgcggatatgggctattggatcgaatctgccctcaacgacacctggaagatggagaaggcttccttcattgaggtgaaaagctgccactggcctaagtcttacacgctgtggagcaatggggtcctggaatccgagatgatcattcccaaaaacttcgccggaccggtgagccagcataactatcgccctggctaccacacacaaaccgctgggccctggcatcttggaaagctcgaaatggattttgacttctgtgagggcaccacagtggtcgttaccgaagattgcgggaatcggggaccctctctgagaacgacaaccgcctccggcaaactgatcacagagtggtgctgtcggagctgcaccctccctccgctgcgctacagaggcgaggacgggtgttggtatggaatggaaattcggccccttaaggagaaggaagagaacctggtgaatagcctcgtgacagccggccacgggcagatcgataacttttctctgggagtcctgggcatggctcttttcctcgaagagatgctgagaacccgcatcgggacgaaacatgcgattctgctcgtggccgttagctttgtgaccctgatcacaggaaatatgtccttccgggaccttggcagagtcatggtgatggttggcgctaccatgacagatgacattgggatgggagtgacctacctggccctcctggccgcttttaaggtccgccctacgttcgccgcgggcctgcttctgagaaaactcacatctaaggagctgatgatggctaccatcgggattgccctcctgagccagtccacaatccccgaaaccatccttgagctgaccgatgccctcgctctgggaatgatggtgctgaaaattgttcggaacatggaaaagtatcaacttgccgtgacaatcatggcgatttcttgcgtccctaatgctgtgatcctgcagaacgcctggaaggtgagctgtacgattctcgccgctgtctccgttagccccctgctcctgacctcttcccagcagaaagccgactggatccctcttgctctgacaatcaagggcctcaatcccaccgccatttttctgacaaccctgagccgcacgtctaaaaagagatcctggccgcttaacgaggcgatcatggccgtggggatggtgagcattctggcttcttccctcctgaaaaatgacatccctatgacaggacccctcgtcgccggcggcctgcttaccgtgtgctacgttctgaccgggcggagcgctgatctggaactcgagcgcgccgccgacgtgaagtgggaggatcaagctgaaatttccggaagctctcctatcctgagcattacaatctccgaggacggctctatgagcatcaaaaacgaagaggaggaacagacccttacaattctgatcagaacggggctcctggtcatttccggagtgttccccgtttctatcccgattaccgcggccgcttggtatctctgggaggtgaagaagcagcgggccggcgtcctgtgggatgtgccttctccccctcccgtcgaaaaagccgagcttgaagacggggcttaccgcatcaagcagagaggaatcctgggctattcccaaattggcgccggggtgtacaaagagggaacatttcacaccatgtggcacgttacacggggcgcggtgctgatgcatcgcgggaagagaatcgagccctcctgggctgatgtcaaaaaggacctcattagctacggaggcgggtggaagctggaaggagagtggaaagaaggcgaggaagtgcaggttcttgccctggagcctggcaagaatccgcgggccgtgcagaccaaacccgggatcttcaagacgaacaccggaacaattggcgctgtctccctcgattttagccctgggacctctggatcccccatcgtggacagaaaaggcaaggtggttgggctgtatggaaatggcgtcgtgacacgcagcggcgcctacgtgtctgcgatcgctcagaccgagaagtccattgaagataaccctgagatcgaagacgatattttccggaaaaagagactcacaatcatggacctgcaccccggggccggaaaaacgaagcgctatcttcctgccattgtccgggaggctatcaaaagaggcctgcgcaccctgattctcgccccgacacgggtggttgctgccgaaatggaggaggcgctgagagggcttcccatccgctaccaaacccctgccatcaagaccgaacatacaggacgggagattgtggacctgatgtgtcacgctacgttcaccatgagactcctgagccccgtccgggtgcctaactataatctcatcattatggatgaagcccattttacagaccccgcttccatcgccgcccgcggctacatttctaccagagttgagatgggggaggctgcgggcatcttcatgacagccaccccgcctggaagccgggatccctttccccagtccaacgctcctatcatggacgaagaaagagaaattcccgagagaagctggaactctggccacgaatgggtgacggatttcaaggggaaaacagtctggtttgtgccttccatcaaggccggaaacgacattgccgcttgcctgcggaaaaatggcaagaaagttatccagcttagcagaaagaccttcgattctgagtatgtgaagacccgcgccaacgactgggattttgtcgtgacaaccgacattagcgagatgggggcgaatttcaaagctgaacgggtgatcgatccgagacgctgtatgaagcccgtcatcctgacagacggagaggaacgggttattctggccggccctatgcccgtgacccactcctctgccgctcaaagacgcgggcggatcggcagaaaccctaaaaatgagaacgaccagtacatttacatgggagaacccctcgagaatgatgaggactgcgcccattggaaggaagcgaaaatgctgcttgataacatcaatacgccggagggcattatccctagcatgtttgaacccgagcgcgaaaaggtggacgccattgatggggagtatagactgcggggagaggctcgcaaaacattcgtcgacctcatgagacggggcgatctgcctgtgtggctggcctacaaggttgctgccgaagggatcaactatgctgaccgcaagtggtgttttgatggaatcaaaaataaccagattctcgaggaaaacatggaggtggagatctggaccaaggaaggcgagcgcaagaaacttaaaccccggtggctggacgccagaatttactccgatcctctggcgctcaaggagttcaaggagttcgccgctgggcgcaaatctctgacacttaatctgatcaccgaaatgggccggctccccacgtttatgacccagaaggccagaaacgctctggacaatctggccgtcctccacacagccgaggctggaggccgcgcgtataaccatgcccttagcgagctgccggaaaccctggagacactcctgcttctgaccctcctggctacagtgaccgggggaattttcctgtttctcatgtccggcaaagggatcggaaagatgacgcttggcatgtgctgcatcattacagccagcatcctgctgtggtacgcccaaattcagcctcactggatcgctgcctctattatcctcgagttctttctgatcgttcttctgattcccgagcccgaaaaacagcggacccctcaggataatcaactcacctatgtggtcatcgcgattctgacagtggtcgccgctaccatggccaacgagatgggcttcctggagaagacaaagaaagacctcgggcttggatccatcacgacccaggaaagcgagtccaatattctggacatcgatctgagaccggcttctgcctggacactctacgcggtggccaccacatttgttacccccatgctgcggcacagcattgaaaactcctctgtgaatgtgagccttacggctatcgccaaccaggctaccgtcctgatgggcctcgggaagggatggcctctgtccaaaatggacatcggcgttcccctgctcgccattgggtgttacagccaggtgaatcctatcacacttaccgctgccctgctgctcctggtggcgcattatgccattatcggacccggccttcaagctaaggccacacgcgaggctcagaaaagagccgccgcgggcattatgaagaaccctaccgtcgatgggatcacggtgatcgacctggaaccgattccctacgatcctaagttcgagaaacagctcggacaggttatgctgctgatcctctgcgtgacacaagtccttatgatgcggaccacatgggctctgtgtgaggccctgaccctcgctaccggccccatttctacactgtgggaagggaatcctggacgcttttggaacacgaccatcgccgtgtccatggccaatattttcagaggcagctatcttgctggggccggactgctcttttctatcatgaagaacacaacctccacacggcgcggcaccggcaatatcggggagacgctgggagaaaaatggaaaagcagactgaacgcgctcggcaaatctgagttccagatttacaagaaaagcgggatccaggaggtcgaccggacacttgccaaggaaggaattaagcgcggcgagaccgatcaccatgctgtgtccagagggtctgccaaactgcggtggtttgttgaaagaaacatggtgacccccgagggaaaggtcgtggacctgggctgcggccgcgggggatggagctattactgtggcgggctcaaaaatgttcgggaagtgaagggactgacaaaaggcgggccgggacacgaggagcctatccccatgtccacctatggctggaaccttgtcagactgcaaagcggcgtggatgtgttcttcacaccccctgaaaagtgcgacacgctcctgtgtgatattggggagtcctctcccaatcctaccatcgaagctggacgcacactgcgggttctcaaccttgtcgagaattggctgaacaataacacccagttttgcatcaaggtgctgaatccgtacatgcccagcgtgattgagaagatggaggccctccagagacagtacggcggggcgctggtccgcaaccctctttccagaaattctacacatgagatgtattgggttagcaacgccaccggaaatatcgtgtcctctgtgaacatgattagcagaatgctgatcaatcgcttcacgatgaagcacaaaaaggctacctacgaacccgacgtcgatctcggctccgggacacggaacattggaatcgagagcgaaattcctaacctggacatcatcggcaaaagaattgagaagatcaagcaagaacacgagatttcttggcattatgaccaggatcacccctacaaaacctgggcctatcatggctcctacgagacaaagcagaccgggagcgcttcttccatggtgaatggagttgtgcgcctgctcacaaaaccgtgggacgtcgtgcctatggttacccagatggccatgacggatacaaccccctttggccaacagcgggtgttcaaggaaaaagtcgacaccagaacacaggagcctaaggaagggacgaagaaacttatgaagatcaccgctgagtggctgtggaaagagctgggaaagaaaaagacaccccgcatgtgtaccagagaagagtttaccaagaaggtgcggagcaacgccgcgctcggcgccattttcaccgatgaaaataagtggaaatctgctcgcgaggccgtggaagacgggagattttgggagctggtcgatcgggagagaaaccttcacctggaaggaaagtgcgagacatgtgtttataatatgatgggcaaacgggaaaagaaactcggcgagttcgggaaggctaagggatcccgcgccatctggtacatgtggctgggcgccagatttctggagttcgaggcgctcgggtttctgaacgaggaccactggttcagccggggaaattcccttagcggcgtggaaggggagggcctgcatcgcctcggatacatcctgagagatgtgggcaaaaaggaagggggagctatgtatgccgacgataccgccggctgggacacgcggattacccttgaggacctgaaaaacgaagagatggtcacaaatcacatgaagggggagcataaaaagctcgctgaagccatctttaagctgacctaccagaacaaagtggttcgcgtgcaaagacctacaccccggggaaccgtcatggatattatctctcgcagagaccagcggggcagcggacaggtgggcacgtatggactgaatacattcaccaacatggaggctcaactcattcgccagatggaaggcgaggggatcttcaagtccatccagcacctgacagccaccgaggaaattgcggttcagaattggcttgccagagtgggacgggagcgcctgtctagaatggctatcagcggcgatgactgcgtcgtgaaaccgattgatgaccggtttgcctccgctctcacggccctgaacgatatggggaaggttagaaaagacatccaacagtgggaaccttctcgcggatggaatgattggacccaggtgcccttctgcagccatcactttcacgagcttgtcatgaaggacggccgggtgctggtcgtgccctgtagaaaccaggatgaactcattgggcgcgcgcggatctcccaaggcgccggatggtctctgaaggagacagcttgcctgggcaaaagctacgcccagatgtggaccctcatgtatttccatagacgcgacctgcggcttgctgccaacgctatttgttccgccgttcctagccactgggtgccgacatctagaaccacatggtccatccatgcgaagcacgagtggatgaccacggaagatatgctggccgtctggaatcgcgtgtggatccaggagaacccctggatggaagacaaaacacctgtggagagctgggaagaggttccctacctcgggaagcgggaggaccagtggtgcggatctctgattggccttacctccagagctacctgggccaaaaatatccaaacagccattaaccaggtgcgcagcctgatcgggaatgaagagtataccgattacatgccttccatgaagcggtttagacgggaagaggaagaggctggagtcctctggtga

SEQ ID NO: 19741 - RNA, 9876 nt, synthetic construct
  misc_feature 1..9876: note = derived and/or modified CDS sequence (opt5) from DENV-2__EU569695__SS-prME
  source 1..9876: mol_type = other RNA
accgccggcgtgatcgtcatgctgattcccaccgctatggccttccacctcacgacccggaatggggaacctcatatgatcgttggacggcaggaaaagggcaagagcctgctttttaagaccgaagacggggtgaatatgtgcaccctgatggcgattgatctcggagaactgtgtgaggacacgatcacctacaagtgcccgcttctgcgccaaaatgaacccgaggatattgactgttggtgcaattccacatctacctgggtgacgtatggcacctgtacaaccacaggggagcacagacgggaaaagcgcagcgtcgctctcgtgcctcatgttggaatgggcctggagaccagaacggaaacatggatgtcctctgagggcgcctggaaacacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaagaacaggacaaacgctttatctgcaagcattccatggtggatagaggctggggcaacgggtgtggactgttcggcaaagggggaattgtcacatgcgccatgtttacgtgcaaaaagaatatggaaggcaaagttgtgcagcctgagaacctcgaatacaccatcgtgattacaccccacagcggggaggagcatgcggtcggaaatgacaccggcaagcacggcaaagaaatcaagatcacacctcagtcttccattaccgaggccgaactgacggggtatggaaccgtgacaatggagtgtagcccccggaccggccttgatttcaacgaaatggttctgctccaaatggaggacaaggcttggctggtgcaccgccagtggtttcttgatctgccgctcccttggctgcccggggccgacacacagggatctaattggatccagaaggagaccctggtcacgttcaagaaccctcatgctaaaaagcaagacgtggttgtgctcggctcccaggaaggggccatgcacacagccctgaccggcgctacagagattcagatgagctccggaaatcttctgtttaccggccatctcaaatgcagactgcggatggataaacttcaactgaaagggatgtcttacagcatgtgtaccggaaagttcaagatcgtcaaagaaattgcggagacacagcacggcacgatcgtgatcagagtccagtatgagggggacggatccccctgcaagattcccttcgaaatcaccgatctcgagaaacgccatgtgctgggccggctgattacagttaaccctatcgtgaccgaaaaggacagcccggtcaacattgaggccgaacccccttttggggattcttacatcattatcggcgtggagcccggacagctcaaactgaattggttcaagaagggctccagcatcgggcaaatgtttgagacaaccatgagaggagctaaacgcatggccattcttggcgacacggcctgggatttcgggtctctgggaggcgtttttacaagcatcgggaaggctctccaccaggtgttcggcgccatttacggagcggctttttccggcgtctcttggaccatgaaaatcctgattggggtgatcatcacctggattggaatgaacagccggtccacaagcctgtctgtgtcccttgttctcgtcggcgtggtgaccctgtatctgggggccgtcgtgcaggccgacagcggatgtgttgtgtcttggaagaataaagaactcaagtgcggctccgggatcttcattacagataacgtccacacgtggaccgagcagtacaagtttcaacctgaaagcccctccaaactggcttctgccatccagaaggctcatgaggaaggcatttgtggaatcagaagcgtgacacgccttgagaatctgatgtggaaacagatcaccccggagctcaaccacattctgtccgaaaatgaggttaagctgacaatcatgaccggcgacattaaagggatcatgcaggccggaaagcggtctcttagacctcaacccacggaactcaaatatagctggaagacctggggcaaggcgaaaatgctgtccacagagagccataaccagaccttcctgattgatgggcctgaaacagccgagtgccccaataccaaccgcgcttggaactctctcgaggtggaagactacggatttggcgtcttcacaaccaacatctggctgaaacttcgggagaaacaggacgtgttttgtgattccaagctgatgagcgccgctatcaaagacaatagagccgttcacgcggatatgggctattggattgaatctgccctcaacgacacgtggaagatggagaaggcttccttcatcgaggtgaaaagctgccactggcctaagtctcatacactgtggagcaatggggtcctggaatccgagatgattatccccaaaaacttcgccggaccggtgagccagcacaactaccgccctggctatcatacccaaaccgctgggccctggcaccttggaaagctcgaaatggattttgacttctgtgagggcacaaccgtggtcgttacggaagattgcgggaatcggggaccctctctgagaacaaccacagcctccggcaaactgattaccgagtggtgctgtcggagctgcacactccctccgctgcgctacagaggcgaggacgggtgttggtacggaatggaaatccggccccttaaggagaaggaagagaacctggtgaatagcctcgtgaccgccggccatgggcagattgataacttttctctgggagtcctgggcatggctcttttcctcgaagagatgctgagaacgcgcatcgggaccaaacacgcgatcctgctcgtggccgttagctttgtgacactgattaccggaaatatgtccttccgggaccttggcagagtcatggtgatggttggcgctacaatgaccgatgacatcgggatgggagtgacgtatctggccctcctggccgcttttaaggtccgccctacattcgccgcgggcctgcttctgagaaaactcacctctaaggagctgatgatggctacaattgggatcgccctcctgagccagtccaccattcccgaaaccatccttgagctgacagatgccctcgctctgggaatgatggtgctgaaaatcgttcggaacatggaaaagtaccaacttgccgtgacgattatggcgatctcttgcgtccctaatgctgtgattctgcagaacgcctggaaggtgagctgtaccatcctcgccgctgtctccgttagccccctgctcctgacatcttcccagcagaaagccgactggattcctcttgctctgaccatcaagggcctcaatcccacagccatctttctgaccacgctgagccgcacatctaaaaagagatcctggccgcttaacgaggcgattatggccgtggggatggtgagcatcctggcttcttccctcctgaaaaatgacattcctatgaccggacccctcgtcgccggcggcctgcttaccgtgtgctatgttctgacagggcggagcgctgatctggaactcgagcgcgccgccgacgtgaagtgggaggatcaagctgaaatctccggaagctctcctattctgagcatcaccatttccgaggacggctctatgagcatcaaaaacgaagaggaggaacagacacttacgatcctgattagaaccgggctcctggtcatctccggagtgttccccgtttctattccgatcacagcggccgcttggtacctctgggaggtgaagaagcagcgggccggcgtcctgtgggatgtgccttctccccctcccgtcgaaaaagccgagcttgaagacggggcttatcgcattaagcagagaggaatcctgggctactcccaaatcggcgccggggtgtataaagagggaacctttcacacaatgtggcatgttacccggggcgcggtgctgatgcaccgcgggaagagaattgagccctcctgggctgatgtcaaaaaggacctcatcagctacggaggcgggtggaagctggaaggagagtggaaagaaggcgaggaagtgcaggttcttgccctggagcctggcaagaatccgcgggccgtgcagacgaaacccgggattttcaagaccaacacaggaaccatcggcgctgtctccctcgattttagccctgggacatctggatcccccattgtggacagaaaaggcaaggtggttgggctgtacggaaatggcgtcgtgacccgcagcggcgcctatgtgtctgcgatcgctcagacagagaagtccatcgaagataaccctgagattgaagacgatatcttccggaaaaagagactcacgattatggacctgcatcccggggccggaaaaaccaagcgctaccttcctgccatcgtccgggaggctattaaaagaggcctgcgcacactgatcctcgccccgacccgggtggttgctgccgaaatggaggaggcgctgagagggcttcccattcgctatcaaacccctgccatcaagacagaacacacgggacgggagatcgtggacctgatgtgtcatgctaccttcacaatgagactcctgagccccgtccgggtgcctaactacaatctcattatcatggatgaagcccactttaccgaccccgcttccattgccgcccgcggctatatctctacaagagttgagatgggggaggctgcgggcattttcatgaccgccacgccgcctggaagccgggatccctttccccagtccaacgctcctatcatggacgaagaaagagaaatccccgagagaagctggaactctggccacgaatgggtgacagatttcaaggggaaaaccgtctggtttgtgccttccattaaggccggaaacgacatcgccgcttgcctgcggaaaaatggcaagaaagttattcagcttagcagaaagaccttcgattctgagtacgtgaagacacgcgccaacgactgggattttgtcgtgaccacagacatcagcgagatgggggcgaatttcaaagctgaacgggtgattgatccgagacgctgtatgaagcccgtcatcctgaccgacggagaggaacgggttatcctggccggccctatgcccgtgacgcattcctctgccgctcaaagacgcgggcggattggcagaaaccctaaaaatgagaacgaccagtatatctacatgggagaacccctcgagaatgatgaggactgcgcccactggaaggaagcgaaaatgctgcttgataacattaatacaccggagggcatcattcctagcatgtttgaacccgagcgcgaaaaggtggacgccatcgatggggagtacagactgcggggagaggctcgcaaaaccttcgtcgacctcatgagacggggcgatctgcctgtgtggctggcctataaggttgctgccgaagggattaactacgctgaccgcaagtggtgttttgatggaatcaaaaataaccagatcctcgaggaaaacatggaggtggagatttggacaaaggaaggcgagcgcaagaaacttaaaccccggtggctggacgccagaatctattccgatcctctggcgctcaaggagttcaaggagttcgccgctgggcgcaaatctctgacccttaatctgattacggaaatgggccggctccccacctttatgacacagaaggccagaaacgctctggacaatctggccgtcctccataccgccgaggctggaggccgcgcgtacaaccacgcccttagcgagctgccggaaacactggagaccctcctgcttctgacactcctggctaccgtgacagggggaatcttcctgtttctcatgtccggcaaagggattggaaagatgacacttggcatgtgctgcatcatcaccgccagcattctgctgtggtatgcccaaatccagcctcactggattgctgcctctatcattctcgagttctttctgatcgttcttctgatccccgagcccgaaaaacagcggacccctcaggataatcaactcacatacgtggtcattgcgatcctgaccgtggtcgccgctacaatggccaacgagatgggcttcctggagaagacgaagaaagacctcgggcttggatccattaccacacaggaaagcgagtccaatatcctggacattgatctgagaccggcttctgcctggaccctctatgcggtggccacaacctttgttacgcccatgctgcggcatagcatcgaaaactcctctgtgaatgtgagccttaccgctgtcgccaaccaggctacagttctgatgggcctcgggaagggatggcctctgtccaaaatggacattggcgtgcccctgctcgccatcgggtgttacagccaggtgaatcctatcacccttacagctgccctgctgctcctggtcgcgcactacgccattatcggacccggccttcaagctaaggccacccgcgaggctcagaaaagagccgccgcgggcattatgaagaaccctacggtggatgggatcacagttattgacctggaaccgatcccctatgatcctaagttcgagaaacagctcggacaggtgatgctgctgatcctctgcgtcacccaagtgcttatgatgcggacaacctgggctctgtgtgaggccctgaccctcgctacaggccccatttctacgctgtgggaagggaatcctggacgcttttggaacaccacaatcgccgtctccatggccaatattttcagaggcagctaccttgctggggccggactgctcttttctatcatgaagaacaccacatccacccggcgcggcacgggcaatattggggagacactgggagaaaaatggaaaagcagactgaacgcgctcggcaaatctgagttccagatctataagaaaagcgggatccaggaggtggaccggacccttgccaaggaaggaattaagcgcggcgagaccgatcatcacgctgtttccagagggtctgccaaactgcggtggtttgtggaaagaaacatggtcacacccgagggaaaggtggttgacctgggctgcggccgcgggggatggagctactattgtggcgggctcaaaaatgtgcgggaagtcaagggactgaccaaaggcgggccgggacatgaggagcctatccccatgtccacatacggctggaaccttgtgagactgcaaagcggcgtggatgttttcttcacgccccctgaaaagtgcgacaccctcctgtgtgatattggggagtcctctcccaatcctacaatcgaagctggacgcaccctgcgggtcctcaaccttgtggagaattggctgaacaataacacacagttttgcattaaggtgctgaatccgtatatgcccagcgtcatcgagaagatggaggccctccagagacagtacggcggggcgctggttcgcaaccctctttccagaaattctacccacgagatgtactgggtgagcaacgccacgggaaatatcgtgtcctctgtcaacatgattagcagaatgctgatcaatcgcttcaccatgaagcacaaaaaggctacatatgaacccgacgtggatctcggctccgggacccggaacattggaatcgagagcgaaattcctaacctggacatcattggcaaaagaatcgagaagatcaagcaagaacatgagatttcttggcactacgaccaggatcatccctataaaacatgggcctaccacggctcctatgagaccaagcagacagggagcgcttcttccatggttaatggagtggtccgcctgctcaccaaaccgtgggacgtggttcctatggtgacgcagatggccatgacagataccaccccctttggccaacagcgggtcttcaaggaaaaagtggacacaagaacgcaggagcctaaggaagggaccaagaaacttatgaagatcacagctgagtggctgtggaaagagctgggaaagaaaaagacaccccgcatgtgtacaagagaagagtttaccaaaaaggtgcggagcaacgccgcgctcggcgccattttcacagatgaaaataagtggaaatctgctcgcgaggccgtcgaagacgggagattttgggagctggttgatcgggagagaaaccttcacctggaaggaaagtgcgagacctgtgtgtacaatatgatgggcaaacgggaaaagaaactcggcgagttcgggaaggctaagggatcccgcgccatctggtatatgtggctgggcgccagatttctggagttcgaggcgctcgggtttctgaacgaggaccattggttcagccggggaaattcccttagcggcgtggaaggggagggcctgcaccgcctcggatacattctgagagatgtcggcaaaaaggaagggggagctatgtacgccgacgatacggccggctgggacacccggatcacacttgaggacctgaaaaacgaagagatggtgaccaatcatatgaagggggagcacaaaaagctcgctgaagccatctttaagctgacatatcagaacaaagttgtgcgcgtccaaagacctacaccccggggaacggtgatggatattatctctcgcagagaccagcggggcagcgggcaggttggcacatacggactgaataccttcacaaacatggaggctcaactcattcgccagatggaaggcgaggggatcttcaagtccattcagcatctgaccgccacggaggaaatcgcggtgcagaattggcttgccagagtcggacgggagcgcctgtctagaatggctatcagcggcgatgactgcgtggttaaaccgattgatgaccggtttgcctccgctctcaccgccctgaacgatatggggaaggtgagaaaagacatccaacagtgggaaccttctcgcggatggaatgattggacacaggtccccttctgcagccaccactttcatgagcttgtgatgaaggacggccgggtcctggtggttccctgtagaaaccaggatgaactcattgggcgcgcgcggatctcccaaggcgccggatggtctctgaaggagaccgcttgcctgggcaaaagctatgcccagatgtggacactcatgtacttccacagacgcgacctgcggcttgctgccaacgctatttgttccgccgtgcctagccattgggtcccgacctctagaacaacctggtccatccacgcgaagcacgagtggatgacgacagaagatatgctggccgtgtggaatcgcgtgtggattcaggagaacccctggatggaagacaaaacccctgttgagagctgggaagaggtgccctatctcgggaagcgggaggaccagtggtgcggatctctgatcggccttacctccagagctacatgggccaaaaatatccaaaccgccattaaccaggtccgcagcctgatcgggaatgaagagtacacagattatatgccttccatgaagcggtttagacgggaagaggaagaggctggagtgctctggtga

SEQ ID NO: 19742 - RNA, 9876 nt, synthetic construct
  misc_feature 1..9876: note = derived and/or modified CDS sequence (opt5) from DENV-2__EU482623__SS-prME
  source 1..9876: mol_type = other RNA
acagccggagtgatcgtcatgctgattcccacagctatggccttccacctcacgacccggaatggggagcctcatatgatcgttggacggcaggaaaagggcaaaagcctgctttttaagacagaggacggggtgaatatgtgcaccctgatggcgattgatctcggagaactgtgtgaggacacaatcacctacaaatgcccgcttctgagacaaaatgaacccgaggatattgactgttggtgcaattccacatctacctgggtgacgtatggcacctgtacaaccacaggggagcacagacgggaaaagcgcagcgtcgctctcgtgcctcatgttggaatgggcctggagaccagaacggaaacatggatgtcctctgagggcgcctggaaacacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaggaacaggacaaacgctttatctgcaagcattccatggtggatagaggctggggcaacgggtgtggactgttcggcaaagggggaattgtcacatgcgccatgtttacgtgcaaaaagaatatggaaggcaaagttgtgcagcctgagaacctcgaatacaccatcgtgattacaccccacagcggggaggagcatgcggtcggaaatgacaccggcaagcacggcaaagaaatcaagatcacacctcagtcttccattaccgaggccgaactgacggggtatggaaccgtgacaatggagtgtagcccccggaccggccttgatttcaacgaaatggttctgctccaaatggaggacaaggcttggctggtgcaccgccagtggtttcttgatctgccgctcccttggctgcccggggccgacacacaggagtctaattggatccagaaggaaaccctggtcacgttcaagaaccctcatgctaaaaagcaagacgtggttgtgctcggatcccaggagggcgccatgcacacagccctgaccggggctacagaaattcagatgagctccggcaatcttctgtttaccggacatctcaaatgcagactgcggatggataaacttcaactgaaaggcatgtcttacagcatgtgtaccgggaagttcaagatcgtcaaagagattgcggagacacagcacggaacgatcgtgatcagagtccagtatgaaggcgacgggtccccctgcaagattcccttcgagatcaccgatctcgaaaaacgccatgtgctgggacggctgattacagttaaccctatcgtgaccgagaaggacagcccggtcaacattgaagccgagcccccttttggcgattcttacatcattatcggggtggagcccggccagctcaaactgaattggttcaagaagggatccagcatcggccaaatgtttgaaacaaccatgagaggggctaaacgcatggccattcttggagacacggcctgggatttcggctctctcgggggagtttttacaagcatcggcaaggctctccaccaggtgttcggggccatttacggcgcggctttttccggagtctcttggaccatgaaaatcctgattggcgtgatcatcacctggattgggatgaacagccggtccacaagcctgtctgtgtcccttgttctcgtcggagtggtgaccctgtatctgggcgccgtcgtgcaggccgacagcgggtgtgttgtgtcttggaagaataaagagctcaagtgcggatccggcatcttcattacagataacgtccacacgtggaccgaacagtacaagtttcaacctgagagcccctccaaactggcttctgccatccagaaggctcatgaagaggggatttgtggcatcagaagcgtgacacgccttgagaatctgatgtggaaacagatcaccccggaactcaaccacattctgtccgagaatgaagttaagctgacaatcatgaccggagacattaaaggcatcatgcaggccgggaagcggtctcttagacctcaacccacggagctcaaatatagctggaagacctggggaaaggcgaaaatgctgtccacagaaagccataaccagaccttcctgattgatggccctgagacagccgagtgccccaataccaaccgcgcttggaactctctcgaagtggaggactacgggtttggagtcttcacaaccaacatctggctgaaacttcgggaaaaacaggacgtgttttgtgattccaagctgatgagcgccgctatcaaagacaatagagccgttcacgcggatatgggctattggattgagtctgccctcaacgacacgtggaagatggagaaggcttccttcatcgaagtgaaaagctgccactggcctaagtctcatacactgtggagcaatggcgtcctggagtccgaaatgattatccccaaaaacttcgccgggccggtgagccagcacaactaccgccctggatatcatacccaaaccgctggcccctggcaccttgggaagctcgagatggattttgacttctgtgaaggaacaaccgtggtcgttacggaggattgcggcaatcgggggccctctctgagaacaaccacagcctccggaaaactgattaccgagtggtgctgtcggagctgcacactccctccgctgcgctacagaggcgaagacggctgttggtacgggatggagatccggccccttaaggaaaaggaggaaaacctggtgaatagcctcgtgaccgccggacatggccagattgataacttttctctgggggtcctgggaatggcgcttctgctggaggagatgctgagaacgcgcatcggcaccaaacacgctatcctcctggtggccgttagcttcgtgacacttattaccgggaatatgtcctttcgggacctgggaagagtcatggtgatggttggcgctacaatgaccgatgacatcggcatgggggtgacgtatctcgccctgctggccgctttcaaggtccgccctacatttgccgcgggacttctgctcagaaaactgacctctaaggaactcatgatggctacaattggcatcgccctgcttagccagtccaccattcccgagaccatcctggaactcacagatgccctggctctggggatgatggtgcttaaaatcgttcggaacatggagaagtaccaactggccgtgacgattatggcgatctcttgcgtccctaatgctgtgattctccagaacgcctggaaggtgagctgtaccatcctggccgctgtctccgttagccccctcctgcttacatcttcccagcagaaagccgactggattcctctggctctcaccatcaagggactgaatcccacagccatcttcctgaccacgcttagccgcacatctaaaaagagatcctggccgctgaacgaagcgattatggccgtgggcatggtgagcatcctcgcttcttccctgctcaaaaatgacattcctatgaccgggcccctggtcgccggaggccttctgaccgtgtgctatgttctgacaggccggagcgctgatctcgagctggagcgcgccgccgacgtgaagtgggaagatcaagctgagatctccgggagctctcctattcttagcatcaccatttccgaagacggatctatgagcatcaaaaacgaggaggaagaacagacactgacgatcctcattagaaccggcctgctcgtcatctccggggtgtttcccgtttctattccgatcacagcggccgcttggtacctgtgggaagtgaagaagcagcgggccggagtcctttgggatgtgccttctccccctcccgtcgagaaagccgaactggaggacggcgcttatcgcattaagcagagagggatcctgggatactcccaaatcggcgccggcgtgtataaagaggggaccttccacacaatgtggcatgttacccggggagcggtgctcatgcaccgcggcaagagaattgaaccctcctgggctgatgtcaaaaaggacctgatcagctacgggggaggctggaaacttgagggggaatggaaagagggagaagaggtgcaggttctggccctcgagcctggcaagaatccgcgggccgtgcagacgaaacccggcatttttaagaccaactccgggacaatcggagctgtcagcctggatttctctcctggcacctccgggagccccattgtggacagaaaaggaaaggtggttggcctctacgggaatggagtcgtgacacgctctggcgcctatgtgtccgcgatcgctcagaccgaaaagagcatcgaggataaccctgaaattgaggacgatatctttcggaaaaagagactgacaattatggaccttcatcccggcgccgggaaaacgaagcgctacctgcctgccatcgtccgggaagctattaaaagaggactgcgcaccctcatcctggccccgacacgggtggttgctgccgagatggaggaagcgcttagaggcctgcccattcgctatcaaacccctgccatcaagaccgagcacacagggcgggaaatcgtggacctcatgtgtcatgctacgttcaccatgagactgctctcccccgtccgggtgcctaactacaatctgattatcatggatgaggcccacttcacagaccccgcttctattgccgcccgcggatatatcagcaccagagttgagatgggcgaagctgcggggatttttatgacagccaccccgcctggctcccgggatcccttcccccagagcaacgctcctatcatggacgaggaacgcgagatccccgaaagatcttggaactccggacacgagtgggtgacggattttaagggcaaaacagtctggttcgtgcctagcattaaggccgggaacgacatcgccgcttgccttcggaaaaatggaaagaaagttattcagctgtctagaaagacctttgatagcgagtacgtgaagacccgcgccatcgactgggatttcgtcgtgacaaccgacatttccgaaatgggcgcgaactttaaagctgagcgggtgatcgatccgagacgctgtatgaagcccgtcatcctgacagacggggaggaacgggttattctcgccggacctatgcccgtgacccattctagcgccgctcaaagacgcggccggatcgggagaaatcctaaaaacgaaaatgaccagtatatttacatgggcgagcccctggagaacgatgaagactgcgcccactggaaggaggcgaaaatgcttctggataatatcaacacgccggaaggaattatcccttccatgttcgagcccgaacgcgagaaggtggacgccattgatggcgagtacagactcagaggggaagctcgcaaaacatttgtcgacctgatgagacggggagatctgcctgtgtggctcgcctataaggttgctgccgagggcatcaattacgctgaccgcaagtggtgtttcgatgggatcaaaaacaatcagattcttgaagagaacatggaggtggaaatctggaccaaggagggagaacgcaagaagctgaaaccccggtggctggacgccagaatttattctgatcctctcgcgctgaaggagtttaaggagttcgccgctggccgcaaaagccttacactgaacctcatcaccgagatggggcggctgcccacgttcatgacccagaaggccagaaatgctctggacaacctcgccgtccttcatacagccgaggctggcggacgcgcgtacaatcacgccctgtccgaactgccggagaccctcgaaacactgcttctgctcaccctgctggctacagtgaccggcgggatttttctcttccttatgagcggaaaaggcatcgggaagatgacgctgggaatgtgctgcatcattacagcctctatcctgctctggtatgcccaaattcagcctcactggatcgctgcctccattatcctggagtttttccttatcgttctgctcattcccgaacccgagaaacagcggacccctcaggataaccaactgacctacgtggtcatcgcgattctgacagtggtcgccgctaccatggccaatgagatgggctttctcgaaaagacaaagaaagaccttggcctggggagcatcacgacccaggagtccgaatctaacattctggacatcgatctcagaccggctagcgcctggacactgtatgcggtggccaccacattcgttacccccatgcttcggcattccattgaaaattctagcgtgaacgtgtccctgacggctatcgccaatcaggctaccgtcctcatgggactgggcaaggggtggcctctgagcaaaatggacatcggagttcccctccttgccattggctgttactctcaggtgaaccctatcacactgaccgctgccctgctcctgcttgtggcgcactacgccattatcgggcccggactgcaagctaaggccacacgcgaagctcagaaaagagccgccgcgggcattatgaagaatcctaccgtcgatggcatcacggtgatcgacctcgagccgattccctatgatcctaagtttgagaaacagctggggcaggttatgctgctcatcctttgcgtgacacaagtcctgatgatgcggaccacatgggctctgtgtgaagccctcaccctggctaccggacccatttccacactttgggagggcaaccctgggcgcttctggaatacgaccatcgccgtgagcatggccaacatttttagaggatcttacctggctggcgccgggctcctgttctccatcatgaagaatacaaccagcacacggcgcggaaccggcaacatcggcgaaacgctgggggagaaatggaagtctagactcaatgcgcttggaaaaagcgagtttcagatttataagaaatccggcatccaggaagtcgaccggacactggccaaggaggggattaagcgcggagaaaccgatcatcacgctgtgtctagaggcagcgccaaactgcggtggttcgttgagagaaacatggtgacccccgaagggaaggtcgtggacctcggatgcggccgcggcgggtggtcctactattgtggaggcctgaaaaacgttcgggaggtgaaggggcttacaaaaggaggcccggggcatgaggaacctatccccatgagcacctacggatggaatctggtcagactccaatccggcgtggatgtgtttttcacaccccctgagaagtgcgacacgctgctgtgtgatattggcgaatctagccccaaccctaccatcgaggctgggcgcacactccgggttcttaatctggtcgaaaactggctgaataacaatacccagttctgcatcaaggtgctcaacccgtatatgccctccgtgattgagaaaatggaggccctgcagagacagtacggaggcgcgcttgtccgcaatcctctgtctcggaacagcacacacgaaatgtactgggtttccaatgccaccgggaacatcgtgtctagcgtgaatatgatttccagaatgctcatcaaccgctttacgatgaagcacaaaaaggctacctatgagcccgacgtcgatctgggaagcggcacacggaatattgggatcgaatctgagattcctaacctggacatcatcggaaaaagaattgaaaagatcaagcaagagcatgagatttcctggcactacgaccaggatcatccctataaaacctgggcctaccacggcagctatgaaacaaagcagaccggctctgcttccagcatggtgaacggggttgtgcgcctccttacaaaaccgtgggacgtcgtgcctatggttacccagatggccatgacggatacaacccccttcggacaacagcgggtgtttaaggagaaagtcgacaccagaacacaggaacctaaggagggcacgaagaaactgatgaagatcaccgctgagtggctgtggaaagaactcgggaagaaaaagacaccccgcatgtgtaccagagaggagttcaccaagaaggtgcggtctaatgccgcgctgggagccatttttaccgatgagaacaagtggaaatccgctcgcgaagccgtggaggacggcagattctgggagcttgtcgatcgggaaagaaatctgcacctcgaggggaagtgcgaaacatgtgtttacaacatgatgggaaaacgggagaagaaactgggcgaatttggcaaggctaaggggagccgcgccatctggtatatgtggctgggagccagattcctcgagtttgaggcgctgggcttccttaatgaagaccattggttttcccgggggaacagcctgtctggagtggagggcgaagggctccaccgcctgggctacatccttagagatgtgggcaagaaggagggcggggctatgtacgccgacgataccgccggatgggacacgcggattaccctggaagacctcaaaaatgaggagatggtcacaaaccatatgaagggcgaacacaaaaagctggctgaggccatcttcaagctgacctatcagaataaagtggttcgcgtgcaaagacctacaccccgggggaccgtcatggatattatcagccgcagagaccagcggggatccggccaggtggggacgtacggcctcaacacatttaccaatatggaagctcaactgattcgccagatggagggagagggcatcttcaagtctatccagcatcttacagccaccgaagagattgcggttcagaactggctggccagagtggggcgggaacgcctcagcagaatggctatctccggagatgactgcgtcgtgaaaccgattgatgaccggttcgcctctgctctgacggcccttaatgatatgggcaaggttagaaaagacatccaacagtgggagcctagccgcgggtggaacgattggacccaggtgcccttttgctcccaccacttccatgaactggtcatgaaggacggacgggtgctcgtcgtgccctgtagaaatcaggatgagctgattggccgcgcgcggatctctcaaggggccggctggagcctgaaggagacagcttgcctcggaaaatcctatgcccagatgtggaccctgatgtactttcacagacgcgaccttcggctggctgccaacgctatttgtagcgccgttccttctcattgggtgccgacatccagaaccacatggagcatccacgcgaagcacgaatggatgaccacggaggatatgctcgccgtctggaaccgcgtgtggatccaggaaaatccctggatggaggacaaaacacctgtggaatcttgggaggaggttccctatctgggcaagcgggaagaccagtggtgcgggtcccttattggactgaccagcagagctacctgggccaaaaacatccaaacagccattaatcaggtgcgctccctcatcggcaacgaggaatacaccgattatatgccttctatgaagcggttcagacgggaggaagaggaggctggggtcctgtggtga

SEQ ID NO: 19743 - RNA, 9876 nt, synthetic construct
  misc_feature 1..9876: note = derived and/or modified CDS sequence (opt5) from DENV-2__EU569698__SS-prME
  source 1..9876: mol_type = other RNA
accgccggcgtgatcgtcatgctgattcccaccgctatggccttccacctcacgaccagaaatggggaacctcatatgatcgttggacggcaggaaaagggcaagagcctgctttttaagacggaagacggggtgaatatgtgcaccctgatggcgattgatctcggagaactgtgtgaggacacaatcacctacaaatgcccgcttctgcgccaaaatgaacccgaggatattgactgttggtgcaattccacatctacctgggtgacgtatggcacctgtacaaccacaggggagcacagacgggaaaagcgcagcgtcgctctcgtgcctcatgttggaatgggcctggagaccagaacggaaacatggatgtcctctgagggcgcctggaaacacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaagaacaggacaaacgctttatctgcaagcattccatggtggatagaggctggggcaacgggtgtggactgttcggcaaaggcgggattgtcacatgcgccatgtttacgtgcaaaaagaatatggaagggaaagttgtgcagcctgagaacctcgaatacaccatcgtgattacaccccacagcggggaggagcatgcggtcggaaatgacaccggcaagcacggcaaagaaatcaagatcacacctcagtcttccattaccgaggccgaactgacggggtatggaaccgtgacaatggagtgtagcccccggaccggccttgatttcaacgaaatggttctgctccaaatggaggacaaggcttggctggtgcaccgccagtggtttcttgatctgccgctcccttggctgcccggggccgacacacagggatctaattggatccagaaggagaccctggtcacgttcaagaaccctcatgctaaaaagcaagacgtggttgtgctcggctcccaggaaggggccatgcacacagccctgaccggcgctacagagattcagatgagctccggaaatcttctgtttaccggccatctcaaatgcagactgcggatggataaacttcaactgaaagggatgtcttacagcatgtgtaccggaaagttcaagatcgtcaaagaaattgcggagacacagcacggcacgatcgtgatcagagtccagtatgagggggacggatccccctgcaagattcccttcgaaatcaccgatctcgagaaacgccatgtgctgggccggctgattacagttaaccctatcgtgaccgaaaaggacagcccggtcaacattgaggccgaacccccttttggggattcttacatcattatcggcgtggagcccggacagctcaaactgaattggttcaagaagggctccagcatcgggcaaatgtttgagacaaccatgagaggagctaaacgcatggccattcttggcgacacggcctgggatttcgggtctctgggaggcgtttttacaagcatcgggaaggctctccaccaggtgttcggcgccatttacggagcggctttttccggcgtctcttggaccatgaaaatcctgattggggtgatcatcacctggattggaatgaacagccggtccacaagcctgtctgtgtcccttgttctcgtcggcgtggtgaccctgtatctgggggccgtcgtgcaggccgacagcggatgtgttgtgtcttggaagaataaagaactcaagtgcggctccgggatcttcattacagataacgtccacacgtggaccgagcagtacaagtttcaacctgaaagcccctccaaactggcttctgccatccagaaggctcatgaggaaggcatttgtggaatcagaagcgtgacacgccttgagaatctgatgtggaaacagatcaccccggagctcaaccacattctgtccgaaaatgaggttaagctgacaatcatgaccggcgacattaaagggatcatgcaggccggaaagcggtctcttagacctcaacccacggaactcaaatatagctggaagacctggggcaaggcgaaaatgctgtccacagagagccataaccagaccttcctgattgatgggcctgaaacagccgagtgccccaataccaaccgcgcttggaactctctcgaggtggaagactacggatttggcgtcttcacaaccaacatctggctgaaacttcgggagaaacaggacgtgttttgtgattccaagctgatgagcgccgctatcaaagacaatagagccgttcacgcggatatgggctattggattgaatctgccctcaacgacacgtggaagatggagaaggcttccttcatcgaggtgaaaagctgccactggcctaagtctcatacactgtggagcaatggggtcctggaatccgagatgattatccccaaaaacttcgccggaccggtgagccagcacaactaccgccctggctatcatacccaaaccgctgggccctggcaccttggaaagctcgaaatggattttgacttctgtgagggcacaaccgtggtcgttacggaagattgcgggaatcggggaccctctctgagaacaaccacagcctccggcaaactgattaccgagtggtgctgtcggagctgcacactccctccgctgcgctacagaggcgaggacgggtgttggtacggaatggaaatccggccccttaaggagaaggaagagaacctggtgaatagcctcgtgaccgccggccatgggcagattgataacttttctctgggagtcctgggcatggctcttttcctcgaagagatgctgagaacgcgcatcgggaccaaacacgcgatcctgctcgtggccgttagctttgtgacactgattaccggaaatatgtccttccgggaccttggcagagtcatggtgatggttggcgctacaatgaccgatgacatcgggatgggagtgacgtatctggccctcctggccgcttttaaggtccgccctacattcgccgcgggcctgcttctgagaaaactcacctctaaggagctgatgatggctacaattgggatcgccctcctgagccagtccaccattcccgaaaccatccttgagctgacagatgccctcgctctgggaatgatggtgctgaaaatcgttcggaacatggaaaagtaccaacttgccgtgacgattatggcgatctcttgcgtccctaatgctgtgattctgcagaacgcctggaaggtgagctgtaccatcctcgccgctgtctccgttagccccctgctcctgacatcttcccagcagaaagccgactggattcctcttgctctgaccatcaagggcctcaatcccacagccatctttctgaccacgctgagccgcacatctaaaaagagatcctggccgcttaacgaggcgattatggccgtggggatggtgagcatcctggcttcttccctcctgaaaaatgacattcctatgaccggacccctcgtcgccggcggcctgcttaccgtgtgctatgttctgacagggcggagcgctgatctggaactcgagcgcgccgccgacgtgaagtgggaggatcaagctgaaatctccggaagctctcctattctgagcatcaccatttccgaggacggctctatgagcatcaaaaacgaagaggaggaacagacacttacgatcctgattagaaccgggctcctggtcatctccggagtgttccccgtttctattccgatcacagcggccgcttggtacctctgggaggtgaagaagcagcgggccggcgtcctgtgggatgtgccttctccccctcccgtcgaaaaagccgagcttgaagacggggcttatcgcattaagcagagaggaatcctgggctactcccaaatcggcgccggggtgtataaagagggaacctttcacacaatgtggcatgttacccggggcgcggtgctgatgcaccgcgggaagagaattgagccctcctgggctgatgtcaaaaaggacctcatcagctacggaggcgggtggaagctggaaggagagtggaaagaaggcgaggaagtgcaggttcttgccctggagcctggcaagaatccgcgggccgtgcagacgaaacccgggattttcaagaccaacacaggaaccatcggcgctgtctccctcgattttagccctgggacatctggatcccccattgtggacagaaaaggcaaggtggttgggctgtacggaaatggcgtcgtgacccgcagcggcgcctatgtgtctgcgatcgctcagacagagaagtccatcgaagataaccctgagattgaagacgatatcttccggaaaaagagactcacgattatggacctgcatcccggggccggaaaaaccaagcgctaccttcctgccatcgtccgggaggctattaaaagaggcctgcgcacactgatcctcgccccgacccgggtggttgctgccgaaatggaggaggcgctgagagggcttcccattcgctatcaaacccctgccatcaagacagaacacacgggacgggagatcgtggacctgatgtgtcatgctaccttcacaatgagactcctgagccccgtccgggtgcctaactacaatctcattatcatggatgaagcccactttaccgaccccgcttccattgccgcccgcggctatatctctacaagagttgagatgggggaggctgcgggcattttcatgaccgccacgccgcctggaagccgggattcctttccccagagcaacgctcccatcatggacgaagaaagagaaatccctgagagatcttggaactccggccacgaatgggtgacagatttcaaggggaaaaccgtctggtttgtgcccagcattaaggccggaaacgacatcgccgcttgcctgcggaaaaatggcaagaaagttattcagctttctagaaagaccttcgatagcgagtacgtgaagacacgcgccaacgactgggattttgtcgtgaccacagacatctccgagatgggggcgaatttcaaagctgaacgggtgattgatcctagacgctgtatgaagccggtcatcctgaccgacggagaggaacgggttatcctggccggccccatgcctgtgacgcattctagcgccgctcaaagacgcgggcggattggcagaaaccccaaaaatgagaacgaccagtatatctacatgggagaacctctcgagaatgatgaggactgcgcccactggaaggaagcgaaaatgctgcttgataacattaatacacccgagggcatcattccgtccatgtttgaacctgagcgcgaaaaggtggacgccatcgatggggagtacagactgcggggagaggctcgcaaaaccttcgtcgacctcatgagacggggcgatctgcccgtgtggctggcctataaggttgctgccgaagggattaactacgctgaccgcaagtggtgttttgatggaatcaaaaataaccagatcctcgaggaaaacatggaggtggagatttggacaaaggaaggcgagcgcaagaaacttaaacctcggtggctggacgccagaatctattctgatcccctggcgctcaaggagttcaaggagttcgccgctgggcgcaaaagcctgacccttaatctgattacggaaatgggccggctccctacctttatgacacagaaggccagaaacgctctggacaatctggccgtcctccataccgccgaggctggaggccgcgcgtacaaccacgccctttccgagctgcccgaaacactggagaccctcctgcttctgacactcctggctaccgtgacagggggaatcttcctgtttctcatgagcggcaaagggattggaaagatgacacttggcatgtgctgcatcatcaccgcctctattctgctgtggtatgcccaaatccagccgcactggattgctgcctccatcattctcgagttctttctgatcgttcttctgatccctgagcccgaaaaacagcggacaccccaggataatcaactcacatacgtggtcattgcgatcctgaccgtggtcgccgctacaatggccaacgagatgggcttcctggagaagacgaagaaagacctcgggcttggaagcattaccacacaggaatccgagtctaatatcctggacattgatctgagacctgctagcgcctggaccctctatgcggtggccacaacctttgttacgccgatgctgcggcattccatcgaaaactctagcgtgaatgtgtcccttaccgctattgccaaccaggctacagtcctgatgggcctcgggaagggatggcccctgagcaaaatggacatcggcgttcctctgctcgccatcgggtgttactctcaggtgaatcccattacccttacagctgccctgctgctcctggtggcgcactacgccatcattggacctggccttcaagctaaggccacccgcgaggctcagaaaagagccgccgcgggcatcatgaagaaccccacggtcgatgggattacagtgatcgacctggaacctatcccgtatgatcccaagttcgagaaacagctcggacaggttatgctgctgattctctgcgtgacccaagtccttatgatgcggacaacctgggctctgtgtgaggccctgaccctcgctacaggccctatctccacgctgtgggaagggaatcccggacgcttttggaacaccacaattgccgtgagcatggccaatatcttcagaggctcttaccttgctggggccggactgctcttttccattatgaagaacaccacaagcacccggcgcggcacgggcaatatcggggagacactgggagaaaaatggaagtctagactgaacgcgctcggcaaaagcgagttccagatctataagaaatccgggattcaggaggtcgaccggacccttgccaaggaaggaatcaagcgcggcgagaccgatcatcacgctgtgtctagagggagcgccaaactgcggtggtttgttgaaagaaacatggtgacacctgagggaaaggtcgtggacctgggctgcggccgcgggggatggtcctactattgtggcgggctcaaaaatgttcgggaagtgaagggactgaccaaaggcgggcccggacatgaggagccgattcctatgagcacatacggctggaaccttgtcagactgcaatccggcgtggatgtgttcttcacgcctcccgaaaagtgcgacaccctcctgtgtgatatcggggagtctagccccaatcccacaattgaagctggacgcaccctgcgggttctcaaccttgtcgagaattggctgaacaataacacacagttttgcatcaaggtgctgaatccttatatgccgtccgtgatcgagaagatggaggccctccagagacagtacggcggggcgctggtccgcaaccccctttctcggaatagcacccacgagatgtactgggtttccaacgccacgggaaatattgtgtctagcgtgaacatgatctccagaatgctgattaatcgcttcaccatgaagcacaaaaaggctacatatgaacctgacgtcgatctcggcagcgggacccggaacatcggaattgagtctgaaatccccaacctggacattatcggcaaaagaatcgagaagattaagcaagaacatgagatctcctggcactacgaccaggatcatccttataaaacatgggcctaccacggcagctatgagaccaagcagacagggtctgcttccagcatggtgaatggagttgtgcgcctgctcaccaaaccctgggacgtcgtgccgatggttacgcagatggccatgacagataccaccccttttggccaacagcgggtgttcaaggaaaaagtcgacacaagaacgcaggagcccaaggaagggaccaagaaacttatgaagattacagctgagtggctgtggaaagagctgggaaagaaaaagacccctcgcatgtgtacaagagaagagtttaccaaaaaggtgcggtctaacgccgcgctcggcgccatcttcacagatgaaaataagtggaaatccgctcgcgaggccgtggaagacgggagattttgggagctggtcgatcgggagagaaaccttcacctggaaggaaagtgcgagacctgtgtttacaatatgatgggcaaacgggaaaagaaactcggcgagttcgggaaggctaagggaagccgcgccatttggtatatgtggctgggcgccagatttctggagttcgaggcgctcgggtttctgaacgaggaccattggttctcccggggaaatagcctttctggcgtggaaggggagggcctgcaccgcctcggatacatcctgagagatgtgggcaaaaaggaagggggagctatgtacgccgacgatacggccggctgggacacccggatcacacttgaggacctgaaaaacgaagagatggtcaccaatcatatgaagggggagcacaaaaagctcgctgaagccatttttaagctgacatatcagaacaaagtggttcgcgtgcaaagacccacccctcggggaacggtcatggatatcattagccgcagagaccagcggggctccggacaggtgggcacatacggactgaataccttcacaaacatggaggctcaactcatccgccagatggaaggcgaggggattttcaagtctatccagcatctgaccgccacggaggaaatcgcggttcagaattggcttgccagagtgggacgggagcgcctgagcagaatggctatttccggcgatgactgcgtcgtgaaacccatcgatgaccggtttgcctctgctctcaccgccctgaacgatatggggaaggttagaaaagacattcaacagtgggaaccgagccgcggatggaatgattggacacaggtgcctttctgctcccaccactttcatgagcttgtcatgaaggacggccgggtgctggtcgtgccctgtagaaaccaggatgaactcatcgggcgcgcgcggatttctcaaggcgccggatggagcctgaaggagaccgcttgcctgggcaaatcctatgcccagatgtggacactcatgtacttccacagacgcgacctgcggcttgctgccaacgctatctgtagcgccgttccctctcattgggtgcctacctccagaacaacctggagcattcacgcgaagcacgagtggatgacgacagaagatatgctggccgtctggaatcgcgtgtggatccaggagaacccgtggatggaagacaaaacccccgtggagtcttgggaagaggttccttatctcgggaagcgggaggaccagtggtgcggatccctgatcggccttaccagcagagctacatgggccaaaaatattcaaaccgccatcaaccaggtgcgctccctgattgggaatgaagagtacacagattatatgccctctatgaagcggtttagacgggaagaggaagaggctggagtcctctggtga

SEQ ID NO: 19744 - RNA, 9876 nt, synthetic construct
  misc_feature 1..9876: note = derived and/or modified CDS sequence (opt5) from DENV-2__EU569699__SS-prME
  source 1..9876: mol_type = other RNA
accgccggagtgatcgtcatgctgattcccacagctatggccttccacctcacgaccagaaatggggagcctcatatgatcgttggacggcaggaaaagggaaaaagcctgctttttaagacagaggacggggtgaatatgtgcaccctgatggcgattgatctcggagaactgtgtgaggacacaatcacctacaaatgcccgcttctgagacaaaatgaacccgaggatattgactgttggtgcaatagcacatctacctgggtgacgtatggcacctgtacaaccacaggggagcacagacgggaaaagagaagcgtcgctctcgtgcctcatgttggaatgggcctggagaccagaacggaaacatggatgtcctctgagggcgcctggaaacacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaggaacaggacaaacgctttatctgcaagcattccatggtggatagaggctggggcaacgggtgtggactgttcggcaaaggcgggattgtcacatgcgccaaatttacgtgcaagaaaaatatggaagggaaggttgtgcagcctgagaacctcgaatacaccatcgtgattacaccccacagcggggaggagcatgcggtcggaaatgacaccggcaaacacggcaaggaaatcaaaatcacacctcagtcttccattaccgaggccgaactgacggggtatggaaccgtgacaatggagtgtagcccccggaccggccttgatttcaacgaaatggttctgctccaaatggaggacaaggcttggctggtgcaccgccagtggtttcttgatctgccgctcccttggctgcccggggccgacacacagggatctaattggatccagaaggagaccctggtcacgttcaaaaaccctcatgctaagaaacaagacgtggttgtgctcggctcccaggaaggggccatgcacacagccctgaccggcgctacagagattcagatgagctccggaaatcttctgtttaccggccatctcaagtgcagactgcggatggataaacttcaactgaaggggatgtcttacagcatgtgtaccggaaagttcaaaatcgtcaaggaaattgcggagacacagcacggcacgatcgtgatcagagtccagtatgagggggacggatccccctgcaaaattcccttcgaaatcaccgatctcgagaagcgccatgtgctgggccggctgattacagttaaccctatcgtgaccgaaaaagacagcccggtcaacattgaggccgaacccccttttggggattcttacatcattatcggcgtggagcccggacagctcaagctgaattggttcaagaaaggctccagcatcgggcaaatgtttgagacaaccatgagaggagctaagcgcatggccattcttggcgacacggcctgggatttcgggtctctgggaggcgtttttacaagcatcgggaaagctctccaccaggtgttcggcgccatttacggagcggctttttccggcgtctcttggaccatgaagatcctgattggggtgatcatcacctggattggaatgaacagccggtccacaagcctgtctgtgtcccttgttctcgtcggcgtggtgaccctgtatctgggggccatggtccaggccgacagcggatgtgtggtttcttggaaaaataaggaactcaagtgcggctccgggatcttcattacagataacgtgcacacgtggaccgagcagtacaaatttcaacctgaaagcccctccaagctggcttctgccatccagaaagctcatgaggaaggcatttgtggaatcagaagcgtcacacgccttgagaatctgatgtggaagcagatcaccccggagctcaaccacattctgtccgaaaatgaggtgaaactgacaatcatgaccggcgacattcgggggatcatgcaggccggaaagagatctcttcgccctcaacccacggaactcaaatatagctggaagacctggggcaaggcgaaaatgctgtccacagagagccataaccagaccttcctgattgatgggcctgaaacagccgagtgccccaataccaaccgggcttggaactctctcgaggttgaagactacggatttggcgtgttcacaaccaacatctggctgaaacttagagacaaacaggatgtcttttgtgactccaagctgatgagcgccgctatcaaagataatcgcgccgtgcacgcggacatgggctattggattgagtctgccctcaacgatacgtggaagatggaaaaggcttccttcatcgaggttaaaagctgccactggcctaagtctcatacactgtggagcaatggggtgctggagtccgaaatgattatccccaaaaacttcgccggaccggtcagccagcacaactaccggcctggctatcatacccaaaccgctgggccctggcaccttggaaagctcgagatggactttgatctgtgtgaaggcacaaccgtggtggtcacggaggactgcgggaatagaggaccctctctgcggacaaccacagcctccggcaaactcattaccgaatggtgctgtcgcagctgcacactgcctccgcttagataccggggcgaggatgggtgttggtacggaatggagatcagacccctgaaggaaaaggaggaaaacctcgttaattccctggtgaccgccggccatgggcagattgacaacttctctctgggagtgcttggcatggctctcctgctggaggaaatgctccgcacgcggatcgggaccaaacacgcgatcctgcttgtcgccgtgagctttgttacactgattaccggaaatatgtccttcagagatctcggccgcgtgatggtcatggtgggcgctacaatgaccgacgatatcgggatgggagttacgtatctggccctgcttgccgcttttaaggtgagacctacattcgccgcgggcctgctcctgcggaaactcacctctaaggagctgatgatggctacaattgggatcgcccttctgagccagtccaccattcccgagaccatcctcgaactgacagacgccctggctcttggaatgatggtcctgaaaatcgtgcgcaacatggagaagtaccaactcgccgttacggtgatggcgatttcttgcgtccctaatgctgtgatcctgcagaacgcctggaaggtgagctgtaccattctcgccgctgtctccgttagccccctgcttctgacatcttcccagcagaaagccgactggatccctctcgctctgaccattaagggcctgaatcccacagccatctttcttaccacgctgagcagaacatctaaaaagcggtcctggccgctcaacgaagcgatcatggccgtggggatggtgagcattctggcttcttccctcctgaaaaatgatatccctatgaccggaccccttgtcgccggcggcctgctgaccgtgtgctatgttctcacagggcgcagcgctgacctggagcttgaaagagccgccgatgtgaagtgggaggaccaagctgagatttccggaagctctcctatcctgagcattaccatctccgaagatggctctatgagcattaaaaacgaggaagaggagcagacactcacgatcctgatccggaccgggctcctggtcatttccggagtgttccccgtttctatcccgattacagcggccgcttggtacctttgggaagtgaagaagcagcgcgccggcgtcctgtgggacgtgccttctccccctcccgtcgagaaagccgaactggaggatggggcttatagaatcaagcagcggggcattctcggctactcccaaatcggcgccggggtgtataaagaaggaacctttcacacaatgtggcatgttacccgcggcgcggtgctgatgcacagagggaagcggatcgagccctcctgggctgacgtcaaaaaggatcttattagctacggaggcgggtggaagctggagggagaatggaaagagggcgaagaggtgcaggttctcgccctggaacctggcaagaatccgagagccgtgcagacgaaacccgggatcttcaagaccaacacaggaaccattggcgctgtctccctcgactttagccctgggacatctggatcccccatcgtggatcgcaaaggcaaggtggttgggctgtacggaaatggcgtcgtgacccggagcggcgcctatgtgtctgcgattgctcagacagagaagtccatcgaggacaaccctgaaatcgaggatgacattttccgcaagaagcgccttacgatcatggacctgcatcccggggccggaaaaaccaagcggtacctgcctgccattgtcagagaagctatcaaacgcggcctccggacactgattcttgccccgaccagagtggttgctgccgagatggaagaggcgctgcgcgggctccccatccggtatcaaaccacagccattaagacggagcacaccggaagagaaatcgtggatctgatgtgtcatgctacatttaccatgcggctcctgagccctgtccgcgtgcccaactacaatcttatcattatggacgaggcccacttcacagatcctgcttccatcgccgccagaggctatatttctacccgggttgaaatgggggaggctgcgggcatcttcatgacggccacacccccgggaagccgcgacccttttccccagtccaacgctcccattatggatgaggaaagagagatccctgaacggagctggaactctggccacgagtgggtgaccgacttcaaggggaaaaccgtctggtttgtgccctccatcaaggccggaaacgatattgccgcttgcctgcgcaagaatggcaagaaagttatccagctgagccgcaagacattcgactctgaatacgtgaagacccgggccaacgattgggactttgtcgtgacaaccgatattagcgagatgggggcgaatttcaaagctgagagagtgatcgaccctcgccggtgtatgaagccggtcattctcacggacggagaagagagagttatcctggccggccccatgcctgtgacacattcctctgccgctcaacgccgggggagaatcggccgcaaccccaaaaatgaaaacgatcagtatatttacatgggagagcctcttgaaaatgacgaggattgcgcccactggaaggaggcgaaaatgctgctcgacaacatcaatacccccgaaggcattatcccgagcatgtttgagcctgaaagagagaaggtggatgccattgacggggaataccggctgcgcggagaggctagaaaaacattcgtcgatctgatgcggcgcggcgacctccccgtgtggcttgcctataaggttgctgccgaggggatcaactacgctgatagaaagtggtgttttgacggaattaaaaataaccagatcctggaagagaacatggaagtggagatctggaccaaggagggcgaacggaaaaagctgaaacctagatggctcgatgcccgcatttattccgaccccctggcgcttaaggagttcaaggaatttgccgctgggcggaaatctctgacgctcaatctgatcaccgagatgggcagactgcctacattcatgacccagaaggcccgcaacgctctcgataatcttgccgtcctgcatacagccgaagctggaggccgggcgtacaaccacgccctgagcgagctccccgagaccctggaaacacttctgctcctgaccctgctcgctacggtgacagggggaattttcctttttctgatgtccggcaaagggatcggaaagatgaccctgggcatgtgctgcattatcaccgccagcatcctcctgtggtatgcccaaattcagccgcactggatcgctgcctctattatccttgagttctttctgattgttctcctgatccctgaacccgagaaacagagaacaccccaggacaatcaactgacctacgtggtcatcgcgattctcacagtggtcgccgctacgatggccaacgaaatgggcttccttgagaagaccaagaaagacctggggctgggatccatcacaacccaggagagcgaatccaatattctcgatatcgacctgcggcctgcttctgcctggacactttatgcggtggccaccacgtttgttaccccgatgctgcgccatagcattgagaactcctctgtgaatgtgagcctcacagctatcgccaaccaggctaccgtcctgatgggcctggggaagggatggcccctctccaaaatggatattggcgttcctcttctggccatcgggtgttacagccaggtgaatcccatcacactgaccgctgccctcctgcttctggtggcgcactacgccattatcggacctggcctccaagctaaggccacgagagaagctcagaaacgggccgccgcgggcattatgaagaaccccacagtcgacgggatcaccgtgattgatctggagcctatcccgtatgaccccaagttcgaaaaacagctgggacaggttatgctccttatcctgtgcgtgacacaagtcctgatgatgcgcaccacctgggctctctgtgaggccctgacacttgctacgggccctatttctaccctgtgggaggggaatcccggaagattttggaacacaaccatcgccgtgtccatggccaatattttccggggcagctacctcgctggggccggactgctgttttctatcatgaagaacacaaccaatacgcgcagaggcacaggcaacattggggaaaccctcggagagaaatggaagtcccggcttaacgcgctgggcaaaagcgagttccagatctataagaaatctgggatccaggaggtcgatcgcaccctggccaaggagggaattaagagaggcgaaacagaccatcacgctgtgagccgggggtccgccaaactcagatggtttgttgagcgcaatatggtgacccctgaaggaaaggtcgtggatctgggctgcggcagagggggatggtcttactattgtggcgggcttaaaaacgttcgggaggtgaagggactgacaaaaggcgggcccggacatgaagaaccgatccctatgagcacgtacggctggaatctcgtccgcctgcaatccggcgtggacgtgttctttacccctcccgagaagtgcgatacactgctctgtgacattggggaaagctcccccaaccccaccatcgaggctggacggacacttagagttctgaatctggtcgaaaactggctcaataacaatacccagttctgcattaaggtgctgaacccttatatgccgtctgtgatcgagaaaatggaagcccttcagcgcaagtacggcggggcgctggtccggaatcccctcagcagaaactccacgcacgagatgtactgggtttctaatgccaccggaaacatcgtgagctccgtgaatatgatttctcgcatgctgatcaaccggttcacaatgaaacacaagaaagctacctatgagcctgatgtcgacctgggcagcgggacaagaaacattggaatcgaatccgagattcccaatctcgacatcattggcaagcgcatcgaaaagatcaaacaggagcatgaaaccagctggcactacgatcaagaccatccttataagacatgggcctaccacggctcttatgagaccaaacagacggggtccgctagctctatggtgaacggagttgtgcggcttctgacaaagccctgggatgtcgtgccgatggttacccagatggccatgaccgacacaacgccttttggccagcaaagagtgttcaaagagaaggtcgatacccgcacacaggaacccaaggaggggaccaaaaagctgatgaaaattacagctgaatggctctggaaggagctgggcaaaaagaaaacccctagaatgtgtacacgggaggaatttacccgcaaggtgagatccaatgccgcgcttggcgccatcttcacggacgagaacaagtggaaaagcgctcgggaagccgtggaggatgggagattttgggaactggtcgaccgggagcgcaatctccacctggagggaaagtgcgaaacctgtgtttacaacatgatgggcaaaagagagaagaaactgggcgagttcgggaaggctaagggatctcgggccatttggtatatgtggctcggcgcccgctttctggagttcgaagcgcttgggtttctgaatgaggatcattggttctccagaggaaacagcctctccggcgtggagggggaaggcctgcaccggcttggatacatcctgcgcgacgtgggcaaaaaggaagggggagctatgtacgccgatgacacagccggctgggacaccagaattacactcgaagatctgaaaaatgaggaaatggtcaccaaccatatgaagggggagcacaaaaagctggctgaggccatctttaagctcacgtatcagaataaagtggttcgggtgcagcgccccacacctagaggaaccgtcatggacatcattagccggcgcgatcaaagaggctctggacaggtgggcacatacggactgaacaccttcacgaatatggaagctcagcttatccggcaaatggagggcgaagggatttttaagagcatccagcatctgaccgccattgaggagatcgcggttcagaactggctcgcccgcgtgggaagagaacggctgtccagaatggctatctctggcgacgattgcgtcattaaacccatcgacgatcgcttcgccagcgctcttacagccctgaatgacatggggaaggtgcggaaagatattcagcaatgggagccgtccagaggatggaacgactggacccaggttcctttctgctctcaccactttcatgaactcgtgatgaaggatggccgcgtcctggtggtcccctgtcggaaccaggacgagctgatcgggagagcgcgcattagccagggcgccggatggtccctcaaggaaacagcttgcctgggcaaatcttatgcccaaatgtggacccttatgtacttccaccggagagatctgcgcctcgctgccaatgctatctgtagcgccgtgccctcccattgggttcctacaagccggaccacgtggtctattcacgcgaagcacgagtggatgacaaccgaggacatgctggccgtgtggaacagagtctggatccaggaaaatccgtggatggaggacaaaacccccgtggaatcctgggaggaagtgccttatcttgggaagcgcgaggatcagtggtgcggaagcctgatcggcctcacatctcgggctacctgggccaaaaacattcagacagccatcaatcaagttagatccctgattgggaacgaggaatacacggactatatgcccagcatgaagcggtttagacgcgaggaagaggaagctggagtgctgtggtga

SEQ ID NO: 19745 - RNA, 9876 nt, synthetic construct
  misc_feature 1..9876: note = derived and/or modified CDS sequence (opt5) from DENV-2__KF955366__SS-prME
  source 1..9876: mol_type = other RNA
accgccggcgtgatcgtcatgctgattcccaccgctatggccttccacctcacgaccagaaatggggaacctcatatgatcgttggacggcaggaaaagggcaagagcctgctttttaagacggaagacggggtgaatatgtgcaccctgatggcgattgatctcggagaactgtgtgaggacacaatcacctacaaatgcccgcttctgcgccaaaatgaacccgaggatattgactgttggtgcaattccacatctacctgggtgacgtatggcacctgtacaaccacaggggagcacagacgggaaaagcgcagcgtcgctctcgtgcctcatgttggaatgggcctggagaccagaacggaaacatggatgtcctctgagggcgcctggaaacacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaagaacaggacaaacgctttatctgcaagcattccatggtggatagaggctggggcaacgggtgtggactgttcggcaaaggcgggattgtcacatgcgccatgtttacgtgcaaaaagaatatggaagggaaagttgtgcagcctgagaacctcgaatacaccatcgtgattacaccccacagcggggaggagcatgcggtcggaaatgacaccggcaagcacggcaaagaaatcaagatcacacctcagtcttccattaccgaggccgaactgacggggtatggaaccgtgacaatggagtgtagcccccggaccggccttgatttcaacgaaatggttctgctccaaatggaggacaaggcttggctggtgcaccgccagtggtttcttgatctgccgctcccttggctgcccggggccgacacacagggatctaattggatccagaaggagaccctggtcacgttcaagaaccctcatgctaaaaagcaagacgtggttgtgctcggctcccaggaaggggccatgcacacagccctgaccggcgctacagagattcagatgagctccggaaatcttctgtttaccggccatctcaaatgcagactgcggatggataaacttcaactgaaagggatgtcttacagcatgtgtaccggaaagttcaagatcgtcaaagaaattgcggagacacagcacggcacgatcgtgatcagagtccagtatgagggggacggatccccctgcaagattcccttcgaaatcaccgatctcgagaaacgccatgtgctgggccggctgattacagttaaccctatcgtgaccgaaaaggacagcccggtcaacattgaggccgaacccccttttggggattcttacatcattatcggcgtggagcccggacagctcaaactgaattggttcaagaagggctccagcatcgggcaaatgtttgagacaaccatgagaggagctaaacgcatggccattcttggcgacacggcctgggatttcgggtctctgggaggcgtttttacaagcatcgggaaggctctccaccaggtgttcggcgccatttacggagcggctttttccggcgtctcttggaccatgaaaatcctgattggggtgatcatcacctggattggaatgaacagccggtccacaagcctgtctgtgtcccttgttctcgtcggcgtggtgaccctgtatctgggggccgtcgtgcaggccgacagcggatgtgttgtgtcttggaagaataaagaactcaagtgcggctccgggatcttcattacagataacgtccacacgtggaccgagcagtacaagtttcaacctgaaagcccctccaaactggcttctgccatccagaaggctcatgaggaaggcatttgtggaatcagaagcgtgacacgccttgagaatctgatgtggaaacagatcaccccggagctcaaccacattctgtccgaaaatgaggttaagctgacaatcatgaccggcgacattaaagggatcatgcaggccggaaagcggtctcttagacctcaacccacggaactcaaatatagctggaagacctggggcaaggcgaaaatgctgtccacagagagccataaccagaccttcctgattgatgggcctgaaacagccgagtgccccaataccaaccgcgcttggaactctctcgaggtggaagactacggatttggcgtcttcacaaccaacatctggctgaaacttcgggagaaacaggacgtgttttgtgattccaagctgatgagcgccgctatcaaagacaatagagccgttcacgcggatatgggctattggattgaatctgccctcaacgacacgtggaagatggagaaggcttccttcatcgaggtgaaaagctgccactggcctaagtctcatacactgtggagcaatggggtcctggaatccgagatgattatccccaaaaacttcgccggaccggtgagccagcacaactaccgccctggctatcatacccaaaccgctgggccctggcaccttggaaagctcgaaatggattttgacttctgtgagggcacaaccgtggtcgttacggaagattgcgggaatcggggaccctctctgagaacaaccacagcctccggcaaactgattaccgagtggtgctgtcggagctgcacactccctccgctgcgctacagaggcgaggacgggtgttggtacggaatggaaatccggccccttaaggagaaggaagagaacctggtgaatagcctcgtgaccgccggccatgggcagattgataacttttctctgggagtcctgggcatggctcttttcctcgaagagatgctgagaacgcgcatcgggaccaaacacgcgatcctgctcgtggccgttagctttgtgacactgattaccggaaatatgtccttccgggaccttggcagagtcatggtgatggttggcgctacaatgaccgatgacatcgggatgggagtgacgtatctggccctcctggccgcttttaaggtccgccctacattcgccgcgggcctgcttctgagaaaactcacctctaaggagctgatgatggctacaattgggatcgccctcctgagccagtccaccattcccgaaaccatccttgagctgacagatgccctcgctctgggaatgatggtgctgaaaatcgttcggaacatggaaaagtaccaacttgccgtgacgattatggcgatctcttgcgtccctaatgctgtgattctgcagaacgcctggaaggtgagctgtaccatcctcgccgctgtctccgttagccccctgctcctgacatcttcccagcagaaagccgactggattcctcttgctctgaccatcaagggcctcaatcccacagccatctttctgaccacgctgagccgcacatctaaaaagagatcctggccgcttaacgaggcgattatggccgtggggatggtgagcatcctggcttcttccctcctgaaaaatgacattcctatgaccggacccctcgtcgccggcggcctgcttaccgtgtgctatgttctgacagggcggagcgctgatctggaactcgagcgcgccgccgacgtgaagtgggaggatcaagctgaaatctccggaagctctcctattctgagcatcaccatttccgaggacggctctatgagcatcaaaaacgaagaggaggaacagacacttacgatcctgattagaaccgggctcctggtcatctccggagtgttccccgtttctattccgatcacagcggccgcttggtacctctgggaggtgaagaagcagcgggccggcgtcctgtgggatgtgccttctccccctcccgtcgaaaaagccgagcttgaagacggggcttatcgcattaagcagagaggaatcctgggctactcccaaatcggcgccggggtgtataaagagggaacctttcacacaatgtggcatgttacccggggcgcggtgctgatgcaccgcgggaagagaattgagccctcctgggctgatgtcaaaaaggacctcatcagctacggaggcgggtggaagctggaaggagagtggaaagaaggcgaggaagtgcaggttcttgccctggagcctggcaagaatccgcgggccgtgcagacgaaacccgggattttcaagaccaacacaggaaccatcggcgctgtctccctcgattttagccctgggacatctggatcccccattgtggacagaaaaggcaaggtggttgggctgtacggaaatggcgtcgtgacccgcagcggcgcctatgtgtctgcgatcgctcagacagagaagtccatcgaagataaccctgagattgaagacgatatcttccggaaaaagagactcacgattatggacctgcatcccggggccggaaaaaccaagcgctaccttcctgccatcgtccgggaggctattaaaagaggcctgcgcacactgatcctcgccccgacccgggtggttgctgccgaaatggaggaggcgctgagagggcttcccattcgctatcaaacccctgccatcaagacagaacacacgggacgggagatcgtggacctgatgtgtcatgctaccttcacaatgagactcctgagccccgtccgggtgcctaactacaatctcattatcatggatgaagcccactttaccgaccccgcttccattgccgcccgcggctatatctctacaagagttgagatgggggaggctgcgggcattttcatgaccgccacgagcccgggatcccgggatccttttccccagagcaacgctcccatcatggacgaagaaagagaaatccctgagagatcttggaactccggccacgaatgggtgacagatttcaaggggaaaaccgtctggtttgtgcccagcattaaggccggaaacgacatcgccgcttgcctgcggaaaaatggcaagaaagttattcagctttctagaaagaccttcgatagcgagtacgtgaagacacgcgccaacgactgggattttgtcgtgaccacagacatctccgagatgggggcgaatttcaaagctgaacgggtgattgatcctagacgctgtatgaagccggtcatcctgaccgacggagaggaacgggttatcctggccggccccatgcctgtgacgcattctagcgccgctcaaagacgcgggcggattggcagaaaccccaaaaatgagaacgaccagtatatctacatgggagaacctctcgagaatgatgaggactgcgcccactggaaggaagcgaaaatgctgcttgataacattaatacacccgagggcatcattccgtccatgtttgaacctgagcgcgaaaaggtggacgccatcgatggggagtacagactgcggggagaggctcgcaaaaccttcgtcgacctcatgagacggggcgatctgcccgtgtggctggcctataaggttgctgccgaagggattaactacgctgaccgcaagtggtgttttgatggaatcaaaaataaccagatcctcgaggaaaacatggaggtggagatttggacaaaggaaggcgagcgcaagaaacttaaacctcggtggctggacgccagaatctattctgatcccctggcgctcaaggagttcaaggagttcgccgctgggcgcaaaagcctgacccttaatctgattacggaaatgggccggctccctacctttatgacacagaaggccagaaacgctctggacaatctggccgtcctccataccgccgaggctggaggccgcgcgtacaaccacgccctttccgagctgcccgaaacactggagaccctcctgcttctgacactcctggctaccgtgacagggggaatcttcctgtttctcatgagcggcaaagggattggaaagatgacacttggcatgtgctgcatcatcaccgcctctattctgctgtggtatgcccaaatccagccgcactggattgctgcctccatcattctcgagttctttctgatcgttcttctgatccctgagcccgaaaaacagcggacaccccaggataatcaactcacatacgtggtcattgcgatcctgaccgtggtcgccgctacaatggccaacgagatgggcttcctggagaagacgaagaaagacctcgggcttggaagcattaccacacaggaatccgagtctaatatcctggacattgatctgagacctgctagcgcctggaccctctatgcggtggccacaacctttgttacgccgatgctgcggcattccatcgaaaactctagcgtgaatgtgtcccttaccgctattgccaaccaggctacagtcctgatgggcctcgggaagggatggcccctgagcaaaatggacatcggcgttcctctgctcgccatcgggtgttactctcaggtgaatcccattacccttacagctgccctgctgctcctggtggcgcactacgccatcattggacctggccttcaagctaaggccacccgcgaggctcagaaaagagccgccgcgggcatcatgaagaaccccacggtcgatgggattacagtgatcgacctggaacctatcccgtatgatcccaagttcgagaaacagctcggacaggttatgctgctgattctctgcgtgacccaagtccttatgatgcggacaacctgggctctgtgtgaggccctgaccctcgctacaggccctatctccacgctgtgggaagggaatcccggacgcttttggaacaccacaattgccgtgagcatggccaatatcttcagaggctcttaccttgctggggccggactgctcttttccattatgaagaacaccacaagcacccggcgcggcacgggcaatatcggggagacactgggagaaaaatggaagtctagactgaacgcgctcggcaaaagcgagttccagatctataagaaatccgggattcaggaggtcgaccggacccttgccaaggaaggaatcaagcgcggcgagaccgatcatcacgctgtgtctagagggagcgccaaactgcggtggtttgttgaaagaaacatggtgacacctgagggaaaggtcgtggacctgggctgcggccgcgggggatggtcctactattgtggcgggctcaaaaatgttcgggaagtgaagggactgaccaaaggcgggcccggacatgaggagccgattcctatgagcacatacggctggaaccttgtcagactgcaatccggcgtggatgtgttcttcacgcctcccgaaaagtgcgacaccctcctgtgtgatatcggggagtctagccccaatcccacaattgaagctggacgcaccctgcgggttctcaaccttgtcgagaattggctgaacaataacacacagttttgcatcaaggtgctgaatccttatatgccgtccgtgatcgagaagatggaggccctccagagacagtacggcggggcgctggtccgcaaccccctttctcggaatagcacccacgagatgtactgggtttccaacgccacgggaaatattgtgtctagcgtgaacatgatctccagaatgctgattaatcgcttcaccatgaagcacaaaaaggctacatatgaacctgacgtcgatctcggcagcgggacccggaacatcggaattgagtctgaaatccccaacctggacattatcggcaaaagaatcgagaagattaagcaagaacatgagatctcctggcactacgaccaggatcatccttataaaacatgggcctaccacggcagctatgagaccaagcagacagggtctgcttccagcatggtgaatggagttgtgcgcctgctcaccaaaccctgggacgtcgtgccgatggttacgcagatggccatgacagataccaccccttttggccaacagcgggtgttcaaggaaaaagtcgacacaagaacgcaggagcccaaggaagggaccaagaaacttatgaagattacagctgagtggctgtggaaagagctgggaaagaaaaagacccctcgcatgtgtacaagagaagagtttaccaaaaaggtgcggtctaacgccgcgctcggcgccatcttcacagatgaaaataagtggaaatccgctcgcgaggccgtggaagacgggagattttgggagctggtcgatcgggagagaaaccttcacctggaaggaaagtgcgagacctgtgtttacaatatgatgggcaaacgggaaaagaaactcggcgagttcgggaaggctaagggaagccgcgccatttggtatatgtggctgggcgccagatttctggagttcgaggcgctcgggtttctgaacgaggaccattggttctcccggggaaatagcctttctggcgtggaaggggagggcctgcaccgcctcggatacatcctgagagatgtgggcaaaaaggaagggggagctatgtacgccgacgatacggccggctgggacacccggatcacacttgaggacctgaaaaacgaagagatggtcaccaatcatatgaagggggagcacaaaaagctcgctgaagccatttttaagctgacatatcagaacaaagtggttcgcgtgcaaagacccacccctcggggaacggtcatggatatcattagccgcagagaccagcggggctccggacaggtgggcacatacggactgaataccttcacaaacatggaggctcaactcatccgccagatggaaggcgaggggattttcaagtctatccagcatctgaccgccacggaggaaatcgcggttcagaattggcttgccagagtgggacgggagcgcctgagcagaatggctatttccggcgatgactgcgtcgtgaaacccatcgatgaccggtttgcctctgctctcaccgccctgaacgatatggggaaggttagaaaagacattcaacagtgggaaccgagccgcggatggaatgattggacacaggtgcctttctgctcccaccactttcatgagcttgtcatgaaggacggccgggtgctggtcgtgccctgtagaaaccaggatgaactcatcgggcgcgcgcggatttctcaaggcgccggatggagcctgaaggagaccgcttgcctgggcaaatcctatgcccagatgtggacactcatgtacttccacagacgcgacctgcggcttgctgccaacgctatctgtagcgccgttccctctcattgggtgcctacctccagaacaacctggagcattcacgcgaagcacgagtggatgacgacagaagatatgctggccgtctggaatcgcgtgtggatccaggagaacccgtggatggaagacaaaacccccgtggagtcttgggaagaggttccttatctcgggaagcgggaggaccagtggtgcggatccctgatcggccttaccagcagagctacatgggccaaaaatattcaaaccgccatcaaccaggtgcgctccctgattgggaatgaagagtacacagattatatgccctctatgaagcggtttagacgggaagaggaagaggctggagtcctctggtga

SEQ ID NO: 19746 - RNA, 9876 nt, synthetic construct
  misc_feature 1..9876: note = derived and/or modified CDS sequence (opt5) from DENV-2__EU569700__SS-prME
  source 1..9876: mol_type = other RNA
accgccggcgtgatcgtcatgctgattcccaccgctatggccttccacctcacgacccggaatggggaacctcatatgatcgttggacggcaggaaaagggcaagagcctgctttttaagaccgaagacggggtgaatatgtgcaccctgatggcgattgatctcggagaactgtgtgaggacacgatcacctacaagtgcccgcttctgcgccaaaatgaacccgaggatattgactgttggtgcaattccacatctacctgggtgacgtatggcacctgtacaaccacaggggagcacagacgggaaaagcgcagcgtcgctctcgtgcctcatgttggaatgggcctggagaccagaacggaaacatggatgtcctctgagggcgcctggaaacacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaagaacaggacaaacgctttatctgcaagcattccatggtggatagaggctggggcaacgggtgtggactgttcggcaaaggcgggattgtcacatgcgccatgtttacgtgcaaaaagaatatggaagggaaagttgtgcagcctgagaacctcgaatacaccatcgtgattacaccccacagcggggaggagcatgcggtcggaaatgacaccggcaagcacggcaaagaaatcaagatcacacctcagtcttccattaccgaggccgaactgacggggtatggaaccgtgacaatggagtgtagcccccggaccggccttgatttcaacgaaatggttctgctccaaatggaggacaaggcttggctggtgcaccgccagtggtttcttgatctgccgctcccttggctgcccggggccgacacacagggatctaattggatccagaaggagaccctggtcacgttcaagaaccctcatgctaaaaagcaagacgtggttgtgctcggctcccaggaaggggccatgcacacagccctgaccggcgctacagagattcagatgagctccggaaatcttctgtttaccggccatctcaaatgcagactgcggatggataaacttcaactgaaagggatgtcttacagcatgtgtaccggaaagttcaagatcgtcaaagaaattgcggagacacagcacggcacgatcgtgatcagagtccagtatgagggggacggatccccctgcaagattcccttcgaaatcaccgatctcgagaaacgccatgtgctgggccggctgattacagttaaccctatcgtgaccgaaaaggacagcccggtcaacattgaggccgaacccccttttggggattcttacatcattatcggcgtggagcccggacagctcaaactgaattggttcaagaagggctccagcatcgggcaaatgtttgagacaaccatgagaggagctaaacgcatggccattcttggcgacacggcctgggatttcgggtctctgggaggcgtttttacaagcatcgggaaggctctccaccaggtgttcggcgccatttacggagcggctttttccggcgtctcttggaccatgaaaatcctgattggggtgatcatcacctggattggaatgaacagccggtccacaagcctgtctgtgtcccttgttctcgtcggcgtggtgaccctgtatctgggggccgtcgtgcaggccgacagcggatgtgttgtgtcttggaagaataaagaactcaagtgcggctccgggatcttcattacagataacgtccacacgtggaccgagcagtacaagtttcaacctgaaagcccctccaaactggcttctgccatccagaaggctcatgaggaaggcatttgtggaatcagaagcgtgacacgccttgagaatctgatgtggaaacagatcaccccggagctcaaccacattctgtccgaaaatgaggttaagctgacaatcatgaccggcgacattaaagggatcatgcaggccggaaagcggtctcttagacctcaacccacggaactcaaatatagctggaagacctggggcaaggcgaaaatgctgtccacagagagccataaccagaccttcctgattgatgggcctgaaacagccgagtgccccaataccaaccgcgcttggaactctctcgaggtggaagactacggatttggcgtcttcacaaccaacatctggctgaaacttcgggagaaacaggacgtgttttgtgattccaagctgatgagcgccgctatcaaagacaatagagccgttcacgcggatatgggctattggattgaatctgccctcaacgacacgtggaagatggagaaggcttccttcatcgaggtgaaaagctgccactggcctaagtctcatacactgtggagcaatggggtcctggaatccgagatgattatccccaaaaacttcgccggaccggtgagccagcacaactaccgccctggctatcatacccaaaccgctgggccctggcaccttggaaagctcgaaatggattttgacttctgtgagggcacaaccgtggtcgttacggaagattgcgggaatcggggaccctctctgagaacaaccacagcctccggcaaactgattaccgagtggtgctgtcggagctgcacactccctccgctgcgctacagaggcgaggacgggtgttggtacggaatggaaatccggccccttaaggagaaggaagagaacctggtgaatagcctcgtgaccgccggccatgggcagattgataacttttctctgggagtcctgggcatggctcttttcctcgaagagatgctgagaacgcgcatcgggaccaaacacgcgatcctgctcgtggccgttagctttgtgacactgattaccggaaatatgtccttccgggaccttggcagagtcatggtgatggttggcgctacaatgaccgatgacatcgggatgggagtgacgtatctggccctcctggccgcttttaaggtccgccctacattcgccgcgggcctgcttctgagaaaactcacctctaaggagctgatgatggctacaattgggatcgccctcctgagccagtccaccattcccgaaaccatccttgagctgacagatgccctcgctctgggaatgatggtgctgaaaatcgttcggaacatggaaaagtaccaacttgccgtgacgattatggcgatctcttgcgtccctaatgctgtgattctgcagaacgcctggaaggtgagctgtaccatcctcgccgctgtctccgttagccccctgctcctgacatcttcccagcagaaagccgactggattcctcttgctctgaccatcaagggcctcaatcccacagccatctttctgaccacgctgagccgcacatctaaaaagagatcctggccgcttaacgaggcgattatggccgtggggatggtgagcatcctggcttcttccctcctgaaaaatgacattcctatgaccggacccctcgtcgccggcggcctgcttaccgtgtgctatgttctgacagggcggagcgctgatctggaactcgagcgcgccgccgacgtgaagtgggaggatcaagctgaaatctccggaagctctcctattctgagcatcaccatttccgaggacggctctatgagcatcaaaaacgaagaggaggaacagacacttacgatcctgattagaaccgggctcctggtcatctccggagtgttccccgtttctattccgatcacagcggccgcttggtacctctgggaggtgaagaagcagcgggccggcgtcctgtgggatgtgccttctccccctcccgtcgaaaaagccgagcttgaagacggggcttatcgcattaagcagagaggaatcctgggctactcccaaatcggcgccggggtgtataaagagggaacctttcacacaatgtggcatgttacccggggcgcggtgctgatgcaccgcgggaagagaattgagccctcctgggctgatgtcaaaaaggacctcatcagctacggaggcgggtggaagctggaaggagagtggaaagaaggcgaggaagtgcaggttcttgccctggagcctggcaagaatccgcgggccgtgcagacgaaacccgggattttcaagaccaacacaggaaccatcggcgctgtctccctcgattttagccctgggacatctggatcccccattgtggacagaaaaggcaaggtggttgggctgtacggaaatggcgtcgtgacccgcagcggcgcctatgtgtctgcgatcgctcagacagagaagtccatcgaagataaccctgagattgaagacgatatcttccggaaaaagagactcacgattatggacctgcatcccggggccggaaaaaccaagcgctaccttcctgccatcgtccgggaggctattaaaagaggcctgcgcacactgatcctcgccccgacccgggtggttgctgccgaaatggaggaggcgctgagagggcttcccattcgctatcaaacccctgccatcaagacagaacacacgggacgggagatcgtggacctgatgtgtcatgctaccttcacaatgagactcctgagccccgtccgggtgcctaactacaatctcattatcatggatgaagcccactttaccgaccccgcttccattgccgcccgcggctatatctctacaagagttgagatgggggaggctgcgggcattttcatgaccgccacgccgcctggaagccgggatccctttccccagtccaacgctcctatcatggacgaagaaagagaaatccccgagagaagctggaactctggccacgaatgggtgacagatttcaaggggaaaaccgtctggtttgtgccttccattaaggccggaaacgacatcgccgcttgcctgcggaaaaatggcaagaaagttattcagcttagcagaaagaccttcgattctgagtacgtgaagacacgcgccaacgactgggattttgtcgtgaccacagacatcagcgagatgggggcgaatttcaaagctgaacgggtgattgatccgagacgctgtatgaagcccgtcatcctgaccgacggagaggaacgggttatcctggccggccctatgcccgtgacgcattcctctgccgctcaaagacgcgggcggattggcagaaaccctaaaaatgagaacgaccagtatatctacatgggagaacccctcgagaatgatgaggactgcgcccactggaaggaagcgaaaatgctgcttgataacattaatacaccggagggcatcattcctagcatgtttgaacccgagcgcgaaaaggtggacgccatcgatggggagtacagactgcggggagaggctcgcaaaaccttcgtcgacctcatgagacggggcgatctgcctgtgtggctggcctataaggttgctgccgaagggattaactacgctgaccgcaagtggtgttttgatggaatcaaaaataaccagatcctcgaggaaaacatggaggtggagatttggacaaaggaaggcgagcgcaagaaacttaaaccccggtggctggacgccagaatctattccgatcctctggcgctcaaggagttcaaggagttcgccgctgggcgcaaatctctgacccttaatctgattacggaaatgggccggctccccacctttatgacacagaaggccagaaacgctctggacaatctggccgtcctccataccgccgaggctggaggccgcgcgtacaaccacgcccttagcgagctgccggaaacactggagaccctcctgcttctgacactcctggctaccgtgacagggggaatcttcctgtttctcatgtccggcaaagggattggaaagatgacacttggcatgtgctgcatcatcaccgccagcattctgctgtggtatgcccaaatccagcctcactggattgctgcctctatcattctcgagttctttctgatcgttcttctgatccccgagcccgaaaaacagcggacccctcaggataatcaactcacatacgtggtcattgcgatcctgaccgtggtcgccgctacaatggccaacgagatgggcttcctggagaagacgaagaaagacctcgggcttggatccattaccacacaggaaagcgagtccaatatcctggacattgatctgagaccggcttctgcctggaccctctatgcggtggccacaacctttgttacgcccatgctgcggcatagcatcgaaaactcctctgtgaatgtgagccttaccgctattgccaaccaggctacagtcctgatgggcctcgggaagggatggcctctgtccaaaatggacatcggcgttcccctgctcgccatcgggtgttacagccaggtgaatcctattacccttacagctgccctgctgctcctggtggcgcactacgccatcattggacccggccttcaagctaaggccacccgcgaggctcagaaaagagccgccgcgggcatcatgaagaaccctacggtcgatgggattacagtgatcgacctggaaccgatcccctatgatcctaagttcgagaaacagctcggacaggttatgctgctgattctctgcgtgacccaagtccttatgatgcggacaacctgggctctgtgtgaggccctgaccctcgctacaggccccatctctacgctgtgggaagggaatcctggacgcttttggaacaccacaattgccgtgtccatggccaatatcttcagaggcagctaccttgctggggccggactgctcttttctattatgaagaacaccacatccacccggcgcggcacgggcaatatcggggagacactgggagaaaaatggaaaagcagactgaacgcgctcggcaaatctgagttccagatctataagaaaagcgggattcaggaggtcgaccggacccttgccaaggaaggaatcaagcgcggcgagaccgatcatcacgctgtgtccagagggtctgccaaactgcggtggtttgttgaaagaaacatggtgacacccgagggaaaggtcgtggacctgggctgcggccgcgggggatggagctactattgtggcgggctcaaaaatgttcgggaagtgaagggactgaccaaaggcgggccgggacatgaggagcctattcccatgtccacatacggctggaaccttgtcagactgcaaagcggcgtggatgtgttcttcacgccccctgaaaagtgcgacaccctcctgtgtgatatcggggagtcctctcccaatcctacaattgaagctggacgcaccctgcgggttctcaaccttgtcgagaattggctgaacaataacacacagttttgcatcaaggtgctgaatccgtatatgcccagcgtgatcgagaagatggaggccctccagagacagtacggcggggcgctggtccgcaaccctctttccagaaattctacccacgagatgtactgggttagcaacgccacgggaaatattgtgtcctctgtgaacatgatcagcagaatgctgattaatcgcttcaccatgaagcacaaaaaggctacatatgaacccgacgtcgatctcggctccgggacccggaacatcggaattgagagcgaaatccctaacctggacattatcggcaaaagaatcgagaagattaagcaagaacatgagatctcttggcactacgaccaggatcatccctataaaacatgggcctaccacggctcctatgagaccaagcagacagggagcgcttcttccatggtgaatggagttgtgcgcctgctcaccaaaccgtgggacgtcgtgcctatggttacgcagatggccatgacagataccaccccctttggccaacagcgggtgttcaaggaaaaagtcgacacaagaacgcaggagcctaaggaagggaccaagaaacttatgaagattacagctgagtggctgtggaaagagctgggaaagaaaaagacaccccgcatgtgtacaagagaagagtttaccaaaaaggtgcggagcaacgccgcgctcggcgccatcttcacagatgaaaataagtggaaatctgctcgcgaggccgtggaagacgggagattttgggagctggtcgatcgggagagaaaccttcacctggaaggaaagtgcgagacctgtgtttacaatatgatgggcaaacgggaaaagaaactcggcgagttcgggaaggctaagggatcccgcgccatttggtatatgtggctgggcgccagatttctggagttcgaggcgctcgggtttctgaacgaggaccattggttcagccggggaaattcccttagcggcgtggaaggggagggcctgcaccgcctcggatacatcctgagagatgtgggcaaaaaggaagggggagctatgtacgccgacgatacggccggctgggacacccggatcacacttgaggacctgaaaaacgaagagatggtcaccaatcatatgaagggggagcacaaaaagctcgctgaagccatttttaagctgacatatcagaacaaagtggttcgcgtgcaaagacctacaccccggggaacggtcatggatatcatttctcgcagagaccagcggggcagcggacaggtgggcacatacggactgaataccttcacaaacatggaggctcaactcatccgccagatggaaggcgaggggattttcaagtccatccagcatctgaccgccacggaggaaatcgcggttcagaattggcttgccagagtgggacgggagcgcctgtctagaatggctattagcggcgatgactgcgtcgtgaaaccgatcgatgaccggtttgcctccgctctcaccgccctgaacgatatggggaaggttagaaaagacattcaacagtgggaaccttctcgcggatggaatgattggacacaggtgcccttctgcagccaccactttcatgagcttgtcatgaaggacggccgggtgctggtcgtgccctgtagaaaccaggatgaactcatcgggcgcgcgcggatttcccaaggcgccggatggtctctgaaggagaccgcttgcctgggcaaaagctatgcccagatgtggacactcatgtacttccacagacgcgacctgcggcttgctgccaacgctatctgttccgccgttcctagccattgggtgccgacctctagaacaacctggtccattcacgcgaagcacgagtggatgacgacagaagatatgctggccgtctggaatcgcgtgtggatccaggagaacccctggatggaagacaaaacccctgtggagagctgggaagaggttccctatctcgggaagcgggaggaccagtggtgcggatctctgatcggccttacctccagagctacatgggccaaaaatattcaaaccgccatcaaccaggtgcgcagcctgattgggaatgaagagtacacagattatatgccttccatgaagcggtttagacgggaagaggaagaggctggagtcctctggtga

SEQ ID NO: 19747 - RNA, 9876 nt, synthetic construct
  misc_feature 1..9876: note = derived and/or modified CDS sequence (opt5) from DENV-2__KF955369__SS-prME
  source 1..9876: mol_type = other RNA
acagccggcgtgatcgtcatgctgattcccacagctatggccttccacctcacgacccggaatggggaacctcatatgatcgttggacggcaggaaaagggcaagagcctgctttttaagacagaagacggggtgaatatgtgcaccctgatggcgattgatctcggagaactgtgtgaggacacaatcacctacaagtgcccgcttctgcgccaaaatgaacccgaggatattgactgttggtgcaattccacatctacctgggtgacgtatggcacctgtacaaccacaggggagcacagacgggaaaagcgcagcgtcgctctcgtgcctcatgttggaatgggcctggagaccagaacggaaacatggatgtcctctgagggcgcctggaaacacgtgcagcggatcgagacctggatcctgcgccatcccgggttcacaattatggccgctatcctcgcctacaccattggaaccacacactttcagagagctctgatcttcattcttctgacgaccgtcgcccctagcatgacaatgcggtgcatcggcatttccaaccgcgattttgtggaaggggtttctggaggcagctgggtggacatcgtcctcgagcacgggtcctgtgtgaccacaatggcgaagaataagcccaccctggatttcgaacttatcaaaacggaggccaagcagcctgctacactgagaaaatattgcattgaagccaagctcaccaacaccacaaccgagagccggtgtccgacacaaggagagccctctctgaatgaagaacaggacaaacgctttatctgcaagcattccatggtggatagaggctggggcaacgggtgtggactgttcggcaaaggcgggattgtcacgtgcgctatgtttacctgcaaaaagaatatggaagggaaagttgtgcagcctgagaacctcgaatacacaatcgtgattacaccccacagcggggaggagcatgccgtcggaaatgacacaggcaagcacggcaaagaaatcaagatcacccctcagtcttccattacggaggcggaactgaccgggtatggaacagtgaccatggagtgtagcccccggacaggccttgatttcaacgaaatggttctgctccaaatggaggacaaagcctggctggtgcaccgccagtggtttcttgatctgccgctcccttggctgcccggggctgacacccagggatctaattggatccagaaggagacgctggtcacattcaagaaccctcatgccaaaaagcaagacgtggttgtgctcggctcccaggaaggggctatgcacaccgccctgacaggcgccaccgagattcagatgagctccggaaatcttctgtttaccggccatctcaaatgcagactgcggatggataaacttcaactgaaagggatgtcttacagcatgtgtacaggaaagttcaagatcgtcaaagaaattgctgagacgcagcacggcaccatcgtgatcagagtccagtatgagggggacggatccccctgcaagattcccttcgaaatcacagatctcgagaaacgccatgtgctgggccggctgattaccgttaaccctatcgtgacagaaaaggacagcccggtcaacattgaggcggaacccccttttggggattcttacatcattatcggcgtggagcccggacagctcaaactgaattggttcaagaagggctccagcatcgggcaaatgtttgagaccacgatgagaggagccaaacgcatggctattcttggcgacacagcctgggatttcgggtctctgggaggcgtttttaccagcatcgggaaggccctccaccaggtgttcggcgctatttacggagccgcgttttccggcgtctcttggaccatgaaaatcctgattggggtgatcatcacatggattggaatgaacagccggtccaccagcctgtctgtgtcccttgttctcgtcggcgtggtgacactgtatctgggggctgtcgtgcaggccgacagcggatgtgttgtgtcttggaagaataaagaactcaagtgcggctccgggatcttcattacggataacgtccacacctggacagagcagtacaagtttcaacctgaaagcccctccaaactggcctctgctatccagaaggcccatgaggaaggcatttgtggaatcagaagcgtgacccgccttgagaatctgatgtggaaacagatcacaccggagctcaaccacattctgtccgaaaatgaggttaagctgaccatcatgacgggcgacattaaagggatcatgcaggctggaaagcggtctcttagacctcaacccaccgaactcaaatatagctggaagacatggggcaaggccaaaatgctgtccaccgagagccataaccagacattcctgattgatgggcctgaaaccgcggagtgccccaatacaaaccgcgcctggaactctctcgaggtggaagactacggatttggcgtcttcaccacgaacatctggctgaaacttcgggagaaacaggacgtgttttgtgattccaagctgatgagcgctgccatcaaagacaatagagctgttcacgccgatatgggctattggattgaatctgcgctcaacgacacatggaagatggagaaggcctccttcatcgaggtgaaaagctgccactggcctaagtctcataccctgtggagcaatggggtcctggaatccgagatgattatccccaaaaacttcgctggaccggtgagccagcacaactaccgccctggctatcatacccaaacagccgggccctggcaccttggaaagctcgaaatggattttgacttctgtgagggcaccacggtggtcgttacagaagattgcgggaatcggggaccctctctgagaaccacaaccgcttccggcaaactgattacagagtggtgctgtcggagctgcaccctccctccgctgcgctacagaggcgaggacgggtgttggtacggaatggaaatccggccccttaaggagaaggaagagaacctggtgaatagcctcgtgacggccggccatgggcagattgataacttttctctgggagtcctgggcatggcccttttcctcgaagagatgctgagaacccgcatcgggacaaaacacgctatcctgctcgtggcggttagctttgtgaccctgattacaggaaatatgtccttccgggaccttggcagagtcatggtgatggttggcgccaccatgacggatgacatcgggatgggagtgacatatctggctctcctggccgcctttaaggtccgccctaccttcgctgccggcctgcttctgagaaaactcacatctaaggagctgatgatggcgaccattgggatcgctctcctgagccagtccaccattcccgaaacaatccttgagctgacggatgccctcgccctgggaatgatggtgctgaaaatcgttcggaacatggaaaagtaccaacttgctgtgaccattatggccatctcttgcgtccctaatgcggtgattctgcagaacgcttggaaggtgagctgtacaatcctcgccgccgtctccgttagccccctgctcctgacctcttcccagcagaaagctgactggattcctcttgccctgacaatcaagggcctcaatcccaccgctatctttctgacgacactgagccgcacctctaaaaagagatcctggccgcttaacgaggccattatggcggtggggatggtgagcatcctggcctcttccctcctgaaaaatgacattcctatgaccggacccctcgtcgctggcggcctgcttacagtgtgctatgttctgaccgggcggagcgccgatctggaactcgagcgcgctgccgacgtgaagtgggaggatcaagccgaaatctccggaagctctcctattctgagcatcacaatttccgaggacggctctatgagcatcaaaaacgaagaggaggaacagacgcttaccatcctgattagaacagggctcctggtcatctccggagtgttccccgtttctattccgatcaccgctgcggcctggtacctctgggaggtgaagaagcagcgggctggcgtcctgtgggatgtgccttctccccctcccgtcgaaaaagccgagcttgaagacggggcctatcgcattaagcagagaggaatcctgggctactcccaaatcggcgctggggtgtataaagagggaacatttcacaccatgtggcatgttacgcggggcgccgtgctgatgcaccgcgggaagagaattgagccctcctgggcggatgtcaaaaaggacctcatcagctacggaggcgggtggaagctggaaggagagtggaaagaaggcgaggaagtgcaggttcttgctctggagcctggcaagaatccgcgggccgtgcagaccaaacccgggattttcaagacaaacaccggaacaatcggcgccgtctccctcgattttagccctgggacctctggatcccccattgtggacagaaaaggcaaggtggttgggctgtacggaaatggcgtcgtgacacgcagcggcgcttatgtgtctgccatcgcgcagacggagaagtccatcgaagataaccctgagattgaagacgatatcttccggaaaaagagactcaccattatggacctgcatcccggggctggaaaaacaaagcgctaccttcctgccatcgtccgggaggccattaaaagaggcctgcgcaccctgatcctcgctccgacccgggtggttgccgctgaaatggaggaggccctgagagggcttcccattcgctatcaaacccctgcgatcaagacggaacacaccggacgggagatcgtggacctgatgtgtcatgccacattcaccatgagactcctgagccccgtccgggtgcctaactacaatctcattatcatggatgaagctcactttacagaccccgcctccattgctgcccgcggctatatctctaccagagttgagatgggggaggccgctggcattttcatgacggcgacaccgcctggaagccgggatccctttccccagtccaacgcccctatcatggacgaagaaagagaaatccccgagagaagctggaactctggccacgaatgggtgaccgatttcaaggggaaaaccgtctggtttgtgccttccattaaggctggaaacgacatcgccgcctgcctgcggaaaaatggcaagaaagttattcagcttagcagaaagacattcgattctgagtacgtgaagacccgcgctaacgactgggattttgtcgtgacaaccgacatcagcgagatgggggccaatttcaaagcggaacgggtgattgatccgagacgctgtatgaagcccgtcatcctgacggacggagaggaacgggttatcctggctggccctatgcccgtgacacattcctctgccgcccaaagacgcgggcggattggcagaaaccctaaaaatgagaacgaccagtatatctacatgggagaacccctcgagaatgatgaggactgcgctcactggaaggaagccaaaatgctgcttgataacattaataccccggagggcatcattcctagcatgtttgaacccgagcgcgaaaaggtggacgcgatcgatggggagtacagactgcggggagaggcccgcaaaacattcgtcgacctcatgagacggggcgatctgcctgtgtggctggcttataaggttgccgctgaagggattaactacgccgaccgcaagtggtgttttgatggaatcaaaaataaccagatcctcgaggaaaacatggaggtggagatttggaccaaggaaggcgagcgcaagaaacttaaaccccggtggctggacgctagaatctattccgatcctctggccctcaaggagttcaaggagttcgcggccgggcgcaaatctctgacgcttaatctgattaccgaaatgggccggctccccacatttatgacccagaaggctagaaacgccctggacaatctggctgtcctccatacagccgaggccggaggccgcgcttacaaccacgcgcttagcgagctgccggaaaccctggagacactcctgcttctgaccctcctggccacggtgacagggggaatcttcctgtttctcatgtccggcaaagggattggaaagatgacccttggcatgtgctgcatcatcaccgctagcattctgctgtggtatgcccaaatccagcctcactggattgccgcttctatcattctcgagttctttctgatcgttcttctgatccccgagcccgaaaaacagcggacacctcaggataatcaactcacctacgtggtcattgccatcctgacagtggtcgcggccacgatggctaacgagatgggcttcctggagaagaccaagaaagacctcgggcttggatccattacaacccaggaaagcgagtccaatatcctggacattgatctgagaccggcctctgcttggacactctatgccgtggcgaccacgtttgttacccccatgctgcggcatagcatcgaaaactcctctgtgaatgtgagccttacagccattgctaaccaggccaccgtcctgatgggcctcgggaagggatggcctctgtccaaaatggacatcggcgttcccctgctcgctatcgggtgttacagccaggtgaatcctattacacttaccgccgctctgctgctcctggtggcccactacgcgatcattggacccggccttcaagccaaggctacgcgcgaggcccagaaaagagctgccgccggcatcatgaagaaccctacagtcgatgggattaccgtgatcgacctggaaccgatcccctatgatcctaagttcgagaaacagctcggacaggttatgctgctgattctctgcgtgacacaagtccttatgatgcggaccacctgggcgctgtgtgaggctctgacactcgccacgggccccatctctaccctgtgggaagggaatcctggacgcttttggaacacaaccattgctgtgtccatggccaatatcttcagaggcagctaccttgccggggctggactgctcttttctattatgaagaacacaacctccacgcggcgcggcacaggcaatatcggggagaccctgggagaaaaatggaaaagcagactgaacgccctcggcaaatctgagttccagatctataagaaaagcgggattcaggaggtcgaccggacccttgcgaaggaaggaatcaagcgcggcgagacagatcatcacgccgtgtccagagggtctgctaaactgcggtggtttgttgaaagaaacatggtgacccccgagggaaaggtcgtggacctgggctgcggccgcgggggatggagctactattgtggcgggctcaaaaatgttcgggaagtgaagggactgacaaaaggcgggccgggacatgaggagcctattcccatgtccacgtacggctggaaccttgtcagactgcaaagcggcgtggatgtgttcttcacaccccctgaaaagtgcgacaccctcctgtgtgatatcggggagtcctctcccaatcctaccattgaagccggacgcacactgcgggttctcaaccttgtcgagaattggctgaacaataacacccagttttgcatcaaggtgctgaatccgtatatgcccagcgtgatcgagaagatggaggctctccagagacagtacggcggggccctggtccgcaaccctctttccagaaattctacgcacgagatgtactgggttagcaacgcgaccggaaatattgtgtcctctgtgaacatgatcagcagaatgctgattaatcgcttcacaatgaagcacaaaaaggccacctatgaacccgacgtcgatctcggctccgggacacggaacatcggaattgagagcgaaatccctaacctggacattatcggcaaaagaatcgagaagattaagcaagaacatgagatctcttggcactacgaccaggatcatccctataaaacctgggcttaccacggctcctatgagacaaagcagaccgggagcgcctcttccatggtgaatggagttgtgcgcctgctcacgaaaccgtgggacgtcgtgcctatggttacacagatggctatgaccgataccacaccctttggccaacagcgggtgttcaaggaaaaagtcgacacgagaacccaggagcctaaggaagggacaaagaaacttatgaagattaccgccgagtggctgtggaaagagctgggaaagaaaaagacaccccgcatgtgtaccagagaagagtttaccaagaaggtgcggagcaacgctgccctcggcgcgatcttcaccgatgaaaataagtggaaatctgcccgcgaggctgtggaagacgggagattttgggagctggtcgatcgggagagaaaccttcacctggaaggaaagtgcgagacgtgtgtttacaatatgatgggcaaacgggaaaagaaactcggcgagttcgggaaggccaagggatcccgcgctatttggtatatgtggctgggcgccagatttctggagttcgaggccctcgggtttctgaacgaggaccattggttcagccggggaaattcccttagcggcgtggaaggggagggcctgcaccgcctcggatacatcctgagagatgtgggcaaaaaggaagggggagcgatgtacgctgacgataccgccggctgggacacacggatcacccttgaggacctgaaaaacgaagagatggtcacaaatcatatgaagggggagcacaaaaagctcgccgaagctatttttaagctgacctatcagaacaaagtggttcgcgtgcaaagacctacgccccggggaacagtcatggatatcatttctcgcagagaccagcggggcagcggacaggtgggcacctacggactgaatacattcaccaacatggaggcccaactcatccgccagatggaaggcgaggggattttcaagtccatccagcatctgacggctaccgaggaaatcgccgttcagaattggcttgcgagagtgggacgggagcgcctgtctagaatggccattagcggcgatgactgcgtcgtgaaaccgatcgatgaccggtttgcttccgccctcacagctctgaacgatatggggaaggttagaaaagacattcaacagtgggaaccttctcgcggatggaatgattggacccaggtgcccttctgcagccaccactttcatgagcttgtcatgaaggacggccgggtgctggtcgtgccctgtagaaaccaggatgaactcatcgggcgcgcccggatttcccaaggcgcgggatggtctctgaaggagacagcctgcctgggcaaaagctatgctcagatgtggaccctcatgtacttccacagacgcgacctgcggcttgccgctaacgccatctgttccgctgttcctagccattgggtgccgacatctagaaccacgtggtccattcacgccaagcacgagtggatgacaaccgaagatatgctggcggtctggaatcgcgtgtggatccaggagaacccctggatggaagacaaaacccctgtggagagctgggaagaggttccctatctcgggaagcgggaggaccagtggtgcggatctctgatcggccttacatccagagccacctgggctaaaaatattcaaacagccatcaaccaggtgcgcagcctgattgggaatgaagagtacacggattatatgccttccatgaagcggtttagacgggaagaggaagaggccggagtcctctggtga

SEQ ID NO: 19748 - RNA, 9876 nt, synthetic construct
  misc_feature 1..9876: note = derived and/or modified CDS sequence (opt5) from DENV-2__EU569702__SS-prME
  source 1..9876: mol_type = other RNA
accgccggcgtgatcgtgatgctgattcccaccgctatggccttccacctcacgacccggaatggggaacctcatatgatcgttggacggcaggaaaagggcaagagcctgctttttaagacagaagacggggtgaatatgtgcaccctgatggcgattgatctcggagaactgtgtgaagacacaatcacctacaagtgcccgcttctgcgccaaaatgaacccgaggatattgactgttggtgcaattccacatctacctgggtgacgtatggcacctgtacaaccacaggggagcacagacgggaaaagcgcagcgtcgctctcgtgcctcatgttggaatgggcctggagaccagaacggaaacatggatgtcctctgagggcgcctggaaacacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaagaacaggacaaacgctttatctgcaagcattccatggtggatagaggctggggcaacgggtgtggactgttcggcaaagggggaattgtcacatgcgccatgtttacgtgcaaaaagaatatggaaggcaaagttgtgcagcctgagaacctcgaatacaccatcgtgattacaccccacagcggggaggagcatgcggtcggaaatgacaccggcaagcacggcaaagaaatcaagatcacacctcagtcttccattaccgaggccgaactgacggggtatggaaccgtgacaatggagtgtagcccccggaccggccttgatttcaacgaaatggttctgctccaaatggaggacaaggcttggctggtgcaccgccagtggtttcttgatctgccgctcccttggctgcccggggccgacacacagggatctaattggatccagaaggagaccctggtcacgttcaagaaccctcatgctaaaaagcaagacgtggttgtgctcggctcccaggaaggggccatgcacacagccctgaccggcgctacagagattcagatgagctccggaaatcttctgtttaccggccatctcaaatgcagactgcggatggataaacttcaactgaaagggatgtcttacagcatgtgtaccggaaagttcaagatcgtcaaagaaattgcggagacacagcacggcacgatcgtgatcagagtccagtatgagggggacggatccccctgcaagattcccttcgaaatcaccgatctcgagaaacgccatgtgctgggccggctgattacagttaaccctatcgtgaccgaaaaggacagcccggtcaacattgaggccgaacccccttttggggattcttacatcattatcggcgtggagcccggacagctcaaactgaattggttcaagaagggctccagcatcgggcaaatgtttgagacaaccatgagaggagctaaacgcatggccattcttggcgacacggcctgggatttcgggtctctgggaggcgtttttacaagcatcgggaaggctctccaccaggtgttcggcgccatttacggagcggctttttccggcgtctcttggaccatgaaaatcctgattggggtgatcatcacctggattggaatgaacagccggtccacaagcctgtctgtgtcccttgttctcgtcggcgtggtgaccctgtatctgggggccgtcgtgcaggccgacagcggatgtgttgtgtcttggaagaataaagaactcaagtgcggctccgggatcttcattacagataacgtccacacgtggaccgagcagtacaagtttcaacctgaaagcccctccaaactggcttctgccatccagaaggctcatgaggaaggcatttgtggaatcagaagcgtgacacgccttgagaatctgatgtggaaacagatcaccccggagctcaaccacattctgtccgaaaatgaggttaagctgacaatcatgaccggcgacattaaagggatcatgcaggccggaaagcggtctcttagacctcaacccacggaactcaaatatagctggaagacctggggcaaggcgaaaatgctgtccacagagagccataaccagaccttcctgattgatgggcctgaaacagccgagtgccccaataccaaccgcgcttggaactctctcgaggtggaagactacggatttggcgtcttcacaaccaacatctggctgaaacttcgggagaaacaggacgtgttttgtgattccaagctgatgagcgccgctatcaaagacaatagagccgttcacgcggatatgggctattggattgaatctgccctcaacgacacgtggaagatggagcgcgcttccttcatcgaggtcaagagctgccactggcctaaatctcatacactgtggagcaatggggtcctggaatccgagatgattatccccaagaacttcgccggaccggtgagccagcacaactaccggcctggctatcatacccaaaccgctgggccctggcaccttggaaaactcgaaatggattttgacttctgtgagggcacaaccgtggtcgttacggaagattgcgggaatagaggaccctctctgcggacaaccacagcctccggcaagctgattaccgagtggtgctgtcgcagctgcacactccctccgctgagataccggggcgaggacgggtgttggtacggaatggaaatcagaccccttaaagagaaggaagagaacctggtgaatagcctcgtgaccgccggccatgggcagattgataacttttctctgggagtcctgggcatggctcttttcctcgaagagatgctgcgcacgcggatcgggaccaagcacgcgatcctgctcgtggccgttagctttgtgacactgattaccggaaatatgtccttcagagaccttggccgcgtcatggtgatggttggcgctacaatgaccgatgacatcgggatgggagtgacgtatctggccctcctggccgcttttaaagtcagacctacattcgccgcgggcctgcttctgcggaagctcacctctaaagagctgatgatggctacaattgggatcgccctcctgagccagtccaccattcccgaaaccatccttgagctgacagatgccctcgctctgggaatgatggtgctgaagatcgttcgcaacatggaaaaataccaacttgccgtgacgattatggcgatctcttgcgtccctaatgctgtgattctgcagaacgcctggaaggtgagctgtaccatcctcgccgctgtctccgttagccccctgctcctgacatcttcccagcagaaggccgactggattcctcttgctctgaccatcaaaggcctcaatcccacagccatctttctgaccacgctgagcagaacatctaagaaacggtcctggccgcttaacgaggcgattatggccgtggggatggtgagcatcctggcttcttccctcctgaagaatgacattcctatgaccggacccctcgtcgccggcggcctgcttaccgtgtgctatgttctgacagggcgcagcgctgatctggaactcgagagagccgccgacgtgaaatgggaggatcaagctgaaatctccggaagctctcctattctgagcatcaccatttccgaggacggctctatgagcatcaagaacgaagaggaggaacagacacttacgatcctgattcggaccgggctcctggtcatctccggagtgttccccgtttctattccgatcacagcggccgcttggtacctctgggaggtgaaaaagcagcgcgccggcgtcctgtgggatgtgccttctccccctcccgtcgaaaaggccgagcttgaagacggggcttatagaattaaacagcggggaatcctgggctactcccaaatcggcgccggggtgtataaggagggaacctttcacacaatgtggcatgttacccgcggcgcggtgctgatgcacagagggaaacggattgagccctcctgggctgatgtcaagaaagacctcatcagctacggaggcgggtggaagctggaaggagagtggaaggaaggcgaggaagtgcaggttcttgccctggagcctggcaaaaatccgagagccgtgcagacgaagcccgggattttcaaaaccaacacaggaaccatcggcgctgtctccctcgattttagccctgggacatctggatcccccattgtggaccgcaagggcaaagtggttgggctgtacggaaatggcgtcgtgacccggagcggcgcctatgtgtctgcgatcgctcagacagagaagtccatcgaagataaccctgagattgaagacgatatcttcagaaagaaacgcctcacgattatggacctgcatcccggggccggaaagaccaaacggtaccttcctgccatcgtcagagaggctattaagcgcggcctgcggacactgatcctcgccccgaccagagtggttgctgccgaaatggaggaggcgctgcgcgggcttcccattcggtatcaaacccctgccatcaaaacagaacacacgggaagagagatcgtggacctgatgtgtcatgctaccttcacaatgcggctcctgagccccgtccgcgtgcctaactacaatctcattatcatggatgaagcccactttaccgaccccgcttccattgccgccagaggctatatctctacacgggttgagatgggggaggctgcgggcattttcatgaccgccacgccgcctggaagccgcgatccctttccccagtccaacgctcctatcatggacgaagagagagaaatccccgagcggagctggaactctggccacgaatgggtgacagatttcaaggggaagaccgtctggtttgtgccttccattaaagccggaaacgacatcgccgcttgcctgagaaagaatggcaaaaaggttattcagcttagccgcaaaaccttcgattctgagtacgtgaagacacgggccaacgactgggattttgtcgtgaccacagacatcagcgagatgggggcgaatttcaaggctgaaagagtgattgatccgcgccggtgtatgaaacccgtcatcctgaccgactccgaggaaagagttatcctggccggacctatgcccgtgacgcattctagcgccgctcaacgccggggcagaattgggcgcaaccctaagaatgagaacgaccagtatatctacatgggcgaacccctcgagaatgatgaggactgcgcccactggaaagaagcgaagatgctgcttgataacattaatacaccggagggaatcattccttccatgtttgaacccgagagagaaaaagtggacgccatcgatggcgagtaccggctgcgcggggaggctagaaagaccttcgtcgacctcatgcggcgcggagatctgcctgtgtggctggcctataaagttgctgccgaaggcattaactacgctgacagaaagtggtgttttgatgggatcaagaataaccagatcctcgaggaaaacatggaggtggagatttggacaaaagaaggagagcggaagaaacttaagcccagatggctggacgcccgcatctattctgatcctctggcgctcaaagagttcaaggagttcgccgctggcagaaagagcctgacccttaatctgattacggaaatggggagactccccacctttatgacacagaaagcccgcaacgctctggacaatctggccgtcctccataccgccgaggctggcggacgggcgtacaaccacgccctttccgagctgccggaaacactggagaccctcctgcttctgacactcctggctaccgtgacgggcgggatcttcctgtttctcatgagcggaaagggcattgggaaaatgacacttggaatgtgctgcatcatcaccgcctctattctgctgtggtatgcccaaatccagcctcactggattgctgcctccatcattctcgagttctttctgatcgttcttctgatccccgagcccgaaaagcagagaacccctcaggataatcaactcacatacgtggtcattgcgatcctgaccgtggtcgccgctacaatggccaacgagatgggcttcctggagaaaacgaagaaggacctcggccttgggagcattaccacacaggaatccgagtctaatatcctggacattgatctgcggccggctagcgcctggaccctctatgcggtggccacaacctttgttacgcccatgctgcgccattccatcgaaaactctagcgtgaatgtgtcccttaccgctattgccaaccaggctacagtcctgatgggactcggcaaagggtggcctctgagcaagatggacatcggagttcccctgctcgccatcggctgttactctcaggtgaatcctattacccttacagctgccctgctgctcctggtggcgcactacgccatcattgggcccggacttcaagctaaagccaccagagaggctcagaagcgggccgccgcgggcatcatgaaaaaccctacggtcgatggcattacagtgatcgacctggaaccgatcccctatgatcctaagttcgagaagcagctcgggcaggttatgctgctgattctctgcgtgacccaagtccttatgatgcgcacaacctgggctctgtgtgaggccctgaccctcgctacaggacccatctccacgctgtgggaaggcaatcctgggagattttggaacaccacaattgccgtgagcatggccaatatcttccggggatcttaccttgctggcgccgggctgctcttttccattatgaaaaacaccacaagcacccgcagaggaacgggcaatatcggcgagacactgggggaaaagtggaaatctcggctgaacgcgctcggaaagagcgagttccagatctataaaaagtccggcattcaggaggtcgaccgcacccttgccaaagaagggatcaagagaggagagaccgatcatcacgctgtgtctcggggcagcgccaagctgagatggtttgttgaacgcaacatggtgacacccgaggggaaagtcgtggacctgggatgcggccggggcgggtggtcctactattgtggaggcctcaagaatgttagagaagtgaaagggctgaccaagggaggcccggggcatgaggagcctattcccatgagcacatacggatggaaccttgtccgcctgcaatccggcgtggatgtgttcttcacgccccctgaaaaatgcgacaccctcctgtgtgatatcggcgagtctagccccaatcctacaattgaagctgggcggaccctgagagttctcaaccttgtcgagaattggctgaacaataacacacagttttgcatcaaggtgctgaatccgtatatgccctccgtgatcgaaaagatggaggccctccagcgccagtacggaggcgcgctggtccggaaccctctttctagaaatagcacccacgagatgtactgggtttccaacgccacggggaatattgtgtctagcgtgaacatgatctcccgcatgctgattaatcggttcaccatgaaacacaagaaagctacatatgaacccgacgtcgatctcggaagcggcaccagaaacatcgggattgagtctgaaatccctaacctggacattatcggaaagcgcatcgagaaaattaagcaagaacatgagatctcctggcactacgaccaggatcatccctataagacatgggcctaccacggcagctatgagaccaaacagacaggctctgcttccagcatggtgaatggggttgtgcggctgctcaccaagccgtgggacgtcgtgcctatggttacgcagatggccatgacagataccaccccctttggacaacagagagtgttcaaagaaaaggtcgacacacgcacgcaggagcctaaagaaggcaccaagaaacttatgaaaattacagctgagtggctgtggaaggagctggggaaaaagaaaacccccagaatgtgtacacgggaagagtttaccaagaaagtgcgctctaacgccgcgctcggagccatcttcacagatgaaaataagtggaagtccgctagagaggccgtggaagacggccggttttgggagctggtcgatagagagcggaaccttcacctggaagggaaatgcgagacctgtgtttacaatatgatgggaaagcgcgagaagaagctcggcgagttcggcaaagctaaggggagcagagccatttggtatatgtggctgggagcccggtttctggagttcgaggcgctcggctttctgaacgaggaccattggttctcccgcgggaatagcctttctggagtggaaggcgaggggctgcacagactcggctacatcctgcgggatgtgggaaagaaagaaggcggggctatgtacgccgacgatacggccggatgggacacccgcatcacacttgaggacctgaagaacgaagagatggtcaccaatcatatgaaaggcgagcacaagaaactcgctgaagccatttttaagctgacatatcagaacaaggtggttagagtgcaacggcctacaccccgcgggacggtcatggatatcattagcagacgggaccagcgcggatccggccaggtggggacatacggcctgaataccttcacaaacatggaggctcaactcatcagacagatggaaggagagggcattttcaaatctatccagcatctgaccgccacggaggaaatcgcggttcagaattggcttgcccgggtggggcgcgagagactgagccggatggctatttccggagatgactgcgtcgtgaagccgatcgatgacagatttgcctctgctctcaccgccctgaacgatatgggcaaagttcgcaaggacattcaacagtgggaacctagccgggggtggaatgattggacacaggtgcccttctgctcccaccactttcatgagcttgtcatgaaagacggaagagtgctggtcgtgccctgtcgcaaccaggatgaactcatcggccgggcgagaatttctcaaggggccggctggagcctgaaggagaccgcttgcctgggaaagtcctatgcccagatgtggacactcatgtacttccaccgccgggacctgagacttgctgccaacgctatctgtagcgccgttccttctcattgggtgccgacctcccgcacaacctggagcattcacgcgaaacacgagtggatgacgacagaagatatgctggccgtctggaatcgggtgtggatccaggagaacccctggatggaagacaagacccctgtggagtcttgggaagaggttccctatctcggcaaaagagaggaccagtggtgcgggtccctgatcggacttaccagccgcgctacatgggccaagaatattcaaaccgccatcaaccaggtgcggtccctgattggcaatgaagagtacacagattatatgccttctatgaaaagatttcggagagaagaggaagaggctggggtcctctggtga

SEQ ID NO: 19749 - RNA, 9876 nt, synthetic construct
  misc_feature 1..9876: note = derived and/or modified CDS sequence (opt5) from DENV-2__EU482624__SS-prME
  source 1..9876: mol_type = other RNA
acagccggcgtgatcgtcatgctgattcccacagctatggccttccacctcacgaccagaaacggggaacctcatatgatcgttggacggcaggaaaagggcaagagcctgctttttaagacagaagacggggtgaatatgtgcaccctgatggcgattgatctcggagaactgtgtgaggacacaatcacctacaaatgcccgcttctgcgccaaaacgaacccgaggatattgactgttggtgcaatagcacatctacctgggtgacgtatggcacctgtacaaccacaggggagcacagacgggaaaagcgcagcgtcgctctcgtgcctcatgttggaatgggcctggagaccagaacggaaacatggatgtcctctgagggcgcctggaaacacgtgcagcggatcgagacctggatcctgcgccatcccgggttcacaattatggccgctatcctcgccaacaccattggaaccacacactttcagagagctctgatcttcattcttctgacggccgtcgcgcctagcatgaccatgcggtgcatcggcatttccaatcgcgattttgtggaaggggtttctggaggcagctgggtggacatcgtcctcgagcacgggtcctgtgtgacaaccatggccaagaacaagcccacactggatttcgaacttatcaaaaccgaggctaagcagcctgccacgctgagaaaatactgcattgaagctaagctcacaaataccaccacagagagccggtgtccgacccaaggagagccctctctgaacgaagaacaggacaaacgctttatctgcaagcattccatggtggatagaggctggggcaatgggtgtggactgttcggcaaaggcgggattgtcacatgcgccatgtttacgtgcaaaaagaacatggaagggaaagttgtgcagcctgagaatctcgaatataccatcgtgattacaccccacagcggggaggagcatgcggtcggaaacgacaccggcaagcacggcaaagaaatcaagatcacacctcagtcttccattaccgaggccgaactgacggggtacggaaccgtgacaatggagtgtagcccccggaccggccttgatttcaatgaaatggttctgctccaaatggaggacaaggcttggctggtgcaccgccagtggtttcttgatctgccgctcccttggctgcccggggccgacatccagggatctaactggattcagaaggagacactggtcaccttcaagaatcctcatgctaaaaagcaagacgtggttgtgctcggctcccaggaaggggccatgcacacggccctgacaggcgctaccgagatccagatgagctccggaaaccttctgtttacaggccatctcaaatgcagactgcggatggataaacttcaactgaaagggatgtcttatagcatgtgtaccggaaagttcaagattgtcaaagaaatcgcggagacccagcacggcacaatcgtgattagagtccagtacgagggggacggatccccctgcaagatccccttcgaaattacggatctcgagaaacgccatgtgctgggccggctgatcaccgttaaccctattgtgacagaaaaggacagcccggtcaatatcgaggccgaacccccttttggggattcttatattatcatcggcgtggagcccggacagctcaaactgaactggttcaagaagggctccagcattgggcaaatgtttgagaccacaatgagaggagctaaacgcatggccatccttggcgacaccgcctgggatttcgggtctctgggaggcgtttttacgagcattgggaaggctctccaccaggtgttcggcgccatctacggagcggctttttccggcgtctcttggacaatgaaaattctgatcggggtgatcattacctggatcggaatgaatagccggtccaccagcctgtctgtgtcccttgttctcgtcggcgtggtgacactgtacctgggggccgtcgtgcaggccgacagcggatgtgttgtgtcttggaagaacaaagaactcaagtgcggctccgggattttcatcaccgataatgtccacacatggacggagcagtataagtttcaacctgaaagcccctccaaactggcttctgccattcagaaggctcatgaggaaggcatctgtggaatcagaagcgtgacccgccttgagaacctgatgtggaaacagattacaccggagctcaatcacatcctgtccgaaaacgaggttaagctgaccattatgacaggcgacatcaaagggattatgcaggccggaaagcggtctcttagacctcaacccaccgaactcaaatacagctggaagacgtggggcaaggcgaaaatgctgtccaccgagagccataatcagacattcctgatcgatgggcctgaaaccgccgagtgccccaacacaaatcgcgcttggaactctctcgaggtggaagactatggatttggcgtcttcaccacaaatatctggctgaaacttcgggagaaacaggacgtgttttgtgattccaagctgatgagcgccgctattaaagacaacagagccgttcacgcggatatgggctactggatcgaatctgccctcaatgacacctggaagatggagaaggcttccttcattgaggtgaaaagctgccactggcctaagtctcatacgctgtggagcaacggggtcctggaatccgagatgatcattcccaaaaacttcgccggaccggtgagccagcacaattatcgccctggctaccatacacaaaccgctgggccctggcaccttggaaagctcgaaatggattttgacttctgtgagggcaccacagtggtcgttaccgaagattgcgggaaccggggaccctctctgagaacgacaaccgcctccggcaaactgatcacagagtggtgctgtcggagctgcaccctccctccgctgcgctatagaggcgaggacgggtgttggtacggaatggaaattcggccccttaaggagaaggaagagaatctggtgaactccctcgtgacagccggccatgggcagatcgataatttttctctgggagtcctgggcatggctcttttcctcgaagagatgctgagaacccgcatcgggacgaaacacgcgattctgctcgtggccgttagctttgtgaccctgatcacaggaaacatgtccttccgggaccttggcagagtcatggtgatggttggcgctaccatgacagatgacattgggatgggagtgacctacctggccctcctggccgcttttaaggtccgccctacgttcgccgcgggcctgcttctgagaaaactcacatctaaggagctgatgatggctaccatcgggattgccctcctgagccagtccacaatccccgaaaccatccttgagctgaccgatgccctcgctctgggaatgatggtgctgaaaattgttcggaatatggaaaagtatcaacttgccgtgacaatcatggcgatttcttgcgtccctaacgctgtgatcctgcagaatgcctggaaggtgagctgtacgattctcgccgctgtctccgttagccccctgctcctgacctcttcccagcagaaagccgactggatccctcttgctctgacaatcaagggcctcaaccccaccgccatttttctgacaaccctgagccgcacgtctaaaaagagatcctggccgcttaatgaggcgatcatggccgtggggatggtgagcattctggcttcttccctcctgaaaaacgacatccctatgacaggacccctcgtcgccggcggcctgcttaccgtgtgctacgttctgaccgggcggagcgctgatctggaactcgagcgcgccgccgacgtgaagtgggaggatcaagctgaaatttccggaagctctcctatcctgagcattacaatctccgaggacggctctatgagcatcaaaaatgaagaggaggaacagacccttacaattctgatcagaacggggctcctggtcatttccggagtgttccccgtttctatcccgattaccgcggccgcttggtatctctgggaggtgaagaagcagcgggccggcgtcctgtgggatgtgccttctccccctcccgtcgaaaaagccgagcttgaagacggggcttaccgcatcaagcagagaggaatcctgggctattcccaaattggcgccggggtgtacaaagagggaacatttcacaccatgtggcatgttacacggggcgcggtgctgatgcaccgcgggaagagaatcgagccctcctgggctgatgtcaaaaaggacctcattagctatggaggcgggtggaagctggaaggagagtggaaagaaggcgaggaagtgcaggttcttgccctggagcctggcaagaacccgcgggccgtgcagaccaaacccgggatcttcaagacgaataccggaacaattggcgctgtctccctcgattttagccctgggacctctggatcccccatcgtggacagaaaaggcaaggtggttgggctgtacggaaacggcgtcgtgacacgcagcggcgcctacgtgtctgcgatcgctcagaccgagaagtccattgaagataaccctgagatcgaagacgatattttccggaaaaagagactcacaatcatggacctgcatcccggggccggaaaaacgaagcgctatcttcctgccattgtccgggaggctatcaaaagaggcctgcgcaccctgattctcgccccgacacgggtggttgctgccgaaatggaggaggcgctgagagggcttcccatccgctaccaaacccctgccatcaagaccgaacacacaggacgggagattgtggacctgatgtgtcatgctacgttcaccatgagactcctgagccccgtccgggtgcctaattataacctcatcattatggatgaagcccactttacagaccccgcttccatcgccgcccgcggctacatttctaccagagttgagatgggggaggctgcgggcatcttcatgacagccaccccgcctggaagccgggatccctttccccagtccaatgctcctatcatggacgaagaaagagaaattcccgagagaagctggaactctggccacgaatgggtgacggatttcaaggggaaaacagtctggtttgtgccttccatcaaggccggaaatgacattgccgcttgcctgcggaaaaacggcaagaaagttatccagcttagcagaaagaccttcgattctgagtatgtgaagacccgcgccaatgactgggattttgtcgtgacaaccgacattagcgagatgggggcgaacttcaaagctgaacgggtgatcgatccgagacgctgtatgaagcccgtcatcctgacagacggagaggaacgggttattctggccggccctatgcccgtgacccattcctctgccgctcaaagacgcgggcggatcggcagaaatcctaaaaacgagaatgaccagtacatttatatgggagaacccctcgagaacgatgaggactgcgcccactggaaggaagcgaaaatgctgcttgataatatcaacacgccggagggcattatccctagcatgtttgaacccgagcgcgaaaaggtggacgccattgatggggagtacagactgcggggagaggctcgcaaaacattcgtcgacctcatgagacggggcgatctgcctgtgtggctggcctacaaggttgctgccgaagggatcaattatgctgaccgcaagtggtgttttgatggaatcaaaaacaaccagattctcgaggaaaatatggaggtggagatctggaccaaggaaggcgagcgcaagaaacttaaaccccggtggctggacgccagaatttactccgatcctctggcgctcaaggagttcaaggagttcgccgctgggcgcaaatctctgacacttaacctgatcaccgaaatgggccggctccccacgtttatgacccagaaggccagaaatgctctggacaacctggccgtcctccatacagccgaggctggaggccgcgcgtataatcacgcccttagcgagctgccggaaaccctggagacactcctgcttctgaccctcctggctacagtgaccgggggaattttcctgtttctcatgtccggcaaagggatcggaaagatgacgcttggcatgtgctgcatcattacagccagcatcctgctgtggtacgcccaaattcagcctcactggatcgctgcctctattatcctcgagttctttctgatcgttcttctgattcccgagcccgaaaaacagcggacccctcaggataaccaactcacctatgtggtcatcgcgattctgacagtggtcgccgctaccatggccaatgagatgggcttcctggagaagacaaagaaagacctcgggcttggatccatcacgacccaggaaagcgagtccaacattctggacatcgatctgagaccggcttctgcctggacactctacgcggtggccaccacatttgttacccccatgctgcggcatagcattgaaaattcctctgtgaacgtgagccttacggctatcgccaatcaggctaccgtcctgatgggcctcgggaagggatggcctctgtccaaaatggacatcggcgttcccctgctcgccattgggtgttatagccaggtgaaccctatcacacttaccgctgccctgctgctcctggtggcgcactacgccattatcggacccggccttcaagctaaggccacacgcgaggctcagaaaagagccgccgcgggcattatgaagaatcctaccgtcgatgggatcacggtgatcgacctggaaccgattccctacgatcctaagttcgagaaacagctcggacaggttatgctgctgatcctctgcgtgacacaagtccttatgatgcggaccacatgggctctgtgtgaggccctgaccctcgctaccggccccatttctacactgtgggaagggaaccctggacgcttttggaatacgaccatcgccgtgtccatggccaacattttcagaggcagctatcttgctggggccggactgctcttttctatcatgaagaatacaacctccacacggcgcggcaccggcaacatcggggagacgctgggagaaaaatggaaaagcagactgaacgcgctcggcaaatctgagttccagatttacaagaaaagcgggatccaggaggtcgaccggacacttgccaaggaaggaattaagcgcggcgagaccgatcatcacgctgtgtccagagggtctgccaaactgcggtggtttgttgaaagaaatatggtgacccccgagggaaaggtcgtggacctgggctgcggccgcgggggatggagctattactgtggcgggctcaaaaacgttcgggaagtgaagggactgacaaaaggcgggccgggacatgaggagcctatccccatgtccacctatggctggaatcttgtcagactgcaaagcggcgtggatgtgttcttcacaccccctgaaaagtgcgacacgctcctgtgtgatattggggagtcctctcccaaccctaccatcgaagctggacgcacactgcgggttctcaatcttgtcgagaactggctgaataacaatacccagttttgcatcaaggtgctgaacccgtacatgcccagcgtgattgagaagatggaggccctccagagacagtatggcggggcgctggtccgcaatcctctttcccggaactctacacacgagatgtactgggttagcaatgccaccggaaacatcgtgtcctctgtgaatatgattagcagaatgctgatcaaccgcttcacgatgaagcacaaaaaggctacctacgaacccgacgtcgatctcggctccgggacacggaacattggaatcgagagcgaaattcctaatctggacatcatcggcaaaagaattgagaagatcaagcaagaacatgagatttcttggcactatgaccaggatcatccctacaaaacctgggcctatcacggctcctacgagacaaagcagaccgggagcgcttcttccatggtgaacggagttgtgcgcctgctcacaaaaccgtgggacgtcgtgcctatggttacccagatggccatgacggatacaaccccctttggccaacagcgggtgttcaaggaaaaagtcgacaccagaacacaggagcctaaggaagggacgaagaaacttatgaagatcaccgctgagtggctgtggaaagagctgggaaagaaaaagacaccccgcatgtgtaccagagaagagtttaccaagaaggtgcggagcaatgccgcgctcggcgccattttcaccgatgaaaacaagtggaaatctgctcgcgaggccgtggaagacgggagattttgggagctggtcgatcgggagagaaatcttcacctggaaggaaagtgcgagacatgtgtttataacatgatgggcaaacgggaaaagaaactcggcgagttcgggaaggctaagggatcccgcgccatctggtacatgtggctgggcgccagatttctggagttcgaggcgctcgggtttctgaatgaggaccattggttcagccggggaaactcccttagcggcgtggaaggggagggcctgcaccgcctcggatatatcctgagagatgtgggcaaaaaggaagggggagctatgtacgccgacgataccgccggctgggacacgcggattacccttgaggacctgaaaaatgaagagatggtcacaaaccatatgaagggggagcacaaaaagctcgctgaagccatctttaagctgacctaccagaataaagtggttcgcgtgcaaagacctacaccccggggaaccgtcatggatattatctctcgcagagaccagcggggcagcggacaggtgggcacgtatggactgaacacattcaccaatatggaggctcaactcattcgccagatggaaggcgaggggatcttcaagtccatccagcatctgacagccaccgaggaaattgcggttcagaactggcttgccagagtgggacgggagcgcctgtctagaatggctatcagcggcgatgactgcgtcgtgaaaccgattgatgaccggtttgcctccgctctcacggccctgaatgatatggggaaggttagaaaagacatccaacagtgggaaccttctcgcggatggaacgattggacccaggtgcccttctgcagccaccactttcatgagcttgtcatgaaggacggccgggtgctggtcgtgccctgtagaaaccaggatgaactcattgggcgcgcgcggatctcccaaggcgccggatggtctctgaaggagacagcttgcctgggcaaaagctacgcccagatgtggaccctcatgtatttccacagacgcgacctgcggcttgctgccaatgctatttgttccgccgttcctagccattgggtgccgacatctagaaccacatggtccatccacgcgaagcacgagtggatgaccacggaagatatgctggccgtctggaaccgcgtgtggatccaggagaatccctggatggaagacaaaacacctgtggagagctgggaagaggttccctacctcgggaagcgggaggaccagtggtgcggatctctgattggccttacctccagagctacctgggccaaaaacatccaaacagccattaatcaggtgcgcagcctgatcgggaacgaagagtataccgattacatgccttccatgaagcggtttagacgggaagaggaagaggctggagtcctctggtga

SEQ ID NO: 19750 - RNA, 9876 nt, synthetic construct
  misc_feature 1..9876: note = derived and/or modified CDS sequence (opt5) from DENV-2__EU596500__SS-prME
  source 1..9876: mol_type = other RNA
accgccggcgtgatcgtcatgctgattcccacggctatggccttccacctcacgaccagaaatggggaacctcatatgatcgttggacggcaggaaaagggcaagagcctgctttttaagacagaagacggggtgaatatgtgcaccctgatggcgattgatctcggagaactgtgtgaggacacaatcacctacaagtgcccgcttctgcgccaaaatgaacccgaggatattgactgttggtgcaattccacatctacctgggtgacgtatggcacctgtacaaccacaggggagcacagacgggaaaagcgcagcgtcgctctcgtgcctcatgttggaatgggcctggagaccagaacggaaacatggatgtcctctgagggcgcctggaaacacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaagaacaggacaaacgctttatctgcaagcattccatggtggatagaggctggggcaacgggtgtggactgttcggcaaagggggaattgtcacatgcgccatgtttacgtgcaaaaagaatatggaaggcaaagttgtgcagcctgagaacctcgaatacaccatcgtgattacaccccacagcggggaggagcatgcggtcggaaatgacaccggcaagcacggcaaagaaatcaagatcacacctcagtcttccattaccgaggccgaactgacggggtatggaaccgtgacaatggagtgtagcccccggaccggccttgatttcaacgaaatggttctgctccaaatggaggacaaggcttggctggtgcaccgccagtggtttcttgatctgccgctcccttggctgcccggggccgacacacagggatctaattggatccagaaggagaccctggtcacgttcaagaaccctcatgctaaaaagcaagacgtggttgtgctcggctcccaggaaggggccatgcacacagccctgaccggcgctacagagattcagatgagctccggaaatcttctgtttaccggccatctcaaatgcagactgcggatggataaacttcaactgaaagggatgtcttacagcatgtgtaccggaaagttcaagatcgtcaaagaaattgcggagacacagcacggcacgatcgtgatcagagtccagtatgagggggacggatccccctgcaagattcccttcgaaatcaccgatctcgagaaacgccatgtgctgggccggctgattacagttaaccctatcgtgaccgaaaaggacagcccggtcaacattgaggccgaacccccttttggggattcttacatcattatcggcgtggagcccggacagctcaaactgaattggttcaagaagggctccagcatcgggcaaatgtttgagacaaccatgagaggagctaaacgcatggccattcttggcgacacggcctgggatttcgggtctctgggaggcgtttttacaagcatcgggaaggctctccaccaggtgttcggcgccatttacggagcggctttttccggcgtctcttggaccatgaaaatcctgattggggtgatcatcacctggattggaatgaacagccggtccacaagcctgtctgtgtcccttgttctcgtcggcgtggtgaccctgtatctgggggccgtcgtgcaggccgacagcggatgtgttgtgtcttggaagaataaagaactcaagtgcggctccgggatcttcattacagataacgtccacacgtggaccgagcagtacaagtttcaacctgaaagcccctccaaactggcttctgccatccagaaggctcatgaggaaggcatttgtggaatcagaagcgtgacacgccttgagaatctgatgtggaaacagatcaccccggagctcaaccacattctgtccgaaaatgaggttaagctgacaatcatgaccggcgacattaaagggatcatgcaggccggaaagcggtctcttagacctcaacccacggaactcaaatatagctggaagacctggggcaaggcgaaaatgctgtccacagagagccataaccagaccttcctgattgatgggcctgaaacagccgagtgccccaataccaaccgcgcttggaactctctcgaggtggaagactacggatttggcgtcttcacaaccaacatctggctgaaacttcgggagaaacaggacgtgttttgtgattccaagctgatgagcgccgctatcaaagacaatagagccgttcacgcggatatgggctattggattgaatctgccctcaacgacacgtggaagatggagaaggcttccttcatcgaggtgaaaagctgccactggcctaagtctcatacactgtggagcaatggggtcctggaatccgagatggtgattcccaaaaacttcgccggaccggtgagccagcacaactaccgccctggctatcatacccaaaccgctgggccctggcaccttggaaagctcgaaatggattttgacttctgtgagggcacaaccgtcgttgtgacggaagattgcgggaatcggggaccctctctgagaacaaccacagcctccggcaaactgatcaccgagtggtgctgtcggagctgcacactccctccgctgcgctacagaggcgaggacgggtgttggtacggaatggaaattcggccccttaaggagaaggaagagaacctggtgaatagcctcgtcaccgccggccatgggcagatcgataacttttctctgggagtgctgggcatggctcttttcctcgaagagatgctgagaacgcgcattgggaccaaacacgcgatcctgctcgttgccgtgagctttgtcacactgatcaccggaaatatgtccttccgggaccttggcagagtgatggttatggtgggcgctacaatgaccgatgacattgggatgggagtcacgtatctggccctcctggccgcttttaaggtgcgccctacattcgccgcgggcctgcttctgagaaaactcacctctaaggagctgatgatggctacaatcgggattgccctcctgagccagtccaccatccccgaaaccattcttgagctgacagatgccctcgctctgggaatgatggttctgaaaatcgtgcggaacatggaaaagtaccaacttgccgtcacgatcatggcgatttcttgcgtgcctaatgctgtgatcctgcagaacgcctggaaggtcagctgtaccattctcgccgctgtttccgtgagccccctgctcctgacatcttcccagcagaaagccgactggatccctcttgctctgaccattaagggcctcaatcccacagccatctttctgaccacgctgagccgcacatctaaaaagagatcctggccgcttaacgaggcgatcatggccgtggggatggtcagcattctggcttcttccctcctgaaaaatgacatccctatgaccggacccctcgtggccggcggcctgcttaccgtttgctatgtgctgacagggcggagcgctgatctggaactcgagcgcgccgccgacgtcaagtgggaggatcaagctgaaatttccggaagctctcctatcctgagcattaccatctccgaggacggctctatgagcattaaaaacgaagaggaggaacagacacttacgatcctgatcagaaccgggctcctggtgatttccggagttttccccgtgtctatcccgattacagcggccgcttggtacctctgggaggtcaagaagcagcgggccggcgtgctgtgggatgtcccttctccccctcccgtggaaaaagccgagcttgaagacggggcttatcgcatcaagcagagaggcattctgggatactcccaaatcggcgccggggtttataaagagggaacctttcacacaatgtggcatgtgacccggggcgcggtcctgatgcaccgcgggaagagaatcgagccctcctgggctgatgtgaaaaaggacctcattagctacggaggcgggtggaagctggaaggagagtggaaagaaggcgaggaagttcaggtgcttgccctggagcctggcaagaatccgcgggccgtccagacgaaacccgggatcttcaagaccaacacaggaaccattggcgctgtgtccctcgattttagccctgggacatctggatcccccatcgtggacagaaaaggcaaggttgtcgggctgtacggaaatggcgtggtgacccgcagcggcgcctatgtctctgcgattgctcagacagagaagtccatcgaagataaccctgagatcgaagacgatattttccggaaaaagagactcacgatcatggacctgcatcccggggccggaaaaaccaagcgctaccttcctgccattgtgcgggaggctatcaaaagaggcctgcgcacactgattctcgccccgacccgggttgtggctgccgaaatggaggaggcgctgagagggcttcccatccgctatcaaacccctgccattaagacagaacacacgggacgggagatcgtcgacctgatgtgtcatgctaccttcacaatgagactcctgagccccgtgcgggttcctaactacaatctcatcattatggatgaagcccactttaccgaccccgcttccatcgccgcccgcggctatatttctacaagagtggagatgggggaggctgcgggcatcttcatgaccgccacgccgcctggaagccgggatccctttccccagtccaacgctcctattatggacgaagaaagagaaatccccgagagaagctggaactctggccacgaatgggtcacagatttcaaggggaaaaccgtgtggtttgttccttccatcaaggccggaaacgacattgccgcttgcctgcggaaaaatggcaagaaagtgatccagcttagcagaaagaccttcgattctgagtacgtcaagacacgcgccaacgactgggattttgtggtgaccacagacattagcgagatgggggcgaatttcaaagctgaacgggtcatcgatccgagacgctgtatgaagcccgttattctgaccgacggagaggaacgggtgatcctggccggccctatgcccgtgacgcattcctctgccgctcaaagacgcgggcggatcggcagaaaccctaaaaatgagaacgaccagtatatttacatgggagaacccctcgagaatgatgaggactgcgcccactggaaggaagcgaaaatgctgcttgataacatcaatacaccggagggcattatccctagcatgtttgaacccgagcgcgaaaaggtcgacgccattgatggggagtacagactgcggggagaggctcgcaaaaccttcgtggacctcatgagacggggcgatctgcctgtttggctggcctataaggtggctgccgaagggatcaactacgctgaccgcaagtggtgttttgatggaattaaaaataaccagatcctcgaggaaaacatggaggtcgagatctggacaaaggaaggcgagcgcaagaaacttaaaccccggtggctggacgccagaatttattccgatcctctggcgctcaaggagttcaaggagttcgccgctgggcgcaaatctctgacccttaatctgatcacggaaatgggccggctccccacctttatgacacagaaggccagaaacgctctggacaatctggccgtgctccataccgccgaggctggaggccgcgcgtacaaccacgcccttagcgagctgccggaaacactggagaccctcctgcttctgacactcctggctaccgttacagggggaattttcctgtttctcatgtccggcaaaagcatcgggaagatgacacttggaatgtgctgcattatcaccgcctctatcctgctgtggcacgcccaaattcagcctcattggatcgctgcctccattatcctcgagttctttctgattgtgcttctgatccccgagcccgaaaaacagcggacccctcaggataatcaactcacatatgtcgtgatcgcgattctgaccgtcgtggccgctacaatggccaacgagatgggcttcctggagaagacgaagaaagacctcggccttgggagcatcaccacacaggaatccgagtctaatattctggacatcgatctgagaccggctagcgcctggaccctctacgcggttgccacaacctttgtgacgcccatgctgcggcactccattgaaaactctagcgtgaatgtctcccttaccgctatcgccaaccaggctacagttctgatgggactcggcaaggggtggcctctgagcaaaatggacattggagtgcccctgttcgccatcggctgttattaccaggtgaatcctatcaccctcacagctgcccttctgctgctcgtcgcgcataacgccattatcgggcaaggactgcaggctaaggccacccgcgaggctcagaaaagagccgccgcgggcattatgaagaatcccacggtggatggcatcacagttattgaccttgaacctatcccgtacgatcccaagtttgagaaacagctggggcaagtgatgctcctgatcctgtgcgtcacccaggtgctcatgatgcggacaacctgggctctttgtgaggccctgaccctggctacaggacctatttctacgctctgggaaggcaaccccgggcgcttctggaataccacaatcgccgtctccatggccaacatttttagaggaagctatctggctggcgccgggcttctgttctctatcatgaagaataccacatccacccggcgcggaacgggcaacattggcgagacactcggggaaaaatggaaaagcagactgaacgcgctgggaaaatctgagtttcagatctacaagaaaagcggcatccaagaggtggaccggaccctcgccaaggaagggattaagcgcggagagaccgatcaccatgctgtttccagaggctctgccaaacttcggtggttcgtggaaagaaatatggtcacacctgaggggaaggtggttgacctgggatgcggccgcggcgggtggagctattactgtggaggcctgaaaaacgtgcgggaagtcaaggggctcaccaaaggaggccccgggcacgaggagccgatccctatgtccacatatggatggaatctggtgagacttcagagcggcgtggatgttttctttacgcctcccgaaaagtgcgacaccctgctctgtgatattggcgagtcctctcccaaccccacaatcgaagctgggcgcaccctgcgggtcctgaatctcgtggagaactggcttaataacaatacacagttctgcattaaggtgctgaacccttacatgccgagcgtcatcgagaagatggaggccctgcagagacaatatggaggcgcgctcgttcgcaatcccctgtcccggaactctacccacgagatgtactgggtgagcaatgccacggggaacatcgtgtcctctgtcaatatgattagcagaatgcttatcaaccgctttaccatgaagcataaaaaggctacatacgaacctgacgtggatctgggatccggcacccggaacattgggatcgagaatgaaattcccaacctcgacatcattggaaaaagaatcgagaagatcaagcaggaacacgagattagctggcattatgaccaggatcacccttacaaaacatgggcctatcacggctcttacgagaccaagcagacaggctccgctagctctatggttaatggggtggtccgcctgctgaccaaaccctgggacgtggttccgatggtgacgcaaatggccatgacagataccacccctttcggacagcagcgggtctttaaggaaaaagtggacacaagaacgcaggagcccaaggaaggcaccaagaaactcatgaagatcacagctgagtggctttggaaagagctggggaagaaaaagacccctcgcatgtgtacaagagaagagttcacccggaaagtgcgctccaacgccgcgctgggagccatttttacagatgaaaataagtggaaaagcgctagagaggccgtcgaagacggccggttctgggagctcgttgatagagagcggaacctgcatcttgaagggaaatgcgagacctgtgtgtataatatgatgggaaagcgcgagaagaagctgggcgagtttggcaaagctaaggggtctagagccatctggtacatgtggctcggagcccggttcctggaatttgaggcgctgggcttcctcaacgaggaccactggttttcccgcgggaatagcctgtccggagtggaaggcgaggggcttcatagactgggctatattctccgggatgtcggaaagaaagaaggcggggctatgtacgccgacgatacggccggatgggacacccgcatcacactggaggaccttaagaacgaagagatggtgaccaatcacatgaaaggcgagcataagaaactggctgaagccatcttcaagctcacataccaaaacaaggttgtgagagtccagcggcccacccctcgcgggacggtgatggatattatcagcagacgggaccagcgcggatctggccaagttgggacatatggcctgaataccttcacaaacatggaggctcagctgattagacagatggaaggagagggcatctttaaaagcattcagcacctcaccgccacggaggaaatcgcggtgcaaaattggctggcccgggtcgggcgcgagagactttcccggatggctatctctggagatgactgcgtggttaagcccattgatgacagattcgccagcgctctgaccgccctcaacgatatgggcaaagtgcgcaaggacatccagcagtgggaaccgtcccgggggtggaacgattggacacaggtccctttttgctctcaccatttccacgagctggtgatgaaagacggaagagtccttgtggttccctgtcgcaatcaagatgaactgattggccgggcgagaatcagccagggggccggctggtccctcaaggagaccgcttgcctgggaaagtcttacgcccagatgtggacactgatgtattttcatcgccgggacctcagactggctgccaacgctatttgtagcgccgtgccctcccactgggtccctaccagccgcacaacctggtctatccacgcgaaacatgagtggatgacgacagaagatatgcttgccgtgtggaatcgggtgtggattcaggagaacccgtggatggaagacaagacccccgttgagtcctgggaagaggtgccttacctgggcaaaagagaggaccaatggtgcgggagcctcatcggactgacctctcgcgctacatgggccaagaatatccagaccgccattaaccaggtccggtcccttatcggcaatgaagagtatacagattacatgcccagcatgaaaagattccggagagaagaggaagaggctggggtgctgtggtga

SEQ ID NO: 19751 - RNA, 9876 nt, synthetic construct
  misc_feature 1..9876: note = derived and/or modified CDS sequence (opt5) from DENV-2__EU482626__SS-prME
  source 1..9876: mol_type = other RNA
acagccggcgtgatcgtcatgctgattcccacagctatggccttccacctcacgacccggaatggggagcctcatatgatcgttggacggcaggaaaagggcaagagcctgctttttaagacagaggacggggtgaatatgtgcaccctgatggcgattgatctcggagaactgtgtgaggacacaatcacctacaagtgcccgcttctgagacaaaatgaacccgaggatattgactgttggtgcaattccacatctacctgggtgacgtatggcacctgtacaaccacaggggagcacagacgggaaaagcgcagcgtcgctctcgtgcctcatgttggaatgggcctggagaccagaacggaaacatggatgtcctctgagggcgcctggaaacacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaggaacaggacaaacgctttatctgcaagcattccatggtggatagaggctggggcaacgggtgtggactgttcggcaaagggggaattgtcacatgcgccatgtttacgtgcaaaaagaatatggaaggcaaagttgtgcagcctgagaacctcgaatacaccatcgtgattacaccccacagcggggaggagcatgcggtcggaaatgacaccggcaagcacggcaaagaaatcaagatcacacctcagtcttccattaccgaggccgaactgacggggtatggaaccgtgacaatggagtgtagcccccggaccggccttgatttcaacgaaatggttctgctccaaatggaggacaaggcttggctggtgcaccgccagtggtttcttgatctgccgctcccttggctgcccggggccgacatccagggatctaattggattcagaaggagacactggtcaccttcaagaaccctcatgctaaaaagcaagacgtggttgtgctcggctcccaggaaggggccatgcacacggccctgacaggcgctaccgagatccagatgagctccggaaatcttctgtttacaggccatctcaaatgcagactgcggatggataaacttcaactgaaagggatgtcttacagcatgtgtaccggaaagttcaagattgtcaaagaaatcgcggagacccagcacggcacaatcgtgattagagtccagtatgagggggacggatccccctgcaagatccccttcgaaattacggatctcgagaaacgccatgtgctgggccggctgatcaccgttaaccctattgtgacagaaaaggacagcccggtcaacatcgaggccgaacccccttttggggattcttacattatcatcggcgtggagcccggacagctcaaactgaattggttcaagaagggctccagcattgggcaaatgtttgagaccacaatgagaggagctaaacgcatggccatccttggcgacaccgcctgggatttcgggtctctgggaggcgtttttacgagcattgggaaggctctccaccaggtgttcggcgccatctacggagcggctttttccggcgtctcttggacaatgaaaattctgatcggggtgatcattacctggatcggaatgaacagccggtccaccagcctgtctgtgtcccttgttctcgtcggcgtggtgacactgtatctgggggccgtcgtgcaggccgacagcggatgtgttgtgtcttggaagaataaagaactcaagtgcggctccgggattttcatcaccgataacgtccacacatggacggagcagtacaagtttcaacctgaaagcccctccaaactggcttctgccattcagaaggctcatgaggaaggcatctgtggaatcagaagcgtgacccgccttgagaatctgatgtggaaacagattacaccggagctcaaccacatcctgtccgaaaatgaggttaagctgaccattatgacaggcgacatcaaagggattatgcaggccggaaagcggtctcttagacctcaacccacccagctcaaatatagctggaagacgtggggcaaggcgaaaatgctgtccaccgaaagccataaccagacattcctgatcgatgggcctgagaccgccgaatgccccaatacaaaccgcgcttggaactctctcgaggtggaggactacggatttggcgtcttcaccacaaacatctggctgaaacttcgggaaaaacaggacgtgttttgtgattccaagctgatgagcgccgctattaaagacaatagagccgttcacgcggatatgggctattggatcgagtctgccctcaacgacacctggaagatggaaaaggcttccttcattgaggtgaaaagctgccactggcctaagtctcatacgctgtggagcaatggggtcctggagtccgaaatgatcattcccaaaaacttcgccggaccggtgagccaacacaactaccgccctggctatcatacacagaccgctgggccctggcaccttggaaagctcgagatggattttgacttctgtgaaggcaccacagtggtcgttaccgaggattgcgggaatcggggaccctctctgagaacgacaaccgcctccggcaaactgatcacagaatggtgctgtcggagctgcaccctccctccgctgcgctacagaggcgaggacgggtgttggtacggaatggagattcggccccttaaggaaaaggaggaaaacctggtgaatagcctcgtgacagccggccatgggcagatcgataacttttctctgggagtcctgggcatggctcttttcctcgaggaaatgctgagaacccgcatcgggacgaaacacgcgattctgctcgtggccgttagctttgtgaccctgatcacaggaaatatgtccttccgggaccttggcagagtcatggtgatggttggcgctaccatgacagatgacattgggatgggagtgacctatctggccctcctggccgcttttaaggtccgccctacgttcgccgcgggcctgcttctgagaaaactcacatctaaggagctgatgatggctaccatcgggattgccctcctgagccaatccacaatccccgagaccatccttgaactgaccgatgccctcgctctgggaatgatggtgctgaaaattgttcggaacatggagaagtaccagcttgccgtgacaatcatggcgatttcttgcgtccctaatgctgtgatcctgcagaacgcctggaaggtgagctgtacgattctcgccgctgtctccgttagccccctgctcctgacctcttcccagcaaaaagccgactggatccctcttgctctgacaatcaagggcctcaatcccaccgccatttttctgacaaccctgagccgcacgtctaaaaagagatcctggccgcttaacgaagcgatcatggccgtggggatggtgagcattctggcttcttccctcctgaaaaatgacatccctatgacaggacccctcgtcgccggcggcctgcttaccgtgtgctatgttctgaccgggcggagcgctgatctggagctcgaacgcgccgccgacgtgaagtgggaggatcaggctgagatttccggaagctctcctatcctgagcattacaatctccgaagacggctctatgagcatcaaaaacgaggaagaggagcagacccttacaattctgatcagaacggggctcctggtcatttccggagtgttccccgtttctatcccgattaccgcggccgcttggtacctctgggaagtgaagaagcagcgggccggcgtcctgtgggatgtgccttctccccctcccgtcgagaaagccgaacttgaggacggggcttatcgcatcaagcaaagaggaatcctgggctactcccagattggcgccggggtgtataaagaaggaacatttcacaccatgtggcatgttacacggggcgcggtgctgatgcaccgcgggaagagaatcgagccctcctgggctgatgtcaaaaaggacctcattagctacggaggcgggtggaagctggagggagaatggaaagagggcgaagaggtgcaggttcttgccctggaacctggcaagaatccgcgggccgtgcagaccaaacccgggatcttcaagacgaacaccggaacaattggcgctgtctccctcgattttagccctgggacctctggatcccccatcgtggacagaaaaggcaaggtggttgggctgtacggaaatggcgtcgtgacacgcagcggcgcctatgtgtctgcgatcgctcaaaccgagaagtccattgaggataaccctgaaatcgaggacgatattttccggaaaaagagactcacaatcatggacctgcatcccggggccggaaaaacgaagcgctaccttcctgccattgtccgggaagctatcaaaagaggcctgcgcaccctgattctcgccccgacacgggtggttgctgccgagatggaagaggcgctgagagggcttcccatccgctatcagacccctgccatcaagaccgagcacacaggacgggaaattgtggacctgatgtgtcatgctacgttcaccatgagactcctgagccccgtccgggtgcctaactacaatctcatcattatggatgaggcccactttacagaccccgcttccatcgccgcccgcggctatatttctaccagagttgaaatgggggaggctgcgggcatcttcatgacagccaccccgcctggaagccgggatccctttccccagtccaacgctcctatcatggacgaggaacgcgagattcccgaaagaagctggaactctggccacgagtgggtgacggatttcaaggggaaaacagtctggtttgtgccttccatcaaggccggaaacgacattgccgcttgcctgcggaaaaatggcaagaaagttatccaacttagcagaaagaccttcgattctgaatacgtgaagacccgcgccaacgactgggattttgtcgtgacaaccgacattagcgagatgggggcgaatttcaaagctgagcgggtgatcgatccgagacgctgtatgaagcccgtcatcctgacagacggagaagaacgggttattctggccggccctatgcccgtgacccattcctctgccgctcagagacgcgggcggatcggcagaaaccctaaaaatgaaaacgaccagtatatttacatgggagagcccctcgaaaatgatgaggactgcgcccactggaaggaggcgaaaatgctgcttgataacatcaatacgccggaaggcattatccctagcatgtttgagcccgaacgcgagaaggtggacgccattgatggggaatacagactgcggggagaggctcgcaaaacattcgtcgacctcatgagacggggcgatctgcctgtgtggctggcctataaggttgctgccgaggggatcaactacgctgaccgcaagtggtgttttgatggaatcaaaaataaccagattctcgaagagaacatggaagtggagatctggaccaaggagggcgaacgcaagaaacttaaaccccggtggctggacgccagaatttattccgatcctctggcgctcaaggagttcaaggagttcgccgctgggcgcaaatctctgacacttaatctgatcaccgagatgggccggctccccacgtttatgacccaaaaggccagaaacgctctggacaatctggccgtcctccatacagccgaagctggaggccgcgcgtacaaccacgcccttagcgagctgccggagaccctggaaacactcctgcttctgaccctcctggctacagtgaccgggggaattttcctgtttctcatgtccggcaaagggatcggaaagatgacgcttggcatgtgctgcatcattacagccagcatcctgctgtggtatgcccagattcagcctcactggatcgctgcctctattatcctcgagttctttctgatcgttcttctgattcccgaacccgagaaacagcggacccctcaagataatcagctcacctacgtggtcatcgcgattctgacagtggtcgccgctaccatggccaacgaaatgggcttcctggagaagacaaagaaagacctcgggcttggatccatcacgacccaggagagcgaatccaatattctggacatcgatctgagaccggcttctgcctggacactctatgcggtggccaccacatttgttacccccatgctgcggcatagcattgagaactcctctgtgaatgtgagccttacggctatcgccaaccaggctaccgtcctgatgggcctcgggaagggatggcctctgtccaaaatggacatcggcgttcccctgctcgccattgggtgttacagccaagtgaatcctatcacacttaccgctgccctgctgctcctggtggcgcactacgccattatcggacccggccttcaggctaaggccacacgcgaagctcagaaaagagccgccgcgggcattatgaagaaccctaccgtcgatgggatcacggtgatcgacctggagccgattccctatgatcctaagttcgaaaaacagctcggacaagttatgctgctgatcctctgcgtgacacaggtccttatgatgcggaccacatgggctctgtgtgaggccctgaccctcgctaccggccccatttctacactgtgggaggggaatcctggacgcttttggaacacgaccatcgccgtgtccatggccaatattttcagaggcagctaccttgctggggccggactgctcttttctatcatgaagaacacaacctccacacggcgcggcaccggcaatatcggggaaacgctgggagagaaatggaaaagcagactgaacgcgctcggcaaatctgagttccagatttataagaaaagcgggatccaagaggtcgaccggacacttgccaaggagggaattaagcgcggcgaaaccgatcatcacgctgtgtccagagggtctgccaaactgcggtggtttgttgagagaaacatggtgacccccgaaggaaaggtcgtggacctgggctgcggccgcgggggatggagctactattgtggcgggctcaaaaatgttcgggaggtgaagggactgacaaaaggcgggccgggacatgaagaacctatccccatgtccacctacggctggaaccttgtcagactgcagagcggcgtggatgtgttcttcacaccccctgagaagtgcgacacgctcctgtgtgatattggggaatcctctcccaatcctaccatcgaggctggacgcacactgcgggttctcaaccttgtcgaaaattggctgaacaataacacccagttttgcatcaaggtgctgaatccgtatatgcccagcgtgattgagaaaatggaagccctccagagacaatacggcggggcgctggtccgcaaccctctttccagaaattctacacacgagatgtactgggttagcaacgccaccggaaatatcgtgtcctctgtgaacatgattagcagaatgctgatcaatcgcttcacgatgaagcacaaaaaggctacctatgagcccgacgtcgatctcggctccgggacacggaacattggaatcgaaagcgagattcctaacctggacatcatcggcaaaagaattgaaaagatcaagcaggagcatgaaatttcttggcactacgaccaggatcatccctataaaacctgggcctaccacggctcctatgagacaaagcagaccgggagcgcttcttccatggtgaatggagttgtgcgcctgctcacaaaaccgtgggacgtcgtgcctatggttacccaaatggccatgacggatacaaccccctttggccagcagcgggtgttcaaggagaaagtcgacaccagaacacaggaacctaaggaggggacgaagaaacttatgaagatcaccgctgaatggctgtggaaagagctgggaaagaaaaagacaccccgcatgtgtaccagagaggaatttaccaagaaggtgcggagcaacgccgcgctcggcgccattttcaccgatgagaataagtggaaatctgctcgcgaagccgtggaggacgggagattttgggaactggtcgatcgggagagaaaccttcacctggagggaaagtgcgaaacatgtgtttacaatatgatgggcaaacgggagaagaaactcggcgagttcgggaaggctaagggatcccgcgccatctggtatatgtggctgggcgccagatttctggagttcgaagcgctcgggtttctgaacgaggaccattggttcagccggggaaattcccttagcggcgtggagggggaaggcctgcaccgcctcggatacatcctgagagatgtgggcaaaaaggaagggggagctatgtacgccgacgataccgccggctgggacacgcggattacccttgaagacctgaaaaacgaggaaatggtcacaaatcatatgaagggggagcacaaaaagctcgctgaggccatctttaagctgacctatcaaaacaaagtggttcgcgtgcagagacctacaccccggggaaccgtcatggatattatctctcgcagagaccagcggggcagcgggcaagtgggcacgtacggactgaatacattcaccaacatggaagctcagctcattcgccagatggagggcgaagggatcttcaagtccatccagcatctgacagccaccgaggagattgcggttcaaaattggcttgccagagtgggacgggaacgcctgtctagaatggctatcagcggcgatgactgcgtcgtgaaaccgattgatgaccggtttgcctccgctctcacggccctgaacgatatggggaaggttagaaaagacatccagcagtgggagccttctcgcggatggaatgattggacccaggtgcccttctgcagccaccactttcatgaacttgtcatgaaggacggccgggtgctggtcgtgccctgtagaaaccaagatgagctcattgggcgcgcgcggatctcccagggcgccggatggtctctgaaggaaacagcttgcctgggcaaaagctatgcccagatgtggaccctcatgtacttccacagacgcgacctgcggcttgctgccaacgctatttgttccgccgttcctagccattgggtgccgacatctagaaccacatggtccatccacgcgaagcacgagtggatgaccacggaggatatgctggccgtctggaatcgcgtgtggatccaggaaaacccctggatggaggacaaaacacctgtggaaagctgggaggaagttccctatctcgggaagcgggaggaccaatggtgcggatctctgattggccttacctccagagctacctgggccaaaaatatccagacagccattaaccaggtgcgcagcctgatcgggaatgaggaatacaccgattatatgccttccatgaagcggtttagacgggaggaagaggaagctggagtcctctggtga

SEQ ID NO: 19752 - RNA, 9876 nt, synthetic construct
  misc_feature 1..9876: note = derived and/or modified CDS sequence (opt5) from DENV-2__EU482629__SS-prME
  source 1..9876: mol_type = other RNA
accgccggagtgatcgtgatgctgattcccacagctatggccttccacctcacgaccagaaatggggagcctcatatgatcgttggacggcaggaaaagggcaaaagcctgctttttaagaccgaggacggggtgaatatgtgcaccctgatggcgattgatctcggagaactgtgtgaggacacaatcacctacaaatgcccccttctgcgccaaaatgaacccgaggatattgactgttggtgcaatagcacatctacctgggtgacgtatggcacctgtacaaccacaggggagcacagacgggaaaagcgcagcgttgctctcgtgcctcatgttggaatgggcctggagaccagaacggaaacatggatgtcctctgagggcgcctggaaacacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaagaacaggacaaacgctttatctgcaagcattccatggtggatagaggctggggcaacgggtgtggactgttcggcaaaggcgggattgtcacatgcgccatgtttacgtgcaaaaagaatatggaagggaaaatcgttcagcctgagaacctcgaatacaccattgtgatcacaccccacagcggggaggagcatgcggtgggaaatgacaccggcaagcacggcaaagaaatcaagattacacctcagtcttccatcaccgaggccgaactgacggggtatggaaccgtcacaatggagtgtagcccccggaccggccttgatttcaacgaaatggtgctgctccaaatggaggacaaggcttggctggttcaccgccagtggtttcttgatctgccgctcccttggctgcccggggccgacacacagggatctaattggattcagaaggagaccctggtgacgttcaagaaccctcatgctaaaaagcaagacgtcgtggttctcggctcccaggaaggggccatgcacacagccctgaccggcgctacagagatccagatgagctccggaaatcttctgtttaccggccatctcaaatgcagactgcggatggataaacttcaactgaaagggatgtcttacagcatgtgtaccggaaagttcaagattgtgaaagaaatcgcggagacacagcacggcacgatcgtcattagagtgcagtatgagggggacggatccccctgcaagatccccttcgaaattaccgatctcgagaaacgccatgtcctgggccggctgatcacagtgaaccctattgttaccgaaaaggacagcccggtgaacatcgaggccgaacccccttttggggattcttacattatcatcggcgtcgagcccggacagctcaaactgaattggttcaagaagggctccagcattgggcaaatgtttgagacaaccatgagaggagctaaacgcatggccatccttggcgacacggcctgggatttcgggtctctgggaggcgtgtttacaagcattgggaaggctctccaccaggttttcggcgccatctacggagcggctttttccggcgtgtcttggaccatgaaaattctgatcggggtcatcattacctggatcggaatgaacagccggtccacaagcctgtctgtgtcccttgtgctcgttggcgtcgtgaccctgtatctgggggccatggtgcaggccgacagcggatgtgtcgtgtcttggaagaataaagaactcaagtgcggctccgggattttcatcacagataacgttcacacgtggaccgagcagtacaagtttcaacctgaaagcccctccaaactggcttctgccattcagaaggctcatgaggaaggcatctgtggaatcagaagcgtgacacgccttgagaatctgatgtggaaacagattaccccggagctcaaccacatcctgtccgaaaatgaggtcaagctgacaattatgaccggcgacatccgggggattatgcaggccggaaaaagatctcttcgccctcaacccacggaactcaagtatagctggaaaacctggggcaaggcgaagatgctgtccacagagagccataaccagaccttcctgatcgatgggcctgaaacagccgagtgccccaataccaaccgggcttggaactctctcgaggtggaagactacggatttggcgttttcacaaccaacatctggctgaaacttagagagaagcaggacgtgttttgtgattccaaactgatgagcgccgctattaaggacaatcgcgccgtccacgcggatatgggctattggatcgaatctgccctcaacgacacgtggaaaatggagaaggcttccttcattgaggtcaagagctgccactggcctaaatctcatacactgtggagcaatggggttctggaatccgagatgatcattcccaagaacttcgccggaccggtgagccagcacaactaccggcctggctatcatacccaaaccgctgggccctggcaccttggaaaactcgaaatggattttgacctgtgtgagggcacaaccgtcgtggtgacggaagattgcgggaatagaggaccctctctgcggacaaccacagcctccggcaagctcatcaccgagtggtgctgtcgcagctgcacactgcctccgcttagataccggggcgaggacgggtgttggtacggaatggaaattagacccctgaaagagaaggaagagaacctcgtcaattccctggttaccgccggccatgggcagatcgataacttctctctgggagtgcttggcatggctctctttctggaagagatgctgcgcacgcggatcgggaccaagcacgcgattctcctggtggccgtcagcttcgtgacacttatcaccggaaatatgtcctttaaagacctgggcagagttatggtgatgatgggcgctacaatgaccgatgacattgggatgggagtcacgtatctcgccctgctggccgctttcaaggtgcgccctacatttgccgcgggccttctgctcagaaaactgacctctaaggagctcatgatggctacaatcgggattgccctgcttagccagtccaccatccccgaaaccatcctggagctcacagatgccctggctctgggaatgatggttcttaaaattgtgcggaacatggaaaagtaccaactggccgtcacgatcatggcgatttcttgcgtgcctaatgctgttatcctccagaacgcctggaaggtgagctgtaccattctggccgctgtctccgtgagccccctcctgcttacatcttcccagcagaaagccgactggatccctctggctctcaccatcaagggcctgaatcccacagccattttcctgaccacgcttagccgcacatctaaaaagagatcctggccgctgaacgaggcgatcatggccgtggggatggtcagcattctcgcttcttccctgctcaaaaatgacatccctatgaccggacccctggttgccggcggccttctgaccgtgtgctatgtgctgacagggcggagcgctgatctcgaactggagcgcgccgccgacgtcaagtgggaggatcaagctgaaatttccggaagctctcctatccttagcattaccatctccgaggacggctctatgagcatcaaaaacgaagaggaggaacagacactgacgattctcatcagaaccgggctgctcgtgatttccggagtttttcccgtgtctatcccgattacagcggccgcttggtacctgtgggaggtcaagaagcagcgggccggcgtgctttgggatgttccttctccccctcccgtggaaaaagccgagctggaagacggggcttatcgcatcaagcagagaggaatcctgggctactcccaaattggcgccggggtctataaagagggaaccttccacacaatgtggcatgtgacccggggcgcggtcctcatgcaccgcgggaagagaatcgagccctcctgggctgatgtgaaaaaggacctgattagctacggaggcgggtggaaacttgaaggagagtggaaagaaggcgaggaagttcaggtgctggccctcgagcctggcaagaatccgcgggccgtccagacgaaacccgggatctttaagaccaacacaggaaccattggcgctgtgtccctggatttcagccctgggacatctggatcccccatcgttgacagaaaaggcaaggtggtcgggctctacggaaatggcgtggtgacccgcagcggcgcctatgtttctgcgatcgctcagacagagaagtccattgaagataaccctgagatcgaagacgatatttttcggaaaaagagactgacgatcatggaccttcatcccggggccggaaaaaccaagcgctacctgcctgccattgtccgggaggctatcaaaagaggcctgcgcacactcattctggccccgacccgggtggtggctgccgaaatggaggaggcgcttagagggctgcccatccgctatcaaaccacagccatcaagacggaacacaccggacgggagattgtcgacctcatgtgtcatgctacattcaccatgagactgctcagccctgtgcgggttcccaactacaatctgatcattatggatgaagcccacttcacagaccctgcttccatcgccgcccgcggctatatttctaccagagtggagatgggggaggctgcgggcatctttatgacggccacacccccgggaagccgggatcctttcccccagtccaacgctcccatcatggacgaagagagagaaattcctgagagaagctggaactctggccacgaatgggtcaccgattttaaggggaaaaccgtgtggttcgttccctccatcaaggccggaaacgacattgccgcttgccttcggaaaaatggcaagaaagtgatccagctgagcagaaagacatttgattctgagtacgtcaagacccgcgccaacgactgggatttcgtggttacaaccgacattagcgagatgggggcgaattttaaagctgaacgggtgatcgatcctagacgctgtatgaagccggtcatcctgacggacggagaggaacgggtgattctcgccggccccatgcctgtgacacattcctctgccgctcaaagacgcgggcggatcggcagaaaccccaaaaatgagaacgaccagtatatttacatgggagaacctctggagaatgatgaggactgcgcccactggaaggaagcgaaaatgcttctggataacatcaatacccccgagggcattatcccgagcatgttcgaacctgagcgcgaaaaggtcgacgccattgatggggagtacagactccggggagaggctcgcaaaacatttgttgacctgatgagacggggcgatctgcccgtgtggctcgcctataaggtggctgccgaagggatcaactacgctgaccgcaagtggtgtttcgatggaatcaaaaataaccagattcttgaggaaaacatggaggtcgagatctggaccaaggaaggcgagcgcaagaagctgaaacctcggtggctggacgccagaatttattccgatcccctcgcgctgaaggaatttaaggagttcgccgctgggcgcaaatctcttacgctgaatctcatcaccgaaatgggccggctgcctacattcatgacccagaaggccagaaacgctctggacaatctcgccgtgcttcatacagccgaggctggaggccgcgcgtacaaccacgccctgagcgagctgcccgaaaccctcgagacactgcttctgctcaccctgctggctacggttacagggggaatttttctcttccttatgtccggcaaagggatcggaaagatgaccctgggcatgtgctgcatcattaccgccagcatcctgctctggtatgcccaaattcagccgcactggatcgctgcctctattatcctggaatttttccttatcgtgctgctcattcctgagcccgaaaaacagcggacaccccaggataatcaactgacctacgtcgtgatcgcgattctgacagttgtggccgctacgatggccaacgagatgggctttctcgagaagaccaagaaagaccttgggctgggatccatcacaacccaggaaagcgagtccaatattctggacatcgatctcagacctgcttctgcctggacactgtatgcggtcgccaccacgttcattaccccgatgcttcggcatagcatcgaaaactcctctgtgaatgtcagcctgacagctatcgccaaccaggctaccgtgctcatgggcctggggaagggatggcccctgtccaaaatggacattggcgttcctctccttgccatcgggtgttacagccaggtgaatcccattacactgaccgctgccctgctcctgcttgtggcgcactacgccatcattggacctggcctgcaagctaaggccacgcgcgaggctcagaaaagagccgccgcgggcatcatgaagaaccccacagtcgatgggatcaccgttattgacctcgaacctatcccgtatgatcccaagtttgagaaacagctgggacaggtgatgctgctcattctttgcgtgacacaagtcctgatgatgcggaccacctgggctctgtgtgaggccctcacactggctacgggccctatctctaccctttgggaagggaatcccggacgcttctggaacacaaccattgccgtgtccatggccaatatctttagaggcagctacctggctggggccggactcctgttctctatcatgaagaacacaaccaatacgcggcgcggcacaggcaacattggggagaccctgggagaaaaatggaagtccagactcaacgcgcttggcaaaagcgagtttcagatctataagaaatctgggattcaggaggttgaccggaccctggccaaggaaggaatcaagcgcggcgagacagatcatcacgctgtgagcagagggtccgccaaactgcggtggttcgtcgaaagaaatatggtgacccctgagggaaaggtcgtggacctcggctgcggccgcgggggatggtcttactattgtggcgggctgaaaaacgttcgggaagtgaagggacttacaaaaggcgggcccggacatgaggagccgattcctatgagcacgtacggctggaatctggtcagactccaatccggcgtggatgtctttttcacaccgcccgaaaagtgcgacacactgctgtgtgatatcggggagagctcccctaaccccaccatcgaagctggacgcacactccgggtgcttaatctggtcgagaactggctgaataacaatacccagttctgcattaaggtgctcaacccttatatgccgtctgtgatcgagaagatggaggccctgcagagaaagtacggcggggcgcttgttcgcaatcccctgagccggaactccacgcacgagatgtactgggtctctaatgccaccggaaacattgtgagctccgtgaatatgatctctagaatgctcattaaccgctttacaatgaaacacaagaaagctacctatgaacctgacgtcgatctgggcagcgggacacggaacatcggaattgagtccgaaatccccaatctggacatcattggcaagagaatcgagaagattaaacaggaacatgagaccagctggcactacgaccaagatcatccttataagacatgggcctaccacggctcttatgagaccaaacagacggggtccgctagctctatggttaacggagtggtgcgcctccttacaaagccctgggacgtcgtgccgatggttacccagatggccatgaccgatacaacgcctttcggccagcaacgggtgtttaaagaaaaggtcgacaccagaacacaggagcccaaggaagggaccaaaaagctgatgaaaatcacagctgagtggctgtggaaggagctcggcaaaaagaaaacccctcgcatgtgtacaagagaagagttcacccggaaggtgcgctccaatgccgcgctgggcgccatttttacggatgaaaacaagtggaaaagcgctagagaggccgttgaagacgggcggttctgggagcttgtggatagagagcggaatctgcacctcgaaggaaagtgcgagacctgtgtctacaacatgatgggcaaacgcgaaaagaaactgggcgagtttgggaaggctaagggatctagagccatctggtatatgtggctgggcgcccggttcctcgaatttgaggcgctggggttccttaatgaggaccattggttttcccgcggaaacagcctgtccggcgtggaaggggagggcctccacagactgggatacatccttcgggatgtgggcaaaaaggaagggggagctatgtacgccgacgatacagccggctgggacacccgcattacactggaggacctcaaaaatgaagagatggtcaccaaccatatgaagggggagcacaaaaagctggctgaagccatcttcaagctgacgtatcagaataaagttgtgagagtgcagcggcccacacctcgcggaaccgtcatggatattatcagcagacgggaccaacgcggctctggacaggtgggcacatacggactcaacacctttacgaatatggaggctcagctgattagacaaatggaaggcgaggggatcttcaagagcatccagcatcttaccgccacagaggaaattgcggttcagaactggctggcccgggtgggacgcgagagactctcccggatggctatctctggcgatgactgcgtcgtgaaacccattgatgacagattcgccagcgctctgaccgcccttaatgatatggggaagatccgcaaagacattcagcaatgggaaccgtcccggggatggaacgattggacacaggttcctttttgctctcaccacttccatgagctggtgatgaaggacggcagagtcctcgtggttccctgtcgcaaccaggatgaactgatcgggcgggcgagaattagccagggcgccggatggtccctgaaggagaccgcttgcctcggcaaatcttatgcccaaatgtggacactgatgtactttcaccgccgggaccttagactggctgccaatgctatctgtagcgccgtgccctcccattgggtccctaccagccgcacgacatggtctatccacgcgaagcacgagtggatgaccaccgaagatatgctcgccgtgtggaaccgggtctggattcaggagaatccgtggatggaagacaaaacacccgtggagtcctgggaagaggttccttatctggggaagagagaggaccagtggtgcggaagccttatcggcctgacctctcgcgctacatgggccaaaaacattcagacggccatcaatcaagtgcggtccctcattgggaacgaagagtacaccgattatatgcccagcatgaagagattccggagagaagaggaagaggctggagtcctgtggtga

SEQ ID NO: 19753 - RNA, 9876 nt, synthetic construct
  misc_feature 1..9876: note = derived and/or modified CDS sequence (opt5) from DENV-2__FJ390390__SS-prME
  source 1..9876: mol_type = other RNA
accgccggagtgatcgtcatgctgattcccacagctatggccttccacctcacgaccagaaatggggagcctcatatgatcgttggacggcaggaaaagggaaaaagcctgctttttaagacagaggacggggtgaatatgtgcaccctgatggcgattgatctcggagaactgtgtgaggacacaatcacctacaaatgcccgcttctgagacaaaatgaacccgaggatattgactgttggtgcaatagcacatctacctgggtgacgtatggcacctgtacaaccacaggggagcacagacgggaaaagagaagcgtcgctctcgtgcctcatgttggaatgggcctggagaccagaacggaaacatggatgtcctctgagggcgcctggaaacacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaggaacaggacaaacgctttatctgcaagcattccatggtggatagaggctggggcaacgggtgtggactgttcggcaaaggcgggattgtcacatgcgccaaatttacgtgcaagaaaaatatggaagggaaggttgtgcagcctgagaacctcgaatacaccatcgtgattacaccccacagcggggaggagcatgcggtcggaaatgacaccggcaaacacggcaaggaaatcaaaatcacacctcagtcttccattaccgaggccgaactgacggggtatggaaccgtgacaatggagtgtagcccccggaccggccttgatttcaacgaaatggttctgctccaaatggaggacaaggcttggctggtgcaccgccagtggtttcttgatctgccgctcccttggctgcccggggccgacacacagggatctaattggatccagaaggagaccctggtcacgttcaaaaaccctcatgctaagaaacaagacgtggttgtgctcggctcccaggaaggggccatgcacacagccctgaccggcgctacagagattcagatgagctccggaaatcttctgtttaccggccatctcaagtgcagactgcggatggataaacttcaactgaaggggatgtcttacagcatgtgtaccggaaagttcaaaatcgtcaaggaaattgcggagacacagcacggcacgatcgtgatcagagtccagtatgagggggacggatccccctgcaaaattcccttcgaaatcaccgatctcgagaagcgccatgtgctgggccggctgattacagttaaccctatcgtgaccgaaaaagacagcccggtcaacattgaggccgaacccccttttggggattcttacatcattatcggcgtggagcccggacagctcaagctgaattggttcaagaaaggctccagcatcgggcaaatgtttgagacaaccatgagaggagctaagcgcatggccattcttggcgacacggcctgggatttcgggtctctgggaggcgtttttacaagcatcgggaaagctctccaccaggtgttcggcgccatttacggagcggctttttccggcgtctcttggaccatgaagatcctgattggggtgatcatcacctggattggaatgaacagccggtccacaagcctgtctgtgtcccttgttctcgtcggcgtggtgaccctgtatctgggggccatggtccaggccgacagcggatgtgtggtttcttggaaaaataaggaactcaagtgcggctccgggatcttcattacagataacgtgcacacgtggaccgagcagtacaaatttcaacctgaaagcccctccaagctggcttctgccatccagaaagctcatgaggaaggcatttgtggaatcagaagcgtcacacgccttgagaatctgatgtggaagcagatcaccccggagctcaaccacattctgtccgaaaatgaggtgaaactgacaatcatgaccggcgacattcgggggatcatgcaggccggaaagagatctcttcgccctcaacccacggaactcaaatatagctggaagacctggggcaaggcgaaaatgctgtccacagagagccataaccagaccttcctgattgatgggcctgaaacagccgagtgccccaataccaaccgggcttggaactctctcgaggttgaagactacggatttggcgtgttcacaaccaacatctggctgaaacttagagacaaacaggatgtcttttgtgactccaagctgatgagcgccgctatcaaagataatcgcgccgtgcacgcggacatgggctattggattgagtctgccctcaacgatacgtggaagatggaaaaggcttccttcatcgaggttaaaagctgccactggcctaagtctcatacactgtggagcaatggggtgctggagtccgaaatgattatccccaaaaacttcgccggaccggtcagccagcacaactaccggcctggctatcatacccaaaccgctgggccctggcaccttggaaagctcgagatggactttgatctgtgtgaaggcacaaccgtggtggtcacggaggactgcgggaatagaggaccctctctgcggacaaccacagcctccggcaaactcattaccgaatggtgctgtcgcagctgcacactgcctccgcttagataccggggcgaggatgggtgttggtacggaatggagatcagacccctgaaggaaaaggaggaaaacctcgttaattccctggtgaccgccggccatgggcagattgacaacttctctctgggagtgcttggcatggctctcctgctggaggaaatgctccgcacgcggatcgggaccaaacacgcgatcctgcttgtcgccgtgagctttgttacactgattaccggaaatatgtccttcagagatctcggccgcgtgatggtcatggtgggcgctacaatgaccgacgatatcgggatgggagttacgtatctggccctgcttgccgcttttaaggtgagacctacattcgccgcgggcctgctcctgcggaaactcacctctaaggagctgatgatggctacaattgggatcgcccttctgagccagtccaccattcccgagaccatcctcgaactgacagacgccctggctcttggaatgatggtcctgaaaatcgtgcgcaacatggagaagtaccaactcgccgttacggtgatggcgatttcttgcgtccctaatgctgtgatcctgcagaacgcctggaaggtgagctgtaccattctcgccgctgtctccgttagccccctgcttctgacatcttcccagcagaaagccgactggatccctctcgctctgaccattaagggcctgaatcccacagccatctttcttaccacgctgagcagaacatctaaaaagcggtcctggccgctcaacgaagcgatcatggccgtggggatggtgagcattctggcttcttccctcctgaaaaatgatatccctatgaccggaccccttgtcgccggcggcctgctgaccgtgtgctatgttctcacagggcgcagcgctgacctggagcttgaaagagccgccgatgtgaagtgggaggaccaagctgagatttccggaagctctcctatcctgagcattaccatctccgaagatggctctatgagcattaaaaacgaggaagaggagcagacactcacgatcctgatccggaccgggctcctggtcatttccggagtgttccccgtttctatcccgattacagcggccgcttggtacctttgggaagtgaagaagcagcgcgccggcgtcctgtgggacgtgccttctccccctcccgtcgagaaagccgaactggaggatggggcttatagaatcaagcagcggggcattctcggctactcccaaatcggcgccggggtgtataaagaaggaacctttcacacaatgtggcatgttacccgcggcgcggtgctgatgcacagagggaagcggatcgagccctcctgggctgacgtcaaaaaggatcttattagctacggaggcgggtggaagctggagggagaatggaaagagggcgaagaggtgcaggttctcgccctggaacctggcaagaatccgagagccgtgcagacgaaacccgggatcttcaagaccaacacaggaaccattggcgctgtctccctcgactttagccctgggacatctggatcccccatcgtggatcgcaaaggcaaggtggttgggctgtacggaaatggcgtcgtgacccggagcggcgcctatgtgtctgcgattgctcagacagagaagtccatcgaggacaaccctgaaatcgaggatgacattttccgcaagaagcgccttacgatcatggacctgcatcccggggccggaaaaaccaagcggtacctgcctgccattgtcagagaagctatcaaacgcggcctccggacactgattcttgccccgaccagagtggttgctgccgagatggaagaggcgctgcgcgggctccccatccggtatcaaaccacagccattaagacggagcacaccggaagagaaatcgtggatctgatgtgtcatgctacatttaccatgcggctcctgagccctgtccgcgtgcccaactacaatcttatcattatggacgaggcccacttcacagatcctgcttccatcgccgccagaggctatatttctacccgggttgaaatgggggaggctgcgggcatcttcatgacggccacacccccgggaagccgcgacccttttccccagtccaacgctcccattatggatgaggaaagagagatccctgaacggagctggaactctggccacgagtgggtgaccgacttcaaggggaaaaccgtctggtttgtgccctccatcaaggccggaaacgatattgccgcttgcctgcgcaagaatggcaagaaagttatccagctgagccgcaagacattcgactctgaatacgtgaagacccgggccaacgattgggactttgtcgtgacaaccgatattagcgagatgggggcgaatttcaaagctgagagagtgatcgaccctcgccggtgtatgaagccggtcattctcacggacggagaagagagagttatcctggccggccccatgcctgtgacacattcctctgccgctcaacgccgggggagaatcggccgcaaccccaaaaatgaaaacgatcagtatatttacatgggagagcctcttgaaaatgacgaggattgcgcccactggaaggaggcgaaaatgctgctcgacaacatcaatacccccgaaggcattatcccgagcatgtttgagcctgaaagagagaaggtggatgccattgacggggaataccggctgcgcggagaggctagaaaaacattcgtcgatctgatgcggcgcggcgacctccccgtgtggcttgcctataaggttgctgccgaggggatcaactacgctgatagaaagtggtgttttgacggaattaaaaataaccagatcctggaagagaacatggaagtggagatctggaccaaggagggcgaacggaaaaagctgaaacctagatggctcgatgcccgcatttattccgaccccctggcgcttaaggagttcaaggaatttgccgctgggcggaaatctctgacgctcaatctgatcaccgagatgggcagactgcctacattcatgacccagaaggcccgcaacgctctcgataatcttgccgtcctgcatacagccgaagctggaggccgggcgtacaaccacgccctgagcgagctccccgagaccctggaaacacttctgctcctgaccctgctcgctacggtgacagggggaattttcctttttctgatgtccggcaaagggatcggaaagatgaccctgggcatgtgctgcattatcaccgccagcatcctcctgtggtatgcccaaattcagccgcactggatcgctgcctctattatccttgagttctttctgattgttctcctgatccctgaacccgagaaacagagaacaccccaggacaatcaactgacctacgtggtcatcgcgattctcacagtggtcgccgctacgatggccaacgaaatgggcttccttgagaagaccaagaaagacctggggctgggatccatcacaacccaggagagcgaatccaatattctcgatatcgacctgcggcctgcttctgcctggacactttatgcggtggccaccacgtttgttaccccgatgctgcgccatagcattgagaactcctctgtgaatgtgagcctcacagctatcgccaaccaggctaccgtcctgatgggcctggggaagggatggcccctctccaaaatggatattggcgttcctcttctggccatcgggtgttacagccaggtgaatcccatcacactgaccgctgccctcctgcttctggtggcgcactacgccattatcggacctggcctccaagctaaggccacgagagaagctcagaaacgggccgccgcgggcattatgaagaaccccacagtcgacgggatcaccgtgattgatctggagcctatcccgtatgaccccaagttcgaaaaacagctgggacaggttatgctccttatcctgtgcgtgacacaagtcctgatgatgcgcaccacctgggctctctgtgaggccctgacacttgctacgggccctatttctaccctgtgggaggggaatcccggaagattttggaacacaaccatcgccgtgtccatggccaatattttccggggcagctacctcgctggggccggactgctgttttctatcatgaagaacacaaccaatacgcgcagaggcacaggcaacattggggaaaccctcggagagaaatggaagtcccggcttaacgcgctgggcaaaagcgagttccagatctataagaaatctgggatccaggaggtcgatcgcaccctggccaaggagggaattaagagaggcgaaacagaccatcacgctgtgagccgggggtccgccaaactcagatggtttgttgagcgcaatatggtgacccctgaaggaaaggtcgtggatctgggctgcggcagagggggatggtcttactattgtggcgggcttaaaaacgttcgggaggtgaagggactgacaaaaggcgggcccggacatgaagaaccgatccctatgagcacgtacggctggaatctcgtccgcctgcaatccggcgtggacgtgttctttacccctcccgagaagtgcgatacactgctctgtgacattggggaaagctcccccaaccccaccatcgaggctggacggacacttagagttctgaatctggtcgaaaactggctcaataacaatacccagttctgcattaaggtgctgaacccttatatgccgtctgtgatcgagaaaatggaagcccttcagcgcaagtacggcggggcgctggtccggaatcccctcagcagaaactccacgcacgagatgtactgggtttctaatgccaccggaaacatcgtgagctccgtgaatatgatttctcgcatgctgatcaaccggttcacaatgaaacacaagaaagctacctatgagcctgatgtcgacctgggcagcgggacaagaaacattggaatcgaatccgagattcccaatctcgacatcattggcaagcgcatcgaaaagatcaaacaggagcatgaaaccagctggcactacgatcaagaccatccttataagacatgggcctaccacggctcttatgagaccaaacagacggggtccgctagctctatggtgaacggagttgtgcggcttctgacaaagccctgggatgtcgtgccgatggttacccagatggccatgaccgacacaacgccttttggccagcaaagagtgttcaaagagaaggtcgatacccgcacacaggaacccaaggaggggaccaaaaagctgatgaaaattacagctgaatggctctggaaggagctgggcaaaaagaaaacccctagaatgtgtacacgggaggaatttacccgcaaggtgagatccaatgccgcgcttggcgccatcttcacggacgagaacaagtggaaaagcgctcgggaagccgtggaggatgggagattttgggaactggtcgaccgggagcgcaatctccacctggagggaaagtgcgaaacctgtgtttacaacatgatgggcaaaagagagaagaaactgggcgagttcgggaaggctaagggatctcgggccatttggtatatgtggctcggcgcccgctttctggagttcgaagcgcttgggtttctgaatgaggatcattggttctccagaggaaacagcctctccggcgtggagggggaaggcctgcaccggcttggatacatcctgcgcgacgtgggcaaaaaggaagggggagctatgtacgccgatgacacagccggctgggacaccagaattacactcgaagatctgaaaaatgaggaaatggtcaccaaccatatgaagggggagcacaaaaagctggctgaggccatctttaagctcacgtatcagaataaagtggttcgggtgcagcgccccacacctagaggaaccgtcatggacatcattagccggcgcgatcaaagaggctctggacaggtgggcacatacggactgaacaccttcacgaatatggaagctcagcttatccggcaaatggagggcgaagggatttttaagagcatccagcatctgaccgccacagaggagattgcggttcagaactggctcgcccgcgtgggaagagaacggctgtccagaatggctatctctggcgacgattgcgtcgtgaaacccatcgacgatcgcttcgccagcgctcttaccgccctgaatgacatggggaaggttcggaaagatattcagcaatgggagccgtccagaggatggaacgactggacacaggtgcctttctgctctcaccactttcatgaactcgtcatgaaggatggccgcgtgctggtcgtgccctgtcggaaccaggacgagctgatcgggagagcgcgcattagccagggcgccggatggtccctcaaggaaaccgcttgcctgggcaaatcttatgcccaaatgtggacacttatgtacttccaccggagagatctgcgcctcgctgccaatgctatctgtagcgccgttccctcccattgggtgcctaccagccggacgacatggtctattcacgcgaagcacgagtggatgaccaccgaggacatgctggccgtctggaacagagtgtggatccaggaaaatccgtggatggaggacaaaacacccgtggaatcctgggaggaagttccttatcttgggaagcgcgaggatcagtggtgcggaagcctgattggcctcacctctcgggctacatgggccaaaaacatccagacggccatcaatcaagtgagatccctgattgggaacgaggaatacaccgactatatgcccagcatgaagcggtttagacgcgaggaagaggaagctggagtcctgtggtga

SEQ ID NO: 19754 - RNA, 9876 nt, synthetic construct
  misc_feature 1..9876: note = derived and/or modified CDS sequence (opt5) from DENV-2__FJ390391__SS-prME
  source 1..9876: mol_type = other RNA
accgccggcgtgatcgtcatgctgattcccaccgctatggccttccacctcacgacccggaatggggagcctcatatgatcgttggacggcaggaaaagggcaagagcctgctttttaagaccgaggacggggtgaatatgtgcaccctgatggcgattgatctcggagaactgtgtgaggacacgatcacctacaaatgcccgcttctgcgccaaaatgaacccgaggatattgactgttggtgcaattccacatctacctgggtgacgtatggcacctgtacaaccacaggggagcacagacgggaaaagcgcagcgtcgctctcgtgcctcatgttggaatgggcctggagaccagaacggaaacatggatgtcctctgagggcgcctggaaacacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaagaacaggacaaacgctttatctgcaagcattccatggtggatagaggctggggcaacgggtgtggactgttcggcaaaggcgggattgtcacatgcgccatgtttacgtgcaaaaagaatatggaagggaaagttgtgcagcctgagaacctcgaatacaccatcgtgattacaccccacagcggggaggagcatgcggtcggaaatgacaccggcaagcacggcaaagaaatcaagatcacacctcagtcttccattaccgaggccgaactgacggggtatggaaccgtgacaatggagtgtagcccccggaccggccttgatttcaacgaaatggttctgctccaaatggaggacaaggcttggctggtgcaccgccagtggtttcttgatctgccgctcccttggctgcccggggccgacacacagggatctaattggatccagaaggagaccctggtcacgttcaagaaccctcatgctaaaaagcaagacgtggttgtgctcggctcccaggaaggggccatgcacacagccctgaccggcgctacagagattcagatgagctccggaaatcttctgtttaccggccatctcaaatgcagactgcggatggataaacttcaactgaaagggatgtcttacagcatgtgtaccggaaagttcaagatcgtcaaagaaattgcggagacacagcacggcacgatcgtgatcagagtccagtatgagggggacggatccccctgcaagattcccttcgaaatcaccgatctcgagaaacgccatgtgctgggccggctgattacagttaaccctatcgtgaccgaaaaggacagcccggtcaacattgaggccgaacccccttttggggattcttacatcattatcggcgtggagcccggacagctcaaactgaattggttcaagaagggctccagcatcgggcaaatgtttgagacaaccatgagaggagctaaacgcatggccattcttggcgacacggcctgggatttcgggtctctgggaggcgtttttacaagcatcgggaaggctctccaccaggtgttcggcgccatttacggagcggctttttccggcgtctcttggaccatgaaaatcctgattggggtgatcatcacctggattggaatgaacagccggtccacaagcctgtctgtgtcccttgttctcgtcggcgtggtgaccctgtatctgggggccgtcgtgcaggccgacagcggatgtgttgtgtcttggaagaataaagaactcaagtgcggctccgggatcttcattacagataacgtccacacgtggaccgagcagtacaagtttcaacctgaaagcccctccaaactggcttctgccatccagaaggctcatgaggaaggcatttgtggaatcagaagcgtgacacgccttgagaatctgatgtggaaacagatcaccccggagctcaaccacattctgtccgaaaatgaggttaagctgacaatcatgaccggcgacattaaagggatcatgcaggccggaaagcggtctcttagacctcaacccacggaactcaaatatagctggaagacctggggcaaggcgaaaatgctgtccacagagagccataaccagaccttcctgattgatgggcctgaaacagccgagtgccccaataccaaccgcgcttggaactctctcgaggtggaagactacggatttggcgtcttcacaaccaacatctggctgaaacttcgggagaaacaggacgtgttttgtgattccaagctgatgagcgccgctatcaaagacaatagagccgttcacgcggatatgggctattggattgaatctgccctcaacgacacgtggaagatggagaaggcttccttcatcgaggtgaaaagctgccactggcctaagtctcatacactgtggagcaatggggtcctggaatccgagatgattatccccaaaaacttcgccggaccggtgagccagcacaactaccgccctggctatcatacccaaaccgctgggccctggcaccttggaaagctcgaaatggattttgacttctgtgagggcacaaccgtggtcgttacggaagattgcgggaatcggggaccctctctgagaacaaccacagcctccggcaaactgattaccgagtggtgctgtcggagctgcacactccctccgctgcgctacagaggcgaggacgggtgttggtacggaatggaaatccggccccttaaggagaaggaagagaacctggtgaatagcctcgtgaccgccggccatgggcagattgataacttttctctgggagtcctgggcatggctcttttcctcgaagagatgctgagaacgcgcatcgggaccaaacacgcgatcctgctcgtggccgttagctttgtgacactgattaccggaaatatgtccttccgggaccttggcagagtcatggtgatggttggcgctacaatgaccgatgacatcgggatgggagtgacgtatctggccctcctggccgcttttaaggtccgccctacattcgccgcgggcctgcttctgagaaaactcacctctaaggagctgatgatggctacaattgggatcgccctcctgagccagtccaccattcccgaaaccatctttgagcttacagatgccctggctctcggaatgatggtgctgaaaatcgttcggaacatggaaaagtaccaactggccgtgacgattatggcgatctcttgcgtccctaatgctgtgattcttcagaacgcctggaaggtgagctgtaccatcctggccgctgtctccgttagccccctcctgctcacatcttcccagcagaaagccgactggattcctctggctcttaccatcaagggcctgaatcccacagccatcttcctcaccacgctgagccgcacatctaaaaagagatcctggccgctgaacgaggcgattatggccgtggggatggtgagcatccttgcttcttccctgctcaaaaatgacattcctatgaccggacccctggtcgccggcggcctcctgaccgtgtgctatgttcttacagggcggagcgctgatctggaactggagcgcgccgccgacgtgaagtgggaggatcaagctgaaatctccggaagctctcctattctcagcatcaccatttccgaggacggctctatgagcatcaaaaacgaagaggaggaacagacactgacgatccttattagaaccgggctgctcgtcatctccggagtgtttcccgtttctattccgatcacagcggccgcttggtacctgtgggaggtgaagaagcagcgggccggcgtcctctgggatgtgccttctccccctcccgtcgaaaaagccgagctggaagacggggcttatcgcattaagcagagaggaatccttggctactcccaaatcggcgccggggtgtataaagagggaaccttccacacaatgtggcatgttacccggggcgcggtgctgatgcaccgcgggaagagaattgagccctcctgggctgatgtcaaaaaggacctgatcagctacggaggcgggtggaagctcgaaggagagtggaaagaaggcgaggaagtgcaggttctggcccttgagcctggcaagaatccgcgggccgtgcagacgaaacccgggatttttaagaccaacacaggaaccatcggcgctgtctccctggatttcagccctgggacatctggatcccccattgtggacagaaaaggcaaggtggttgggctctacggaaatggcgtcgtgacccgcagcggcgcctatgtgtctgcgatcgctcagacagagaagtccatcgaagataaccctgagattgaagacgatatcttccggaaaaagagactgacgattatggacctccatcccggggccggaaaaaccaagcgctacctgcctgccatcgtccgggaggctattaaaagaggccttcgcacactgatcctggccccgacccgggtggttgctgccgaaatggaggaggcgctcagagggctgcccattcgctatcaaacccctgccatcaagacagaacacacgggacgggagatcgtggaccttatgtgtcatgctacctttacaatgagactgctcagccccgtccgggtgcctaactacaatctgattatcatggatgaagcccacttcaccgaccccgcttccattgccgcccgcggctatatctctacaagagttgagatgggggaggctgcgggcatttttatgaccgccacgccgcctggaagccgggatcccttcccccagtccaacgctcctatcatggacgaagaaagagaaatccccgagagaagctggaactctggccacgaatgggtgacagattttaaggggaaaaccgtctggttcgtgccttccattaaggccggaaacgacatcgccgcttgcctccggaaaaatggcaagaaagttattcagctgagcagaaagacctttgattctgagtacgtgaagacacgcgccaacgactgggatttcgtcgtgaccacagacatcagcgagatgggggcgaattttaaagctgaacgggtgattgatccgagacgctgtatgaagcccgtcatccttaccgacggagaggaacgggttatcctggccggccctatgcccgtgacgcattcctctgccgctcaaagacgcgggcggattggcagaaaccctaaaaatgagaacgaccagtatatctacatgggagaacccctggagaatgatgaggactgcgcccactggaaggaagcgaaaatgctcctggataacattaatacaccggagggcatcattcctagcatgttcgaacccgagcgcgaaaaggtggacgccatcgatggggagtacagacttcggggagaggctcgcaaaacctttgtcgacctgatgagacggggcgatctccctgtgtggctggcctataaggttgctgccgaagggattaactacgctgaccgcaagtggtgtttcgatggaatcaaaaataaccagatcctggaggaaaacatggaggtggagatttggacaaaggaaggcgagcgcaagaagctcaaaccccggtggcttgacgccagaatctattccgatcctctggcgctgaaggagttcaaggagtttgccgctgggcgcaaatctctcaccctgaatcttattacggaaatgggccggctgcccaccttcatgacacagaaggccagaaacgctctcgacaatctggccgtcctgcataccgccgaggctggaggccgcgcgtacaaccacgccctcagcgagcttccggaaacactggagaccctgctcctgcttacactgctcgctaccgtgacagggggaatctttctgttcctgatgtccggcaaagggattggaaagatgacactcggcatgtgctgcatcatcaccgccagcattcttctgtggtatgcccaaatccagcctcactggattgctgcctctatcattctggaatttttcctcatcgttctgcttatccccgagcccgaaaaacagcggacccctcaggataatcaactgacatacgtggtcattgcgatcctcaccgtggtcgccgctacaatggccaacgagatgggctttctggagaagacgaagaaagacctggggctcggatccattaccacacaggaaagcgagtccaatatccttgacattgatctgagaccggcttctgcctggaccctgtatgcggtggccacaaccttcgttacgcccatgctccggcatagcatcgaaaactcctctgtgaatgtgagcctgaccgctattgccaaccaggctacagtccttatgggcctggggaagggatggcctctctccaaaatggacatcggcgttcccctgctggccatcgggtgttacagccaggtgaatcctattaccctcacagctgcccttctgctgctcgtggcgcactacgccatcattggacccggcctgcaagctaaggccacccgcgaggctcagaaaagagccgccgcgggcatcatgaagaaccctacggtcgatgggattacagtgatcgaccttgaaccgatcccctatgatcctaagtttgagaaacagctgggacaggttatgctcctgattctgtgcgtgacccaagtcctcatgatgcggacaacctgggctctttgtgaggccctgaccctggctacaggccccatctctacgctctgggaagggaatcctggacgcttctggaacaccacaattgccgtgtccatggccaatatctttagaggcagctacctggctggggccggacttctgttctctattatgaagaacaccacatccacccggcgcggcacgggcaatatcggggagacactcggagaaaaatggaaaagcagactgaacgcgctgggcaaatctgagtttcagatctataagaaaagcgggattcaggaggtcgaccggaccctcgccaaggaaggaatcaagcgcggcgagaccgatcatcacgctgtgtccagagggtctgccaaacttcggtggttcgttgaaagaaacatggtgacacccgagggaaaggtcgtggacctgggctgcggccgcgggggatggagctactattgtggcgggctgaaaaatgttcgggaagtgaagggactcaccaaaggcgggccgggacatgaggagcctattcccatgtccacatacggctggaacctggtcagacttcaaagcggcgtggatgtgttctttacgccccctgaaaagtgcgacaccctgctctgtgatatcggggagtcctctcccaatcctacaattgaagctggacgcaccctgcgggttctgaacctcgtcgagaattggcttaacaataacacacagttctgcatcaaggtgctgaatccgtatatgcccagcgtgatcgagaagatggaggccctgcagagacagtacggcggggcgctcgtccgcaaccctctgtccagaaattctacccacgagatgtactgggttagcaacgccacgggaaatattgtgtcctctgtgaacatgatcagcagaatgcttattaatcgctttaccatgaagcacaaaaaggctacatatgaacccgacgtcgatctgggctccgggacccggaacatcggaattgagaacgaaatccctaatctcgacattatcggcaaaagaatcgagaagattaagcaagaacatgagatcagctggcactacgaccaggatcatccctataaaacatgggcctaccacggctcttatgagaccaagcagacagggtccgctagctctatggtgaacggagttgtgcgcctgctgaccaaaccgtgggacgtcgtgcctatggttacgcagatggccatgacagataccacccccttcggccaacagcgggtgtttaaggaaaaagtcgacacaagaacgcaggagcctaaggaagggaccaagaaactcatgaagattacagctgagtggctttggaaagagctgggaaagaaaaagacaccccgcatgtgtacaagagaagagttcaccaaaaaggtgcggtccaatgccgcgctgggcgccatctttacagatgaaaacaagtggaaaagcgctcgcgaggccgtggaagacgggagattctgggagctcgtcgatcgggagagaaatctgcaccttgaaggaaagtgcgagacctgtgtttacaacatgatgggcaaacgggaaaagaaactgggcgagtttgggaaggctaagggatctcgcgccatttggtatatgtggctcggcgccagattcctggaatttgaggcgctggggttcctcaatgaggaccattggttttcccggggaaacagcctgtccggcgtggaaggggagggccttcaccgcctgggatacatcctcagagatgtgggcaaaaaggaagggggagctatgtacgccgacgatacggccggctgggacacccggatcacactggaggaccttaaaaatgaagagatggtcaccaaccatatgaagggggagcacaaaaagctggctgaagccattttcaagctcacatatcagaataaagtggttcgcgtgcaaagacctacaccccggggaacggtcatggatatcattagccgcagagaccagcggggctctggacaggtgggcacatacggactgaacaccttcacaaatatggaggctcaactgatccgccagatggaaggcgaggggatttttaagagcatccagcatctcaccgccacggaggaaatcgcggttcagaactggctggccagagtgggacgggagcgcctttccagaatggctatttctggcgatgactgcgtcgtgaaaccgatcgatgaccggttcgccagcgctctgaccgccctcaatgatatggggaaggttagaaaagacattcaacagtgggaaccttcccgcggatggaacgattggacacaggtgcccttttgctctcaccacttccatgagctggtcatgaaggacggccgggtgcttgtcgtgccctgtagaaaccaggatgaactgatcgggcgcgcgcggattagccaaggcgccggatggtccctcaaggagaccgcttgcctgggcaaatcttatgcccagatgtggacactgatgtactttcacagacgcgacctccggctggctgccaatgctatctgtagcgccgttccttcccattgggtgccgaccagcagaacaacctggtctattcacgcgaagcacgagtggatgacgacagaagatatgcttgccgtctggaaccgcgtgtggatccaggagaatccctggatggaagacaaaacccctgtggagtcctgggaagaggttccctatctggggaagcgggaggaccagtggtgcggaagcctcatcggcctgacctctagagctacatgggccaaaaacattcaaaccgccatcaatcaggtgcgctcccttattgggaacgaagagtacacagattatatgcctagcatgaagcggttcagacgggaagaggaagaggctggagtcctgtggtga

SEQ ID NO: 19755 - RNA, 9876 nt, synthetic construct
  misc_feature 1..9876: note = derived and/or modified CDS sequence (opt5) from DENV-2__FJ882593__SS-prME
  source 1..9876: mol_type = other RNA
accgccggagtgatcgtcatgctgattcccaccgctatggccttccacctgacgacccggaatggggagcctcatatgatcgttggacggcaggaaaagggcaagagcctgctttttaagacagaggacggggtgaatatgtgcaccctgatggcgattgatctcggagaactgtgtgaggacacaatcacctacaagtgcccgcttctgcgccaaaatgaacccgaggatattgactgttggtgcaattccacatctacctgggtgacgtatggcacctgtacaaccacaggggagcaccggcgggaaaagcgcagcgtcgctctcgtgcctcatgttggaatgggcctggagaccagaacggaaacatggatgtcctctgagggcgcctggaaacacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaagaacaggacaaacgctttatctgcaagcattccatggtggatagaggctggggcaacgggtgtggactgttcggcaaaggcgggattgtcacatgcgccatgtttacgtgcaaaaagaatatggaagggaaagttgtgcagcctgagaacctcgaatacaccatcgtgattacaccccacagcggggaggagcatgcggtcggaaatgacaccggcaagcacggcaaagaaatcaagatcacacctcagtcttccattaccgaggccgaactgacggggtatggaaccgtgacaatggagtgtagcccccggaccggccttgatttcaacgaaatggttctgctccaaatggaggacaaggcttggctggtgcaccgccagtggtttcttgatctgccgctcccttggctgcccggggccgacacacaggagtctaattggatccagaaggaaaccctggtcacgttcaagaaccctcatgctaaaaagcaagacgtggttgtgctcggatcccaggagggcgccatgcacacagccctgaccggggctacagaaattcagatgagctccggcaatcttctgtttaccggacatctcaaatgcagactgcggatggataaacttcaactgaaaggcatgtcttacagcatgtgtaccgggaagttcaagatcgtcaaagagattgcggagacacagcacggaacgatcgtgatcagagtccagtatgaaggcgacgggtccccctgcaagattcccttcgagatcaccgatctcgaaaaacgccatgtgctgggacggctgattacagttaaccctatcgtgaccgagaaggacagcccggtcaacattgaagccgagcccccttttggcgattcttacatcattatcggggtggagcccggccagctcaaactgaattggttcaagaagggatccagcatcggccaaatgtttgaaacaaccatgagaggggctaaacgcatggccattcttggagacacggcctgggatttcggctctctcgggggagtttttacaagcatcggcaaggctctccaccaggtgttcggggccatttacggcgcggctttttccggagtctcttggaccatgaaaatcctgattggcgtgatcatcacctggattgggatgaacagccggtccacaagcctgtctgtgtcccttgttctcgtcggagtggtgaccctgtatctgggcgccgtcgtgcaggccgacagcgggtgtgttgtgtcttggaagaataaagagctcaagtgcggatccggcatcttcattacagataacgtccacacgtggaccgaacagtacaagtttcaacctgagagcccctccaaactggcttctgccatccagaaggctcatgaagaggggatttgtggcatcagaagcgtgacacgccttgagaatctgatgtggaaacagatcaccccggaactcaaccacattctgtccgagaatgaagttaagctgacaatcatgaccggagacattaaaggcatcatgcaggccgggaagcggtctcttagacctcaacccacggagctcaaatatagctggaagacctggggaaaggcgaaaatgctgtccacagaaagccataaccagaccttcctgattgatggccctgagacagccgagtgccccaataccaaccgcgcttggaactctctcgaagtggaggactacgggtttggagtcttcacaaccaacatctggctgaaacttcgggaaaaacaggacgtgttttgtgattccaagctgatgagcgccgctatcaaagacaatagagccgttcacgcggatatgggctattggattgagtctgccctcaacgacacgtggaagatggagaaggcttccttcatcgaagtgaaaagctgccactggcctaagtctcatacactgtggagcaatggcgtcctggagtccgaaatgattatccccaaaaacttcgccgggccggtgagccagcacaactaccgccctggatatcatacccaaaccgctggcccctggcaccttgggaagctcgagatggattttgacttctgtgaaggaacaaccgtggtcgttacggaggattgcggcaatcgggggccctctctgagaacaaccacagcctccggaaaactgattaccgagtggtgctgtcggagctgcacactccctccgctgcgctacagaggcgaagacggctgttggtacgggatggagatccggccccttaaggaaaaggaggaaaacctggtgaatagcctcgtgaccgccggacatggccagattgataacttttctctgggggtcctgggaatggctcttttcctcgaggagatgctgagaacgcgcatcggcaccaaacacgcgatcctgctcgtggccgttagctttgtgacactgattaccgggaatatgtccttccgggaccttggaagagtcatggtgatggttggcgctacaatgaccgatgacatcggcatgggggtgacgtatctggccctcctggccgcttttaaggtccgccctacattcgccgcgggactgcttctgagaaaactcacctctaaggaactgatgatggctacaattggcatcgccctcctgagccagtccaccattcccgagaccatccttgaactgacagatgccctcgctctggggatgatggtgctgaaaatcgttcggaacatggagaagtaccaacttgccgtgacgattatggcgatctcttgcgtccctaatgctgtgattctgcagaacgcctggaaggtgagctgtaccatcctcgccgctgtctccgttagccccctgctcctgacatcttcccagcagaaagccgactggattcctcttgctctgaccatcaagggactcaatcccacagccatctttctgaccacgctgagccgcacatctaaaaagagatcctggccgcttaacgaagcgattatggccgtgggcatggtgagcatcctggcttcttccctcctgaaaaatgacattcctatgaccgggcccctcgtcgccggaggcctgcttaccgtgtgctatgttctgacaggccggagcgctgatctggagctcgagcgcgccgccgacgtgaagtgggaagatcaagctgagatctccgggagctctcctattctgagcatcaccatttccgaagacggatctatgagcatcaaaaacgaggaggaagaacagacacttacgatcctgattagaaccggcctcctggtcatctccggggtgttccccgtttctattccgatcacagcggccgcttggtacctctgggaagtgaagaagcagcgggccggagtcctgtgggatgtgccttctccccctcccgtcgagaaagccgaacttgaggacggcgcttatcgcattaagcagagagggatcctgggatactcccaaatcggcgccggcgtgtataaagaggggacctttcacacaatgtggcatgttacccggggagcggtgctgatgcaccgcggcaagagaattgaaccctcctgggctgatgtcaaaaaggacctcatcagctacgggggaggctggaagctggagggggaatggaaagagggagaagaggtgcaggttcttgccctggagcctggcaagaatccgcgggccgtgcagacgaaacccggcattttcaagaccaacacagggaccatcggagctgtctccctcgattttagccctggcacatctgggtcccccattgtggacagaaaaggaaaggtggttggcctgtacgggaatggagtcgtgacccgcagcggcgcctatgtgtctgcgatcgctcagacagaaaagtccatcgaggataaccctgaaattgaggacgatatcttccggaaaaagagactcacgattatggacctgcatcccggcgccgggaaaaccaagcgctaccttcctgccatcgtccgggaagctattaaaagaggactgcgcacactgatcctcgccccgacccgggtggttgctgccgagatggaggaagcgctgagaggccttcccattcgctatcaaacccctgccatcaagacagagcacacggggcgggaaatcgtggacctgatgtgtcatgctaccttcacaatgagactcctgagccccgtccgggtgcctaactacaatctcattatcatggatgaggcccactttaccgaccccgcttccattgccgcccgcggatatatctctacaagagttgagatgggcgaagctgcggggattttcatgaccgccacgccgcctggcagccgggatccctttccccagtccaacgctcctatcatggacgaggaacgcgagatccccgaaagaagctggaactctggacacgagtgggtgacagatttcaagggcaaaaccgtctggtttgtgccttccattaaggccgggaacgacatcgccgcttgcctgcggaaaaatggaaagaaagttattcagcttagcagaaagaccttcgattctgagtacgtgaagacacgcgccaacgactgggattttgtcgtgaccacagacatcagcgaaatgggcgcgaatttcaaagctgagcgggtgattgatccgagacgctgtatgaagcccgtcatcctgaccgacggggaggaacgggttatcctggccggacctatgcccgtgacgcattcctctgccgctcaaagacgcggccggattgggagaaaccctaaaaatgaaaacgaccagtatatctacatgggcgagcccctcgagaatgatgaagactgcgcccactggaaggaggcgaaaatgctgcttgataacattaatacaccggaaggaatcattcctagcatgtttgagcccgaacgcgagaaggtggacgccatcgatggcgagtacagactgagaggggaagctcgcaaaaccttcgtcgacctcatgagacggggagatctgcctgtgtggctggcctataaggttgctgccgagggcattaactacgctgaccgcaagtggtgttttgatgggatcaaaaataaccagatcctcgaagagaacatggaggtggaaatttggacaaaggagggagaacgcaagaaacttaaaccccggtggctggacgccagaatctattccgatcctctggcgctcaaggagttcaaggagttcgccgctggccgcaaatctctgacccttaatctgattacggagatggggcggctccccacctttatgacacagaaggccagaaacgctctggacaatctggccgtcctccataccgccgaggctggcggacgcgcgtacaaccacgcccttagcgaactgccggagacactggaaaccctcctgcttctgacactcctggctaccgtgacgggcgggatcttcctgtttctcatgtccggaaaaggcattgggaagatgacacttggaatgtgctgcatcatcaccgccagcattctgctgtggtatgcccaaatccagcctcactggattgctgcctctatcattctcgagttctttctgatcgttcttctgatccccgaacccgagaaacagcggacccctcaggataatcaactcacatacgtggtcattgcgatcctgaccgtggtcgccgctacaatggccaacgagatgggcttcctggaaaagacgaagaaagacctcggccttgggtccattaccacacaggagagcgaatccaatatcctggacattgatctgagaccggcttctgcctggaccctctatgcggtggccacaacctttgttacgcccatgctgcggcatagcatcgagaactcctctgtgaatgtgagccttaccgctattgccaaccaggctacagtcctgatgggactcggcaaggggtggcctctgtccaaaatggacatcggagttcccctgctcgccatcggctgttacagccaggtgaatcctattacccttacagctgccctgctgctcctggtggcgcactacgccatcattgggcccggacttcaagctaaggccacccgcgaagctcagaaaagagccgccgcgggcatcatgaagaaccctacggtcgatggcattacagtgatcgacctggagccgatcccctatgatcctaagttcgagaaacagctcgggcaggttatgctgctgattctctgcgtgacccaagtccttatgatgcggacaacctgggctctgtgtgaagccctgaccctcgctacaggacccatctctacgctgtgggagggcaatcctgggcgcttttggaacaccacaattgccgtgtccatggccaatatcttcagaggaagctaccttgctggcgccgggctgctcttttctattatgaagaacaccacatccacccggcgcggaacgggcaatatcggcgaaacactgggggagaaatggaaaagcagactgaacgcgctcggaaaatctgagttccagatctataagaaaagcggcattcaggaagtcgaccggacccttgccaaggaggggatcaagcgcggagaaaccgatcatcacgctgtgtccagaggctctgccaaactgcggtggtttgttgagagaaacatggtgacacccgaagggaaggtcgtggacctgggatgcggccgcggcgggtggagctactattgtggaggcctcaaaaatgttcgggaggtgaaggggctgaccaaaggaggcccggggcatgaggaacctattcccatgtccacatacggatggaaccttgtcagactgcaaagcggcgtggatgtgttcttcacgccccctgagaagtgcgacaccctcctgtgtgatatcggcgaatcctctcccaatcctacaattgaggctgggcgcaccctgcgggttctcaaccttgtcgaaaattggctgaacaataacacacagttttgcatcaaggtgctgaatccgtatatgcccagcgtgatcgagaaaatggaggccctccagagacagtacggaggcgcgctggtccgcaaccctctttccagaaattctacccacgaaatgtactgggttagcaacgccacggggaatattgtgtcctctgtgaacatgatcagcagaatgctgattaatcgcttcaccatgaagcacaaaaaggctacatatgagcccgacgtcgatctcggatccggcacccggaacatcgggattgaaagcgagatccctaacctggacattatcggaaaaagaatcgaaaagattaagcaagagcatgagatctcttggcactacgaccaggatcatccctataaaacatgggcctaccacggctcctatgaaaccaagcagacaggcagcgcttcttccatggtgaatggggttgtgcgcctgctcaccaaaccgtgggacgtcgtgcctatggttacgcagatggccatgacagataccaccccctttggacaacagcgggtgttcaaggagaaagtcgacacaagaacgcaggaacctaaggagggcaccaagaaacttatgaagattacagctgagtggctgtggaaagaactggggaagaaaaagacccccagaatgtgtacaagagaggaatttaccaaaaaggtgcggagcaacgccgcgctcggagccatcttcacagatgagaataagtggaaatctgctcgcgaagccgtggaggacggcagattttgggagctggtcgatcgggaaagaaaccttcacctggaggggaagtgcgaaacctgtgtttacaatatgatgggaaaacgggagaagaaactcggcgagttcggcaaggctaaggggtcccgcgccatttggtatatgtggctgggagccagatttctggagttcgaggcgctcggctttctgaacgaagaccattggttcagccggggaaattcccttagcggagtggagggcgaagggctgcaccgcctcggctacatcctgagagatgtgggcaagaaggagggcggggctatgtacgccgacgatacggccggatgggacacccggatcacacttgaagacctgaaaaacgaggagatggtcaccaatcatatgaagggcgaacacaaaaagctcgctgaggccatttttaagctgacatatcagaacaaagtggttcgcgtgcaaagacctacaccccgggggacggtcatggatatcatttctcgcagagaccagcggggaagcggccaggtggggacatacggcctgaataccttcacaaacatggaagctcaactcatccgccagatggagggagagggcattttcaagtccatccagcatctgaccgccacggaagagatcgcggttcagaattggcttgccagagtggggcgggaacgcctgtctagaatggctattagcggagatgactgcgtcgtgaaaccgatcgatgaccggtttgcctccgctctcaccgccctgaacgatatgggcaaggttagaaaagacattcaacagtgggagccttctcgcgggtggaatgattggacacaggtgcccttctgcagccaccactttcatgaacttgtcatgaaggacggacgggtgctggtcgtgccctgtagaaaccaggatgagctcatcggccgcgcgcggatttcccaaggggccggctggtctctgaaggagaccgcttgcctgggaaaaagctatgcccagatgtggacactcatgtacttccacagacgcgacctgcggcttgctgccaacgctatctgttccgccgttcctagccattgggtgccgacctctagaacaacctggtccattcacgcgaagcacgaatggatgacgacagaggatatgctggccgtctggaatcgcgtgtggatccaggaaaacccctggatggaggacaaaacccctgtggaaagctgggaggaggttccctatctcggcaagcgggaagaccagtggtgcgggtctctgatcggacttacctccagagctacatgggccaaaaatattcaaaccgccatcaaccaggtgcgcagcctgattggcaatgaggaatacacagattatatgccttccatgaagcggtttagacgggaggaagaggaggctggggtcctctggtga

SEQ ID NO: 19756 - RNA, 9876 nt, synthetic construct
  misc_feature 1..9876: note = derived and/or modified CDS sequence (opt5) from DENV-2__FJ182014__SS-prME
  source 1..9876: mol_type = other RNA
acagccggcgtgatcgtcatgctgattcccacagctatggccttccacctcacgacccggaatggggagcctcatatgatcgttggacggcaggaaaagggcaaaagcctgctttttaagacagaggacggggtgaatatgtgcaccctgatggcgattgatctcggagaactgtgtgaggacacaatcacctacaaatgcccgttccttcgccaaaatgaacccgaggatattgactgttggtgcaattccacatctacctgggtgacgtatggcacctgtacaaccacaggggagcacagacgggaaaagcgcagcgtcgctctggtgcctcatgttggaatgggcctcgagaccagaacggaaacatggatgtcctctgagggcgcctggaaacacgtgcagcggatcgagacctggatcctgcgccatcccgggtttacaattatggccgctatcctggcctacaccattggaaccacacacttccagagagctctcatctttattctgcttacggccgtcgcgcctagcatgaccatgcggtgcatcggcatttccaaccgcgatttcgtggaaggggtttctggaggcagctgggtggacatcgtcctggagcacgggtcctgtgtgacaaccatggccaagaataagcccacactcgattttgaactgatcaaaaccgaggctaagcagcctgccacgcttagaaaatattgcattgaagctaagctgacaaacaccaccacagagagccggtgtccgacccaaggagagccctctctcaatgaagaacaggacaaacgcttcatctgcaagcattccatggtggatagaggctggggcaacgggtgtggactgtttggcaaaggcgggattgtcacatgcgccatgttcacgtgcaaaaagaatatggaagggaaagttgtgcagcctgagaacctggaatacaccatcgtgattacaccccacagcggggaggagcatgcggtcggaaatgacaccggcaagcacggcaaagaaatcaagatcacacctcagtcttccattaccgaggccgaactcacggggtatggaaccgtgacaatggagtgtagcccccggaccggcctggattttaacgaaatggttcttctgcaaatggaggacaaggcttggctcgtgcaccgccagtggttcctggatcttccgctgccttggctccccggggccgacacacagggatctaattggatccagaaggagaccctggtcacgtttaagaaccctcatgctaaaaagcaagacgtggttgtgctgggctcccaggaaggggccatgcacacagccctcaccggcgctacagagattcagatgagctccggaaatctgcttttcaccggccatctgaaatgcagactccggatggataagctgcaacttaaagggatgtcttacagcatgtgtaccggaaagttcaagatcgtcaaagaaattgcggagacacagcacggcacgatcgtgatcagagtccagtatgagggggacggatccccctgcaagattccctttgaaatcaccgatctggagaaacgccatgtgctcggccggctgattacagttaaccctatcgtgaccgaaaaggacagcccggtcaacattgaggccgaaccccctttcggggattcttacatcattatcggcgtggagcccggacagctgaaactcaattggtttaagaagggctccagcatcgggcaaatgttcgagacaaccatgagaggagctaaacgcatggccattctgggcgacacggcctgggattttgggtctcttggaggcgttttcacaagcatcgggaaggctctgcaccaggtgtttggcgccatttacggagcggctttctccggcgtctcttggaccatgaaaatcctcattggggtgatcatcacctggattggaatgaacagccggtccacaagcctgtctgtgtccctggttcttgtcggcgtggtgaccctctatctgggggccgtcgtgcaggccgacagcggatgtgttgtgtcttggaagaataaagaactgaagtgcggctccgggatctttattacagataacgtccacacgtggaccgagcagtacaagttccaacctgaaagcccctccaaactcgcttctgccatccagaaggctcatgaggaaggcatttgtggaatcagaagcgtgacacgcctggagaatcttatgtggaaacagatcaccccggagctgaaccacattctctccgaaaatgaggttaagctgacaatcatgaccggcgacattaaagggatcatgcaggccggaaagcggtctctgagacctcaacccacggaacttaaatatagctggaagacctggggcaaggcgaaaatgctctccacagagagccataaccagacctttctgattgatgggcctgaaacagccgagtgccccaataccaaccgcgcttggaactctctggaggtggaagactacggattcggcgtctttacaaccaacatctggctcaagctgcgggagaaacaggacgtgttctgtgattccaaacttatgagcgccgctatcaaagacaatagagccgttcacgcggatatgggctattggattgaatctgccctgaacgacacgtggaagatggagaaggcttccttcatcgaggtgaaaagctgccactggcctaagtctcatacactctggagcaatggggtcctggaatccgagatgattatccccaaaaactttgccggaccggtgagccagcacaactaccgccctggctatcatacccaaaccgctgggccctggcacctgggaaaacttgaaatggatttcgacttttgtgagggcacaaccgtggtcgttacggaagattgcgggaatcggggaccctctctcagaacaaccacagcctccggcaaactgattaccgagtggtgctgtcggagctgcacactgcctccgctccgctacagaggcgaggacgggtgttggtacggaatggaaatccggcccctgaaggagaaggaagagaaccttgtgaatagcctggtgaccgccggccatgggcagattgataacttctctctcggagtcctgggcatggctctgtttcttgaagagatgctcagaacgcgcatcgggaccaaacacgcgatcctgctggtggccgttagcttcgtgacactcattaccggaaatatgtcctttcgggacctgggcagagtcatggtgatggttggcgctacaatgaccgatgacatcgggatgggagtgacgtatcttgccctgctcgccgctttcaaggtccgccctacatttgccgcgggcctgctgcttagaaaactgacctctaaggagctcatgatggctacaattgggatcgccctgctcagccagtccaccattcccgaaaccatcctggagcttacagatgccctggctctcggaatgatggtgctgaaaatcgttcggaacatggaaaagtaccaactggccgtgacgattatggcgatctcttgcgtccctaatgctgtgattcttcagaacgcctggaaggtgagctgtaccatcctggccgctgtctccgttagccccctcctgctcacatcttcccagcagaaagccgactggattcctctggctcttaccatcaagggcctgaatcccacagccatcttcctcaccacgctgagccgcacatctaaaaagagatcctggccgctgaacgaggcgattatggccgtggggatggtgagcatccttgcttcttccctgctcaaaaatgacattcctatgaccggacccctggtcgccggcggcctcctgaccgtgtgctatgttcttacagggcggagcgctgatctggaactggagcgcgccgccgacgtgaagtgggaggatcaagctgaaatctccggaagctctcctattctcagcatcattatctccgaggacggctctatgagcatcaaaaacgaagaggaggaacagaccctgacaattcttatcagaacggggctgctcgtcatttccggagtgtttcccgtttctatcccgattaccgcggccgcttggtacctgtgggaggtgaagaagcagcgggccggcgtcctctgggatgtgccttctccccctcccgtcgaaaaagccgagctggaagacggggcttatcgcatcaagcagagaggaatccttggctactcccaaattggcgccggggtgtataaagagggaacattccacaccatgtggcatgttacacggggcgcggtgctgatgcaccgcgggaagagaatcgagccctcctgggctgatgtcaaaaaggacctgattagctacggaggcgggtggaagctcgaaggagagtggaaagaaggcgaggaagtgcaggttctggcccttgagcctggcaagaatccgcgggccgtgcagaccaaacccgggatctttaagacgaacaccggaacaattggcgctgtctccctggatttcagccctgggacctctggatcccccatcgtggacagaaaaggcaaggtggttgggctctacggaaatggcgtcgtgacacgcagcggcgcctatgtgtctgcgatcgctcagaccgagaagtccattgaagataaccctgagatcgaagacgatattttccggaaaaagagactgacaatcatggacctccatcccggggccggaaaaacgaagcgctacctgcctgccattgtccgggaggctatcaaaagaggccttcgcaccctgattctggccccgacacgggtggttgctgccgaaatggaggaggcgctcagagggctgcccatccgctatcaaacccctgccatcaagaccgaacacacaggacgggagattgtggaccttatgtgtcatgctacgtttaccatgagactgctcagccccgtccgggtgcctaactacaatctgatcattatggatgaagcccacttcacagaccccgcttccatcgccgcccgcggctatatttctaccagagttgagatgggggaggctgcgggcatctttatgacagccaccccgcctggaagccgggatcccttcccccagtccaacgctcctatcatggacgaagaaagagaaattcccgagagaagctggaactctggccacgaatgggtgacggattttaaggggaaaacagtctggttcgtgccttccatcaaggccggaaacgacattgccgcttgcctccggaaaaatggcaagaaagttatccagctgagcagaaagacctttgattctgagtacgtgaagacccgcgccaacgactgggatttcgtcgtgacaaccgacattagcgagatgggggcgaattttaaagctgaacgggtgatcgatccgagacgctgtatgaagcccgtcatccttacagacggagaggaacgggttattctggccggccctatgcccgtgacccattcctctgccgctcaaagacgcgggcggatcggcagaaaccctaaaaatgagaacgaccagtatatttacatgggagaacccctggagaatgatgaggactgcgcccactggaaggaagcgaaaatgctcctggataacatcaatacgccggagggcattatccctagcatgttcgaacccgagcgcgaaaaggtggacgccattgatggggagtacagacttcggggagaggctcgcaaaacatttgtcgacctgatgagacggggcgatctccctgtgtggctggcctataaggttgctgccgaagggatcaactacgctgaccgcaagtggtgtttcgatggaatcaaaaataaccagattctggaggaaaacatggaggtggagatctggaccaaggaaggcgagcgcaagaagctcaaaccccggtggcttgacgccagaatttattccgatcctctggcgctgaaggagttcaaggagtttgccgctgggcgcaaatctctcacactgaatcttatcaccgaaatgggccggctgcccacgttcatgacccagaaggccagaaacgctctcgacaatctggccgtcctgcatacagccgaggctggaggccgcgcgtacaaccacgccctcagcgagcttccggaaaccctggagacactgctcctgcttaccctgctcgctacagtgaccgggggaatttttctgttcctgatgtccggcaaagggatcggaaagatgacgctcggcatgtgctgcatcattacagccagcatccttctgtggtatgcccaaattcagcctcactggatcgctgcctctattatcctggaatttttcctcatcgttctgcttattcccgagcccgaaaaacagcggacccctcaggataatcaactgacctacgtggtcatcgcgattctcacagtggtcgccgctaccatggccaacgagatgggctttctggagaagacaaagaaagacctggggctcggatccatcacgacccaggaaagcgagtccaatattcttgacatcgatctgagaccggcttctgcctggacactgtatgcggtggccaccacattcgttacccccatgctccggcatagcattgaaaactcctctgtgaatgtgagcctgacggctatcgccaaccaggctaccgtccttatgggcctggggaagggatggcctctctccaaaatggacatcggcgttcccctgctggccattgggtgttacagccaggtgaatcctatcacactcaccgctgcccttctgctgctcgtggcgcactacgccattatcggacccggcctgcaagctaaggccacacgcgaggctcagaaaagagccgccgcgggcattatgaagaaccctaccgtcgatgggatcacggtgatcgaccttgaaccgattccctatgatcctaagtttgagaaacagctgggacaggttatgctcctgatcctgtgcgtgacacaagtcctcatgatgcggaccacatgggctctttgtgaggccctgaccctggctaccggccccatttctacactctgggaagggaatcctggacgcttctggaacacgaccatcgccgtgtccatggccaatatttttagaggcagctacctggctggggccggacttctgttctctatcatgaagaacacaacctccacacggcgcggcaccggcaatatcggggagacgctcggagaaaaatggaaaagcagactgaacgcgctgggcaaatctgagtttcagatttataagaaaagcgggatccaggaggtcgaccggacactcgccaaggaaggaattaagcgcggcgagaccgatcatcacgctgtgtccagagggtctgccaaacttcggtggttcgttgaaagaaacatggtgacccccgagggaaaggtcgtggacctgggctgcggccgcgggggatggagctactattgtggcgggctgaaaaatgttcgggaagtgaagggactcacaaaaggcgggccgggacatgaggagcctatccccatgtccacctacggctggaacctggtcagacttcaaagcggcgtggatgtgttctttacaccccctgaaaagtgcgacacgctgctctgtgatattggggagtcctctcccaatcctaccatcgaagctggacgcacactgcgggttctgaacctcgtcgagaattggcttaacaataacacccagttctgcatcaaggtgctgaatccgtatatgcccagcgtgattgagaagatggaggccctgcagagacagtacggcggggcgctcgtccgcaaccctctgtccagaaattctacacacgagatgtactgggttagcaacgccaccggaaatatcgtgtcctctgtgaacatgattagcagaatgcttatcaatcgctttacgatgaagcacaaaaaggctacctatgaacccgacgtcgatctgggctccgggacacggaacattggaatcgagagcgaaattcctaacctcgacatcatcggcaaaagaattgagaagatcaagcaagaacatgagatttcttggcactacgaccaggatcatccctataaaacctgggcctaccacggctcctatgagacaaagcagaccgggagcgcttcttccatggtgaatggagttgtgcgcctgctgacaaaaccgtgggacgtcgtgcctatggttacccagatggccatgacggatacaacccccttcggccaacagcgggtgtttaaggaaaaagtcgacaccagaacacaggagcctaaggaagggacgaagaaactcatgaagatcaccgctgagtggctttggaaagagctgggaaagaaaaagacaccccgcatgtgtaccagagaagagttcaccaagaaggtgcggagcaacgccgcgctgggcgccatttttaccgatgaaaataagtggaaatctgctcgcgaggccgtggaagacgggagattctgggagctcgtcgatcgggagagaaacctgcaccttgaaggaaagtgcgagacatgtgtttacaatatgatgggcaaacgggaaaagaaactgggcgagtttgggaaggctaagggatcccgcgccatctggtatatgtggctcggcgccagattcctggaatttgaggcgctggggttcctcaacgaggaccattggtttagccggggaaattccctgagcggcgtggaaggggagggccttcaccgcctgggatacatcctcagagatgtgggcaaaaaggaagggggagctatgtacgccgacgataccgccggctgggacacgcggattaccctggaggaccttaaaaacgaagagatggtcacaaatcatatgaagggggagcacaaaaagctggctgaagccatcttcaagctcacctatcagaacaaagtggttcgcgtgcaaagacctacaccccggggaaccgtcatggatattatctctcgcagagaccagcggggcagcggacaggtgggcacgtacggactgaatacattcaccaacatggaggctcaactgattcgccagatggaaggcgaggggatctttaagtccatccagcatctcacagccaccgaggaaattgcggttcagaattggctggccagagtgggacgggagcgcctttctagaatggctatcagcggcgatgactgcgtcgtgaaaccgattgatgaccggttcgcctccgctctgacggccctcaacgatatggggaaggttagaaaagacatccaacagtgggaaccttctcgcggatggaatgattggacccaggtgcccttttgcagccaccacttccatgagctggtcatgaaggacggccgggtgcttgtcgtgccctgtagaaaccaggatgaactgattgggcgcgcgcggatctcccaaggcgccggatggtctctcaaggagacagcttgcctgggcaaaagctatgcccagatgtggaccctgatgtactttcacagacgcgacctccggctggctgccaacgctatttgttccgccgttcctagccattgggtgccgacatctagaaccacatggtccatccacgcgaagcacgagtggatgaccacggaagatatgcttgccgtctggaatcgcgtgtggatccaggagaacccctggatggaagacaaaacacctgtggagagctgggaagaggttccctatctggggaagcgggaggaccagtggtgcggatctctcattggcctgacctccagagctacctgggccaaaaatatccaaacagccattaaccaggtgcgcagccttatcgggaatgaagagtacaccgattatatgccttccatgaagcggttcagacgggaagaggaagaggctggagtcctgtggtga

SEQ ID NO: 19757 - RNA, 9876 nt, synthetic construct
  misc_feature 1..9876: note = derived and/or modified CDS sequence (opt5) from DENV-2__FJ547090__SS-prME
  source 1..9876: mol_type = other RNA
acagccggcgtgatcgtgatgctgattcccacagctatggccttccacctcacgacccggaatggggaacctcatatgatcgttggacggcaggaaaagggcaagagcctgctttttaagacagaagacggggtgaatatgtgcaccctgatggcgattgatctcggagaactgtgtgaggacacaatcacctacaaatgcccgcttctgcgccaaaatgaacccgaggatattgactgttggtgcaattccacatctacctgggtgacgtatggcacctgtacaaccacaggggagcacagacgggaaaagcgcagcgtcgctctcgtgcctcatgttggaatgggcctggagaccagaacggaaacatggatgtcctctgagggcgcctggaaacacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaagaacaggacaaacgctttatctgcaagcattccatggtggatagaggctggggcaacgggtgtggactgttcggcaaaggcgggattgtcacatgcgccatgtttacgtgcaaaaagaatatggaagggaaagttgtgcagcctgagaacctcgaatacaccatcgtgattacaccccacagcggggaggagcatgcggtcggaaatgacaccggcaagcacggcaaagaaatcaagatcacacctcagtcttccattaccgaggccgaactgacggggtatggaaccgtgacaatggagtgtagcccccggaccggccttgatttcaacgaaatggttctgctccaaatggaggacaaggcttggctggtgcaccgccagtggtttcttgatctgccgctcccttggctgcccggggccgacacacagggatctaattggatccagaaggagaccctggtcacgttcaagaaccctcatgctaaaaagcaagacgtggttgtgctcggctcccaggaaggggccatgcacacagccctgaccggcgctacagagattcagatgagctccggaaatcttctgtttaccggccatctcaaatgcagactgcggatggataaacttcaactgaaagggatgtcttacagcatgtgtaccggaaagttcaagatcgtcaaagaaattgcggagacacagcacggcacgatcgtgatcagagtccagtatgagggggacggatccccctgcaagattcccttcgaaatcaccgatctcgagaaacgccatgtgctgggccggctgattacagttaaccctatcgtgaccgaaaaggacagcccggtcaacattgaggccgaacccccttttggggattcttacatcattatcggcgtggagcccggacagctcaaactgaattggttcaagaagggctccagcatcgggcaaatgtttgagacaaccatgagaggagctaaacgcatggccattcttggcgacacggcctgggatttcgggtctctgggaggcgtttttacaagcatcgggaaggctctccaccaggtgttcggcgccatttacggagcggctttttccggcgtctcttggaccatgaaaatcctgattggggtgatcatcacctggattggaatgaacagccggtccacaagcctgtctgtgtcccttgttctcgtcggcgtggtgaccctgtatctgggggccgtcgtgcaggccgacagcggatgtgttgtgtcttggaagaataaagaactcaagtgcggctccgggatcttcattacagataacgtccacacgtggaccgagcagtacaagtttcaacctgaaagcccctccaaactggcttctgccatccagaaggctcatgaggaaggcatttgtggaatcagaagcgtgacacgccttgagaatctgatgtggaaacagatcaccccggagctcaaccacattctgtccgaaaatgaggttaagctgacaatcatgaccggcgacattaaagggatcatgcaggccggaaagcggtctcttagacctcaacccacggaactcaaatatagctggaagacctggggcaaggcgaaaatgctgtccacagagagccataaccagaccttcctgattgatgggcctgaaacagccgagtgccccaataccaaccgcgcttggaactctctcgaggtggaagactacggatttggcgtcttcacaaccaacatctggctgaaacttcgggagaaacaggacgtgttttgtgattccaagctgatgagcgccacgatcaaagacaatagagctgttcacgccgatatgggctattggattgaatctgcgctcaacgacacatggaagatggagaaggcctccttcatcgaggtgaaaagctgccactggcctaagtctcataccctgtggagcaatggggtcctggaatccgagatgattatccccaaaaacttcgctggaccggtgagccagcacaactaccgccttggctatcatacccaaacagccgggccttggcacctcggaaagctggaaatggattttgacttctgtgagggcaccacggtggtcgttacagaagattgcgggaatcggggaccctctctgagaaccacaaccgcttccggcaaactcattacagagtggtgctgtcggagctgcaccctgccccctcttcgctacagaggcgaggacgggtgttggtacggaatggaaatccggccgctgaaggagaaggaagagaacctcgtcaattccctggtgacggccggccatgggcagattgataacttttctctgggagtccttggcatggccctcttcctggaagagatgctgagaacccgcatcgggacaaaacacgctatcctcctggtggcggttagctttgtgacccttattacaggaaatatgtccttccgggacctgggcagagtcatggtgatggttggcgccaccatgacggatgacatcgggatgggagtgacatatctcgctctgctggccgcctttaaggtccgccccaccttcgctgccggccttctgctcagaaaactgacatctaaggagctcatgatggcgaccattgggatcgctctgcttagccagtccaccattcctgaaacaatcctggagctcacggatgccctggccctgggaatgatggtgcttaaaatcgttcggaacatggaaaagtaccaactggctgtgaccattatggccatctcttgcgtccccaatgcggtgattctccagaacgcttggaaggtgagctgtacaatcctggccgccgtctccgttagccctctcctgcttacctcttcccagcagaaagctgactggattcccctggccctcacaatcaagggcctgaatcctaccgctatctttctgacgacacttagccgcacctctaaaaagagatcctggcccctgaacgaggccattatggcggtggggatggtgagcatcctcgcctcttccctgctcaaaaatgacattccgatgaccggacctctggtcgctggcggccttctgacagtgtgctatgttctgaccgggcggagcgccgatctcgaactggagcgcgctgccgacgtgaagtgggaggatcaagccgaaatctccggaagctctcccattcttagcatcacaatttccgaggacggctctatgagcatcaaaaacgaagaggaggaacagacgctgaccatcctcattagaacagggctgctcgtcatctccggagtgttccctgtttctattcccatcaccgctgcggcctggtacctgtgggaggtgaagaagcagcgggctggcgtcctttgggatgtgccgagccctccccctgtcgaaaaagccgagctggaagacggggcctatcgcattaagcagagaggaatcctgggctactcccaaatcggcgctggggtgtataaagagggaacatttcacaccatgtggcatgttacgcggggcgccgtgctcatgcaccgcgggaagagaattgagccctcttgggcggatgtcaaaaaggacctgatcagctacggaggcgggtggaaacttgaaggagagtggaaagaaggcgaggaagtgcaggttctggctctcgagcccggcaagaatcctcgggccgtgcagaccaaaccggggattttcaagacaaacaccggaacaatcggcgccgtctccctggattttagccccgggacctctggatcccctattgtggacagaaaaggcaaggtggttgggctctacggaaatggcgtcgtgacacgcagcggcgcttatgtgtctgccatcgcgcagacggagaagtccatcgaagataaccccgagattgaagacgatatcttccggaaaaagagactgaccattatggaccttcatcctggggctggaaaaacaaagcgctacctgcccgccatcgtccgggaggccattaaaagaggcctgcgcaccctcatcctggctcctacccgggtggttgccgctgaaatggaggaggcccttagagggctgccgattcgctatcaaacacccgcgatcaagacggaacacaccggacgggagatcgtggacctcatgtgtcatgccacattcaccatgagactgctcagccctgtccgggtgcccaactacaatctgattatcatggatgaagctcactttacagaccctgcctccattgctgcccgcggctatatctctaccagagttgagatgggggaggccgctggcattttcatgacggcgacacccccgggaagccgggatccttttccccagtccaacgcccccatcatggacgaagaaagagaaatccctgagagaagctggaactctggccacgaatgggtgaccgatttcaaggggaaaaccgtctggtttgtgccctccattaaggctggaaacgacatcgccgcctgccttcggaaaaatggcaagaaagttattcagctgagcagaaagacattcgattctgagtacgtgaagacccgcgctaacgactgggattttgtcgtgacaaccgacatcagcgagatgggggccaatttcaaagcggaacgggtgattgatcctagacgctgtatgaagccggtcatcctgacggacggagaggaacgggttatcctcgctggccccatgcctgtgacacattcctctgccgcccaaagacgcgggcggattggcagaaaccccaaaaatgagaacgaccagtatatctacatgggagaacctctggagaatgatgaggactgcgctcactggaaggaagccaaaatgcttctggataacattaatacccccgagggcatcattccgagcatgtttgaacctgagcgcgaaaaggtggacgcgatcgatggggagtacagactccggggagaggcccgcaaaacattcgtcgacctgatgagacggggcgatctgcccgtgtggctcgcttataaggttgccgctgaagggattaactacgccgaccgcaagtggtgttttgatggaatcaaaaataaccagatccttgaggaaaacatggaggtggagatttggaccaaggaaggcgagcgcaagaagctgaaacctcggtggctggacgctagaatctattccgatcccctcgccctgaaggagttcaaggagttcgcggccgggcgcaaatctcttacgctgaatctcattaccgaaatgggccggctgcctacatttatgacccagaaggctagaaacgccctggacaatctcgctgtccttcatacagccgaggccggaggccgcgcttacaaccacgcgctgagcgagctgcccgaaaccctcgagacactgcttctgctcaccctgctggccacggtgacagggggaatcttcctctttcttatgtccggcaaagggattggaaagatgaccctgggcatgtgctgcatcatcaccgctagcattctgctctggtatgcccaaatccagccgcactggattgccgcttctatcattctggagttctttcttatcgttctgctcatccctgagcccgaaaaacagcggacaccccaggataatcaactgacctacgtggtcattgccatcctgacagtggtcgcggccacgatggctaacgagatgggcttcctcgagaagaccaagaaagaccttgggctgggatccattacaacccaggaaagcgagtccaatatcctggacattgatctcagacctgcctctgcttggacactgtatgccgtggcgaccacgtttgttaccccgatgcttcggcatagcatcgaaaactcctctgtgaatgtgagcctgacagccattgctaaccaggccaccgtcctcatgggcctggggaagggatggcccctgtccaaaatggacatcggcgttcctctccttgctatcgggtgttacagccaggtgaatcccattacactgaccgccgctctgctcctgcttgtggcccactacgcgatcattggacctggcctgcaagccaaggctacgcgcgaggcccagaaaagagctgccgccggcatcatgaagaaccccacagtcgatgggattaccgtgatcgacctcgaacctatcccgtatgatcccaagttcgagaaacagctgggacaggttatgctgctcattctttgcgtgacacaagtcctgatgatgcggaccacctgggcgctgtgtgaggctctcacactggccacgggccctatctctaccctttgggaagggaatcccggacgcttttggaacacaaccattgctgtgtccatggccaatatcttcagaggcagctacctggccggggctggactcctgttttctattatgaagaacacaacctccacgcggcgcggcacaggcaatatcggggagaccctgggagaaaaatggaaaagcagactcaacgcccttggcaaatctgagttccagatctataagaaaagcgggattcaggaggtcgaccggaccctggcgaaggaaggaatcaagcgcggcgagacagatcatcacgccgtgtccagagggtctgctaaactgcggtggtttgttgaaagaaacatggtgacccctgagggaaaggtcgtggacctcggctgcggccgcgggggatggagctactattgtggcgggctgaaaaatgttcgggaagtgaagggacttacaaaaggcgggcccggacatgaggagccgattcctatgtccacgtacggctggaacctggtcagactccaaagcggcgtggatgtgttcttcacccctcccgaaaagtgcgacacactgctgtgtgatatcggggagtcctctcccaatcccaccattgaagccggacgcacactccgggttcttaacctggtcgagaattggctgaacaataacacccagttttgcatcaaggtgctcaatccttatatgccgagcgtgatcgagaagatggaggctctgcagagacagtacggcggggcccttgtccgcaaccccctgtccagaaattctacgcacgagatgtactgggttagcaacgcgaccggaaatattgtgtcctctgtgaacatgatcagcagaatgctcattaatcgcttcacaatgaagcacaaaaaggccacctatgaacctgacgtcgatctgggctccgggacacggaacatcggaattgagagcgaaatccccaacctggacattatcggcaaaagaatcgagaagattaagcaagaacatgagatctcttggcactacgaccaggatcatccttataaaacctgggcttaccacggctcctatgagacaaagcagaccgggagcgcctcttccatggtgaatggagttgtgcgcctccttacgaaaccctgggacgtcgtgccgatggttacacagatggctatgaccgataccacaccttttggccaacagcgggtgttcaaggaaaaagtcgacacgagaacccaggagcccaaggaagggacaaagaaactgatgaagattaccgccgagtggctgtggaaagagctcggaaagaaaaagacacctcgcatgtgtaccagagaagagtttaccaagaaggtgcggagcaacgctgccctgggcgcgatcttcaccgatgaaaataagtggaaatctgcccgcgaggctgtggaagacgggagattttgggagcttgtcgatcgggagagaaacctgcacctcgaaggaaagtgcgagacgtgtgtttacaatatgatgggcaaacgggaaaagaaactgggcgagttcgggaaggccaagggatcccgcgctatttggtatatgtggctgggcgccagatttctcgagttcgaggccctggggtttcttaacgaggaccattggttcagccggggaaattccctgagcggcgtggaaggggagggcctccaccgcctgggatacatccttagagatgtgggcaaaaaggaagggggagcgatgtacgctgacgataccgccggctgggacacacggatcaccctggaggacctcaaaaacgaagagatggtcacaaatcatatgaagggggagcacaaaaagctggccgaagctatttttaagctgacctatcagaacaaagtggttcgcgtgcaaagacccacgcctcggggaacagtcatggatatcatttctcgcagagaccagcggggcagcggacaggtgggcacctacggactcaatacattcaccaacatggaggcccaactgatccgccagatggaaggcgaggggattttcaagtccatccagcatcttacggctaccgaggaaatcgccgttcagaattggctggcgagagtgggacgggagcgcctctctagaatggccattagcggcgatgactgcgtcgtgaaacccatcgatgaccggtttgcttccgccctgacagctcttaacgatatggggaaggttagaaaagacattcaacagtgggaaccgtctcgcggatggaatgattggacccaggtgcctttctgcagccaccactttcatgagctggtcatgaaggacggccgggtgctcgtcgtgccctgtagaaaccaggatgaactgatcgggcgcgcccggatttcccaaggcgcgggatggtctctgaaggagacagcctgcctcggcaaaagctatgctcagatgtggaccctgatgtacttccacagacgcgaccttcggctggccgctaacgccatctgttccgctgttcccagccattgggtgcctacatctagaaccacgtggtccattcacgccaagcacgagtggatgacaaccgaagatatgctcgcggtctggaatcgcgtgtggatccaggagaacccgtggatggaagacaaaacccccgtggagagctgggaagaggttccttatctggggaagcgggaggaccagtggtgcggatctcttatcggcctgacatccagagccacctgggctaaaaatattcaaacagccatcaaccaggtgcgcagcctcattgggaatgaagagtacacggattatatgccctccatgaagcggtttagacgggaagaggaagaggccggagtcctgtggtga

SEQ ID NO: 19758 - RNA, 9876 nt, synthetic construct
  misc_feature 1..9876: note = derived and/or modified CDS sequence (opt5) from DENV-2__EU482630__SS-prME
  source 1..9876: mol_type = other RNA
accgccggcgtgatcgtcatgctgattcccaccgctatggccttccacctcacgacccggaatggggagcctcatatgatcgttggacggcaggaaaagggcaagagcctgctttttaagaccgaggacggggtgaatatgtgcaccctgatggcgattgatctcggagaactgtgtgaggacacgatcacctacaaatgcccgttccttcgccaaaatgaacccgaggatattgactgttggtgcaattccacatctacctgggtgacgtatggcacctgtacaaccacaggggagcacagacgggaaaagcgcagcgtcgctctggtgcctcatgttggaatgggcctcgagaccagaacggaaacatggatgtcctctgagggcgcctggaaacacgtgcagcggatcgagacctggatcctgcgccatcccgggtttacaattatggccgctatcctggcctacaccattggaaccacacacttccagagagctctcatctttattctgcttacggccgtcgcgcctagcatgaccatgcggtgcatcggcatttccaaccgcgatttcgtggaaggggtttctggaggcagctgggtggacatcgtcctggagcacgggtcctgtgtgacaaccatggccaagaataagcccacactcgattttgaactgatcaaaaccgaggctaagcagcctgccacgcttagaaaatattgcattgaagctaagctgacaaacaccaccacagagagccggtgtccgacccaaggagagccctctctcaatgaagaacaggacaaacgcttcatctgcaagcattccatggtggatagaggctggggcaacgggtgtggactgtttggcaaaggcgggattgtcacatgcgccatgttcacgtgcaaaaagaatatggaagggaaagttgtgcagcctgagaacctggaatacaccatcgtgattacaccccacagcggggaggagcatgcggtcggaaatgacaccggcaagcacggcaaagaaatcaagatcacacctcagtcttccattaccgaggccgaactcacggggtatggaaccgtgacaatggagtgtagcccccggaccggcctggattttaacgaaatggttcttctgcaaatggaggacaaggcttggctcgtgcaccgccagtggttcctggatcttccgctgccttggctccccggggccgacacacagggatctaattggatccagaaggagaccctggtcacgtttaagaaccctcatgctaaaaagcaagacgtggttgtgctgggctcccaggaaggggccatgcacacagccctcaccggcgctacagagattcagatgagctccggaaatctgcttttcaccggccatctgaaatgcagactccggatggataagctgcaacttaaagggatgtcttacagcatgtgtaccggaaagttcaagatcgtcaaagaaattgcggagacacagcacggcacgatcgtgatcagagtccagtatgagggggacggatccccctgcaagattccctttgaaatcaccgatctggagaaacgccatgtgctcggccggctgattacagttaaccctatcgtgaccgaaaaggacagcccggtcaacattgaggccgaaccccctttcggggattcttacatcattatcggcgtggagcccggacagctgaaactcaattggtttaagaagggctccagcatcgggcaaatgttcgagacaaccatgagaggagctaaacgcatggccattctgggcgacacggcctgggattttgggtctcttggaggcgttttcacaagcatcgggaaggctctgcaccaggtgtttggcgccatttacggagcggctttctccggcgtctcttggaccatgaaaatcctcattggggtgatcatcacctggattggaatgaacagccggtccacaagcctgtctgtgtccctggttcttgtcggcgtggtgaccctctatctgggggccgtcgtgcaggccgacagcggatgtgttgtgtcttggaagaataaagaactgaagtgcggctccgggatctttattacagataacgtccacacgtggaccgagcagtacaagttccaacctgaaagcccctccaaactcgcttctgccatccagaaggctcatgaggaaggcatttgtggaatcagaagcgtgacacgcctggagaatcttatgtggaaacagatcaccccggagctgaaccacattctctccgaaaatgaggttaagctgacaatcatgaccggcgacattaaagggatcatgcaggccggaaagcggtctctgagacctcaacccacggaacttaaatatagctggaagacctggggcaaggcgaaaatgctctccacagagagccataaccagacctttctgattgatgggcctgaaacagccgagtgccccaataccaaccgcgcttggaactctctggaggtggaagactacggattcggcgtctttacaaccaacatctggctcaagctgcgggagaaacaggacgtgttctgtgattccaaacttatgagcgccgctatcaaagacaatagagccgttcacgcggatatgggctattggattgaatctgccctgaacgacacgtggaagatggagaaggcttccttcatcgaggtgaaaagctgccactggcctaagtctcatacactctggagcaatggggtcctggaatccgagatgattatccccaaaaactttgccggaccggtgagccagcacaactaccgccctggctatcatacccaaaccgctgggccctggcacctgggaaaacttgaaatggatttcgacttttgtgagggcacaaccgtggtcgttacggaagattgcgggaatcggggaccctctctcagaacaaccacagcctccggcaaactgattaccgagtggtgctgtcggagctgcacactgcctccgctccgctacagaggcgaggacgggtgttggtacggaatggaaatccggcccctgaaggagaaggaagagaaccttgtgaatagcctggtgaccgccggccatgggcagattgataacttctctctcggagtcctgggcatggctctgtttcttgaagagatgctcagaacgcgcatcgggaccaaacacgcgatcctgctggtggccgttagcttcgtgacactcattaccggaaatatgtcctttcgggacctgggcagagtcatggtgatggttggcgctacaatgaccgatgacatcgggatgggagtgacgtatcttgccctgctcgccgctttcaaggtccgccctacatttgccgcgggcctgctgcttagaaaactgacctctaaggagctcatgatggctacaattgggatcgccctgctcagccagtccaccattcccgaaaccatcctggagcttacagatgccctggctctcggaatgatggtgctgaaaatcgttcggaacatggaaaagtaccaactggccgtgacgattatggcgatctcttgcgtccctaatgctgtgattcttcagaacgcctggaaggtgagctgtaccatcctggccgctgtctccgttagccccctcctgctcacatcttcccagcagaaagccgactggattcctctggctcttaccatcaagggcctgaatcccacagccatcttcctcaccacgctgagccgcacatctaaaaagagatcctggccgctgaacgaggcgattatggccgtggggatggtgagcatccttgcttcttccctgctcaaaaatgacattcctatgaccggacccctggtcgccggcggcctcctgaccgtgtgctatgttcttacagggcggagcgctgatctggaactggagcgcgccgccgacgtgaagtgggaggatcaagctgaaatctccggaagctctcctattctcagcatcaccatttccgaggacggctctatgagcatcaaaaacgaagaggaggaacagacactgacgatccttattagaaccgggctgctcgtcatctccggagtgtttcccgtttctattccgatcacagcggccgcttggtacctgtgggaggtgaagaagcagcgggccggcgtcctctgggatgtgccttctccccctcccgtcgaaaaagccgagctggaagacggggcttatcgcattaagcagagaggaatccttggctactcccaaatcggcgccggggtgtataaagagggaaccttccacacaatgtggcatgttacccggggcgcggtgctgatgcaccgcgggaagagaattgagccctcctgggctgatgtcaaaaaggacctgatcagctacggaggcgggtggaagctcgaaggagagtggaaagaaggcgaggaagtgcaggttctggcccttgagcctggcaagaatccgcgggccgtgcagacgaaacccgggatttttaagaccaacacaggaaccatcggcgctgtctccctggatttcagccctgggacatctggatcccccattgtggacagaaaaggcaaggtggttgggctctacggaaatggcgtcgtgacccgcagcggcgcctatgtgtctgcgatcgctcagacagagaagtccatcgaagataaccctgagattgaagacgatatcttccggaaaaagagactgacgattatggacctccatcccggggccggaaaaaccaagcgctacctgcctgccatcgtccgggaggctattaaaagaggccttcgcacactgatcctggccccgacccgggtggttgctgccgaaatggaggaggcgctcagagggctgcccattcgctatcaaacccctgccatcaagacagaacacacgggacgggagatcgtggaccttatgtgtcatgctacctttacaatgagactgctcagccccgtccgggtgcctaactacaatctgattatcatggatgaagcccacttcaccgaccccgcttccattgccgcccgcggctatatctctacaagagttgagatgggggaggctgcgggcatttttatgaccgccacgccgcctggaagccgggatcccttcccccagtccaacgctcctatcatggacgaagaaagagaaatccccgagagaagctggaactctggccacgaatgggtgacagattttaaggggaaaaccgtctggttcgtgccttccattaaggccggaaacgacatcgccgcttgcctccggaaaaatggcaagaaagttattcagctgagcagaaagacctttgattctgagtacgtgaagacacgcgccaacgactgggatttcgtcgtgaccacagacatcagcgagatgggggcgaattttaaagctgaacgggtgattgatccgagacgctgtatgaagcccgtcatccttaccgacggagaggaacgggttatcctggccggccctatgcccgtgacgcattcctctgccgctcaaagacgcgggcggattggcagaaaccctaaaaatgagaacgaccagtatatctacatgggagaacccctggagaatgatgaggactgcgcccactggaaggaagcgaaaatgctcctggataacattaatacaccggagggcatcattcctagcatgttcgaacccgagcgcgaaaaggtggacgccatcgatggggagtacagacttcggggagaggctcgcaaaacctttgtcgacctgatgagacggggcgatctccctgtgtggctggcctataaggttgctgccgaagggattaactacgctgaccgcaagtggtgtttcgatggaatcaaaaataaccagatcctggaggaaaacatggaggtggagatttggacaaaggaaggcgagcgcaagaagctcaaaccccggtggcttgacgccagaatctattccgatcctctggcgctgaaggagttcaaggagtttgccgctgggcgcaaatctctcaccctgaatcttattacggaaatgggccggctgcccaccttcatgacacagaaggccagaaacgctctcgacaatctggccgtcctgcataccgccgaggctggaggccgcgcgtacaaccacgccctcagcgagcttccggaaacactggagaccctgctcctgcttacactgctcgctaccgtgacagggggaatctttctgttcctgatgtccggcaaagggattggaaagatgacactcggcatgtgctgcatcatcaccgccagcattcttctgtggtatgcccaaatccagcctcactggattgctgcctctatcattctggaatttttcctcatcgttctgcttatccccgagcccgaaaaacagcggacccctcaggataatcaactgacatacgtggtcattgcgatcctcaccgtggtcgccgctacaatggccaacgagatgggctttctggagaagacgaagaaagacctggggctcggatccattaccacacaggaaagcgagtccaatatccttgacattgatctgagaccggcttctgcctggaccctgtatgcggtggccacaaccttcgttacgcccatgctccggcatagcatcgaaaactcctctgtgaatgtgagcctgaccgctattgccaaccaggctacagtccttatgggcctggggaagggatggcctctctccaaaatggacatcggcgttcccctgctggccatcgggtgttacagccaggtgaatcctattaccctcacagctgcccttctgctgctcgtggcgcactacgccatcattggacccggcctgcaagctaaggccacccgcgaggctcagaaaagagccgccgcgggcatcatgaagaaccctacggtcgatgggattacagtgatcgaccttgaaccgatcccctatgatcctaagtttgagaaacagctgggacaggttatgctcctgattctgtgcgtgacccaagtcctcatgatgcggacaacctgggctctttgtgaggccctgaccctggctacaggccccatctctacgctctgggaagggaatcctggacgcttctggaacaccacaattgccgtgtccatggccaatatctttagaggcagctacctggctggggccggacttctgttctctattatgaagaacaccacatccacccggcgcggcacgggcaatatcggggagacactcggagaaaaatggaaaagcagactgaacgcgctgggcaaatctgagtttcagatctataagaaaagcgggattcaggaggtcgaccggaccctcgccaaggaaggaatcaagcgcggcgagaccgatcatcacgctgtgtccagagggtctgccaaacttcggtggttcgttgaaagaaacatggtgacacccgagggaaaggtcgtggacctgggctgcggccgcgggggatggagctactattgtggcgggctgaaaaatgttcgggaagtgaagggactcaccaaaggcgggccgggacatgaggagcctattcccatgtccacatacggctggaacctggtcagacttcaaagcggcgtggatgtgttctttacgccccctgaaaagtgcgacaccctgctctgtgatatcggggagtcctctcccaatcctacaattgaagctggacgcaccctgcgggttctgaacctcgtcgagaattggcttaacaataacacacagttctgcatcaaggtgctgaatccgtatatgcccagcgtgatcgagaagatggaggccctgcagagacagtacggcggggcgctcgtccgcaaccctctgtccagaaattctacccacgagatgtactgggttagcaacgccacgggaaatattgtgtcctctgtgaacatgatcagcagaatgcttattaatcgctttaccatgaagcacaaaaaggctacatatgaacccgacgtcgatctgggctccgggacccggaacatcggaattgagagcgaaatccctaacctcgacattatcggcaaaagaatcgagaagattaagcaagaacatgagatctcttggcactacgaccaggatcatccctataaaacatgggcctaccacggctcctatgagaccaagcagacagggagcgcttcttccatggtgaatggagttgtgcgcctgctgaccaaaccgtgggacgtcgtgcctatggttacgcagatggccatgacagataccacccccttcggccaacagcgggtgtttaaggaaaaagtcgacacaagaacgcaggagcctaaggaagggaccaagaaactcatgaagattacagctgagtggctttggaaagagctgggaaagaaaaagacaccccgcatgtgtacaagagaagagttcaccaaaaaggtgcggagcaacgccgcgctgggcgccatctttacagatgaaaataagtggaaatctgctcgcgaggccgtggaagacgggagattctgggagctcgtcgatcgggagagaaacctgcaccttgaaggaaagtgcgagacctgtgtttacaatatgatgggcaaacgggaaaagaaactgggcgagtttgggaaggctaagggatcccgcgccatttggtatatgtggctcggcgccagattcctggaatttgaggcgctggggttcctcaacgaggaccattggtttagccggggaaattccctgagcggcgtggaaggggagggccttcaccgcctgggatacatcctcagagatgtgggcaaaaaggaagggggagctatgtacgccgacgatacggccggctgggacacccggatcacactggaggaccttaaaaacgaagagatggtcaccaatcatatgaagggggagcacaaaaagctggctgaagccattttcaagctcacatatcagaacaaagtggttcgcgtgcaaagacctacaccccggggaacggtcatggatatcatttctcgcagagaccagcggggcagcggacaggtgggcacatacggactgaataccttcacaaacatggaggctcaactgatccgccagatggaaggcgaggggatttttaagtccatccagcatctcaccgccacggaggaaatcgcggttcagaattggctggccagagtgggacgggagcgcctttctagaatggctattagcggcgatgactgcgtcgtgaaaccgatcgatgaccggttcgcctccgctctgaccgccctcaacgatatggggaaggttagaaaagacattcaacagtgggaaccttctcgcggatggaatgattggacacaggtgcccttttgcagccaccacttccatgagctggtcatgaaggacggccgggtgcttgtcgtgccctgtagaaaccaggatgaactgatcgggcgcgcgcggatttcccaaggcgccggatggtctctcaaggagaccgcttgcctgggcaaaagctatgcccagatgtggacactgatgtactttcacagacgcgacctccggctggctgccaacgctatctgttccgccgttcctagccattgggtgccgacctctagaacaacctggtccattcacgcgaagcacgagtggatgacgacagaagatatgcttgccgtctggaatcgcgtgtggatccaggagaacccctggatggaagacaaaacccctgtggagagctgggaagaggttccctatctggggaagcgggaggaccagtggtgcggatctctcatcggcctgacctccagagctacatgggccaaaaatattcaaaccgccatcaaccaggtgcgcagccttattgggaatgaagagtacacagattatatgccttccatgaagcggttcagacgggaagaggaagaggctggagtcctgtggtga

SEQ ID NO: 19759 - RNA, 9876 nt, synthetic construct
  misc_feature 1..9876: note = derived and/or modified CDS sequence (opt5) from DENV-2__FJ882594__SS-prME
  source 1..9876: mol_type = other RNA
accgccggcgtgatcgtcatgctgattcccaccgctatggccttccacctcacgaccagaaatggggagcctcatatgatcgttggacggcaggaaaagggcaagagcctgctttttaagacggaggacggggtgaatatgtgcaccctgatggcgattgatctcggagaactgtgtgaggacacaatcacctacaagtgcccccttctgcgccaaaacgaacccgaggatattgactgttggtgcaatagcacatctacctgggtgacgtatggcacctgtacaaccacaggggagcacagacgggaaaagcgcagcgtcgctctcgtgcctcatgttggaatgggcctggagaccagaacggaaacatggatgtcctctgagggcgcctggaaacacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaggaacaggacaaacgctttatctgcaagcattccatggtggatagaggctggggcaacgggtgtggactgttcggcaaagggggaattgtcacatgcgccatgtttacgtgcaaaaagaatatggaaggcaaagttgtgcagcctgagaacctcgaatacaccatcgtgattacaccccacagcggggaggagcatgcggtcggaaatgacaccggcaagcacggcaaagaaatcaagatcacacctcagtcttccattaccgaggccgaactgacggggtatggaaccgtgacaatggagtgtagcccccggaccggccttgatttcaacgaaatggttctgctccaaatggaggacaaggcttggctggtgcaccgccagtggtttcttgatctgccgctcccttggctgcccggggccgacacacagggatctaattggatccagaaggagaccctggtcacgttcaagaaccctcatgctaaaaagcaagacgtggttgtgctcggctcccaggaaggggccatgcacacagccctgaccggcgctacagagattcagatgagctccggaaatcttctgtttaccggccatctcaaatgcagactgcggatggataaacttcaactgaaagggatgtcttacagcatgtgtaccggaaagttcaagatcgtcaaagaaattgcggagacacagcacggcacgatcgtgatcagagtccagtatgagggggacggatccccctgcaagattcccttcgaaatcaccgatctcgagaaacgccatgtgctgggccggctgattacagttaaccctatcgtgaccgaaaaggacagcccggtcaacattgaggccgaacccccttttggggattcttacatcattatcggcgtggagcccggacagctcaaactgaattggttcaagaagggctccagcatcgggcaaatgtttgagacaaccatgagaggagctaaacgcatggccattcttggcgacacggcctgggatttcgggtctctgggaggcgtttttacaagcatcgggaaggctctccaccaggtgttcggcgccatttacggagcggctttttccggcgtctcttggaccatgaaaatcctgattggggtgatcatcacctggattggaatgaacagccggtccacaagcctgtctgtgtcccttgttctcgtcggcgtggtgaccctgtatctgggggccatggtccaggccgacagcggatgtgtggtttcttggaagaataaagaactcaagtgcggctccgggatcttcattacagataacgtgcacacgtggaccgagcagtacaagtttcaacctgaaagcccctccaaactggcttctgccatccagaaggctcatgaggaaggcatttgtggaatcagaagcgtcacacgccttgagaatctgatgtggaaacagatcaccccggagctcaaccacattctgtccgaaaatgaggtgaagctgacaatcatgaccggcgacattcgggggatcatgcaggccggaaaaagatctcttcgccctcaacccacggaactcaagtatagctggaaaacctggggcaaggcgaagatgctgtccacagagagccataaccagaccttcctgattgatgggcctgaaacagccgagtgccccaataccaaccgggcttggaactctctcgaggttgaagactacggatttggcgtgttcacaaccaacatctggctgaaacttagagagaagcaggacgtcttttgtgattccaaactgatgagcgccgctatcaaggacaatcgcgccgtgcacgcggatatgggctattggattgaatctgccctcaacgacacgtggaaaatggagaaggcttccttcatcgaggttaagagctgccactggcctaaatctcatacactgtggagcaatggggtgctggaatccgagatgattatccccaagaacttcgccggaccggtcagccagcacaactaccggcctggctatcatacccaaaccgctgggccctggcaccttggaaaactcgaaatggattttgacctgtgtgagggcacaaccgtggtggtcacggaagattgcgggaatagaggaccctctctgcggacaaccacagcctccggcaagctcattaccgagtggtgctgtcgcagctgcacactgcctccgcttagataccggggcgaggacgggtgttggtacggaatggaaatcagacccctgaaagagaaggaagagaacctcgttaattccctggtgaccgccggccatgggcagattgataacttctctctgggagtgcttggcatggctctctttctggaagagatgctgcgcacgcggatcgggaccaagcacgcgatcctcctggtcgccgtgagcttcgttacacttattaccggaaatatgtcctttagagacctgggccgcgtgatggtcatggtgggcgctacaatgaccgatgacatcgggatgggagttacgtatctcgccctgctggccgctttcaaagtgagacctacatttgccgcgggccttctgctccggaagctgacctctaaagagctcatgatggctacaattgggatcgccctgcttagccagtccaccattcccgaaaacatcctggagctcaccgatgccctggctctgggaatgatggtccttaagatcgtgcgcaatatggaaaaataccaactggccgttacaattatggcgatctcttgcgtgcctaacgctgtcattctccagaatgcctggaaggtgagctgtacgatcctggccgctgtgtccgtcagccccctcctgcttacctcttcccagcagaaggccgactggattcctctggctctcacaatcaaaggcctgaaccccaccgccatcttcctgacaacccttagcagaacgtctaagaaacggtcctggccgctgaatgaggcgattatggccgttgggatggtgagcatcctcgcttcttccctgctcaagaacgacattcctatgacaggacccctggtggccggcggccttctgaccgtctgctatgtgctgaccgggcgcagcgctgatctcgaactggagagagccgccgacgttaaatgggaggatcaagctgaaatctccggaagctctcctattcttagcatcacaatttccgaggacggctctatgagcatcaagaatgaagaggaggaacagaccctgacaatcctcattcggacggggctgctcgtgatctccggagtctttcccgtgtctattccgatcaccgcggccgcttggtacctgtgggaggttaaaaagcagcgcgccggcgtgctttgggatgtcccttctccccctcccgtggaaaaggccgagctggaagacggggcttatagaattaaacagcggggaatcctgggctactcccaaatcggcgccggggtctataaggagggaacattccacaccatgtggcatgtgacacgcggcgcggttctcatgcacagagggaaacggattgagccctcctgggctgatgtgaagaaagacctgatcagctacggaggcgggtggaaacttgaaggagagtggaaggaaggcgaggaagtccaggtgctggccctcgagcctggcaaaaacccgagagccgttcagaccaagcccgggatttttaaaacgaataccggaacaatcggcgctgtgtccctggatttcagccctgggacctctggatcccccattgtcgaccgcaagggcaaagtggtggggctctacggaaacggcgttgtcacacggagcggcgcctatgtgtctgcgatcgctcagaccgagaagtccatcgaagataaccctgagattgaagacgatatctttagaaagaaacgcctgacaattatggaccttcatcccggggccggaaagacgaaacggtacctgcctgccatcgtgagagaggctattaagcgcggcctgcggaccctcatcctggccccgacaagagtcgtggctgccgaaatggaggaggcgcttcgcgggctgcccattcggtatcaaaccaccgccatcaaaacagaacacacgggaagagagatcgttgacctcatgtgtcatgctaccttcacaatgcggctgctcagccctgtgcgcgtccccaattacaacctgattatcatggatgaagcccacttcaccgaccctgcttccattgccgccagaggctatatctctacacgggtggagatgggggaggctgcgggcatttttatgaccgccacgcccccgggaagccgcgatcctttcccccagtccaatgctcccatcatggacgaagagagagaaatccctgagcggagctggaactctggccacgaatgggttacagattttaaggggaagaccgtgtggttcgtcccctccattaaagccggaaatgacatcgccgcttgccttagaaagaacggcaaaaaggtgattcagctgagccgcaaaacctttgattctgagtacgttaagacacgggccaatgactgggatttcgtggtcaccacagacatcagcgagatgggggcgaactttaaggctgaaagagtgattgatcctcgccggtgtatgaaaccggtgatcctgaccgacggagaggaaagagtcatcctcgccggccccatgcctgttacgcattcctctgccgctcaacgccgggggagaattggccgcaatcccaagaacgagaatgaccagtatatctacatgggagaacctctggagaacgatgaggactgcgcccactggaaagaagcgaagatgcttctggataatattaacacacccgagggcatcattccgagcatgttcgaacctgagagagaaaaagtggacgccatcgatggggagtaccggctccgcggagaggctagaaagacctttgtggacctgatgcggcgcggcgatctgcccgtctggctcgcctataaagtggctgccgaagggattaattacgctgacagaaagtggtgtttcgatggaatcaagaacaaccagatccttgaggaaaatatggaggttgagatttggacaaaagaaggcgagcggaagaaactgaagcctagatggctggacgcccgcatctattccgatcccctcgcgctgaaagaatttaaggagttcgccgctgggcggaagtctcttaccctgaacctcattacggaaatgggcagactgcctaccttcatgacacagaaagcccgcaatgctctggacaacctcgccgtgcttcataccgccgaggctggaggccgggcgtacaatcacgccctgagcgagctgcccgaaacactcgagaccctgcttctgctcacactgctggctaccgtcacagggggaatctttctcttccttatgtccggcaaggggattggaaaaatgacactgggcatgtgctgcatcatcaccgccagcattctgctctggtatgcccaaatccagccgcactggattgctgcctctatcattctggaatttttccttatcgtgctgctcatccctgagcccgaaaagcagagaacaccccaggataaccaactgacatacgttgtgattgcgatcctgaccgtcgtggccgctacaatggccaatgagatgggctttctcgagaaaacgaagaaggaccttgggctgggatccattaccacacaggaaagcgagtccaacatcctggacattgatctccggcctgcttctgcctggaccctgtatgcggtcgccacaaccttcgtgacgccgatgcttcgccatagcatcgaaaattcctctgttaacgtgagcctgaccgctattgccaatcaggctacagtgctcatgggcctggggaaaggatggcccctgtccaagatggacatcggcgtccctctccttgccatcgggtgttacagccaggttaaccccattaccctgacagctgccctgctcctgcttgtggcgcactacgccatcattggacctggcctgcaagctaaagccaccagagaggctcagaagcgggccgccgcgggcatcatgaaaaatcccacggtggatgggattacagtcatcgacctcgaacctatcccgtatgatcccaagtttgagaagcagctgggacaggtgatgctgctcattctttgcgttacccaagtgctgatgatgcgcacaacctgggctctgtgtgaggccctcaccctggctacaggccctatctctacgctttgggaagggaaccccggaagattctggaataccacaattgccgtctccatggccaacatctttcggggcagctacctggctggggccggactcctgttctctattatgaaaaataccacaaacacccgcagaggcacgggcaacatcggggagacactgggagaaaagtggaaatcccggctcaatgcgcttggcaagagcgagtttcagatctataaaaagtctgggattcaggaggtggaccgcaccctggccaaagaaggaatcaagagaggcgagaccgatcatcacgctgtcagccgggggtccgccaagctgagatggttcgtggaacgcaacatggttacacctgagggaaaagtggtcgacctcggctgcggcagagggggatggtcttactattgtggcgggctgaagaatgtgcgggaagttaaaggacttaccaagggcgggcccggacatgaggagccgattcctatgagcacatacggctggaacctggtgcgcctccaatccggcgtcgatgtgtttttcacgccgcccgaaaaatgcgacaccctgctgtgtgatatcggggagagctcccctaatcccacaattgaagctggacggaccctcagagtgcttaacctggttgagaattggctgaacaataacacacagttctgcatcaaggtcctcaatccttatatgccgtctgtgatcgaaaagatggaggccctgcagcgcaaatacggcggggcgcttgtgcggaaccccctgagcagaaattccacccacgagatgtactgggtctctaacgccacgggaaatattgttagctccgtgaacatgatctctcgcatgctcattaaccggtttaccatgaagcacaaaaaggctacatatgaacctgacgtggatctgggcagcgggaccagaaatatcggaattgagtccgaaatccccaacctggacattatcggcaaacgcatcgagaagattaagcaggaacatgaggccagctggcactacgaccaagatcatccttataaaacatgggcttaccacggctcttatgagaccaagcagacagggtccgccagctctatggtcaatggagtggttcggctccttaccaaaccctgggacgtggtcccgatggtgacgcagatggctatgacagataccacccctttcggccagcaaagagtttttaaggaaaaagtggacacacgcacgcaggagcccaaggaagggaccaagaaactgatgaagatcacagccgagtggctgtggaaagagctcggaaagaaaaagacccctagaatgtgtacacgggaagagttcaccaaaaaggtccgctccaacgcggccctgggcgctatttttacagatgaaaataagtggaaaagcgccagagaggctgtggaagacgggcggttctgggagcttgtggatagagagcggaacctgcacctcgaaggaaagtgcgagacctgtgtctacaatatgatgggcaaacgcgaaaagaaactgggcgagtttgggagagccaagggatctcgggccatctggtatatgtggctgggcgcgcgcttcctcgaatttgaggctctggggttccttaacgaggaccattggttttccagaggaaatagcctgtccggcgttgaaggggagggcctccaccggctgggatacattcttcgcgatgtgggcaagaaagaagggggagccatgtacgccgacgatacggctggctgggacaccagaatcacactggaggacctcaagaacgaagagatggtgaccaatcatatgaaaggggagcacaagaaactggccgaagctatcttcaagctgacatatcagaacaaggtcgtgcgggttcagcgccccacccctagaggaacggtgatggatattatcagccggcgcgaccaaagaggctctgggcaggtcggcacatacggactcaatacctttacaaacatggaggcccagctgattcggcaaatggaaggcgaggggatcttcaaaagcattcagcatcttaccgcgacggaggaaatcgccgtgcagaattggctggctcgcgttggaagagagcggctctccagaatggccatctctggcgatgactgcgtggtcaagcccattgatgaccgcttcgctagcgccctgaccgcgcttaacgatatggggaaagtgcggaaggacatccagcaatgggaaccgtccagaggatggaacgattggacacaggttcctttttgctctcaccacttccatgagctggtgatgaaagacggccgcgtcctcgtggtcccctgtcggaatcaggatgaactgattgggagagcccgcatcagccagggcgctggatggtccctgaaggagaccgcctgcctcggcaagtcttatgctcaaatgtggacactgatgtactttcaccggagagaccttcgcctggccgctaacgccatttgtagcgcggtgccctcccattgggttcctaccagccggacaacctggtctatccacgccaaacacgagtggatgacgacagaagatatgctcgctgtgtggaatagagtctggattcaggagaacccgtggatggaagacaagacccccgtggagtcctgggaagaggtgccttatctggggaaacgcgaggaccagtggtgcggaagccttatcggcctgacctctcgggccacatgggccaagaatatccagaccgctattaaccaagttagatccctcatcgggaatgaagagtacacagattatatgcccagcatgaaacggttcagacgcgaagaggaagaggccggagtgctgtggtga

SEQ ID NO: 19760 - RNA, 9876 nt, synthetic construct
  misc_feature 1..9876: note = derived and/or modified CDS sequence (opt5) from DENV-2__FJ205885__SS-prME
  source 1..9876: mol_type = other RNA
accgccggcgtgatcgtcatgctgattcccacagctatggccttccacctcacgacccggaatggggaacctcatatgatcgttggacggcaggaaaagggcaagagcctgctttttaagaccgaggacggggtgaatatgtgcaccctgatggcgattgatctcggagaactgtgtgaggacacaatcacctacaaatgcccgcttctgcgccaaaatgaacccgaggatattgactgttggtgcaattccacatctacctgggtgacgtatggcacctgtacaaccacaggggagcacagacgggaaaagcgcagcgtcgctctcgtgcctcatgttggaatgggcctggagaccagaacggaaacatggatgtcctctgagggcgcctggaaacacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaagaacaggacaaacgctttatctgcaagcattccatggtggatagaggctggggcaacgggtgtggactgttcggcaaaggcgggattgtcacatgcgccatgtttacgtgcaaaaagaatatggaagggaaagttgtgcagcctgagaacctcgaatacaccatcgtgattacaccccacagcggggaggagcatgcggtcggaaatgacaccggcaagcacggcaaagaaatcaagatcacacctcagtcttccattaccgaggccgaactgacggggtatggaaccgtgacaatggagtgtagcccccggaccggccttgatttcaacgaaatggttctgctccaaatggaggacaaggcttggctggtgcaccgccagtggtttcttgatctgccgctcccttggctgcccggggccgacacacagggatctaattggatccagaaggagaccctggtcacgttcaagaaccctcatgctaaaaagcaagacgtggttgtgctcggctcccaggaaggggccatgcacacagccctgaccggcgctacagagattcagatgagctccggaaatcttctgtttaccggccatctcaaatgcagactgcggatggataaacttcaactgaaagggatgtcttacagcatgtgtaccggaaagttcaagatcgtcaaagaaattgcggagacacagcacggcacgatcgtgatcagagtccagtatgagggggacggatccccctgcaagattcccttcgaaatcaccgatctcgagaaacgccatgtgctgggccggctgattacagttaaccctatcgtgaccgaaaaggacagcccggtcaacattgaggccgaacccccttttggggattcttacatcattatcggcgtggagcccggacagctcaaactgaattggttcaagaagggctccagcatcgggcaaatgtttgagacaaccatgagaggagctaaacgcatggccattcttggcgacacggcctgggatttcgggtctctgggaggcgttctcacaagcatcgggaaggctctgcaccaggtgtttggcgccatttacggagcggctttctccggcgtctcttggaccatgaaaatcctgattggggtgatcatcacctggattggaatgaacagccggtccacaagcctttctgtgtccctcgttctggtcggcgtggtgaccctgtatctcggggccgtcgtgcaggccgacagcggatgtgttgtgtcttggaagaataaagaactgaagtgcggctccgggatctttattacagataacgtccacacgtggaccgagcagtacaagttccaacctgaaagcccctccaaacttgcttctgccatccagaaggctcatgaggaaggcatttgtggaatcagaagcgtgacacgcctggagaatctcatgtggaaacagatcaccccggagctgaaccacattctgtccgaaaatgaggttaaacttacaatcatgaccggcgacattaaagggatcatgcaggccggaaagcggtctctcagacctcaacccacggaactgaaatatagctggaagacctggggcaaggcgaaaatgctgtccacagagagccataaccagacctttctcattgatgggcctgaaacagccgagtgccccaataccaaccgcgcttggaactctctggaggtggaagactacggattcggcgtctttacaaccaacatctggcttaagctgcgggagaaacaggacgtgttctgtgattccaagctcatgagcgccgctatcaaagacaatagagccgttcacgcggatatgggctattggattgaatctgccctgaacgacacgtggaagatggagaaggcttcctttatcgaggtgaaaagctgccactggcctaagtctcatacactgtggagcaatggggtccttgaatccgagatgattatccccaaaaacttcgccggaccggtgagccagcacaactaccgccctggctatcatacccaaaccgctgggccctggcacctcggaaagctggaaatggatttcgacttttgtgagggcacaaccgtggtcgttacggaagattgcgggaatcggggaccctctctgagaacaaccacagcctccggcaaactcattaccgagtggtgctgtcggagctgcacactgcctccgcttcgctacagaggcgaggacgggtgttggtacggaatggaaatccggcccctgaaggagaaggaagagaacctcgtgaatagcctggtgaccgccggccatgggcagattgataacttctctctgggagtccttggcatggctctctttctggaagagatgctgagaacgcgcatcgggaccaaacacgcgatcctcctggtggccgttagcttcgtgacacttattaccggaaatatgtcctttcgggacctgggcagagtcatggtgatggttggcgctacaatgaccgatgacatcgggatgggagtgacgtatctcgccctgctggccgctttcaaggtccgccctacatttgccgcgggccttctgctcagaaaactgacctctaaggagctcatgatggctacaattgggatcgccctgcttagccagtccaccattcccgaaaccatcctggagctcacagatgccctggctctgggaatgatggtgcttaaaatcgttcggaacatggaaaagtaccaactggccgtgacgattatggcgatctcttgcgtccctaatgctgtgattctccagaacgcctggaaggtgagctgtaccatcctggccgctgtctccgttagccccctcctgcttacatcttcccagcagaaagccgactggattcctctggctctcaccatcaagggcctgaatcccacagccatcttcctgaccacgcttagccgcacatctaaaaagagatcctggccgctgaacgaggcgattatggccgtggggatggtgagcatcctcgcttcttccctgctcaaaaatgacattcctatgaccggacccctggtcgccggcggccttctgaccgtgtgctatgttctgacagggcggagcgctgatctcgaactggagcgcgccgccgacgtgaagtgggaggatcaagctgaaatctccggaagctctcctattcttagcatcaccatttccgaggacggctctatgagcatcaaaaacgaagaggaggaacagacactgacgatcctcattagaaccgggctgctcgtcatctccggagtgtttcccgtttctattccgatcacagcggccgcttggtacctgtgggaggtgaagaagcagcgggccggcgtcctttgggatgtgccttctccccctcccgtcgaaaaagccgagctggaagacggggcttatcgcattaagcagagaggaatcctgggctactcccaaatcggcgccggggtgtataaagagggaaccttccacacaatgtggcatgttacccggggcgcggtgctcatgcaccgcgggaagagaattgagccctcctgggctgatgtcaaaaaggacctgatcagctacggaggcgggtggaaacttgaaggagagtggaaagaaggcgaggaagtgcaggttctggccctcgagcctggcaagaatccgcgggccgtgcagacgaaacccgggatttttaagaccaacacaggaaccatcggcgctgtctccctggatttcagccctgggacatctggatcccccattgtggacagaaaaggcaaggtggttgggctctacggaaatggcgtcgtgacccgcagcggcgcctatgtgtctgcgatcgctcagacagagaagtccatcgaagataaccctgagattgaagacgatatctttcggaaaaagagactgacgattatggaccttcatcccggggccggaaaaaccaagcgctacctgcctgccatcgtccgggaggctattaaaagaggcctgcgcacactcatcctggccccgacccgggtggttgctgccgaaatggaggaggcgcttagagggctgcccattcgctatcaaacccctgccatcaagacagaacacacgggacgggagatcgtggacctcatgtgtcatgctaccttcacaatgagactgctcagccccgtccgggtgcctaactacaatctgattatcatggatgaagcccacttcaccgaccccgcttccattgccgcccgcggctatatctctacaagagttgagatgggggaggctgcgggcatttttatgaccgccacgccgcctggaagccgggatcccttcccccagtccaacgctcctatcatggacgaagagagagaaatccccgagagaagctggaactctggccacgaatgggtgacagattttaaggggaaaaccgtctggttcgtgccttccattaaggccggaaacgacatcgccgcttgccttcggaaaaatggcaagaaagttattcagctgagcagaaagacctttgattctgagtacgtgaagacacgcgccaacgactgggatttcgtcgtgaccacagacatcagcgagatgggggcgaattttaaagctgaacgggtgattgatccgagacgctgtatgaagcccgtcatcctgaccgacggagaggaacgggttatcctcgccggccctatgcccgtgacgcattcctctgccgctcaaagacgcgggcggattggcagaaaccctaaaaatgagaacgaccagtatatctacatgggagaacccctggagaatgatgaggactgcgcccactggaaggaagcgaaaatgcttctggataacattaatacaccggagggcatcattcctagcatgttcgaacccgagcgcgaaaaggtggacgccatcgatggggagtacagactccggggagaggctcgcaaaacctttgtcgacctgatgagacggggcgatctgcctgtgtggctcgcctataaggttgctgccgaagggattaactacacagaccgcaagtggtgtttcgatggaatcaaaaataaccagatccttgaggaaaacatggaggtggagatttggaccaaggaaggcgagcgcaagaagctgaaaccccggtggctggacgctagaatctattccgatcctctcgccctgaaggaatttaaggagttcgcggccgggcgcaaatctcttacgctgaatctcattaccgaaatgggccggctgcccacattcatgacccagaaggctagaaacgccctggacaatctcgctgtccttcatacagccgaggccggaggccgcgcttacaaccacgcgctgagcgagctgccggaaaccctcgagacactgcttctgctcaccctgctggccacggtgacagggggaatctttctcttccttatgtccggcaaagggattggaaagatgaccctgggcatgtgctgcatcatcaccgctagcattctgctctggtatgcccaaatccagcctcactggattgccgcttctatcattctggaatttttccttatcgttctgctcatccccgagcccgaaaaacagcggacacctcaggataatcaactgacctacgtggtcattgccatcctgacagtggtcgcggccacgatggctaacgagatgggctttctcgagaagaccaagaaagaccttgggctgggatccattacaacccaggaaagcgagtccaatatcctggacattgatctcagaccggcctctgcttggacactgtatgccgtggcgaccacgttcgttacccccatgcttcggcatagcatcgaaaactcctctgtgaatgtgagcctgacagccattgctaaccaggccaccgtcctcatgggcctggggaagggatggcctctgtccaaaatggacatcggcgttcccctccttgctatcgggtgttacagccaggtgaatcctattacactgaccgccgctctgctcctgcttgtggcccactacgcgatcattggacccggcctgcaagccaaggctacgcgcgaggcccagaaaagagctgccgccggcatcatgaagaaccctacagtcgatgggattaccgtgatcgacctcgaaccgatcccctatgatcctaagtttgagaaacagctgggacaggttatgctgctcattctttgcgtgacacaagtcctgatgatgcggaccacctgggcgctgtgtgaggctctcacactggccacgggccccatctctaccctttgggaagggaatcctggacgcttctggaacacaaccattgctgtgtccatggccaatatctttagaggcagctacctggccggggctggactcctgttctctattatgaagaacacaacctccacgcggcgcggcacaggcaatatcggggagaccctgggagaaaaatggaaaagcagactcaacgcccttggcaaatctgagtttcagatctataagaaaagcgggattcaggaggtcgaccggaccctggcgaaggaaggaatcaagcgcggcgagacagatcatcacgccgtgtccagagggtctgctaaactgcggtggttcgttgaaagaaacatggtgacccccgagggaaaggtcgtggacctcggctgcggccgcgggggatggagctactattgtggcgggctgaaaaatgttcgggaagtgaagggacttacaaaaggcgggccgggacatgaggagcctattcccatgtccacgtacggctggaacctggtcagactccaaagcggcgtggatgtgtttttcacaccccctgaaaagtgcgacacactgctgtgtgatatcggggagtcctctcccaatcctaccattgaagccggacgcacactccgggttcttaacctggtcgagaattggctgaacaataacacccagttctgcatcaaggtgctcaatccgtatatgcccagcgtgatcgagaagatggaggctctgcagagacagtacggcggggcccttgtccgcaaccctctgtccagaaattctacgcacgagatgtactgggttagcaacgcgaccggaaatattgtgtcctctgtgaacatgatcagcagaatgctcattaatcgctttacaatgaagcacaaaaaggccacctatgaacccgacgtcgatctgggctccgggacacggaacatcggaattgagagcgaaatccctaacctggacattatcggcaaaagaatcgagaagattaagcaagaacatgagatctcttggcactacgaccaggatcatccctataaaacctgggcttaccacggctcctatgagacaaagcagaccgggagcgcctcttccatggtgaatggagttgtgcgcctccttacgaaaccgtgggacgtcgtgcctatggttacacagatggctatgaccgataccacacccttcggccaacagcgggtgtttaaggaaaaagtcgacacgagaacccaggagcctaaggaagggacaaagaaactgatgaagattaccgccgagtggctgtggaaagagctcggaaagaaaaagacaccccgcatgtgtaccagagaagagttcacacggaaagtgcgcagcaacgctgccctgggcgcgatctttaccgatgaaaataagtggaagtctgccagagaggctgtggaagacgggcggttctgggagcttgtcgatagagagcggaacctgcacctcgaaggaaaatgcgagacgtgtgtttacaatatgatgggcaagcgcgagaagaagctgggcgagtttgggaaagccaagggatccagagctatttggtatatgtggctgggcgcccggttcctcgaatttgaggccctggggttccttaacgaggaccattggtttagccgcggaaattccctgagcggcgtggaaggggagggcctccacagactgggatacatccttcgggatgtgggcaagaaagaagggggagcgatgtacgctgacgataccgccggctgggacacacgcatcaccctggaggacctcaagaacgaagagatggtcacaaatcatatgaaaggggagcacaagaaactggccgaagctattttcaagctgacctatcagaacaaggtggttagagtgcaacggcctacgccccgcggaacagtcatggatatcatttctagacgggaccagcgcggcagcggacaggtgggcacctacggactcaatacatttaccaacatggaggcccaactgatcagacagatggaaggcgaggggattttcaaatccatccagcatcttacggctaccgaggaaatcgccgttcagaattggctggcgcgggtgggacgcgagagactctctcggatggccattagcggcgatgactgcgtcgtgaagccgatcgatgacagattcgcttccgccctgacagctcttaacgatatggggaaagttcgcaaggacattcaacagtgggaaccttctcggggatggaatgattggacccaggtgcccttttgcagccaccacttccatgagctggtcatgaaagacggcagagtgctcgtcgtgccctgtcgcaaccaggatgaactgatcgggcgggccagaatttcccaaggcgcgggatggtctctgaaggagacagcctgcctcggcaagagctatgctcagatgtggaccctgatgtactttcaccgccgggaccttagactggccgctaacgccatctgttccgctgttcctagccattgggtgccgacatctcgcaccacgtggtccattcacgccaaacacgagtggatgacaaccgaagatatgctcgcggtctggaatcgggtgtggatccaggagaacccctggatggaagacaagacccctgtggagagctgggaagaggttccctatctggggaaaagagaggaccagtggtgcggatctcttatcggcctgacatcccgcgccacctgggctaagaatattcaaacagccatcaaccaggtgcggagcctcattgggaatgaagagtacacggattatatgccttccatgaaaagattccggagagaagaggaagaggccggagtcctgtggtga

SEQ ID NO: 19761 - RNA, 9876 nt, synthetic construct
  misc_feature 1..9876: note = derived and/or modified CDS sequence (opt5) from DENV-2__FJ744743__SS-prME
  source 1..9876: mol_type = other RNA
acagccggcgtgatcgtcatgctgattcccacagctatggccttccacctcacgacccggaatggggagcctcatatgatcgttggacggcaggaaaagggcaagagcctgctttttaagacagaggacggggtgaatatgtgcaccctgatggcgattgatctcggagaactgtgtgaggacacaatcacctacaagtgcccgcttctgcgccaaaatgaacccgaggatattgactgttggtgcaattccacatctacctgggtgacgtatggcacctgtacaaccacaggggagcacagacgggaaaagcgcagcgtcgctctcgtgcctcatgttggaatgggcctggagaccagaacggaaacatggatgtcctctgagggcgcctggaagcacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaagaacaggacaaacgctttatctgcaagcattccatggtggatagaggctggggcaacgggtgtggactgttcggcaaagggggaattgtcacatgcgccatgtttacgtgcaaaaagaatatggaaggcaaagttgtgcagcctgagaacctcgaatacaccatcgtgattacaccccacagcggggaggagcatgcggtcggaaatgacaccggcaagcacggcaaagaaatcaagatcacacctcagtcttccattaccgaggccgaactgacggggtatggaaccgtgacaatggagtgtagcccccggaccggccttgatttcaacgaaatggttctgctccaaatggaggacaaggcttggctggtgcaccgccagtggtttcttgatctgccgctcccttggctgcccggggccgacacacagggatctaattggatccagaaggagaccctggtcacgttcaagaaccctcatgctaaaaagcaagacgtggttgtgctcggctcccaggaaggggccatgcacacagccctgaccggcgctacagagattcagatgagctccggaaatcttctgtttaccggccatctcaaatgcagactgcggatggataaacttcaactgaaagggatgtcttacagcatgtgtaccggaaagttcaagatcgtcaaagaaattgcggagacacagcacggcacgatcgtgatcagagtccagtatgagggggacggatccccctgcaagattcccttcgaaatcaccgatctcgagaaacgccatgtgctgggccggctgattacagttaaccctatcgtgaccgggaaggacagcccggtcaacattgaagccgagcccccttttggcgattcttacatcattatcggagtggaacccggccagctcaaactgaattggttcaagaaggggtccagcatcggacaaatgtttgagacaaccatgagaggcgctaaacgcatggccattcttggggacacggcctgggatttcggatctctgggcggggtttttacaagcatcggcaaggctctccaccaggtgttcggagccatttacggcgcggctttttccggggtctcttggaccatgaaaatcctgattggagtgatcatcacctggattggcatgaacagccggtccacaagcctgtctgtgtcccttgttctcgtcggggtggtgaccctgtatctgggagccgtcgtgcaggccgacagcggctgtgttgtgtcttggaagaataaagagctcaagtgcgggtccggcatcttcattacagataacgtccacacgtggaccgaacagtacaagtttcaacctgagagcccctccaaactggcttctgccatccagaaggctcatgaagagggaatttgtggcatcagaagcgtgacacgccttgaaaatctgatgtggaaacagatcaccccggagctcaaccacattctgtccgagaatgaagttaagctgacaatcatgaccggggacattaaaggaatcatgcaggccggcaagcggtctctttggcctcaacccacggagctcaaatatagctggaagacctgggggaaggcgaaaatgctgtccacagaaagccataaccagaccttcctgattgatggacctgagacagccgaatgccccaataccaacagagcttggaactctctcgaggtggaggactacggctttggcgtcttcacaaccaacatctggctgaaacttcgcgaaaaacaggacgtgttttgtgattccaagctgatgagcgccgctatcaaagacaatcgggccgttcacgcggatatggggtattggattgagtctgccctcaacgacacgtggaagatggaaaaggcttccttcatcgaggtgaaaagctgccactggcctaagtctcatacactgtggagcaatggagtcctggagtccgaaatgattatccccaaaaacttcgccggcccggtgagccagcacaactacagacctgggtatcatacccaaaccgctggaccctggcaccttggcaagctcgagatggattttgacttctgtgaagggacaaccgtggtcgttacggaggattgcggaaatcgcggcccctctctgcggacaaccacagcctccggcaaactgattaccgaatggtgctgtagaagctgcacactccctccgctgcggtaccgcggggaggacggatgttggtacggcatggagatcagaccccttaaggaaaaggaggaaaacctggtgaatagcctcgtgaccgccgggcatggacagattgataacttttctctgggcgtcctggggatggctcttttcctcgaggaaatgctgcggacgagaatcggaaccaaacacgcgatcctgctcgtggccgttagctttgtgacactgattaccggcaatatgtccttccgcgaccttggccgggtcatggtgatggttggggctacaatgaccgatgacatcggaatgggcgtgacgtatctggccctcctggccgcttttaaggtcagacctacattcgccgcggggctgcttctgcgcaaactcacctctaaggagctgatgatggctacaattggaatcgccctcctgagccagtccaccattcccgagaccatccttgaactgacagatgccctcgctctgggcatgatggtgctgaaaatcgttagaaacatggagaagtaccaacttgccgtgacgattatggcgatctcttgcgtccctaatgctgtgattctgcagaacgcctggaaggtgagctgtaccatcctcgccgctgtctccgttagccccctgctcctgacatcttcccagcagaaagccgactggattcctcttgctctgaccatcaaggggctcaatcccacagccatctttctgaccacgctgagccggacatctaaaaagcgctcctggccgcttaacgaagcgattatggccgtgggaatggtgagcatcctggcttcttccctcctgaaaaatgacattcctatgaccggccccctcgtcgccggcgggctgcttaccgtgtgctatgttctgacaggaagaagcgctgatctggagctcgaacgggccgccgacgtgaagtgggaggatcaagctgagatctccggcagctctcctattctgagcatcaccatttccgaagacgggtctatgagcatcaaaaacgaggaagaggagcagacacttacgatcctgattcgcaccggactcctggtcatctccggcgtgttccccgtttctattccgatcacagcggccgcttggtacctctgggaagtgaagaagcagagagccggggtcctgtgggatgtgccttctccccctcccgtcgagaaagccgaacttgaggacggagcttatcggattaagcagcgcggcatcctgggctactcccaaatcggggccggagtgtataaagaaggcacctttcacacaatgtggcatgttaccagaggggcggtgctgatgcaccggggaaagcgcattgagccctcctgggctgatgtcaaaaaggacctcatcagctacggcgggggatggaagctggagggcgaatggaaagagggcgaagaggtgcaggttcttgccctggaacctgggaagaatccgagagccgtgcagacgaaacccggaattttcaagaccaacacaggcaccatcggggctgtctccctcgattttagccctggaacatctggctcccccattgtggaccggaaagggaaggtggttggactgtacggcaatggcgtcgtgaccagaagcggggcctatgtgtctgcgatcgctcagacagagaagtccatcgaggataaccctgaaattgaggacgatatcttccgcaaaaagcggctcacgattatggacctgcatcccggagccggcaaaaccaagagataccttcctgccatcgtccgcgaagctattaaacgggggctgagaacactgatcctcgccccgacccgcgtggttgctgccgagatggaagaggcgctgcggggacttcccattagatatcaaacccctgccatcaagacagagcacacgggccgcgaaatcgtggacctgatgtgtcatgctaccttcacaatgcggctcctgagccccgtcagagtgcctaactacaatctcattatcatggatgaggcccactttaccgaccccgcttccattgccgcccgggggtatatctctacacgcgttgaaatgggcgaggctgcgggaattttcatgaccgccacgccgcctggcagcagagatccctttccccagtccaacgctcctatcatggacgaggaacgggagatccccgaacgcagctggaactctgggcacgagtgggtgacagatttcaagggaaaaaccgtctggtttgtgccttccattaaggccggcaacgacatcgccgcttgcctgcgcaagaatgggaagaaagttattcagcttagccggaagaccttcgattctgaatacgtgaagacaagagccaacgactgggattttgtcgtgaccacagacatcagcgagatgggagcgaatttcaaagctgagcgcgtgattgatccgcggagatgtatgaagcccgtcatcctgaccgacggcgaagaaagagttatcctggccgggcctatgcccgtgacgcattcctctgccgctcaacggagaggccgcattggacggaaccctaaaaatgaaaacgaccagtatatctacatgggcgagcccctcgaaaatgatgaggactgcgcccactggaaggaggcgaaaatgctgcttgataacattaatacaccggaagggatcattcctagcatgtttgagcccgaaagagagaaggtggacgccatcgatggagaataccgcctgagaggcgaggctcggaaaaccttcgtcgacctcatgcgcagaggggatctgcctgtgtggctggcctataaggttgctgccgagggaattaactacgctgaccggaagtggtgttttgatggcatcaaaaataaccagatcctcgaagagaacatggaagtggagatttggacaaaggagggggaacgcaagaaacttaaacccagatggctggacgcccggatctattccgatcctctggcgctcaaagagttcaaggagttcgccgctggcagaaaatctctgacccttaatctgattacggagatgggacgcctccccacctttatgacacagaaggcccggaacgctctggacaatctggccgtcctccataccgccgaagctggcgggagagcgtacaaccacgcccttagcgagctgccggagacactggaaaccctcctgcttctgacactcctggctaccgtgacgggaggcatcttcctgtttctcatgtccgggaaaggaattggcaagatgacacttggcatgtgctgcatcatcaccgccagcattctgctgtggtatgcccaaatccagcctcactggattgctgcctctatcattctcgagttctttctgatcgttcttctgatccccgaacccgagaaacagcgcacccctcaggataatcaactcacatacgtggtcattgcgatcctgaccgtggtcgccgctacaatggccaacgaaatggggttcctggagaagacgaagaaagacctcggacttggctccgtgaccacacaggagagcgaatccaatattctggacatcgatctgcggccggcttctgcctggaccctctatgcggttgccacaacctttgtgacgcccatgctgagacatagcattgagaactcctctgtgaatgtcagccttaccgctatcgccaaccaggctacagttctgatggggctcggaaagggctggcctctgtccaaaatggacattggggtgcccctgctcgccatcggatgttacagccaggtgaatcctatcacccttacagctaccctgctgcggttcgtcgcccaatacgcgattatcggccccggcctccaggccaaggctacgcgcgaagcccagaaaagagctgccgccgggattatgaagaaccctacagtggatggaatcaccgttattgacctggagccgatcccctatgatcctaagtttgaaaaacagcttggccaagtgatgctgctcatcctgtgcgtcacacaggtgctgatgatgcggaccacctgggcgctctgtgaggctcttacactggccacggggcccatttctaccctgtgggagggaaatcctggccgcttctggaacacaaccatcgctgtctccatggccaatatttttagagggagctacctcgccggagctggcctgcttttctctatcatgaagaacacaacctccacgcggcgcggcacagggaatattggagaaaccctgggcgagaaatggaaaagcagactcaacgccctggggaaatctgaatttcagatctataagaaaagcggaatccaagaggtggaccggaccctggcgaaggagggcattaagcgcggggaaacagatcaccatgccgtttccagaggatctgctaaactccggtggttcgtggagagaaacatggtcacccccgaaggcaaggtggttgaccttggctgcgggcgcggaggctggagctactattgtgggggactgaaaaatgtgcgggaggtcaagggcctgacaaaagggggaccgggccacgaggaacctatccccatgtccacgtacggctggaacctcgtgagactgcagagcggggtggatgttttctttacaccccctgagaagtgcgacacccttctgtgtgatattggagaatcctctcccaatcctaccatcgaggccggccgcacactccgggtcctgaacctggtggaaaattggctcaacaataacacccagttctgcattaaggtgcttaatccgtatatgcccagcgtcatcgagaaaatggaagctctgcagagacaatacgggggagccctggttcgcaaccctctctccagaaattctacgcatgagatgtactgggtgagcaacgcgaccggcaatatcgtgtcctctgtcaacatgattagcagaatgctgatcaatcgctttacaatgaagcacaaaaaggccacctatgagcccgacgtggatcttgggtccggaacacggaacattggcatcgaaagcgagattcctaacctggacatcattggcaaaagaatcgaaaagatcaagcaggagcacgaaatttcttggcattacgaccaggatcacccctataaaacctgggcttaccatgggtcctatgagacaaagcagaccggaagcgcctcttccatggttaatggcgtggtccgcctcctgacgaaaccgtgggacgtggttcctatggtgacacaaatggctatgaccgataccacacccttcgggcagcagcgggtctttaaggagaaagtggacacgagaacccaggaacctaaggagggaacaaagaaactgatgaagatcaccgccgaatggctctggaaagagcttggcaagaaaaagacaccccgcatgtgtaccagagaggagttcaccaagaaggtgcggagcaacgctgccctgggggcgatttttaccgatgagaataagtggaaatctgcccgcgaagctgtcgaggacggaagattctgggaactggttgatcgggagagaaacctccacctggagggcaagtgcgaaacgtgtgtgtacaatatgatgggcaaacgggagaagaaacttggggaatttggaaaggccaagggctcccgcgctatctggtatatgtggctgggggccagattcctcgagtttgaagccctgggattcctgaacgaggaccactggtttagccggggcaattccctcagcggggtggagggcgaaggactgcatcgccttggctacattctgagagatgtcgggaaaaaggagggaggcgcgatgtacgctgacgataccgccgggtgggacacacggatcaccctcgaagacctgaaaaacgaggaaatggtgacaaatcacatgaagggagagcataagaaacttgccgaggctatcttcaaactgacctatcaaaacaaagttgtgcgcgtccagagacctacgccccggggcacagtgatggatattatctctcgcagagaccagcgggggagcggccaagttggaacctacggcctcaatacattcaccaacatggaagcccagctgattcgccagatggagggggaaggaatctttaagtccattcagcacctgacggctatcgaggagatcgccgtgcaaaattggctcgcgagagtcggccgggaacgcctgtctagaatggccattagcggggatgactgcgtggttaaaccgatcgatgaccggttcgcttccgcccttaccgctctgaacgatatgggaaaggtgagaaaagacattcagcagtgggagccttctcgcggctggaatgattggacacaggtccccttttgcagccatcacttccacgaactcgtgatgaaggacgggcgggtcctggtggttccctgtagaaaccaagatgagcttatcggccgcgcccggatttcccagggagcgggctggtctctgaaggaaaccgcctgcctcgggaaaagctatgctcagatgtggacactgatgtactttcatagacgcgacctgcggctcgccgctaacgccatctgttccgctgtgcctagccactgggtcccgacctctagaacaacctggtccattcatgccaagcacgagtggatgacgacagaggatatgctggcggtgtggaatcgcgtgtggatccaggaaaacccctggatggaggacaaaacccctgttgaaagctgggaggaagtgccctatcttggaaagcgggaggaccaatggtgcggctctctgatcgggctcacctccagagccacatgggctaaaaatattcagaccgccatcaaccaggtccgcagcctgattggaaatgaggaatacacagattatatgccttccatgaagcggttcagacgggaggaagaggaagccggcgtgctttggtga

SEQ ID NO: 19762 - RNA, 9876 nt, synthetic construct
  misc_feature 1..9876: note = derived and/or modified CDS sequence (opt5) from DENV-2__JN819424__SS-prME
  source 1..9876: mol_type = other RNA
acagctggcgtgatcgtcatgctgattcccacggctatggccttccacctcacgaccagaaatggggagcctcatatgatcgttggacggcaggaaaagggcaagagcctgctttttaagacagaggacggggtgaatatgtgcaccctgatggcgattgatctcggagaactgtgtgaggacacaatcacctacaagtgcccccttctgcgccaaaacgaacccgaggatattgactgttggtgcaattccacatctacctgggtgacgtatggcacctgtacaaccacaggggagcacagacgggaaaagcgcagcgtcgctctcgtgcctcatgttggaatgggcctggagaccagaacggaaacatggatgtcctctgagggcgcctggaagcacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaagaccgaggctaagcagcctgccacgctgagaaaatattgcattgaagctaagctcacaaacaccaccacagagagccggtgtccgacccaaggagagccctctctgaatgaggaacaggacaaacgctttatctgcaagcattccatggtggatagaggctggggcaacgggtgtggactgttcggcaaagggggaattgtcacatgcgccatgtttacgtgcaaaaagaatatggaaggcaaagttgtgcagcctgagaacctcgaatacaccatcgtgattacaccccacagcggggaggagcatgcggtcggaaatgacaccggcaagcacggcaaagaaatcaagatcacacctcagtcttccattaccgaggccgaactgacggggtatggaaccgtgacaatggagtgtagcccccggaccggccttgatttcaacgaaatggttctgctccaaatggaggacaaggcttggctggtgcaccgccagtggtttcttgatctgccgctcccttggctgcccggggccgacacacagggatctaattggatccagaaggagaccctggtcacgttcaagaaccctcatgctaaaaagcaagacgtggttgtgctcggctcccaggaaggggccatgcacacagccctgaccggcgctacagagattcagatgagctccggaaatcttctgtttaccggccatctcaaatgcagactgcggatggataaacttcaactgaaagggatgtcttacagcatgtgtaccggaaagttcaagatcgtcaaagaaattgcggagacacagcacggcacgatcgtgatcagagtccagtatgagggggacggatccccctgcaagattcccttcgaaatcaccgatctcgagaaacgccatgtgctgggccggctgattacagttaaccctatcgtgaccgaaaaggacagcccggtcaacattgaggccgaacccccttttggggattcttacatcattatcggcgtggagcccggacagctcaaactgaattggttcaagaagggctccagcatcgggcaaatgtttgagacaaccatgagaggagctaaacgcatggccattcttggcgacacggcctgggatttcgggtctctgggaggcgtttttacaagcatcgggaaggctctccaccaggtgttcggcgccatttacggagcggctttttccggcgtctcttggaccatgaaaatcctgattggggtgatcatcacctggattggaatgaacagccggtccacaagcctgtctgtgtcccttgttctcgtcggcgtggtgaccctgtatctgggggccgtcgtgcaggccgacagcggatgtgttgtgtcttggaagaataaagaactcaagtgcggctccgggatcttcattacagataacgtccacacgtggaccgagcagtacaagtttcaacctgaaagcccctccaaactggcttctgccatccagaaggctcatgaggaaggcatttgtggaatcagaagcgtgacacgccttgagaatctgatgtggaaacagatcaccccggagctcaaccacattctgtccgaaaatgaggttaagctgacaatcatgaccggcgacattaaagggatcatgcaggccggaaagcggtctcttagacctcaacccacggaactcaaatatagctggaagacctggggcaaggcgaaaatgctgtccacagagagccataaccagaccttcctgattgatgggcctgaaacagccgagtgccccaataccaaccgcgcttggaactctctcgaggtggaagactacggatttggcgtcttcacaaccaacatctggctgaaacttcgggagaaacaggacgtgttttgtgattccaagctgatgagcgcctcttccatcgacaatagagctgttcacgccgatatgggctattggatggaaagcgcgccttctgacagctgcaaaatggagaaggcctccttcattgaggataagagctgttactggcccaactctcagcacctctggtccaatggggtgctggaaagcgagatgatcttcccgaaaaactttgctggacctgtctcccaacatatttatcgccccggctaccacacgcagacagccgggccctgcaacctgggaaaacttgaaatggacttcgatttttgcgagggcaccaccgtggtggtcacagaagactgtgggaatcggggaccttctctcagaaccacgacagctagcggcaaactgatcaccgagtggtgctgtcggtcctgcacactgccgcccctccgctacagaggcgaggatgggtgttggtatggaatggaaattcggcctctgaaggagaaagaagagaaccttgttaattctctggtgaccgccggccatgggcagatcgacaacttcagcctcggagtgctgggcatggccctgtttcttgaagagatgctcagaacacgcattgggaccaagcacgctatcctgctggtcgcggtgtccttcgttacgctcatcaccggaaatatgtcttttcgggatctgggcagagtgatggtcatggtgggcgccacaatgaccgacgatattgggatgggagttacataccttgctctgctcgccgccttcaaggtgcgccccacctttgctgccggcctgctgcttagaaaactgacgagcaaggagctcatgatggcgacaatcgggattgctctgctctcccaaagcaccatccctgaaacaattctggagcttaccgacgccctggccctcggaatgatggtcctgaaaatcgtgcggaacatggaaaagtatcagctggctgttaccatcatggccatttcttgcgtgcccaatgcggtcatccttcagaacgcttggaaagtgtcctgtacaattctggccgccgtgagcgtctctcctctcctgctcacgtccagccagcaaaaggctgactggatccccctggcccttaccattaagggcctgaatccgacagctatcttcctcaccacactgtctcgcacctccaaaaagagaagctggcctctgaacgaggccatcatggcggttgggatggtgtccattcttgccagctctctgctcaaaaatgatatccccatgacgggacctctggtggctggcggcctcctgacagtctgctacgtgcttaccgggcggagcgccgacctggaactggagcgcgctgccgatgttaagtgggaggaccaggccgaaatttccggatctagccccatcctctccattaccatctctgaggatggcagcatgtccattaaaaacgaagaggaggaacagacactgaccatccttatcagaacagggctgctcgtgatttctggagtctttccggtgagcatccctattacggctgcggcctggtatctgtgggaggttaagaaacagcgggctggcgtgctctgggacgtcccctcccctccgcccgtggaaaaggccgagctggaagatggggcctaccgcatcaagcaaagagggattcttggctatagccagatcggcgctggggtctacaaagagggaaccttccatacaatgtggcacgtgacccggggcgccgttctgatgcaccgcgggaagagaatcgagccttcttgggcggacgtgaaaaaggatctgatttcctacggaggcgggtggaaactcgaaggagagtggaaggaaggcgaggaagtccaggtgctggctcttgagccgggcaagaatccccgggccgttcagacaaaacctgggatctttaagaccaacacgggaaccattggcgccgtgagcctggacttctctcccgggacatccggaagccctatcgtcgatagaaaaggcaaggtggtggggctctatggaaatggcgttgtcacccgctccggcgcttacgtgtctgccattgcgcaaacagagaaaagcatcgaagacaaccccgagatcgaagatgacattttccggaagaagagactgaccatcatggacctccatcctggggctggaaaaacaaagcgctatctgccggccattgtgcgggaggccatcaaaagaggccttcgcacgctgattctggctcccacccgggtcgtggccgctgaaatggaggaggccctcagagggctgcctatccgctaccagacacccgcgattaagaccgaacacaccggacgggagatcgttgatcttatgtgtcatgccacatttacgatgagactgctctcccctgtgcgggtccccaactataatctgatcattatggacgaagctcacttcaccgatccggccagcatcgctgcccgcggctacatttctacaagagtggagatgggggaggccgctggcatctttatgaccgcgacacctcccggatcccgggaccccttccctcagagcaacgcccccattatggatgaggagcgcgaaatccctgagagatcttggaatagcggccatgaatgggttaccgactttaaagggaagacggtgtggttcgtcccgtccatcaaggctggaaacgatattgccgcctgcctccggaaaaatggcaagaaagtgatccaactgtctagaaagacatttgacagcgagtatgttaaaacccgcgctaacgattgggacttcgtggtcaccacagatatttccgagatgggggccaattttaaggcggaacgggtgatcgaccccagacgctgtatgaagcctgtgattcttaccgacggagaggaacgggtcatcctggctggccccatgcctgttacacactctagcgccgcccagagacgcgggcggatcggcagaaaccccaaaaatgagaacgatcagtacatttacatgggagaaccgctggagaatgacgaggattgcgctcactggaaggaagccaaaatgctcctggacaacatcaatacccctgagggcattatcccctccatgttcgaacctgagcgcgaaaaggtggaggcgattgatggggagtatagacttcggggagaagcccgcaaaacgtttgtggacctgatgagacggggcgatctccccgtccgcctggcttacaaggtggccgctgaggggatcaactatgccgacagaaaatggtgcttcgatggaattaagaatagccagatcctggaagagaacatggaggttgaaatctggacaaaggagggcgaacggaaaaagctcaaacctagatggcttgacgctcgcatttactctgatcccctggccctgaaggagttcaaagaatttgcggccgggcggaagtccctcaccctgaaccttatcacagagatgggcagactgccgaccttcatgacgcaaaaggctcgcaatgccctcgacaacctggctgtgctgcataccgccgaggccggaggccgggcttataatcacgcgctcagcgaacttcctgagacactggaaaccctgctcctgcttacactgctcgccaccgtcacagggggaatttttctgttcctgatgtccggcaaagggatcggaaagatgaccctcggcatgtgttgcattatcacggcttctatccttctgtggtacgcccagattcagccccattggatcgccgctagcattatcctggagtttttcctcattgtgctgcttatccccgaacctgagaaacagagaacaccgcaagataaccagctgacctatgttgtgatcgccattctcaccgtcgtggcggccacaatggctaatgagatgggctttctggaaaagaccaaaaaggacctggggctcggatccatcacaacgcaggagtctgaaagcaacattcttgacatcgatctgcggcccgcctccgcttggaccctgtacgccgtcgcgacaaccttcgtgacacctatgctccgccacagcattgaaaattcttccgttaacgtgagcctgaccgccatcgctaatcaggccacggtgcttatgggcctggggaagggatggcccctctctaaaatggacattggcgtccctctgctggctatcgggtgttactcccaagttaaccccatcaccctcacagccgcccttctgctgctcgtggcccactatgcgattatcggacctggcctgcaggccaaggctaccagagaagcccagaaacgggctgccgccggcattatgaagaatccgacagtggatgggatcaccgtcattgaccttgagcccatcccttacgatcccaaatttgagaagcagctgggacaagtgatgctcctgatcctgtgcgttacacaggtgctcatgatgcgcacaacctgggcgctttgtgaagctctgacactggccaccggccctattagcaccctctgggaggggaaccccggaagattctggaatacaacgatcgctgtctctatggccaacatttttcggggcagctatctggccggggctggacttctgttctccatcatgaagaataccacatctacccgcagaggcacaggcaacattggggaaaccctcggagagaaatggaaaagccggctgaatgccctgggcaaatccgagtttcagatctacaagaaaagcgggatccaagaagtggaccgcacgctcgcgaaggagggaattaaaagaggcgaaacagatcatcacgccgtctcccgggggtctgctaaacttagatggttcgtggagcgcaacatggttaccccggaaggaaaggtggtcgacctgggctgcggccggggaggatggagctattactgtggcgggctgaaaaacgtgagagaggttaagggactcaccaaaggcgggcctggacatgaggaacccatccccatgtccacatatggctggaatctggtgcgccttcagtctggcgtcgatgtgttctttacccctcccgagaagtgcgacacactgctctgtgatattggggaaagctcccctaacccgacgatcgaggccggacggaccctgagagtgctgaatctcgttgaaaactggcttaataacaatacacagttctgcattaaagtcctgaacccctacatgccttctgtgatcgagaagatggaggctctgcagcgccaatacggcggggccctcgtgcggaatcccctgagcagaaactccacccacgaaatgtattgggtcagcaatgcgacaggaaacatcgtttcttccgtgaatatgattagccgcatgcttatcaaccggtttaccatgaagcataaaaaggccacgtacgagcctgacgtggatctgggctctgggaccagaaatattggaatcgaatccgagattcccaacctcgacatcattggcaaacgcatcgaaaagatcaaacaggagcacgagattagctggcactatgaccaggatcatccgtacaagacatgggcttatcacggctcttacgaaaccaagcagacagggtccgccagctccatggtcaacggagtggttcggctgctgaccaaaccttgggacgtggtccccatggtgacacaaatggctatgaccgatacgacacctttcggccagcagagagtttttaaggagaaagtggacacccgcacccaggaacccaaggaggggaccaagaagctcatgaagatcacggccgagtggctttggaaagaactgggaaagaaaaagacccctagaatgtgtacacgggaggagttcaccaaaaaggtccgcagcaatgctgccctgggcgcgatttttacagatgagaacaaatggaagtctgccagagaagctgtggaggacgggcggttctgggagctcgtggatagagaacggaatctgcatcttgagggaaagtgcgaaacctgcgtctataacatgatgggcaaacgcgagaagaaactgggcgaatttgggaaggccaaaggaagcagagctatctggtacatgtggctcggcgcccggttcctggagtttgaggccctggggttcctcaatgaagaccactggttttcccgcggaaactctctgagcggcgttgagggggaaggccttcacagactgggatacattctccgggatgtgggcaagaaggaagggggagcgatgtatgctgacgatacagccggctgggacacccgcatcacgctggaagaccttaaaaatgaggagatggtgaccaaccatatgaagggggaacacaaaaagctggccgaggctatcttcaaactcacataccaaaataaggtcgtgagagttcagcggcccaccccgcgcggaacagtgatggatattatctccagacgggaccagcgcggctctgggcaagtcggcacctatggactgaacacgttcacaaatatggaagcccagctgattagacagatggagggcgaggggatctttaagagcattcagcatctcaccgctacagaagagatcgccgtgcaaaactggctggcgcgggttggacgcgaaagactttcccggatggccatctctggcgatgactgtgtggtcaaacctattgatgacagattcgctagcgccctgaccgctctcaatgatatggggaaggtgcgcaaagacatccagcagtgggagccctcccggggatggaacgattggacgcaggttcccttttgcagccaccatttccacgaactggtgatgaaggacggcagagtccttgtggtcccttgtcgcaatcaagatgagctgattgggcgggccagaatctctcagggcgcgggatggtccctcaaagagaccgcctgcctgggcaagagctacgctcagatgtggacactgatgtattttcaccgccgggacctcagactggccgctaacgccatttgttctgctgtgccgtcccattgggttcccaccagccgcacaacctggtccatccacgccaagcatgaatggatgacaaccgaggatatgcttgcggtgtggaaccgggtctggattcaggaaaatccttggatggaggacaaaacgcccgtggaatcttgggaggaggtgccttacctggggaagagagaagaccaatggtgcggaagcctcatcggcctgacatcccgcgccacctgggctaaaaacatccagaccgccattaatcaggttcggagccttatcgggaacgaggaatatacagattacatgccctctatgaagagattccggagagaggaagaggaggccggagtgctgtggtga

SEQ ID NO: 19763 - RNA, 9876 nt, synthetic construct
  misc_feature 1..9876: note = derived and/or modified CDS sequence (opt5) from DENV-2__FJ744741__SS-prME
  source 1..9876: mol_type = other RNA
accgccggagtgatcgtcatgctgattcccacagctatggccttccacctcacgaccagaaatggggagcctcatatgatcgttggacggcaggaaaagggcaaaagcctgctttttaagaccgaggacggggtgaatatgtgcaccctgatggcgattgatctcggagaactgtgtgaggacacaatcacctacaaatgcccccttctgagacaaaatgaacccgaggatattgactgttggtgcaatagcacatctacctgggtgacgtatggcacctgtacaaccacaggggagcacagacgggaaaagcgcagcgtcgctctcgtgcctcatgttggaatgggcctggagaccagaacggaaacatggatgtcctctgagggcgcctggaaacacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaggaacaggacaaacgctttatctgcaagcattccatggtggatagaggctggggcaacgggtgtggactgttcggcaaagggggaattgtcacatgcgccatgtttacgtgcaaaaagaatatggaaggcaaagttgtgcagcctgagaacctcgaatacaccatcgtgattacaccccacagcggggaggagcatgcggtcggaaatgacaccggcaagcacggcaaagaaatcaagatcacacctcagtcttccattaccgaggccgaactgacggggtatggaaccgtgacaatggagtgtagcccccggaccggccttgatttcaacgaaatggttctgctccaaatggaggacaaggcttggctggtgcaccgccagtggtttcttgatctgccgctcccttggctgcccggggccgacacacagggatctaattggatccagaaggagaccctggtcacgttcaagaaccctcatgctaaaaagcaagacgtggttgtgctcggctcccaggaaggggccatgcacacagccctgaccggcgctacagagattcagatgagctccggaaatcttctgtttaccggccatctcaaatgcagactgcggatggataaacttcaactgaaagggatgtcttacagcatgtgtaccggaaagttcaagatcgtcaaagaaattgcggagacacagcacggcacgatcgtgatcagagtccagtatgagggggacggatccccctgcaagattcccttcgaaatcaccgatctcgagaaacgccatgtgctgggccggctgattacagttaaccctatcgtgaccgaaaaggacagcccggtcaacattgaggccgaacccccttttggggattcttacatcattatcggcgtggagcccggacagctcaaactgaattggttcaagaagggctccagcatcgggcaaatgtttgagacaaccatgagaggagctaaacgcatggccattcttggcgacacggcctgggatttcgggtctctgggaggcgtttttacaagcatcgggaaggctctccaccaggtgttcggcgccatttacggagcggctttttccggcgtctcttggaccatgaaaatcctgattggggtgatcatcacctggattggaatgaacagccggtccacaagcctgtctgtgtcccttgttctcgtcggcgtggtgaccctgtatctgggggccatggtccaggccgacagcggatgtgtggtttcttggaagaataaagaactcaagtgcggctccgggatcttcattacagataacgtgcacacgtggaccgagcagtacaagtttcaacctgaaagcccctccaaactggcttctgccatccagaaggctcatgaggaaggcatttgtggaatcagaagcgtcacacgccttgagaatctgatgtggaaacagatcaccccggagctcaaccacattctgtccgaaaatgaggtgaagctgacaatcatgaccggcgacattcgggggatcatgcaggccggaaaaagatctcttcgccctcaacccacggaactcaagtatagctggaaaacctggggcaaggcgaagatgctgtccacagagagccataaccagaccttcctgattgatgggcctgaaacagccgagtgccccaataccaaccgggcttggaactctctcgaggttgaagactacggatttggcgtgttcacaaccaacatctggctgaaacttagagagaagcaggacgtcttttgtgattccaaactgatgagcgccgctatcaaggacaatcgcgccgtgcacgcggatatgggctattggattgaatctgccctcaacgacacgtggaaaatggagaaggcttccttcatcgaggttaagagctgccactggcctaaatctcatacactgtggagcaatggggtgctggaatccgagatgattatccccaagaacttcgccggaccggtcagccagcacaactaccggcctggctatcatacccaaaccgctgggccctggcaccttggaaaactcgaaatggattttgacctgtgtgagggcacaaccgtggtggtcacggaagattgcgggaatagaggaccctctctgcggacaaccacagcctccggcaagctcattaccgagtggtgctgtcgcagctgcacactgcctccgcttagataccggggcgaggacgggtgttggtacggaatggaaatcagacccctgaaagagaaggaagagaacctcgttaattccctggtgaccgccggccatgggcagattgataacttctctctgggagtgcttggcatggctctctttctggaagagatgctgcgcacgcggatcgggaccaagcacgcgatcctcctggtcgccgtgagcttcgttacacttattaccggaaatatgtcctttagagacctgggccgcgtgatggtcatggtgggcgctacaatgaccgatgacatcgggatgggagttacgtatctcgccctgctggccgctttcaaagtgagacctacatttgccgcgggccttctgctccggaagctgacctctaaagagctcatgatggctacaattgggatcgccctgcttagccagtccaccattcccgaaaccatcctggagctcacagatgccctggctctgggaatgatggtccttaagatcgtgcgcaacatggaaaaataccaactggccgttacgattatggcgatctcttgcgtgcctaatgctgtcattctccagaacgcctggagagtgagctgtaccatcctggccgctgtgtccgtcagccccctcctgcttacatcttcccagcagaaggccgactggattcctctggctctcaccatcaagggcctgaatcccacagccatcttcctgaccacgcttagccggacatctaaaaagcgctcctggccgctgaacgaggcgattatggccgttgggatggtgagcatcctcgcttcttccctgctcaaaaatgacattcctatgaccggacccctggtggccggcggccttctgaccgtctgctatgtgctgacagggagaagcgctgatctcgaactggagcgggccgccgacgttaagtgggaggatcaagctgaaatctccggaagctctcctattcttagcatcaccatttccgaggacggctctatgagcatcaaaaacgaagaggaggaacagacactgacgatcctcattcgcaccgggctgctcgtgatctccggagtctttcccgtgtctattccgatcacagcggccgcttggtacctgtgggaggttaagaaacagagagccggcgtgctttgggatgtcccttctccccctcccgtggaaaaggccgagctggaagacggggcttatcggattaagcagcgcggaatcctgggctactcccaaatcggcgccggggtctataaagagggaaccttccacacaatgtggcatgtgaccagaggcgcggttctcatgcaccgggggaagagaattgagccctcctgggctgatgtgaaaaaggacctgatcagctacggaggcgggtggaaacttgaaggagagtggaaggaaggcgaggaagtccaggtgctggccctcgagcctggcaagaatccgcgcgccgttcagacgaaacccgggatttttaagaccaacacaggaaccatcggcgctgtgtccctggatttcagccctgggacatctggatcccccattgtcgaccggaaaggcaaggtggtggggctctacggaaatggcgttgtcaccagaagcggcgcctatgtgtctgcgatcgctcagacagagaaatccatcgaagataaccctgagattgaagacgatatctttcgcaagaagcggctgacgattatggaccttcatcccggggccggaaaaaccaagagatacctgcctgccatcgtgcgcgaggctattaaacggggcctgagaacactcatcctggccccgacccgcgtcgtggctgccgaaatggaggaggcgcttcgggggctgcccattagatatcaaaccacagccatcaagacggaacacaccggacgggagatcgttgacctcatgtgtcatgctacattcaccatgcgcctgctcagccctgtgagagtccccaactacaatctgattatcatggatgaagcccacttcacagaccctgcttccattgccgcccggggctatatctctacccgcgtggagatgggggaggctgcgggcatttttatgacggccacacccccgggaagcagagatcctttcccccagtccaacgctcccatcatggacgaggaacgggaaatccctgagagaagctggaactctggccacgaatgggttaccgattttaaagggaagaccgtgtggttcgtcccctccattaaggccggaaacgacatcgccgcttgccttcgcaaaaatggcaagaaagtgattcagctgagccggaagacatttgattctgagtacgttaaaaccagagccaacgactgggatttcgtggtcacaaccgacatcagcgagatgggggcgaattttaaggctgaacgcgtgattgatcctcggagatgtatgaagccggtgatcctgacggacggagaggaacgcgtcatcctcgccggccccatgcctgttacacattcctctgccgctcaacggagagggcgcattggcagaaaccccaaaaatgagaacgaccagtatatctacatgggagaacctctggagaatgatgaggactgcgcccactggaaggaagcgaaaatgcttctggataacattaatacccccgagggcatcattccgagcatgttcgaacctgagcgggaaaaggtggacgccatcgatggggagtaccgcctcagaggagaggctcggaaaacatttgtggacctgatgcgcagaggcgatctgcccgtctggctcgcctataaggtggctgccgaagggattaactacgctgaccggaaatggtgtttcgatggaatcaagaataaccagatccttgaggaaaacatggaggttgagatttggaccaaggaaggcgagcgcaagaagctgaaacctcgctggctggacgcccggatctattccgatcccctcgcgctgaaggaatttaaagagttcgccgctgggagaaagtctcttacgctgaatctcattaccgaaatgggccgcctgcctacattcatgacccagaaggcccggaacgctctggacaatctcgccgtgcttcatacagccgaggctggaggcagagcgtacaaccacgccctgagcgagctgcccgaaaccctcgagacactgcttctgctcaccctgctggctacggtcacagggggaatctttctcttccttatgtccggcaaagggattggaaagatgaccctgggcatgtgctgcatcatcaccgccagcattctgctctggtatgcccaaatccagccgcactggattgctgcctctatcattctggaatttttccttatcgtgctgctcatccctgagcccgaaaaacagcggacaccccaggataatcaactgacctacgttgtgattgcgatcctgacagtcgtggccgctacgatggccaacgagatgggctttctcgagaagaccaaaaaggaccttgggctgggatccattacaacccaggaaagcgagtccaatatcctggacattgatctccgccctgcttctgcctggacactgtatgcggtcgccaccacgttcgtgaccccgatgcttagacatagcatcgaaaactcctctgttaatgtgagcctgacagctattgccaaccaggctaccgtgctcatgggcctggggaagggatggcccctgtccaaaatggacatcggcgtccctctccttgccatcgggtgttacagccaggttaatcccattacactgaccgctgccctgctcctgcttgtggcgcactacgccatcattggacctggcctgcaagctaaggccacgcgggaggctcagaaacgcgccgccgcgggcatcatgaagaaccccacagtggatgggattaccgtcatcgacctcgaacctatcccgtatgatcccaaatttgagaagcagctgggacaggtgatgctgctcattctttgcgttacacaagtgctgatgatgagaaccacctgggctctgtgtgaggccctcacactggctacgggccctatctctaccctttgggaagggaatcccggacggttctggaacacaaccattgccgtctccatggccaatatctttcgcggcagctacctggctggggccggactcctgttctctattatgaagaacacaaccaatacgagacggggcacaggcaacatcggggagaccctgggagaaaaatggaagtcccgcctcaacgcgcttggcaaaagcgagtttcagatctataagaaatctgggattcaggaggtggacagaaccctggccaaggaaggaatcaaacggggcgagacagatcatcacgctgtcagcagagggtccgccaagctgcgctggttcgtggaacggaatatggttacccctgagggaaaggtggtcgacctcggctgcggcagagggggatggtcttactattgtggcgggctgaaaaacgtgcgcgaagttaagggacttacaaaaggcgggcccggacatgaggagccgattcctatgagcacgtacggctggaatctggtgcggctccaatccggcgtcgatgtgtttttcacaccgcccgaaaagtgcgacacactgctgtgtgatatcggggagagctcccctaaccccaccattgaagctggaagaacactccgcgtgcttaatctggttgagaactggctgaataacaatacccagttctgcatcaaagtcctcaacccttatatgccgtctgtgatcgaaaagatggaggccctgcagcggaagtacggcggggcgcttgtgagaaatcccctgagccgcaactccacgcacgagatgtactgggtctctaatgccaccggaaacattgttagctccgtgaatatgatctctcggatgctcattaacagatttacaatgaaacacaagaaagctacctatgaacctgacgtggatctgggcagcgggacacgcaacatcggaattgagtccgaaatccccaatctggacattatcggcaagcggatcgagaaaattaagcaggaacatgagaccagctggcactacgaccaagatcatccttataagacatgggcctaccacggctcttatgagaccaaacagacggggtccgctagctctatggtcaacggagtggttagactccttacaaagccctgggacgtggtcccgatggtgacccagatggccatgaccgatacaacgcctttcggccagcaacgcgtttttaaagaaaaggtggacaccagaacacaggagcccaaagaagggaccaagaagctgatgaaaatcacagctgagtggctgtggaaggagctcggcaagaagaaaacccctcggatgtgtacacgcgaagagttcaccagaaaggtccggtccaatgccgcgctgggcgccatttttacggatgaaaacaaatggaaaagcgctagagaggccgtggaagacgggcggttctgggagcttgtggatcgcgagagaaatctgcacctcgaaggaaagtgcgagacctgtgtctacaacatgatgggcaaacgggaaaagaaactgggcgagtttgggaaggctaaaggatctcgcgccatctggtatatgtggctgggcgccagattcctcgaatttgaggcgctggggttccttaatgaggaccattggttttcccggggaaacagcctgtccggcgttgaaggggagggcctccaccgcctgggatacattcttagagatgtgggcaagaaggaagggggagctatgtacgccgacgatacagccggctgggacacccggatcacactggaggacctcaaaaatgaagagatggtgaccaaccatatgaagggggagcacaaaaagctggctgaagccatcttcaaactgacgtatcagaataaggtcgtgcgcgttcagagacccacacctcggggaaccgtgatggatattatcagccgcagagaccaacggggctctgggcaggtcggcacatacggactcaacacctttacgaatatggaggctcagctgattcgccaaatggaaggcgaggggatcttcaagagcattcagcatcttaccgccacagaggaaatcgcggtgcagaactggctggccagagttggacgggagagactctcccgcatggctatctctggcgatgactgcgtggtcaaacccattgatgaccggttcgccagcgctctgaccgcccttaatgatatggggaaggtgagaaaagacatccagcaatgggaaccgtcccgcggatggaacgattggacacaggttcctttttgctctcaccacttccatgagctggtgatgaaggacggccgggtcctcgtggtcccctgtagaaaccaggatgaactgattgggcgcgcgcggatcagccagggcgccggatggtccctgaaagagaccgcttgcctcggcaagtcttatgcccaaatgtggacactgatgtactttcacagacgcgaccttcggctggctgccaatgctatttgtagcgccgtgccctcccattgggttcctaccagcagaacgacatggtctatccacgcgaagcacgagtggatgaccaccgaagatatgctcgccgtgtggaaccgcgtctggattcaggagaatccgtggatggaagacaaaacacccgtggagtcctgggaagaggtgccttatctggggaagcgggaggaccagtggtgcggaagccttatcggcctgacctctagagctacatgggccaaaaacatccagacggccattaatcaagttcggtccctcatcgggaacgaagagtacaccgattatatgcccagcatgaagagattccgccgggaagaggaagaggctggagtgctgtggtga

SEQ ID NO: 19764 - RNA, 9876 nt, synthetic construct
  misc_feature 1..9876: note = derived and/or modified CDS sequence (opt5) from DENV-2__FJ744703__SS-prME
  source 1..9876: mol_type = other RNA
acagccggcgtgatcgtgatgctgattcccacagctatggccttccacctcacgacccggaatggggaacctcatatgatcgttggacggcaggaaaagggcaagagcctgctttttaagacagaagacggggtgaatatgtgcaccctgatggcgattgatctcggagaactgtgtgaggacacaatcacctacaaatgcccccttctgcgccaaaatgaacccgaggatattgactgttggtgcaattccacatctacctgggtgacgtatggcacctgtacaaccacaggggagcacagacgggaaaagcgcagcgtcgctctcgtgcctcatgttggaatgggcctggagaccagaacggaaacatggatgtcctctgagggcgcctggaaacacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaagaacaggacaaacgctttatctgcaagcattccatggtggatagaggctggggcaacgggtgtggactgttcggcaaaggcgggattgtcacatgcgccatgtttacgtgcaaaaagaatatggaagggaaagttgtgcagcctgagaacctcgaatacaccatcgtgattacaccccacagcggggaggagcatgcggtcggaaatgacaccggcaagcacggcaaagaaatcaagatcacacctcagtcttccattaccgaggccgaactgacggggtatggaaccgtgacaatggagtgtagcccccggaccggccttgatttcaacgaaatggttctgctccaaatggaggacaaggcttggctggtgcaccgccagtggtttcttgatctgccgctcccttggctgcccggggccgacacacagggatctaattggatccagaaggagaccctggtcacgttcaagaaccctcatgctaaaaagcaagacgtggttgtgctcggctcccaggaaggggccatgcacacagccctgaccggcgctacagagattcagatgagctccggaaatcttctgtttaccggccatctcaaatgcagactgcggaccgataaacttcaactgaaagggatgtcttacagcatgtgtacaggaaagttcaagatcgtcaaagaaattgcggagacgcagcacggcaccatcgtgatcagagtccagtatgagggggacggatccccctgcaagattcccttcgaaatcacagatctcgagaaacgccatgtgctgggccggctgattaccgttaaccctatcgtgacagaaaaggacagcccggtcaacattgaggccgaacccccttttggggattcttacatcattatcggcgtggagcccggacagctcaaactgaattggttcaagaagggctccagcatcgggcaaatgtttgagaccacgatgagaggagctaaacgcatggccattcttggcgacacagcctgggatttcgggtctctgggaggcgtttttaccagcatcgggaaggctctccaccaggtgttcggcgccatttacggagcggctttttccggcgtctcttggaccatgaaaatcctgattggggtgatcatcacatggattggaatgaacagccggtccaccagcctgtctgtgtcccttgttctcgtcggcgtggtgacactgtatctgggggccgtcgtgcaggccgacagcggatgtgttgtgtcttggaagaataaagaactcaagtgcggctccgggatcttcattacggataacgtccacacctggacagagcagtacaagtttcaacctgaaagcccctccaaactggcttctgccatccagaaggctcatgaggaaggcatttgtggaatcagaagcgtgacccgccttgagaatctgatgtggaaacagatcacaccggagctcaaccacattccttccgaaaatgaggttaagctgaccatcatgacgggcgacattaaagggatcatgcaggccggaaagcggtctctgagaccccaacctaccgaacttaaatatagctggaagacatggggcaaggcgaaaatgctctccaccgagagccataaccagacattcctgattgatgggcccgaaaccgccgagtgccctaatacaaaccgcgcttggaactctctggaggtggaagactacggatttggcgtcttcaccacgaacatctggctcaagctgcgggagaaacaggacgtgttttgtgattccaaacttatgagcgccgctatcaaagacaatagagccgttcacgcggatatgggctattggattgaatctgccctgaacgacacatggaagatggagaaggcttccttcatcgaggtgaaaagctgccactggcccaagtctcataccctctggagcaatggggtcctggaatccgagatgattatcccgaaaaacttcgccggacctgtgagccagcacaactaccgccccggctatcatacccaaacagctgggccctggcacctgggaaaacttgaaatggattttgacttctgtgagggcaccacggtggtcgttacagaagattgcgggaatcggggaccttctctcagaaccacaaccgcctccggcaaactgattacagagtggtgctgtcggagctgcaccctgccgcccctccgctacagaggcgaggacgggtgttggtacggaatggaaatccggcctctgaaggagaaggaagagaaccttgtcaattccctggtgacggccggccatgggcagattgataacttttctctcggagtcctgggcatggctctgttccttgaagagatgctcagaacccgcatcgggacaaaacacgcgatcctgctggtggccgttagctttgtgaccctcattacaggaaatatgtccttccgggacctgggcagagtcatggtgatggttggcgctaccatgacggatgacatcgggatgggagtgacatatcttgccctgctcgccgcttttaaggtccgccccaccttcgccgcgggcctgctgcttagaaaactgacatctaaggagctcatgatggctaccattgggatcgccctgctcagccagtccaccattcctgaaacaatcctggagcttacggatgccctggctctcggaatgatggtgctgaaaatcgttcggaacatggaaaagtaccaactggccgtgaccattatggcgatctcttgcgtccccaatgctgtgattcttcagaacgcctggaaggtgagctgtacaatcctggccgctgtctccgttagccctctcctgctcacctcttcccagcagaaagccgactggattcccctggctcttacaatcaagggcctgaatccgaccgccatctttctcacgacactgagccgcacctctaaaaagagatcctggcctctgaacgaggcgattatggccgtggggatggtgagcatccttgcttcttccctgctcaaaaatgacattcccatgaccggacctctggtcgccggcggcctcctgacagtgtgctatgttcttaccgggcggagcgctgatctggaactggagcgcgccgccgacgtgaagtgggaggatcaagctgaaatctccggaagctctcccattctcagcatcacaatttccgaggacggctctatgagcatcaaaaacgaagaggaggaacagacgctgaccatccttattagaacagggctgctcgtcatctccggagtgttcccggtttctattcctatcaccgcggccgcttggtacctgtgggaggtgaagaagcagcgggccggcgtcctctgggatgtgcccagccctccgcccgtcgaaaaagccgagctggaagacggggcttatcgcattaagcagagaggaatccttggctactcccaaatcggcgccggggtgtataaagagggaacatttcacaccatgtggcatgttacgcggggcgcggtgctgatgcaccgcgggaagagaattgagccttcttgggctgatgtcaaaaaggacctgatcagctacggaggcgggtggaagctcgaaggagagtggaaagaaggcgaggaagtgcaggttctggcccttgagccgggcaagaatccccgggccgtgcagaccaaacctgggattttcaagacaaacaccggaacaatcggcgctgtctccctggattttagccccgggacctctggatcccctattgtggacagaaaaggcaaggtggttgggctctacggaaatggcgtcgtgacacgcagcggcgcctatgtgtctgcgatcgctcagacggagaagtccatcgaagataaccccgagattgaagacgatatcttccggaaaaagagactgaccattatggacctccatcctggggccggaaaaacaaagcgctacctgccggccatcgtccgggaggctattaaaagaggccttcgcaccctgatcctggcccccacccgggtggttgctgccgaaatggaggaggcgctcagagggctgcctattcgctatcaaacacccgccatcaagacggaacacaccggacgggagatcgtggaccttatgtgtcatgctacattcaccatgagactgctcagccctgtccgggtgcccaactacaatctgattatcatggatgaagcccactttacagacccggcttccattgccgcccgcggctatatctctaccagagttgagatgggggaggctgcgggcattttcatgacggccacacctcccggaagccgggatccctttcctcagtccaacgctcccatcatggacgaagaaagagaaatccctgagagaagctggaactctggccacgaatgggtgaccgatttcaaggggaaaaccgtctggtttgtgccgtccattaaggccggaaacgacatcgccgcttgcctccggaaaaatggcaagaaagttattcagctgagcagaaagacattcgattctgagtacgtgaagacccgcgccaacgactgggattttgtcgtgacaaccgacatcagcgagatgggggcgaatttcaaagctgaacgggtgattgatcccagacgctgtatgaagcctgtcatccttacggacggagaggaacgggttatcctggccggccccatgcctgtgacacattcctctgccgctcaaagacgcgggcggattggcagaaaccccaaaaatgagaacgaccagtatatctacatgggagaaccgctggagaatgatgaggactgcgcccactggaaggaagcgaaaatgctcctggataacattaatacccctgagggcatcattcccagcatgtttgaacctgagcgcgaaaaggtggacgccatcgatggggagtacagacttcggggagaggctcgcaaaacattcgtcgacctgatgagacggggcgatctccccgtgtggctggcctataaggttgctgccgaagggattaactacgctgaccgcaagtggtgttttgatggaatcaaaaataaccagatcctggaggaaaacatggaggtggagatttggaccaaggaaggcgagcgcaagaagctcaaacctcggtggcttgacgccagaatctattccgatcccctggcgctgaaggagttcaaggagttcgccgctgggcgcaaatctctcacgctgaatcttattaccgaaatgggccggctgccgacatttatgacccagaaggccagaaacgctctcgacaatctggccgtcctgcatacagccgaggctggaggccgcgcgtacaaccacgccctcagcgagcttcctgaaaccctggagacactgctcctgcttaccctgctcgctacggtgacagggggaatcttcctgtttctgatgtccggcaaagggattggaaagatgaccctcggcatgtgctgcatcatcaccgccagcattcttctgtggtatgcccaaatccagccccactggattgctgcctctatcattctggagttctttctcatcgttctgcttatccccgagcctgaaaaacagcggacaccgcaggataatcaactgacctacgtggtcattgcgatcctcacagtggtcgccgctacgatggccaacgagatgggcttcctggagaagaccaagaaagacctggggctcggatccattacaacccaggaaagcgagtccaatatccttgacattgatctgagacccgcttctgcctggacactgtatgcggtggccaccacgtttgttacccctatgctccggcatagcatcgaaaactcctctgtgaatgtgagcctgacagctattgccaaccaggctaccgtccttatgggcctggggaagggatggcccctctccaaaatggacatcggcgttcctctgctggccatcgggtgttacagccaggtgaatcccattacactcaccgctgcccttctgctgctcgtggcgcactacgccatcattggacctggcctgcaagctaaggccacgcgcgaggctcagaaaagagccgccgcgggcatcatgaagaacccgacagtcgatgggattaccgtgatcgaccttgaacccatcccttatgatcccaagttcgagaaacagctgggacaggttatgctcctgattctgtgcgtgacacaagtcctcatgatgcggaccacctgggctctttgtgaggccctgacactggctacgggccctatctctaccctctgggaagggaatcccggacgcttttggaacacaaccattgccgtgtccatggccaatatcttcagaggcagctacctggctggggccggacttctgttttctattatgaagaacacaacctccacgcggcgcggcacaggcaatatcggggagaccctcggagaaaaatggaaaagcagactgaacgcgctgggcaaatctgagttccagatctataagaaaagcgggattcaggaggtcgaccggaccctcgccaaggaaggaatcaagcgcggcgagacagatcatcacgctgtgtccagagggtctgccaaacttcggtggtttgttgaaagaaacatggtgaccccggagggaaaggtcgtggacctgggctgcggccgcgggggatggagctactattgtggcgggctgaaaaatgttcgggaagtgaagggactcacaaaaggcgggcctggacatgaggagcccattcccatgtccacgtacggctggaacctggtcagacttcaaagcggcgtggatgtgttcttcacccctcccgaaaagtgcgacacactgctctgtgatatcggggagtcctctcctaatccgaccattgaagctggacgcacactgcgggttctgaacctcgtcgagaattggcttaacaataacacccagttttgcatcaaggtgctgaatccctatatgcctagcgtgatcgagaagatggaggccctgcagagacagtacggcggggcgctcgtccgcaaccccctgtccagaaattctacgcacgagatgtactgggttagcaacgccaccggaaatattgtgtcctctgtgaacatgatcagcagaatgcttattaatcgcttcacaatgaagcacaaaaaggctacctatgaacctgacgtcgatctgggctccgggacacggaacatcggaattgagagcgaaatccccaacctcgacattatcggcaaaagaatcgagaagattaagcaagaacatgagatctcttggcactacgaccaggatcatccgtataaaacctgggcctaccacggctcctatgagacaaagcagaccgggagcgcttcttccatggtgaatggagttgtgcgcctgctgacgaaaccttgggacgtcgtgcccatggttacacagatggccatgaccgataccacaccttttggccaacagcgggtgttcaaggaaaaagtcgacacgagaacccaggagcccaaggaagggacaaagaaactcatgaagattaccgctgagtggctttggaaagagctgggaaagaaaaagacacctcgcatgtgtaccagagaagagtttaccaagaaggtgcggagcaacgccgcgctgggcgccatcttcaccgatgaaaataagtggaaatctgctcgcgaggccgtggaagacgggagattttgggagctcgtcgatcgggagagaaacctgcaccttgaaggaaagtgcgagacgtgtgtttacaatatgatgggcaaacgggaaaagaaactgggcgagttcgggcgcgctaagggatccagagccatttggtatatgtggctcggcgcccggtttctggagttcgaggcgctggggtttctcaacgaggaccattggttcagccgcggaaattccctgagcggcgtggaaggggagggccttcacagactgggatacatcctccgggatgtgggcaagaaagaagggggagctatgtacgccgacgataccgccggctgggacacacgcatcaccctggaggaccttaagaacgaagagatggtcacaaatcatatgaaaggggagcacaagaaactggctgaagccatttttaagctcacctatcagaacaaggtggttagagtgcaacggcccacgccgcgcggaacagtcatggatatcatttctagacgggaccagcgcggcagcggacaggtgggcacctacggactgaatacattcaccaacatggaggctcaactgatcagacagatggaaggcgaggggattttcaaatccatccagcatctcacggccaccgaggaaatcgcggttcagaattggctggcccgggtgggacgcgagagactttctcggatggctattagcggcgatgactgcgtcgtgaagcctatcgatgacagatttgcctccgctctgacagccctcaacgatatggggaaagttcgcaaggacattcaacagtgggaaccctctcggggatggaatgattggacccaggtgcccttctgcagccaccactttcatgagctggtcatgaaagacggcagagtgcttgtcgtgccttgtcgcaaccaggatgaactgatcgggcgggcgagaatttcccaaggcgccggatggtctctcaaggagacagcttgcctgggcaagagctatgcccagatgtggaccctgatgtacttccaccgccgggacctcagactggctgccaacgctatctgttccgccgttccgagccattgggtgcccacatctcgcaccacgtggtccattcacgcgaaacacgagtggatgacaaccgaagatatgcttgccgtctggaatcgggtgtggatccaggagaacccttggatggaagacaagacccccgtggagagctgggaagaggttccttatctggggaaaagagaggaccagtggtgcggatctctcatcggcctgacatcccgcgctacctgggccaagaatattcaaacagccatcaaccaggtgcggagccttattgggaatgaagagtacacggattatatgccctccatgaaaagatttcggagagaagaggaagaggctggagtcctgtggtga

SEQ ID NO: 19765 - RNA, 9876 nt, synthetic construct
  misc_feature 1..9876: note = derived and/or modified CDS sequence (opt5) from DENV-2__FJ850067__SS-prME
  source 1..9876: mol_type = other RNA
accgccggcgtgatcgtcatgctgattcccacagctatggccttccacctcacgaccagaaatggggagcctcatatgatcgttggacggcaggaaaagggcaagagcctgctttttaagacagaggacggggtgaatatgtgcaccctgatggcgattgatctcggagaactgtgtgaggacacaatcacctacaagtgcccccttctgcgccaaaatgaacccgaggatattgactgttggtgcaatagcacatctacctgggtgacgtatggcacctgtacaaccacaggggagcacagacgggaaaagcgcagcgtcgctctcgtgcctcatgttggaatgggcctggagaccagaacggaaacatggatgtcctctgagggcgcctggaagcacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaggaacaggacaaacgctttatctgcaagcattccatggtggatagaggctggggcaacgggtgtggactgttcggcaaagggggaattgtcacatgcgccatgtttacgtgcaaaaagaatatggaaggcaaagttgtgcagcctgagaacctcgaatacaccatcgtgattacaccccacagcggggaggagcatgcggtcggaaatgacaccggcaagcacggcaaagaaatcaagatcacacctcagtcttccattaccgaggccgaactgacggggtatggaaccgtgacaatggagtgtagcccccggaccggccttgatttcaacgaaatggttctgctccaaatggaggacaaggcttggctggtgcaccgccagtggtttcttgatctgccgctcccttggctgcccggggccgacacacagggatctaattggatccagaaggagaccctggtcacgttcaagaaccctcatgctaaaaagcaagacgtggttgtgctcggctcccaggaaggggccatgcacacagccctgaccggcgctacagagattcagatgagctccggaaatcttctgtttaccggccatctcaaatgcagactgcggatggataaacttcaactgaaagggatgtcttacagcatgtgtaccggaaagttcaagatcgtcaaagaaattgcggagacacagcacggcacgatcgtgatcagagtccagtatgagggggacggatccccctgcaagattcccttcgaaatcaccgatctcgagaaacgccatgtgctgggccggctgattacagttaaccctatcgtgaccgaaaaggacagcccggtcaacattgaggccgaacccccttttggggattcttacatcattatcggcgtggagcccggacagctcaaactgaattggttcaagaagggctccagcatcgggcaaatgtttgagacaaccatgagaggagctaaacgcatggccattcttggcgacacggcctgggatttcgggtctctgggaggcgtttttacaagcatcgggaaggctctccaccaggtgttcggcgccatttacggagcggctttttccggcgtctcttggaccatgaaaatcctgattggggtgatcatcacctggattggaatgaacagccggtccacaagcctgtctgtgtcccttgttctcgtcggcgtggtgaccctgtatctgggggccatggtccaggccgacagcggatgtgtggtttcttggaagaataaagaactcaagtgcggctccgggatcttcattacagataacgtgcacacgtggaccgagcagtacaagtttcaacctgaaagcccctccaaactggcttctgccatccagaaggctcatgaggaaggcatttgtggaatcagaagcgtcacacgccttgagaatctgatgtggaaacagatcaccccggagctcaaccacattctgtccgaaaatgaggtgaagctgacaatcatgaccggcgacattcgggggatcatgcaggccggaaaaagatctcttcgccctcaacccacggaactcaagtatagctggaaaacctggggcaaggcgaagatgctgtccacagagagccataaccagaccttcctgattgatgggcctgaaacagccgagtgccccaataccaaccgggcttggaactctctcgaggttgaagactacggatttggcgtgttcacaaccaacatctggctgaaacttagagagaagcaggacgtcttttgtgattccaaactgatgagcgccgctatcaaggacaatcgcgccgtgcacgcggatatgggctattggattgaatctgccctcaacgacacgtggaaaatggagaaggcttccttcatcgaggttaagagctgccactggcctaaatctcatacactgtggagcaatggggtgctggaatccgagatgattatccccaagaacttcgccggaccggtcagccagcacaactaccggcctggctatcatacccaaaccgctgggccctggcaccttggaaaactcgaaatggattttgacctgtgtgagggcacaaccgtggtggtcacggaagattgcgggaatagaggaccctctctgcggacaaccacagcctccggcaagctcattaccgagtggtgctgtcgcagctgcacactgcctccgcttagataccggggcgaggacgggtgttggtacggaatggaaatcagacccctgaaagagaaggaagagaacctcgttaattccctggtgaccgccggccatgggcagattgataacttctctctgggagtgcttggcatggctctctttctggaagagatgctgcgcacgcggatcgggaccaagcacgcgatcctcctggtcgccgtgagcttcgttacacttattaccggaaatatgtcctttagagacctgggccgcgtgatggtcatggtgggcgctacaatgaccgatgacatcgggatgggagttacgtatctcgccctgctggccgctttcaaagtgagacctacatttgccgcgggccttctgctccggaagctgacctctaaagagctcatgatggctacaattgggatcgccctgcttagccagtccaccattcccgaaaccatcctggagctcacagatgccctggctctgggaatgatggtccttaagatcgtgcgcaacatggaaaaataccaactggccgttacgattatggcgatctcttgcgtgcctaatgctgtcattctccagaacgcctggaaggtgagctgtaccatcctggccgctgtgtccgtcagccccctcctgcttacatcttcccagcagaaggccgactggattcctctggctctcaccatcaaaggcctgaatcccacagccatcttcctgaccacgcttagcagaacatctaagaaacggtcctggccgctgaacgaggcgattatggccgttgggatggtgagcatcctcgcttcttccctgctcaagaatgacattcctatgaccggacccctggtggccggcggccttctgaccgtctgctatgtgctgacagggcgcagcgctgatctcgaactggagagagccgccgacgttaaatgggaggatcaagctgaaatctccggaagctctcctattcttagcatcaccatttccgaggacggctctatgagcatcaagaacgaagaggaggaacagacactgacgatcctcattcggaccgggctgctcgtgatctccggagtctttcccgtgtctattccgatcacagcggccgcttggtacctgtgggaggttaaaaagcagcgcgccggcgtgctttgggatgtcccttctccccctcccgtggaaaaggccgagctggaagacggggcttatagaattaaacagcggggaatcctgggctactcccaaatcggcgccggggtctataaggagggaaccttccacacaatgtggcatgtgacccgcggcgcggttctcatgcacagagggaaacggattgagccctcctgggctgatgtgaagaaagacctgatcagctacggaggcgggtggaaacttgaaggagagtggaaggaaggcgaggaagtccaggtgctggccctcgagcctggcaaaaatccgagagccgttcagacgaagcccgggatttttaaaaccaacacaggaaccatcggcgctgtgtccctggatttcagccctgggacatctggatcccccattgtcgaccgcaagggcaaagtggtggggctctacggaaatggcgttgtcacccggagcggcgcctatgtgtctgcgatcgctcagacagagaagtccatcgaagataaccctgagattgaagacgatatctttagaaagaaacgcctgacgattatggaccttcatcccggggccggaaagaccaaacggtacctgcctgccatcgtgagagaggctattaagcgcggcctgcggacactcatcctggccccgaccagagtcgtggctgccgaaatggaggaggcgcttcgcgggctgcccattcggtatcaaaccacagccatcaaaacggaacacaccggaagagagatcgttgacctcatgtgtcatgctacattcaccatgcggctgctcagccctgtgcgcgtccccaactacaatctgattatcatggatgaagcccacttcacagaccctgcttccattgccgccagaggctatatctctacccgggtggagatgggggaggctgcgggcatttttatgacggccacacccccgggaagccgcgatcctttcccccagtccaacgctcccatcatggacgaagagagagaaatccctgagcggagctggaactctggccacgaatgggttaccgattttaaggggaagaccgtgtggttcgtcccctccattaaagccggaaacgacatcgccgcttgccttagaaagaatggcaaaaaggtgattcagctgagccgcaaaacatttgattctgagtacgttaagacccgggccaacgactgggatttcgtggtcacaaccgacatcagcgagatgggggcgaattttaaggctgaaagagtgattgatcctcgccggtgtatgaaaccggtgatcctgacggacggagaggaaagagtcatcctcgccggccccatgcctgttacacattcctctgccgctcaacgccgggggagaattggccgcaaccccaagaatgagaacgaccagtatatctacatgggagaacctctggagaatgatgaggactgcgcccactggaaagaagcgaagatgcttctggataacattaatacccccgagggcatcattccgagcatgttcgaacctgagagagaaaaagtggacgccatcgatggggagtaccggctccgcggagaggctagaaagacatttgtggacctgatgcggcgcggcgatctgcccgtctggctcgcctataaagtggctgccgaagggattaactacgctgacagaaagtggtgtttcgatggaatcaagaataaccagatccttgaggaaaacatggaggttgagatttggaccaaagaaggcgagcggaagaaactgaagcctagatggctggacgcccgcatctattccgatcccctcgcgctgaaagaatttaaggagttcgccgctgggcggaagtctcttacgctgaatctcattaccgaaatgggcagactgcctacattcatgacccagaaagcccgcaacgctctggacaatctcgccgtgcttcatacagccgaggctggaggccgggcgtacaaccacgccctgagcgagctgcccgaaaccctcgagacactgcttctgctcaccctgctggctacggtcacagggggaatctttctcttccttatgtccggcaaggggattggaaaaatgaccctgggcatgtgctgcatcatcaccgccagcattctgctctggtatgcccaaatccagccgcactggattgctgcctctatcattctggaatttttccttatcgtgctgctcatccctgagcccgaaaagcagagaacaccccaggataatcaactgacctacgttgtgattgcgatcctgacagtcgtggccgctacgatggccaacgagatgggctttctcgagaaaaccaagaaggaccttgggctgggatccattacaacccaggaaagcgagtccaatatcctggacattgatctccggcctgcttctgcctggacactgtatgcggtcgccaccacgcttgtgaccccgatgctgcgccatagcatcgaaaactcctctgttaatgtgagcctcacagctattgccaaccaggctaccgtgctgatgggcctggggaaaggatggcccctctccaagatggacatcggcgtccctcttctggccatcgggtgttacagccaggttaatcccattacactgaccgctgccctcctgcttctggtggcgcactacgccatcattggacctggcctccaagctaaagccacgagagaggctcagaagcgggccgccgcgggcatcatgaaaaaccccacagtggatgggattaccgtcatcgacctggaacctatcccgtatgatcccaagttcgagaagcagctgggacaggtgatgctccttattctgtgcgttacacaagtgctgatgatgcgcaccacctgggctctctgtgaggccctgacacttgctacgggccctatctctaccctgtgggaagggaatcccggaagattttggaacacaaccattgccgtctccatggccaatatcttccggggcagctacctcgctggggccggactgctgttttctattatgaaaaacacaaccaatacgcgcagaggcacaggcaccatcggggagaccctcggagaaaagtggaaatcccggcttaacgcgctgggcaagagcgagttccagatctataaaaagtctgggattcaggaggtggaccgcacactggccaaagaaggaatcaagagaggcgagaccgatcatcacgctgtcagccgggggtccgccaagctcagatggtttgtggaacgcaacatggttacacctgagggaaaagtggtcgacctgggctgcggcagagggggatggtcttactattgtggcgggcttaagaatgtgcgggaagttaaaggactgacgaagggcgggcccggacatgaggagccgattcctatgagcacctacggctggaacctcgtgcgcctgcaatccggcgtcgatgtgttctttacaccgcccgaaaaatgcgagaccctgctctgtgacatcggggaaagctcccctaatcccacaattgaggctggacggacccttagagtgctgaacctggttgaaaattggctcaacaataacacgcagttctgcatcaaggtcctgaatccttatatgccgtctgtgatcgagaagatggaggcccttcagcgcaaatacggcggggcgctggtgcggaaccccctcagcagaaattccacccacgaaatgtactgggtctctaacgccacaggaaatattgttagctccgtgaacatgatctctcgcatgctgattaatcggttcaccatgaagcacaaaaaggctacatatgagcctgatgtggacctgggcagcgggaccagaaacatcggaattgaatccgagatccccaacctcgatattatcggcaaacgcatcgaaaagattaagcaggagcatgagacaagctggcactacgaccaagaccatccttataaaacctgggcctaccacggctcttatgaaacgaagcagacagggtccgctagctctatggtcaatggagtggttcggcttctgaccaaaccctgggatgtggtcccgatggtgacccagatggccatgacagacacgaccccttttggccagcaaagagttttcaaggagaaagtggatacacgcacccaggaacccaaggaggggacaaagaaactgatgaagatcaccgctgagtggctctggaaagaactgggaaagaaaaagacacctagaatgtgtacccgggaggaatttacgcgcaaagtcagatccaacgccgcgcttggcgccattttcaccgacgagaataagtggaaaagcgctcgggaagccgtggaggatgggagattttgggagctggtggaccgggaacgcaacctccacctggagggaaaatgcgaaacatgtgtctacaatatgatgggcaagagagagaaaaagctgggcgagttcgggaaagctaagggatctcgggccatctggtatatgtggctcggcgcccgctttctggagttcgaggcgcttgggtttctgaacgaagatcattggttctccagaggaaatagcctctccggcgttgagggggaaggcctgcaccggcttggatacattctgcgcgacgtgggcaagaaagaagggggagctatgtacgccgatgacaccgccggctgggatacaagaatcaccctcgaagacctgaagaacgaggagatggtgacgaatcatatgaaaggggaacacaagaaactggctgaggccatctttaagctcacatatcagaacaaggtcgtgcgggttcagcgccccacccctagaggaacagtgatggacattatcagccggcgcgatcaaagaggctctgggcaggtcggcacctacggactgaatacgttcaccaacatggaagctcagcttattcggcaaatggagggcgaggggatctttaaaagcattcagcatctgacagccaccgaagagatcgcggtgcagaattggctcgcccgcgttggaagagaacggctgtccagaatggctatctctggcgacgattgcgtggtcaagcccattgacgatcgcttcgccagcgctcttacagccctgaacgacatggggaaaatccggaaggatattcagcaatgggagccgtccagaggatggaatgactggacccaggtgcctttctgctctcaccactttcatgaactcgttatgaaagatggccgcgtgctggtcgtgccctgtcggaaccaggacgagctgatcgggagagcgcgcattagccagggcgccggatggtccctcaaggagacagcttgcctgggcaagtcttatgcccaaatgtggacccttatgtacttccaccggagagatctgcgcctcgctgccaacgctatctgtagcgccgtcccctcccattgggtgcctacgagccggacaacctggtctattcacgcgaaacacgaatggatgaccacagaggacatgctggccgtttggaatagagtgtggatccaggaaaacccgtggatggaggataagacccccgtcgaatcctgggaggaggtgccttatcttgggaaacgcgaagaccagtggtgcggaagcctgatcggcctcacatctcgggctacgtgggccaagaatattcagaccgccatcaaccaagtgagatccctgattgggaatgaggaatacacagactatatgcccagcatgaaacggtttagacgcgaggaagaggaggctggagttctgtggtga

SEQ ID NO: 19766 - RNA, 9876 nt, synthetic construct
  misc_feature 1..9876: note = derived and/or modified CDS sequence (opt5) from DENV-2__FJ850060__SS-prME
  source 1..9876: mol_type = other RNA
accgccggagtgatcgtcatgctgattcccaccgctatggccttccacctcacgaccagaaatggggagcctcatatgatcgttggacggcaggaaaagggcaagagcctgctttttaagaccgaggacggggtgaatatgtgcaccctgatggcgattgatctcggagaactgtgtgaggacacaatcacctacaaatgcccgcttctgcgccaaaatgaacccgaggatattgactgttggtgcaatagcacatctacctgggtgacgtatggcacctgtacaaccacaggggagcacagacgggaaaagcgcagcgtcgctctcgtgcctcatgttggaatgggcctggagaccagaacggaaacatggatgtcctctgagggcgcctggaaacacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaagaacaggacaaacgctttatctgcaagcattccatggtggatagaggctggggcaacgggtgtggactgttcggcaaagggggaattgtcacatgcgccatgtttacgtgcaaaaagaatatggaaggcaaagttgtgcagcctgagaacctcgaatacaccatcgtgattacaccccacagcggggaggagcatgcggtcggaaatgacaccggcaagcacggcaaagaaatcaagatcacacctcagtcttccattaccgaggccgaactgacggggtatggaaccgtgacaatggagtgtagcccccggaccggccttgatttcaacgaaatggttctgctccaaatggaggacaaggcttggctggtgcaccgccagtggtttcttgatctgccgctcccttggctgcccggggccgacacacagggatctaattggatccagaaggagaccctggtcacgttcaagaaccctcatgctaaaaagcaagacgtggttgtgctcggctcccaggaaggggccatgcacacagccctgaccggcgctacagagattcagatgagctccggaaatcttctgtttaccggccatctcaaatgcagactgcggatggataaacttcaactgaaagggatgtcttacagcatgtgtaccggaaagttcaagatcgtcaaagaaattgcggagacacagcacggcacgatcgtgatcagagtccagtatgagggggacggatccccctgcaagattcccttcgaaatcaccgatctcgagaaacgccatgtgctgggccggctgattacagttaaccctatcgtgaccgaaaaggacagcccggtcaacattgaggccgaacccccttttggggattcttacatcattatcggcgtggagcccggacagctcaaactgaattggttcaagaagggctccagcatcgggcaaatgtttgagacaaccatgagaggagctaaacgcatggccattcttggcgacacggcctgggatttcgggtctctgggaggcgtttttacaagcatcgggaaggctctccaccaggtgttcggcgccatttacggagcggctttttccggcgtctcttggaccatgaaaatcctgattggggtgatcatcacctggattggaatgaacagccggtccacaagcctgtctgtgtcccttgttctcgtcggcgtggtgaccctgtatctgggggccatggtccaggccgacagcggatgtgtggtttcttggaagaataaagaactcaagtgcggctccgggatcttcattacagataacgtgcacacgtggaccgagcagtacaagtttcaacctgaaagcccctccaaactggcttctgccatccagaaggctcatgaggaaggcatttgtggaatcagaagcgtcacacgccttgagaatctgatgtggaaacagatcaccccggagctcaaccacattctgtccgaaaatgaggtgaagctgacaatcatgaccggcgacattaaagggatcatgcaggccggaaagcggtctcttagacctcaacccacggaactcaaatatagctggaagacctggggcaaggcgaaaatgctgtccacagagagccataaccagaccttcctgattgatgggcctgaaacagccgagtgccccaataccaaccgcgcttggaactctctcgaggttgaagactacggatttggcgtgttcacaaccaacatctggctgaaacttcgggagaaacaggacgtcttttgtgattccaagctgatgagcgccgctatcaaagacaatagagccgtgcacgcggatatgggctattggattgaatctgccctcaacgacacgtggaagatggagaaggcttccttcatcgaggttaaaagctgccactggcctaagtctcatacactgtggagcaatggggtgctggaatccgagatgattatccccaaaaacttcgccggaccggtcagccagcacaactaccgccctggctatcatacccaaaccgctgggccctggcaccttggaaagctcgaaatggattttgacctgtgtgagggcacaaccgtggtggtcacggaagattgcgggaatcggggaccctctctgagaacaaccacagcctccggcaaactcattaccgagtggtgctgtcggagctgcacactgcctccgcttcgctacagaggcgaggacgggtgttggtacggaatggaaatccggcccctgaaggagaaggaagagaacctcgttaattccctggtgaccgccggccatgggcagattgataacttctctctgggagtgcttggcatggctctctttctggaagagatgctgagaacgcgcatcgggaccaaacacgcgatcctcctggtcgccgtgagcttcgttacacttattaccggaaatatgtcctttcgggacctgggcagagtgatggtcatggtgggcgctacaatgaccgatgacatcgggatgggagttacgtatctcgccctgctggccgctttcaagattcgccctacatttgccgcgggccttctgctcagaaaactgacctctaaggagctcatgatggctacaatcgggattgccctgcttagccagtccaccatccccgaaaccatcctggagctcacagatgccctggctctgggaatgatggtgcttaaaattgtccggaacatggaaaagtaccaactggccgtgacgatcatggcgatttcttgcgttcctaatgctgtgatcctccagaacgcctggaaggtcagctgtgccattctggctgccgtgtccgtgagccccctcctgcttacctcttcccagcagaaagctgactggatccctctggccctcacaatcaagggcctgaatcccaccgcgattttcctgacaacccttagccgcacgtctaaaaagagatcctggccgctgaacgaggccgtcatggctgttgggatggtgagcatcctcgcctcttccctgctcaaaaatgacattcctatgacaggacccctggtggctggcggccttctgaccgtctgctatgtgctgaccgggcggagcgccgatctcgaactggagcgcgccgctgacgttaagtgggaggatcaagcggaaatctccggaagctctcctattcttagcatcacaatttccgaggacggctctatgagcatcaaaaacgaagaggaggaacagaccctgacaatcctcattagaacggggctgctcgtgatctccggagtctttcccgtgtctattccgatcaccgccgctgcctggtacctgtgggaggttaagaagcagcgggccggcgtgctttgggatgtcccttctccccctcccgtggaaaaagctgagctggaagacggggcctatcgcattaagcagagaggaatcctgggctactcccaaatcggcgcgggggtctataaagagggaacattccacaccatgtggcatgtgacacggggcgctgttctcatgcaccgcgggaagagaattgagccctcctgggccgatgtgaaaaaggacctgatcagctacggaggcgggtggaaacttgaaggagagtggaaagaaggcgaggaagtccaggtgctggccctcgagcctggcaagaatccgcgggctgttcagaccaaacccgggatttttaagacgaacaccggaacaatcggcgccgtgtccctggatttcagccctgggacctctggatcccccattgtcgacagaaaaggcaaggtggtggggctctacggaaatggcgttgtcacacgcagcggcgcgtatgtgtctgctatcgcccagaccgagaagtccatcgaagataaccctgagattgaagacgatatctttcggaaaaagagactgacaattatggaccttcatcccggggccggaaaaacgaagcgctacctgcctgctatcgtgcgggaggccattaaaagaggcctgcgcaccctcatcctggctccgacacgggtcgtggccgcggaaatggaggaggcccttagagggctgcccattcgctatcaaacccctgctatcaagaccgaacacacaggacgggagatcgttgacctcatgtgtcatgccacgttcaccatgagactgctcagccccgtgcgggtccctaactacaatctgattatcatggatgaagctcacttcacagaccccgcctccattgccgctcgcggctatatctctaccagagtggagatgggggaggcggccggcatttttatgacagctaccccgcctggaagccgggatcccttcccccagtccaacgcccctatcatggacgaggaacgcgaaatccccgagagaagctggaactctggccacgaatgggttacggattttaaggggaaaacagtgtggttcgtcccttccattaaggccggaaacgacatcgctgcctgccttcggaaaaatggcaagaaagtgattcagctgagcagaaagacctttgattctgagtacgttaagacccgcgcgaacgactgggatttcgtggtcacaaccgacatcagcgagatgggggctaattttaaagccgaacgggtgattgatccgagacgctgtatgaagcccgtgatcctgacagacggagaggaacgggtcatcctcgccggccctatgcccgttacccattcctctgctgcccaaagacgcgggcggattggcagaaaccctaaaaatgagaacgaccagtatatctacatgggagaacccctggagaatgatgaggactgcgcgcactggaaggaagccaaaatgcttctggataacattaatacgccggagggcatcattcctagcatgttcgaacccgagcgcgaaaaggtggacgctatcgatggggagtacagactccggggagaggcccgcaaaacatttgtggacctgatgagacggggcgatctgcctgtctggctcgcttataaggtggccgctgaagggattaactacgccgaccgcaagtggtgtttcgatggaatcagaaataaccagatccttgaggaaaacatggaggttgagatttggaccaaagaaggcgagcggaagaaactgaagcccagatggctggacgcgcgcatctattccgatcctctcgccctgaaagaatttaaggagttcgctgccgggcggaagtctcttacactgaatctcattaccgaaatgggcaaactgcccacgttcatgacccagaaggctagaaacgccctggacaatctcgccgtgcttcatacagctgaggcgggaggccgcgcctacaaccacgctctgagcgagctgccggaaaccctcgagacactgcttctgctcaccctgctggccacagtcaccgggggaatctttctcttccttatgtccggcaaagggattggaaagatgacgctgggcatgtgctgcatcatcacagccagcattctgctctggtatgctcaaatccagcctcactggattgccgcgtctatcattctggaatttttccttatcgtgctgctcatccccgagcccgaaaaacagcggacccctcaggataatcaactgacctacgttgtgattgccatcctgacagtcgtggctgccaccatggctaacgagatgggctttctcgagaagacaaagaaagaccttgggctgggatccattacgacccaggaaagcgagtccaatatcctggacattgatctcagaccggcctctgcgtggacactgtatgccgtcgctaccacattcgtgacccccatgcttcggcatagcatcgaaaactcctctgttaatgtgagcctgacggccattgctaaccaggccaccgtgctcatgggcctggggaagggatggcctctgtccaaaatggacatcggcgtccccctccttgctatcgggtgttacagccaggttaatcctattacactgaccgccgcgctgctcctgcttgtggcccactacgctatcattggacccggcctgcaagccaaggctacacgcgaggcccagaaaagagccgcggctggcatcatgaagaaccctaccgtggatgggattacggtcatcgacctcgaaccgatcccctatgatcctaagtttgagaaacagctgggacaggtgatgctgctcattctttgcgttacacaagtgctgatgatgcggaccacatgggccctgtgtgaggctctcaccctggccaccggccccatctctacactttgggaagggaatcctggacgcttctggaacacgaccattgccgtctccatggctaatatctttagaggcagctacctggccggggcgggactcctgttctctattatgaagaacacaaccaatacacggcgcggcaccggcaacatcggggagacgctgggagaaaaatggaagtccagactcaacgcccttggcaaaagcgagtttcagatctataagaaatctgggattcaggaggtggaccggacactggctaaggaaggaatcaagcgcggcgagaccgatcatcacgccgtcagcagagggtccgctaaactgcggtggttcgtggaaagaaatatggttacccccgagggaaaggtggtcgacctcggctgcggccgcgggggatggtcttactattgtggcgggctgaaaaacgtgcgggaagttaagggacttacaaaaggcgggccgggacatgaggagcctattcccatgagcacctacggctggaatctggtgagactccaatccggcgtcgatgtgtttttcacaccccctgaaaagtgcgacacgctgctgtgtgatatcggggagagctcccccaaccctaccattgaagccggacgcacactccgggtgcttaatctggttgagaactggctgaataacaatacccagttctgcatcaaggtcctcaacccgtatatgccctctgtgatcgagaagatggaggcgctgcagagaaagtacggcggggcccttgtgcgcaatcctctgagccggaactccacacacgagatgtactgggtctctaatgctaccggaaacattgttagctccgtgaatatgatctctagaatgctcattaaccgctttacgatgaaacacaagaaagccacctatgaacccgacgtggatctgggcagcgggacacggaacatcggaattgagtccgaaatccctaatctggacattatcggcaagagaatcgagaagattaaacaggaacatgagaccagctggcactacgaccaagatcatccctataagacatgggcttaccacggctcttatgagaccaaacagacagggtccgccagctctatggtcaacggagtggttcgcctccttaccaagccgtgggacgtggtccctatggtgacgcagatggctatgacagataccacccccttcggccagcaacgggtttttaaagaaaaggtggacacaagaacgcaggagcctaaggaagggaccaaaaagctgatgaaaatcacagccgagtggctgtggaaggagctcggcaagaagaaaacaccccgcatgtgtacaagagaagagttcacccggaaggtccgctccaatgcggccctgggcgctatttttacagatgaaaacaagtggaaaagcgccagagaggctgtggaagacgggcggttctgggagcttgtggatagagagcggaatctgcacctcgaaggaaagtgcgagacctgtgtctacaacatgatgggcaaacgcgaaaagaaactgggcgagtttgggaaggccaagggatctagagccatctggtatatgtggctgggcgcgcggttcctcgaatttgaggctctggggttccttaatgaggaccattggttttcccgcggaaacagcctgtccggcgttgaaggggagggcctccacagactgggatacattcttcgggatgtgggcaaaaaggaagggggagccatgtacgccgacgatacggctggctgggacacccgcatcacactggaggacctcaaaaatgaagagatggtgaccaaccatatgaagggggagcacaaaaagctggccgaagctatcttcaagctgacatatcagaataaagtcgtgagagttcagcggcctacaccccgcggaacggtgatggatattatcagcagacgggaccaacgcggctctgggcaggtcggcacatacggactcaacacctttacaaatatggaggcccagctgattagacaaatggaaggcgaggggatcttcaagagcattcagcatcttaccgcgacggaggaaatcgccgtgcagaactggctggctcgggttggacgcgagagactctcccggatggccatctctggcgatgactgcgtggtcaaaccgattgatgacagattcgctagcgccctgaccgcgcttaatgatatggggaaggtgcgcaaagacatccagcaatgggaaccttcccggggatggaacgattggacacaggttcccttttgctctcaccacttccatgagctggtgatgaaggacggcagagtcctcgtggtcccctgtcgcaaccaggatgaactgattgggcgggccagaatcagccagggcgctggatggtccctgaaggagaccgcctgcctcggcaaatcttatgctcaaatgtggacactgatgtactttcaccgccgggaccttagactggccgctaatgccatttgtagcgcggtgcctccgcattgggttcccacctcccgcacaacctggagcatccacgccaagcacgagtggatgacgacagaagatatgctcgctgtgtggaaccgggtctggattcaggggaatccttggatggaggacaaaacccccgtggaatcttgggaggaagtgccttatctgggaaagagagaggaccagtggtgcggctcccttatcgggctgaccagccgcgccacatgggccaaaaacatccagaccgctattaatcaagttcggtctctcatcggaaacgaggaatacacagattatatgccctccatgaagagattccggagagaggaagaggaagccggcgtgctgtggtga

SEQ ID NO: 19767 - RNA, 9876 nt, synthetic construct
  misc_feature 1..9876: note = derived and/or modified CDS sequence (opt5) from DENV-2__FJ850061__SS-prME
  source 1..9876: mol_type = other RNA
accgccggcgtgatcattatgctgatccccacggctatggccttccacctcacgaccagaaatggggaacctcatatgattgtcggacggcaggaaaagggcaagagcctgctttttaagacagaggacggggttaatatgtgcaccctgatggcgatcgatctcggagaactgtgtgaggacacaattacctacaagtgcccgcttctgagacaaaatgaacccgaggatatcgactgttggtgcaattccacatctacctgggtgacgtatggcacctgtacaaccacaggggagcacagacgggaaaagcgcagcgtggctctcgtccctcatgtgggaatgggcctggagaccagaacggaaacatggatgtcctctgagggcgcctggaaacacgttcagcggatcgagacctggattctgcgccatcccgggttcacaatcatggccgctattctcgcctacaccatcggaaccacacactttcagagagctctgattttcatccttctgacggccgtggcgcctagcatgaccatgcggtgcattggcatctccaaccgcgattttgtcgaaggggtgtctggaggcagctgggttgacatcgtgctcgagcacgggtcctgtgtcacaaccatggccaagaataagcccacactggatttcgaacttattaaaaccgaggctaagcagcctgccacgctgagaaaatattgcatcgaagctaagctcacaaacaccaccacagagagccggtgtccgacccaaggagagccctctctgaatgaggaacaggacaaacgctttatttgcaagcattccatggtggatagaggctggggcaacgggtgtggactgttcggcaaagggggaatcgtgacatgcgccatgtttacgtgcaaaaagaatatggaaggcaaagtcgttcagcctgagaacctcgaatacaccattgtgatcacaccccacagcggggaggagcatgcggtgggaaatgacaccggcaagcacggcaaagaaatcaagattacacctcagtcttccatcaccgaggccgaactgacggggtatggaaccgtcacaatggagtgtagcccccggaccggccttgatttcaacgaaatggtgctgctccaaatggaggacaaggcttggctggttcaccgccagtggtttcttgatctgccgctcccttggctgcccggggccgacacacagggatctaattggattcagaaggagaccctggtgacgttcaagaaccctcatgctaaaaagcaagacgtcgtggttctcggctcccaggaaggggccatgcacacagccctgaccggcgctacagagatccagatgagctccggaaatcttctgtttaccggccatctcaaatgcagactgcggatggataaacttcaactgaaagggatgtcttacagcatgtgtaccggaaagttcaagattgtgaaagaaatcgcggagacacagcacggcacgatcgtcattagagtgcagtatgagggggacggatccccctgcaagatccccttcgaaattaccgatctcgagaaacgccatgtcctgggccggctgatcacagtgaaccctattgttaccgaaaaggacagcccggtgaacatcgaggccgaacccccttttggggattcttacattatcatcggcgtcgagcccggacagctcaaactgaattggttcaagaagggctccagcattgggcaaatgtttgctacaaccatgagaggagccaaacgcatggccatccttggcgacacggcttgggatttcgggtctctgggaggcgtgtttacaagcattgggaaggccctccaccaggttttcggcgcgatctacggagctgccttttccggcgtgtcttggaccatgaaaattctgatcggggtcatcattacctggatcggaatgaacagccggtccacaagcctgtctgtgtcccttgtgctcgttggcgtcgtgaccctgtatctgggggccatggtgcaggctgacagcggatgtgtcgtgtcttggaagaataaagagctcaagtgcggctccgggattttcatcacagataacgttcacacgtggaccgaacagtacaagtttcaacctgagagcccctccaaactggcctctgctattcagaaggcccatgaagagggcatctgtggaatcagaagcgtgacacgccttgaaaatctgatgtggaaacagattaccccggagctcaaccacatcctgtccgagaatgaagtcaagctgacaattatgaccggcgacatcaaagggattatgcaggcgggaaagcggtctcttagacctcaacccacggagctcaaatatagctggaagacctggggcaaggccaaaatgctgtccacagaaagccataaccagaccttcctgatcgatgggcctgagacagctgaatgccccaataccaaccgcgcctggaactctctcgaggtggaggactacggatttggcgttttcacaaccaacatctggctgaaacttcgggaaaaacaggacgtgttttgtgattccaagctgatgagcgctgccattaaagacaatagagcggtccacgccgatatgggctattggatcgagtctgctctcaacgacacgtggaagatggaaaaggcctccttcattgaggtgaaaagctgccactggcctaagtctcatacactgtggagcaatggggttctggagtccgaaatgatcattcccaaaaacttcgctggaccggtgagccagcacaactaccgccctggctatcatacccaaaccgccgggccctggcaccttggaaagctcgagatggattttgacctgtgtgaaggcacaaccgtcgtggtgacggaggattgcgggaatcggggaccctctctgagaacaaccacagcctccggcaaactcatcaccgaatggtgctgtcggagctgcacactgcctccgcttcgctacagaggcgaggacgggtgttggtacggaatggagattcggcccctgaaggaaaaggaggaaaacctcgtcaattccctggttaccgctggccatgggcagatcgataacttctctctgggagtgcttggcatggcgctctttctggaggaaatgctgagaacgcgcatcgggaccaaacacgccattctcctggtggctgtcagcttcgtgacacttatcaccggaaatatgtcctttcgggacctgggcagagttatggtgatggtcggcgccacaatgaccgatgacattgggatgggagtgacgtatctcgccctgctggctgccttcaaggttcgccctacatttgcggctggccttctgctcagaaaactgacctctaaggagctcatgatggccacaatcgggattgccctgcttagccagtccaccatccccgagaccatcctggaactcacagatgctctggccctgggaatgatggtgcttaaaattgtccggaacatggagaagtaccaactggcggtgacgatcatggctatttcttgcgttcctaatgccgtgatcctccagaacgcctggaaggtcagctgtaccattctggctgccgtgtccgtgagccccctcctgcttacatcttcccagcagaaagctgactggatccctctggccctcaccatcaagggcctgaatcccacagcgattttcctgaccacgcttagccgcacatctaaaaagagatcctggccgctgaacgaagccatcatggctgtcgggatggttagcattctcgcctcttccctgctcaaaaatgacatccctatgaccggacccctggtggctggcggccttctgaccgtgtgctatgtcctgacagggcggagcgccgatctcgagctggaacgcgccgctgacgtgaagtgggaggatcaagcggagatttccggaagctctcctatccttagcattaccatctccgaagacggctctatgagcatcaaaaacgaggaagaggagcagacactgacgattctcatcagaaccgggctgctcgttatttccggagtgtttcccgtctctatcccgattacagccgctgcctggtacctgtgggaagtgaagaagcagcgggccggcgttctttgggatgtgccttctccccctcccgtcgagaaagctgaactggaggacggggcctatcgcatcaagcagagaggaatcctgggctactcccaaattggcgcgggggtgtataaagaaggaaccttccacacaatgtggcatgtcacccggggcgctgtgctcatgcaccgcgggaagagaatcgagccctcctgggccgatgttaaaaaggacctgattagctacggaggcgggtggaaacttgagggagaatggaaagagggcgaagaggtgcaggtcctggccctcgaacctggcaagaatccgcgggctgtgcagacgaaacccgggatctttaagaccaacacaggaaccattggcgccgtttccctggatttcagccctgggacatctggatcccccatcgtggacagaaaaggcaaggtcgtggggctctacggaaatggcgtggttacccgcagcggcgcgtatgtctctgctatcgcccagacagagaagtccattgaggataaccctgaaatcgaggacgatatttttcggaaaaagagactgacgatcatggaccttcatcccggggccggaaaaaccaagcgctacctgcctgctattgtgcgggaagccatcaaaagaggcctgcgcacactcattctggctccgacccgggtggtcgccgcggagatggaagaggcccttagagggctgcccatccgctatcaaacccctgctatcaagacagagcacacgggacgggaaattgtggacctcatgtgtcatgccaccttcacaatgagactgctcagccccgttcgggtgcctaactacaatctgatcattatggatgaggctcacttcaccgaccccgcctccatcgccgctcgcggctatatttctacaagagtcgaaatgggggaggcggccggcatctttatgaccgctacgccgcctggaagccgggatcccttcccccagtccaacgcccctatcatggacgaggaacgcgagattcccgaaagaagctggaactctggccacgagtgggtgacagattttaaggggaaaaccgtttggttcgtgccttccatcaaggccggaaacgacattgctgcctgccttcggaaaaatggcaagaaagtcatccagctgagcagaaagacctttgattctgaatacgtgaagacacgcgcgaacgactgggatttcgttgtgaccacagacattagcgagatgggggctaattttaaagccgagcgggtcatcgatccgagacgctgtatgaagcccgtgatcctgaccgacggagaagaacgggtgattctcgccggccctatgcccgtcacgcattcctctgctgcccaaagacgcgggcggatcggcagaaaccctaaaaatgaaaacgaccagtatatttacatgggagagcccctggaaaatgatgaggactgcgcgcactggaaggaggccaaaatgcttctggataacatcaatacaccggaaggcattatccctagcatgttcgagcccgaacgcgagaaggttgacgctattgatggggaatacagactccggggagaggcccgcaaaacctttgtggacctgatgagacggggcgatctgcctgtgtggctcgcttataaggtcgccgctgaggggatcaactacgccgaccgcaagtggtgtttcgatggaatcaaaaataaccagattcttgaagagaacatggaagtggagatctggacaaaggagggcgaacgcaagaagctgaaaccccggtggctggacgcgagaatttattccgatcctctcgccctgaaggagtttaaggagttcgctgccgggcgcaaatctcttaccctgaatctcatcacggagatgggccggctgcccaccttcatgacacagaaggctagaaacgccctggacaatctcgccgttcttcataccgctgaagcgggaggccgcgcctacaaccacgctctgagcgagctgccggagacactcgaaaccctgcttctgctcacactgctggccaccgtgacagggggaatttttctcttccttatgtccggcaaagggatcggaaagatgacactgggcatgtgctgcatcattaccgccagcatcctgctctggtatgctcaaattcagcctcactggatcgccgcgtctattatcctggagtttttccttatcgtcctgctcattcccgaacccgagaaacagcggacccctcaggataatcaactgacatacgtggttatcgccattctgaccgtggtcgctgccacaatggctaacgaaatgggctttctcgagaagacgaagaaagaccttgggctgggatccatcaccacacaggagagcgaatccaatattctggacatcgatctcagaccggcctctgcgtggaccctgtatgccgtggctacaaccttcgtcacgcccatgcttcggcatagcattgagaactcctctgtgaatgttagcctgaccgccatcgctaaccaggccacagtgctcatgggcctggggaagggatggcctctgtccaaaatggacatcggcgtgcccctccttgctattgggtgttacagccaggtcaagcctatcacctttacagccgcgctgctgctcctggttgcccactacgctattatcggacccggccttcaagccaaagctcctcgcgaagcccagaagagagccgcggctggcattatgaagaatccgaccgtggatgggatcacggtgatcgacctggagcccattccttatgatcccaaattcgaaaagcagctcggacaggtcatgctgctgatcctctgcgtgacacaagttcttatgatgcggaccacatgggccctgtgtgaggctctgaccctcgccaccggccctatttctacactgtgggaggggaaccccggacgcttttggaatacgaccatcgccgtgtccatggctaacattttcagaggcagctaccttgccggggcgggactgctcttttctatcatgaaaaatacaaccaacacacggcgcggcaccggcaatatcggggaaacgctgggagagaagtggaaatccagactgaacgccctcggcaagagcgagttccagatttataaaaagtctgggatccaggaggtcgaccggacacttgctaaggagggaattaaacgcggcgaaaccgatcatcacgccgtgagcagagggtccgctaagctgcggtggtttgtcgagagaaacatggtgaccccggaaggaaaagttgtggacctgggctgcggccgcgggggatggtcttactattgtggcgggctcaagaatgtccgggaggtgaaaggactgacaaagggcgggcctggacatgaagaacccatccccatgagcacctacggctggaaccttgttagactgcaatccggcgtggatgtcttcttcacacctcccgagaagtgcgacacgctcctgtgtgatattggggaaagctcccctaatccgaccatcgaggccggacgcacactgcgggtgctcaaccttgtggaaaattggctgaacaataacacccagttttgcatcaaagttctgaatccctatatgccttctgtcattgagaagatggaagcgctccagagaaaatacggcggggccctggtgcgcaacccccttagccggaatagcacacacgagatgtactgggtgtctaacgctaccggaaatatcgtcagctccgttaacatgatttctagaatgctgatcaatcgcttcacgatgaagcacaaaaaggccacctatgagcctgacgtggatctcggcagcgggacacggaacattggaatcgaatccgaggtgcccaacctggacattatcggcaagagaatcgagaagattaagcaggagcatgaaaccagctggcactacgaccaagatcatccgtataaaacatgggcttaccacggctcttatgagaccaagcagacagggtccgccagctctatggtcaatggagtggttcgcctgctcaccaaaccttgggacgtggtccccatggtgacgcagatggctatgacagataccaccccttttggccagcaacgggttttcaaggagaaggtggacacaagaacgcaggaacccaaagaggggaccaagaaacttatgaagatcacagccgaatggctgtggaaagagctgggaaagaaaaagacccctcgcatgtgtacaagagaggaatttacccggaaggtccgctccaacgcggccctcggcgctattttcacagatgagaataaatggaaaagcgccagagaagctgtggaggacgggcggttttgggaactggtggatagagagcggaaccttcacctggagggaaaatgcgaaacctgtgtctacaatatgatgggcaagcgcgagaaaaagctcggcgagttcgggaaggccaaaggatctagagccatctggtatatgtggctgggcgcgcggtttctggagttcgaagctctcgggtttctgaacgaggaccattggttctcccgcggaaatagcctttccggcgttgagggggaaggcctgcacagactcggatacattctgcgggatgtgggcaagaaagaagggggagccatgtacgccgacgatacggctggctgggacacccgcatcacacttgaagacctgaagaacgaggaaatggtgaccaatcatatgaaaggggagcacaagaagctcgccgaggctatctttaaactgacatatcagaacaaggtcgtgagagttcagcggcccaccccgcgcggaacggtgatggatattatcagcagacgggaccaacgcggctctgggcaggtcggcacatacggactgaataccttcacaaacatggaagcccagctcattagacaaatggagggcgaagggatcttcaaaagcattcagcatctgaccgcgacggaggagatcgccgtgcagaattggcttgctcgggttggacgcgaaagactgtcccggatggccatctctggcgatgactgcgtggtcaagcctattgatgacagatttgctagcgccctcaccgcgctgaacgatatggggaaagtgcgcaaggacatccagcaatgggagccctcccggggatggaatgattggacacaggttcccttctgctctcaccactttcatgaacttgtgatgaaggacggcagagtcctggtggtcccttgtcgcaaccaggatgagctcattgggcgggccagaatcagccagggcgctggatggtccctgaaagaaaccgcctgcctgggcaagtcttatgctcaaatgtggacactcatgtacttccaccgccgggacctgagacttgccgctaacgccatttgtagcgcggtgccgccccattgggttcctacctcccgcacaacctggagcatccacgccaaacacgagtggatgacgacagaggatatgctggctgtgtggaatcgggtctggattcaggaaaacccctggatggaggacaagacccctgtggaatcttgggaggaagtgccctatctcgggaaaagagaggaccagtggtgcggatccctgatcggccttaccagccgcgccacatgggccaagaatatccagaccgctattaaccaagttcggtctctgatcgggaatgaggaatacacagattatatgccttccatgaagagatttcggagagaggaagaggaagccggagtgctctggtga

SEQ ID NO: 19768 - RNA, 9876 nt, synthetic construct
  misc_feature 1..9876: note = derived and/or modified CDS sequence (opt5) from DENV-2__FJ744709__SS-prME
  source 1..9876: mol_type = other RNA
accgccggagtgatcgttatgctgattcccaccgctatggccttccacctcacgaccagaaatggggaacctcatatgatcgttggacggcaggaaaagggcaaaagcctgctttttaagacagaagacggggtgaatatgtgcaccctgatggcgattgatctcggagaactgtgtgaggacacaatcacctacaaatgcccgcttctgagacaaaatgaacccgaggatattgactgttggtgcaattccacatctacctgggtgacgtatggcacctgtacaaccacaggggagcacagacgggaaaagcgcagcgtggctctcgtgcctcatgttggaatgggcctggagaccagaacggaaacatggatgtcctctgagggcgcctggaaacacgtgcagcggatcgagacctggatcctgcgccatcccgggttcacaattatggccgctgtcctcgcctacaccatcggaaccacacactttcagaaggctctgattttcatccttctgacggccgtggcgcctagcatgaccatgagatgcattggcatctccaaccgggattttgttgaaggggtgtctggaggcagctgggtcgacattgtgctcgagcacgggtcctgtgtgacaaccatggccaagaataaacccacactggatttcgaacttatcaagaccgaggctaaacagcctgccacgctgcgcaagtattgcatcgaagctaaactcacaaacaccaccacagagagcagatgtccgacccaaggagagccctctctgaatgaagaacaggacaagcggtttatttgcaagcattccatggtcgatcgcggctggggcaacgggtgtggactgttcggcaaagggggaatcgttacatgcgccatgtttacgtgcaagaaaaatatggaaggcaaggtggtgcagcctgagaacctcgaatacaccattgtcatcacaccccacagcggggaggagcatgcggtgggaaatgacaccggcaaacacggcaaggaaattaaaatcacacctcagtcttccatcaccgaggccgaactgacggggtatggaaccgttacaatggagtgtagccccagaaccggccttgatttcaacgaaatggtgctgctccaaatggaggacaaggcttggctggtccaccggcagtggtttcttgatctgccgctcccttggctgcccggggccgacacacagggatctaattggattcagaaggagaccctggtgacgttcaaaaaccctcatgctaagaaacaagacgttgtggtcctcggctcccaggaaggggccatgcacacagccctgaccggcgctacagagatccagatgagctccggaaatcttctgtttaccggccatctcaagtgccgcctgagaatggataaacttcaactgaaggggatgtcttacagcatgtgtaccggaaagttcaaaattgtgaaggaaatcgcggagacacagcacggcacgattgtcatccgggtgcagtatgagggggacggatccccctgcaaaatccccttcgaaattaccgatctcgagaagagacatgttctgggccgcctgatcacagtgaaccctattgtcaccgaaaaagacagcccggtgaacatcgaggccgaacccccttttggggattcttacattatcattggcgttgagcccggacagctcaagctgaattggttcaagaaaggctccagcatcgggcaaatgtttgagacaaccatgcggggagctaagagaatggccatccttggcgacacggcctgggatttcgggtctctgggaggcgtgtttacaagcattgggaaagctctccaccaggtcttcggcgccatctacggagcggctttttccggcgtgtcttggaccatgaagattctgatcggggtgattatcacctggatcggaatgaacagccgctccacaagcctgtctgtttcccttgtcctcgtgggcgtggtcaccctgtatctgggggccgtggttcaggccgacagcggatgtgtggtctcttggaaaaataaggaactcaagtgcggctccgggattttcatcacagataacgtgcacacgtggaccgagcagtacaaatttcaacctgaaagcccctccaagctggcttctgccattcagaaagctcatgaggaaggcatctgtggcattcggagcgttacaagacttgagaatctgatgtggaagcagatcaccccggagctcaaccacatcctgtccgaaaatgaggtgaaactgacaattatgaccggcgacatcaaggggattatgcaggccggaaaacgctctcttcggcctcaacccacggaactcaagtatagctggaagacctggggcaaagcgaagatgctgtccacagagagccataaccagaccttcctgatcgatgggcctgaaacagccgagtgccccaataccaacagagcttggaactctctcgaggtcgaagactacggatttggcgtgttcacaaccaacatttggctgaaacttcgcgagaagcaggacgtcttttgtgattccaaactgatgagcgccgctatcaaggacaatcgggccgtgcacgcggatatgggctattggatcgaatctgccctcaacgacacgtggaagatggagaaggctagcttcattgaggtcaagagctgccactggcctaaatctcatacactgtggagcaatggggtgctggaatccgagatgatcattcccaagaacttcgccggaccggtgagccagcacaactacagacctggctatcatacccaaaccgctgggccctggcaccttggaaaactcgaaatggattttgacttctgtgagggcacaaccgtcgttgtgacggaagattgcgggaatcgcggaccctctctgcggacaaccacagcctccggcaagctgatcaccgagtggtgctgtagaagctgcacactccctccgctgcggtaccgcggcgaggacgggtgttggtacggaatggaaattagaccccttaaggagaaagaagagaacctggtcaattccctcgtcaccgccggccatgggcagatcgataacttttctctgggagtgctgggcatggctcttttcctcgaagagatgctgcggacgagaattgggaccaagcacgcgatcctgctcgttgccgtgagctttgtcacactgatcaccggaaatatgtccttccgcgaccttggccgggtgatggttatggtgggcgctacaatgaccgatgacattgggatgggagtcacgtatctggccctcctggccgcttttaaagtgagacctacattcgccgcgggcctgcttctgcgcaagctcacctctaaagagctgatgatggctacaatcgggattgccctcctgagccagtccaccatccccgaaaccattcttgagctgacagatgccctcgctctgggaatgatggttctgaagatcgtgagaaacatggaaaagtaccaacttgccgtcacgatcatggcgatttcttgcgtgcctaatgctgtgatcctgcagaacgcctggaaagtcagctgtaccattctcgccgctgtttccgtgagccccctgctcctgacatcttcccagcagaaggccgactggatccctcttgctctgaccattaaaggcctcaatcccacagccatctttctgaccacgctgagccggacatctaagaaacgctcctggccgcttaacgaggcgatcatggccgtggggatggtcagcattctggcttcttccctcctgaagaatgacatccctatgaccggacccctcgtggccggcggcctgcttaccgtttgctatgtgctgacagggagaagcgctgatctggaactcgagcgggccgccgacgtcaaatgggaggatcaagctgaaatttccggaagctctcctatcctgagcattaccatctccgaggacggctctatgagcattaagaacgaagaggaggaacagacacttacgatcctgatccgcaccgggctcctggtgatttccggaatcttccccgtttctattccgatcacagcggccgcttggtacctctgggaggtgaagaaacagagagccggcgtcctgtgggatgtgccttctccccctcccgtcgaaaaggccgagcttgaagacggggcttatcggattaaacagcgcggaatcctgggctactcccaaatcggcgccggggtgtataaggagggaacctttcacacaatgtggcatgttaccagaggcgcggtgctgatgcaccgggggaaacgcattgagccctcctgggctgatgtcaagaaggacctcatcagctacggaggcgggtggaaactggaaggagagtggaaggaaggcgaggaagtgcaggttcttgccctggagcctggcaaaaatccgagagccgtgcagacgaagcccgggattttcaaaaccaacacaggaaccatcggcgctgtctccctcgattttagccctgggacatctggatcccccattgtggaccggaagggcaaggtggttgggctgtacggaaatggcgtcgtgaccagaagcggcgcctatgtgtctgcgatcgctcagacagagaaatccatcgaagataaccctgagattgaagacgatatcttccgcaagaaacggctcacgattatggacctgcatcccggggccggaaagaccaaaagataccttcctgccatcgtccgcgaggctattaagcggggcctgagaacactgatcctcgccccgacccgcgtggttgctgccgaaatggaggaggcgctgcgggggcttcccattagatatcaaacccctgccatcaagacagaacacacgggacgcgagatcgtggacctgatgtgtcatgctaccttcacaatgcggctcctgagccccgtcagagtgcctaactacaatctcattatcatggatgaagcccactttaccgaccccgcttccattgccgcccggggctatatctctacacgcgttgagatgggggaggctgcgggcattttcatgaccgccacgccgcctggaagcagagatccctttccccagtccaacgctcctatcatggacgaagaacgggaaatccccgagcgcagctggaactctggccacgaatgggtgacagatttcaaagggaagaccgtctggtttgtgccttccattaaagccggaaacgacatcgccgcttgcctgagaaagaatggcaaaaaggttattcagcttagccggaagaccttcgattctgagtacgtgaaaacaagagccaacgactgggattttgtcgtgaccacagacatcagcgagatgggggcgaatttcaaggctgaacgcgtgattgatccgcggagatgtatgaaacccgtcatcctgaccgacggagaggaacgcgttatcctggccggccctatgcccgtgacgcattcctctgccgctcaacggagagggcgcattggccggaaccctaagaatgagaacgaccagtatatctacatgggagaacccctcgagaatgatgaggactgcgcccactggaaagaagcgaagatgctgcttgataacattaatacaccggagggcatcattcctagcatgtttgaacccgagagagaaaaagtggacgccatcgatggggagtaccgcctgagaggagaggctcggaagaccttcgtcgacctcatgcgcagaggcgatctgcctgtgtggctggcctataaggttgctgccgaagggattaactacacagaccggaaatggtgttttgatggaatcaagaataaccagatcctcgaggaaaacatggaggtggagatttggaccaaagaaggcgagcgcaagaaacttaagcccagatggctggacgctcggatctattccgatcctctggccctcaaggagttcaaagagttcgcggccgggagaaagtctctgacgcttaatctgattaccgaaatgggccgcctccccacatttatgacccagaaagctcggaacgccctggacaatctggctgtcctccatacagccgaggccggaggcagagcttacaaccacgcgcttagcgagctgccggaaaccctggagacactcctgcttctgaccctcctggccacggtgacagggggaatcttcctgtttctcatgtccggcaaggggattggaaaaatgacccttggcatgtgctgcatcatcaccgctagcattctgctgtggtatgcccaaatccagcctcactggattgccgcttctatcattctcgagttctttctgatcgttcttctgatccccgagcccgaaaagcagcgcacacctcaggataatcaactcacctacgtggtcattgccatcctgacagtggtcgcggccacgatggctaacgagatgggcttcctggagaagaccaaaaaggacctcgggcttggatccattacaacccaggaaagcgagtccaatatcctggacattgatctgcggccggcctctgcttggacactctatgccgtggcgaccacgtttgttacccccatgctgagacatagcatcgaaaactcctctgtgaatgtgagccttacagccattgctaaccaggccaccgtcctgatgggcctcgggaaaggatggcctctgtccaagatggacatcggcgttcccctgctcgctatcgggtgttacagccaggtgaatcctattacacttaccgccgctctgctgctcctggtggcccactacgcgatcattggacccggccttcaagccaaagctacgcgggaggcccagaagcgcgctgccgccggcatcatgaagaaccctacagtcgatgggattaccgtgatcgacctggaaccgatcccctatgatcctaaattcgagaagcagctcggacaggttatgctgctgattctctgcgtgacacaagtccttatgatgagaaccacctgggcgctgtgtgaggctctgacactcgccacgggccccatctctaccctgtgggaagggaatcctggacggttttggaacacaaccattgctgtgtccatggccaatatcttccgcggcagctaccttgccggggctggactgctcttttctattatgaaaaacacaacctccacgagacggggcacaggcaatatcggggagaccctgggagaaaagtggaaaagccgcctgaacgccctcggcaagtctgagttccagatctataaaaagagcgggattcaggaggtcgacagaacccttgcgaaggaaggaatcaaacggggcgagacagatcatcacgccgtgtcccgcgggtctgctaagctgagatggtttgttgaacggaacatggtgacccccgagggaaaagtcgtggacctgggctgcggcagagggggatggagctactattgtggcgggctcaagaatgttcgcgaagtgaaaggactgacaaagggcgggccgggacatgaggagcctattcccatgtccacgtacggctggaaccttgtccggctgcaaagcggcgtggatgtgttcttcacaccccctgaaaagtgcgacacactcctgtgtgatatcggggagtcctctcccaatcctaccattgaagccggaagaacactgcgcgttctcaaccttgtcgagaattggctgaacaataacacccagttttgcatcaaagtgctgaatccgtatatgcccagcgtgatcgaaaagatggaggctctccagcggcagtacggcggggccctggtcagaaaccctctttcccgcaattctacgcacgagatgtactgggttagcaacgcgaccggaaatattgtgtcctctgtgaacatgatcagccggatgctgattaatagattcacaatgaaacacaagaaagccacctatgaacccgacgtcgatctcggctccgggacacgcaacatcggaattgagagcgaaatccctaacctggacattatcggcaagcggatcgagaagattaaacaagaacatgagatctcttggcactacgaccaggatcatccctataagacctgggcttaccacggctcctatgagacaaaacagaccgggagcgcctcttccatggtgaatggagttgtgagactgctcacgaagccgtgggacgtcgtgcctatggttacacagatggctatgaccgataccacaccctttggccaacagcgcgtgttcaaagaaaaggtcgacacgcggacccaggagcctaaggaagggaccaagaaacttatgaaaattaccgccgagtggctgtggaaagagctgggacgcaaaaagacaccccgcatgtgtaccagagaagagtttacacggaaagtgcgcagcaacgctgccctcggcgcgatcttcaccgatgaaaataagtggaagtctgccagagaggctgtggaagacgggcggttttgggagctggtcgatagagagcggaaccttcacctggaaggaaaatgcgagacgtgtgtttacaatatgatgggcaagcgcgagaaaaagctcggcgagttcgggaaagccaagggatccagagctatttggtatatgtggctgggcgcccggtttctggagttcgaggccctcgggtttctgaacgaggaccattggttcagccgcgaaaattcccttagcggagtggagggcgaagggctgcacagactcggctacatcctgcgggatgtgggaaagaaagagggcggggcgatgtacgctgacgataccgccggatgggacacacgcatcacccttgaagacctgaagaacgaggagatggtcacaaatcatatgaaaggcgaacacaagaaactcgccgaggctatttttaagctgacctatcagaacaaggtggttagagtgcaacggcctacgccccgcgggacagtcatggatatcatttctagacgggaccagcgcggaagcggccaggtggggacctacggcctgaatacattcaccaacatggaagcccaactcatcagacagatggagggagagggcattttcaaatccatccagcatctgacggctaccgaagagatcgccgttcagaattggcttgcgcgggtggggcgcgaaagactgtctcggatggccattagcggagatgactgcgtcgtgaagccgatcgatgacagatttgcttccgccctcacagctctgaacgatatgggcaaagttcgcaaggacattcaacagtgggagccttctcgggggtggaatgattggacccaggtgcccttctgcagccaccactttcatgaacttgtcatgaaagacggaagagtgctggtcgtgccctgtcgcaaccaggatgagctcatcggccgggccagaatttcccaaggggcgggctggtctctgaaggagacagcctgcctgggaaagagctatgctcagatgtggaccctcatgtacttccaccgccgggacctgagacttgccgctaacgccatctgttccgctgttcctagccattgggtgccgacatctcgcaccacgtggtccattcacgccaaacacgaatggatgacaaccgaggatatgctggcggtctggaatcgggtgtggatccaggaaaacccctggatggaggacaagacccctgtggaaagctgggaggaggttccctatctcggcaaaagagaagaccagtggtgcgggtctctgatcggacttacatcccgcgccacctgggctaagaatattcaaacagccatcaaccaggtgcggagcctgattggcaatgaggaatacacggattatatgccttccatgaaaagatttcggagagaggaagaggaggccggggtcctctggtga

SEQ ID NO: 19769 - RNA, 9876 nt, synthetic construct
  misc_feature 1..9876: note = derived and/or modified CDS sequence (opt5) from DENV-2__FJ744708__SS-prME
  source 1..9876: mol_type = other RNA
accgccggcgtgatcgtcatgctgattcccacggctatggccttccacctcacgaccagaaatggggagcctcatatgatcgttggacggcaggaaaagggcaagagcctgctttttaagacagaggacggggtgaatatgtgcaccctgatggcgattgatctcggagaactgtgtgaggacacaatcacctacaaatgcccgcttctgcgccaaaatgaacccgaggatattgactgttggtgcaattccacatctacctgggtgacgtatggcacctgtacaaccacaggggagcacagacgggaaaagcgcagcgtcgctctcgtgcctcatgttggaatgggcctggagaccagaacggaaacatggatgtcctctgagggcgcctggaaacacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaggaacaagacaaacgctttatctgcaagcattccatggtggatagaggctggggcaacgggtgtggactgttcggcaaaggcgggattgtcacatgcgccatgtttacgtgcaaaaagaatatggaagggaaagttgtgcagcctgagaacctcgaatacaccatcgtgattacaccccacagcggggaggagcatgcggtcggaaatgacaccggcaagcacggcaaagaaatcaagatcacacctcagtcttccattaccgaggccgaactgacggggtatggaaccgtgacaatggagtgtagcccccggaccggccttgatttcaacgaaatggttctgctccaaatggaggacaaggcttggctggtgcaccgccagtggtttcttgatctgccgctcccttggctgcccggggccgacacacagggatctaattggatccagaaggagaccctggtcacgttcaagaaccctcatgctaaaaagcaagacgtggttgtgctcggctcccaggaaggggccatgcacacagccctgaccggcgctacagagattcagatgagctccggaaatcttctgtttaccggccatctcaaatgcagactgcggatggataaacttcaactgaaagggatgtcttacagcatgtgtaccggaaagttcaagatcgtcaaagaaattgcggagacacagcacggcacgatcgtgatcagagtccagtatgagggggacggatccccctgcaagattcccttcgaaatcaccgatctcgagaaacgccatgtgctgggccggctgattacagttaaccctatcgtgaccgaaaaggacagcccggtcaacattgaggccgaacccccttttggggattcttacatcattatcggcgtggagcccggacagctcaaactgaattggttcaagaagggctccagcatcgggcaaatgtttgagacaaccatgagaggagctaaacgcatggccattcttggcgacacggcctgggatttcgggtctctgggaggcgtttttacaagcatcgggaaggctctccaccaggtgttcggcgccatttacggagcggctttttccggcgtctcttggaccatgaaaatcctgattggggtgatcatcacctggattggaatgaacagccggtccacaagcctgtctgtgtcccttgttctcgtcggcgtggtgaccctgtatctgggggccgtcgtgcaggccgacagcggatgtgttgtgtcttggaagaataaagaactcaagtgcggctccgggatcttcattacagataacgtccacacgtggaccgagcagtacaagtttcaacctgaaagcccctccaaactggcttctgccatccagaaggctcatgaggaaggcatttgtggaatcagaagcgtgacacgccttgagaatctgatgtggaaacagatcaccccggagctcaaccacattctgtccgaaaatgaggttaagctgacaatcatgaccggcgacattaaagggatcatgcaggccggaaagcggtctcttagacctcaacccacggaactcaaatatagctggaagacctggggcaaggcgaaaatgctgtccacagagagccataaccagaccttcctgattgatgggcctgaaacagccgagtgccccaataccaaccgcgcttggaactctctcgaggtggaagactacggatttggcgtcttcacaaccaacatctggctgaaacttcgggagaaacaggacgtgttttgtgattccaagctgatgagcgccgctatcaaagacaatagagccgttcacgcggatatgggctattggattgaatctgccctcaacgacacgtggaagatggagaaggcttccttcatcgaggtgaaaagctgccactggcctaagtctcatacactgtggagcaatggggtcctggaatccgagatgattatccccaaaaacttcgccggaccggtgagccagcacaactaccgccctggctatcatacccaaaccgctgggccctggcaccttggaaagctcgaaatggattttgacttctgtgagggcacaaccgtggtcgttacggaagattgcgggaatcggggaccctctctgagaacaaccacagcctccggcaaactgattaccgagtggtgctgtcggagctgcacactccctccgctgcgctacagaggcgaggacgggtgttggtacggaatggaaatccggccccttaaggagaaggaagagaacctggtgaatagcctcgtgaccgccggccatgggcagattgataacttttctctgggagtcctgggcatggctcttttcctcgaagagatgctgagaacgcgcatcgggaccaaacacgcgatcctgctcgtggccgttagctttgtgacactgattaccggaaatatgtccttccgggaccttggcagagtcatggtgatggttggcgctacaatgaccgatgacatcgggatgggagtgacgtatctggccctcctggccgcttttaaggtccgccctacattcgccgcgggcctgcttctgagaaaactcacctctaaggagctgatgatggctacaattgggatcgccctcctgagccagtccaccattcccgaaaccatccttgagctgacagatgccctcgctctgggaatgatggtgctgaaaatcgttcggaacatggaaaagtaccaacttgccgtgacgattatggcgatctcttgcgtccctaatgctgtgattctgcagaacgcctggaaggtgagctgtaccatcctcgccgctgtctccgttagccccctgctcctgacatcttcccagcagaaagccgactggattcctcttgctctgaccatcaagggcctcaatcccacagccatctttctgaccacgctgagccgcacatctaaaaagagatcctggccgcttaacgaggcgattatggccgtggggatggtgagcatcctggcttcttccctcctgaaaaatgacattcctatgaccggacccctcgtcgccggcggcctgcttaccgtgtgctatgttctgacagggcggagcgctgatctggaactcgagcgcgccgccgacgtgaagtgggaggatcaagctgaaatctccggaagctctcctattctgagcatcaccatttccgaggacggctctatgagcatcaaaaacgaagaggaggaacagacacttacgatcctgattagaaccgggctcctggtcatctccggagtgttccccgtttctattccgatcacagcggccgcttggtacctctgggaggtgaagaagcagcgggccggcgtcctgtgggatgtgccttctccccctcccgtcgaaaaagccgagcttgaagacggggcttatcgcattaagcagagaggaatcctgggctactcccaaatcggcgccggggtgtataaagagggaacctttcacacaatgtggcatgttacccggggcgcggtgctgatgcaccgcgggaagagaattgagccctcctgggctgatgtcaaaaaggacctcatcagctacggaggcgggtggaagctggaaggagagtggaaagaaggcgaggaagtgcaggttcttgccctggagcctggcaagaatccgcgggccgtgcagacgaaacccgggattttcaagaccaacacaggaaccatcggcgctgtctccctcgattttagccctgggacatctggatcccccattgtggacagaaaaggcaaggtggttgggctgtacggaaatggcgtcgtgacccgcagcggcgcctatgtgtctgcgatcgctcagacagagaagtccatcgaagataaccctgagattgaagacgatatcttccggaaaaagagactcacgattatggacctgcatcccggggccggaaaaaccaagcgctaccttcctgccatcgtccgggaggctattaaaagaggcctgcgcacactgatcctcgccccgacccgggtggttgctgccgaaatggaggaggcgctgagagggcttcccattcgctatcaaacccctgccatcaagacagaacacacgggacgggagatcgtggacctgatgtgtcatgctaccttcacaatgagactcctgagccccgtccgggtgcctaactacaatctcattatcatggatgaagcccactttaccgaccccgcttccattgccgcccgcggctatatctctacaagagttgagatgggggaggctgcgggcattttcatgaccgccacgccgcctggaagccgggatccctttccccagtccaacgctcctatcatggacgaagaaagagaaatccccgagagaagctggaactctggccacgaatgggtgacagatttcaaggggaaaaccgtctggtttgtgccttccattaaggccggaaacgacatcgccgcttgcctgcggaaaaatggcaagaaagttattcagcttagcagaaagaccttcgattctgagtacgtgaagacacgcgccaacgactgggattttgtcgtgaccacagacatcagcgagatgggggcgaatttcaaagctgaacgggtgattgatccgagacgctgtatgaagcccgtcatcctgaccgacggagaggaacgggttatcctggccggccctatgcccgtgacgcattcctctgccgctcaaagacgcgggcggattggcagaaaccctaaaaatgagaacgaccagtatatctacatgggagaacccctcgagaatgatgaggactgcgcccactggaaggaagcgaaaatgctgcttgataacattaatacaccggagggcatcattcctagcatgtttgaacccgagcgcgaaaaggtggacgccatcgatggggagtacagactgcggggagaggctcgcaaaaccttcgtcgacctcatgagacggggcgatctgcctgtgtggctggcctataaggttgctgccgaagggattaactacgctgaccgcaagtggtgttttgatggaatcaaaaataaccagatcctcgaggaaaacatggaggtggagatttggacaaaggaaggcgagcgcaagaaacttaaaccccggtggctggacgccagaatctattccgatcctctggcgctcaaggagttcaaggagttcgccgctgggcgcaaatctctgacccttaatctgattacggaaatgggccggctccccacctttatgacacagaaggccagaaacgctctggacaatctggccgtcctccataccgccgaggctggaggccgcgcgtacaaccacgcccttagcgagctgccggaaacactggagaccctcctgcttctgacactcctggctaccgtgacagggggaatcttcctgtttctcatgtccggcaaagggattggaaagatgacacttggcatgtgctgcatcatcaccgccagcattctgctgtggtatgccgaaatccaacctcactggattgctgcctctatcattctcgagttctttctgatcgttcttctgatccccgaacccgagaaacagcggacccctcaggataatcagctcacatacgtggtcattgcgatcctgaccgtggtcgccgctacaatggccaacgagatgggcttcctggaaaagacgaagaaagacctcgggcttggatccattaccacacaagagagcgaatccaatatcctggacattgatctgagaccggcttctgcctggaccctctatgcggtggccacaacctttgttacgcccatgctgcggcatagcatcgagaactcctctgtgaatgtgagccttaccgctattgccaaccaggctacagtcctgatgggcctcgggaagggatggcctctgtccaaaatggacatcggcgttcccctgctcgccatcgggtgttacagccaggtgaatcctattacccttacagctgccctgctgctcctggtggcgcactacgccatcattggacccggccttcaggctaaggccacccgcgaagctcagaagagagccgccgcgggcatcatgaagaaccctacggtcgatgggattacagtgatcgacctggagccgatcccctatgatcctaagttcgagaaacagctcggacaggttatgctgctgattctctgcgtgacccaggtccttatgatgcggacaacctgggctctgtgtgaagccctgaccctcgctacaggccccatctctacgctgtgggaggggaatcctggacgcttttggaacaccacaattgccgtgtccatggtcaatatcttcagcggctcttaccttgccggggctggactgcatgtgcccctcagaaagaacaccctgcggacacgcagaggcaccggcaatacgggggaaacactgggagagaaatggaagtcccggctcaacgcccttggcaaaagcgagtttcaaatttataagaaatctgggatccaggaagttgaccgcaccctggcgaaggagggaatcaagagaggcgaaaccgatcaccatgccgtgagccgggggtccgctaaactgagatggttcgtcgagcgcaacatggtgacaccggaaggaaaggttgtggacctcggctgcggcagagggggatggtcttactattgtggcgggctgaaaaatgtccgggaggtgaagggacttaccaaaggcgggcctggacacgaggaacccattcccatgagcacatacggctggaacctggtgcgcctccagtccggcgttgatgtctttttcacgcctcccgagaagtgcgacaccctgctgtgtgatatcggggaaagctcccctaatccgacaattgaggccggacggaccctcagagtgcttaacctggtggaaaattggctgaacaataacacacaattctgcatcaaggtcctcaatccctatatgccttctgttattgagaaaatggaggctctgcagcgccagtacggcggggcccttgtgcggaaccccctgagcagaaattccacccacgaaatgtactgggtgtctaacgcgacgggaaatatcgtcagctccgtgaacatgatctctcgcatgctcattaatcggtttaccatgaagcataaaaaggccacatatgagcctgacgttgatctgggcagcgggaccagaaacatcggaattgaatccgagatccccaacctggacattatcggcaaacgcattgaaaagatcaagcaggagcacgagatcagctggcattacgaccaagatcacccgtataaaacatgggcttaccacggctcttatgaaaccaagcagacagggtccgccagctctatggtgaatggagtcgtgcggctccttaccaaaccttgggacgttgtgcccatggtcacgcagatggctatgacagataccacccctttcggccagcaaagagtgtttaaggagaaagtggacacacgcacgcaggaacccaaggaggggaccaagaaactgatgaagattacagccgagtggctgtggaaagaactcggaaagaaaaagacccctagaatgtgtacacgggaggagttcaccaaaaaggtccgctccaacgctgccctgggcgcgatctttacagatgagaataagtggaaaagcgccagagaagctgttgaggacgggcggttctgggagcttgtggatagagaacggaacctgcatctcgagggaaagtgcgaaacctgtgtgtacaatatgatgggcaaacgcgagaagaaactgggcgaatttgggaaggccaagggatctagagctatttggtatatgtggctgggcgcccggttcctcgagtttgaggccctggggttccttaacgaagaccactggttttcccgcggaaatagcctgtccggcgtcgagggggaaggcctccatagactgggatacatccttcgggatgtgggcaaaaaggaagggggagcgatgtacgctgacgatacggccggctgggacacccgcattacactggaagacctcaaaaacgaggagatggttaccaatcacatgaagggggaacataaaaagctggccgaggctatcttcaagctgacatatcagaacaaagtggtcagagtgcagcggcccaccccgcgcggaacggttatggatatcattagcagacgggaccaacgcggctctggacaggtgggcacatacggactcaatacctttacaaacatggaagcccagctgatcagacaaatggagggcgaggggattttcaagagcatccagcaccttaccgctacggaagagattgccgtccagaattggctggcgcgggtgggacgcgaaagactctcccggatggccatctctggcgatgactgcgttgtgaaacctatcgatgacagattcgctagcgccctgaccgctcttaacgatatggggaaggtccgcaaagacattcagcaatgggagccctcccggggatggaatgattggacacaggtgcccttttgctctcaccatttccacgaactggtcatgaaggacggcagagtgctcgttgtgccttgtcgcaaccaggatgagctgatcgggcgggccagaattagccagggcgcgggatggtccctgaaggagaccgcctgcctcggcaaatcttatgctcaaatgtggacactgatgtactttcatcgccgggaccttagactggccgctaacgccatctgtagcgctgtcccgtcccactgggtgcccaccagccgcacaacctggtctattcacgccaagcatgaatggatgacgacagaggatatgctcgcggtgtggaatcgggtttggatccaggaaaacccttggatggaggacaaaacccccgtggaatcctgggaggaggtcccttatctggggaagagagaagaccagtggtgcggaagccttattggcctgacctctcgcgccacatgggctaaaaatatccagaccgccatcaaccaagtgcggtccctcattgggaatgaggaatacacagattatatgcccagcatgaagagattccggagagaggaagaggaggccggagttctgtggtga

SEQ ID NO: 19770 - RNA, 9876 nt, synthetic construct
  misc_feature 1..9876: note = derived and/or modified CDS sequence (opt5) from DENV-2__FJ810418__SS-prME
  source 1..9876: mol_type = other RNA
accgccggagtgatcgttatgctgattcccaccgctatggccttccacctcacgacccggaatggggaacctcatatgatcgttggacggcaggaaaagggcaaaagcctgctttttaagaccgaggacggggtgaatatgtgcaccctgatggcgattgatctcggagaactgtgtgaggacacgatcacctacaaatgcccgcttctgcgccaaaatgaacccgaggatattgactgttggtgcaattccacatctacctgggtgacgtatggcacctgtacaaccacaggggagcacagacgggaaaagcgcagcgtcgctctcgtgcctcatgttggaatgggcctggagaccagaacggaaacatggatgtcctctgagggcgcctggaaacacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaagaacaggacaaacgctttatctgcaagcattccatggtggatagaggctggggcaacgggtgtggactgttcggcaaagggggaattgtcacatgcgccatgtttacgtgcaaaaagaatatggaaggcaaagttgtgcagcctgagaacctcgaatacaccatcgtgattacaccccacagcggggaggagcatgcggtcggaaatgacaccggcaagcacggcaaagaaatcaagatcacacctcagtcttccattaccgaggccgaactgacggggtatggaaccgtgacaatggagtgtagcccccggaccggccttgatttcaacgaaatggttctgctccaaatggaggacaaggcttggctggtgcaccgccagtggtttcttgatctgccgctcccttggctgcccggggccgacacacagggatctaattggatccagaaggagaccctggtcacgttcaagaaccctcatgctaaaaagcaagacgtggttgtgctcggctcccaggaaggggccatgcacacagccctgaccggcgctacagagattcagatgagctccggaaatcttctgtttaccggccatctcaaatgcagactgcggatggataaacttcaactgaaagggatgtcttacagcatgtgtaccggaaagttcaagatcgtcaaagaaattgcggagacacagcacggcacgatcgtgatcagagtccagtatgagggggacggatccccctgcaagattcccttcgaaatcaccgatctcgagaaacgccatgtgctgggccggctgattacagttaaccctatcgtgaccgaaaaggacagcccggtcaacattgaggccgaacccccttttggggattcttacatcattatcggcgtggagcccggacagctcaaactgaattggttcaagaagggctccagcatcgggcaaatgtttaaaacaaccatgagaggagctaagcgcatggccattcttggcgacacggcctgggatttcgggtctctgggaggcgtttttacaagcatcgggaaagctctccaccaggtgttcggcgccatttacggagcggctttttccggcgtctcttggaccatgaagatcctgattggggtggtgatcacctggatcggaatgaacagccggtccacaagcctgtctgtttcccttgtcctcgtgggcgtggtcaccctgtatctgggggccgtggttcaggccgacagcggatgtgtggtctcttggaaaaataaggagctcaagtgcggctccgggattttcatcacagataacgtgcacacgtggaccgaacagtacaaatttcaacctgagagcccctccaagctggcttctgccattcagaaagctcatgaagagggcatctgtggaattagaagcgttacacgccttgaaaatctgatgtggaagcagatcaccccggagctcaaccacatcctgtccgagaatgaagtgaaactgacaattatgaccggcgacatcaaggggattatgcaggccggaaaacggtctcttagacctcaacccacggagctcaagtatagctggaagacctggggcaaagcgaagatgctgtccacagaaagccataaccagaccttcctgatcgatgggcctgagacagccgaatgccccaataccaaccgcgcttggaactctctcgaggtcgaggactacggatttggcgtgttcacaaccaacatttggctgaaacttcgggaaaagcaggacgtcttttgtgattccaaactgatgagcgccgctatcaaggacaatagagccgtgcacgcggatatgggctattggatcgagtctgccctcaacgacacgtggaagatggaaaaggctagcttcattgaggtcaagagctgccactggcctaaatctcatacactgtggagcaatggggtgctggagtccgaaatggtgatccccaagaacttcgccggaccggtcagccagcacaactaccgccctggctatcatacccaaaccgctgggccctggcaccttggaaaactcgagatggattttgacttctgtgaaggcacaaccgttgtggtgacggaggattgcgggaatcggggaccctctctgagaacaaccacagcctccggcaagctgattaccgaatggtgctgtcggagctgcacactccctccgctgcgctacagaggcgaggacgggtgttggtacggaatggagatccggccccttaaggaaaaagaggaaaacctggtcaattccctcgtgaccgccggccatgggcagattgataacttttctctgggagttctgggcatggctcttttcctcgaggaaatgctgagaacgcgcatcgggaccaagcacgcgattctgctcgtggccgtcagctttgtgacactgatcaccggaaatatgtccttccgggaccttggcagagttatggtgatggtcggcgctacaatgaccgatgacatcgggatgggagtgacgtatctggccctcctggccgcttttaaagttcgccctacattcgccgcgggcctgcttctgagaaagctcacctctaaagagctgatgatggctacaattgggatcgccctcctgagccagtccaccattcccgagaccatccttgaactgacagatgccctcgctctgggaatgatggtgctgaagattgtccggaacatggagaagtaccaacttgccgtgacgatcatggcgatctcttgcgtgcctaatgctgtcattctgcagaacgcctggaaagttagctgtaccatcctcgccgctgtgtccgtgagccccctgctcctgacatcttcccagcagaaggccgactggattcctcttgctctgaccatcaaaggcctcaatcccacagccatttttctgaccacgctgagccgcacatctaagaaaagatcctggccgcttaacgaagcgatcatggccgtcgggatggtgagcatcctggcttcttccctcctgaagaatgacattcctatgaccggacccctcgttgccggcggcctgcttaccgtgtgctatgtcctgacagggcggagcgctgatctggagctcgaacgcgccgccgacgtgaaatgggaggatcaagctgagatctccggaagctctcctattctgagcatcaccatttccgaagacggctctatgagcatcaagaacgaggaagaggagcagacacttacgattctgatcagaaccgggctcctggttatctccggagtgttccccgtctctattccgatcacagcggccgcttggtacctctgggaagtgaagaaacagcgggccggcgtcctgtgggatgtgccttctccccctcccgttgagaaggccgaacttgaggacggggcttatcgcattaaacagagaggaatcctgggctactcccaaattggcgccggggtgtataaggaaggaacctttcacacaatgtggcatgtcacccggggcgcggtgctgatgcaccgcgggaaaagaatcgagccctcctgggctgatgttaagaaggacctcatcagctacggaggcgggtggaaactggagggagaatggaaggagggcgaagaggtgcaggtccttgccctggaacctggcaaaaatccgcgggccgtgcagacgaagcccgggattttcaaaaccaacacaggaaccatcggcgctgtgtccctcgattttagccctgggacatctggatcccccattgttgacagaaagggcaaggtcgtggggctgtacggaaatggcgtggtcacccgcagcggcgcctatgtgtctgcgatcgctcagacagagaaatccattgaggataaccctgaaatcgaggacgatatcttccggaagaaaagactcacgattatggacctgcatcccggggccggaaagaccaaacgctaccttcctgccatcgttcgggaagctattaagagaggcctgcgcacactgatcctcgccccgacccgggtggtcgctgccgagatggaagaggcgctgagagggcttcccattcgctatcaaacccctgccatcaagacagagcacacgggacgggaaattgtggacctgatgtgtcatgctaccttcacaatgagactcctgagccccgttcgggtgcctaactacaatctcatcatcatggatgaggcccactttaccgaccccgcttccattgccgcccgcggctatatctctacaagagtcgaaatgggggaggctgcgggcattttcatgaccgccacgccgcctggaagccgggatccctttccccagtccaacgctcctatcatggacgaggaacgcgagattcccgaaagaagctggaactctggccacgagtgggtgacagatttcaaagggaagaccgtttggtttgtgccttccatcaaagccggaaacgacatcgccgcttgcctgcggaagaatggcaaaaaggtcattcagcttagcagaaagaccttcgattctgaatacgtgaaaacacgcgccaacgactgggattttgtggtcaccacagacatcagcgagatgggggcgaatttcaaggctgagcgggttattgatccgagacgctgtatgaaacccgtgatcctgaccgacggagaagaacgggtgattctggccggccctatgcccgtcacgcattcctctgccgctcaaagacgcgggcggatcggcagaaaccctaagaatgaaaacgaccagtatatctacatgggagagcccctcgaaaatgatgaggactgcgcccactggaaagaggcgaagatgctgcttgataacattaatacaccggaaggcatcattcctagcatgtttgagcccgaacgcgagaaagtggacgccatcgatggggaatacagactgcggggagaggctcgcaagaccttcgttgacctcatgagacggggcgatctgcctgtgtggctggcctataaggtcgctgccgaggggattaactacgctgaccgcaaatggtgttttgatggaatcaagaataaccagattctcgaagagaacatggaagtggagatctggacaaaagagggcgaaagaaagaaacttaagccccggtggctggacgccagaatctattccgatcctctggcgctcaaggagttcaaagagttcgccgctgggcgcaagtctctgacccttaatctgattacggagatgggccggctccccacctttatgacacagaaagccagaaacgctctggacaatctggccgttctccataccgccgaagctggaggccgcgcgtacaaccacgcccttagcgagctgccggagacactggaaaccctcctgcttctgacactcctggctaccgtgacagggggaatcttcctgtttctcatgtccggcaaggggattggaaaaatgacacttggcatgtgctgcatcattaccgccagcatcctgctgtggtatgcccaaatccagcctcactggattgctgcctctatcattctcgagttctttctgatcgtccttctgattcccgaacccgagaagcagcggacccctcaggataatcaactcacatacgtggtcatcgcgatcctgaccgtggttgccgctacaatggccaacgaaatgggcttcctggagaagacgaaaaaggacctcgggcttggatccattaccacacaggagagcgaatccaatatcctggacattgatctgagaccggcttctgcctggaccctctatgcggtggccacaacctttgtgacgcccatgctgcggcatagcatcgagaactcctctgtcaatgttagccttaccgctattgccaaccaggctacagtgctgatgggcctcgggaaaggatggcctctgtccaagatggacatcggcgtgcccctgctcgccattgggtgttacagccaggtcaatcctatcacccttacagctgccctgctgctcctggtggcgcactacgccatcattggacccggccttcaagctaaagccacccgcgaagctcagaagagagccgccgcgggcatcatgaagaaccctacggttgatgggattacagtgatcgacctggagccgattccctatgatcctaaattcgaaaagcagctcggacaggtcatgctgctgatcctctgcgtgacccaagtccttatgatgcggacaacctgggctctgtgtgaggccctgaccctcgctacaggccccatctctacgctgtgggaggggaatcctggacgcttttggaacaccacaattgccgtgtccatggccaatatcttcagaggcagctaccttgctggggccggactgctcttttctattatgaaaaacaccacatccacccggcgcggcacgggcaatatcggggaaacactgggagagaagtggaaaagcagactgaacgcgctcggcaagtctgagttccagatttataaaaagagcgggatccaggaggttgaccggacccttgccaaggagggaatcaaacgcggcgaaaccgatcatcacgctgtgtccagagggtctgccaagctgcggtggtttgtcgagagaaacatggtgacacccgaaggaaaagttgtggacctgggctgcggccgcgggggatggagctactattgtggcgggctcaagaatgtccgggaggtgaaaggactgaccaagggcgggccgggacatgaagaacctattcccatgtccacatacggctggaaccttgtgagactgcaaagcggcgttgatgtcttcttcacgccccctgagaagtgcgacaccctcctgtgtgatatcggggaatcctctcccaatcctacaattgaggctggacgcaccctgcgggtgctcaaccttgtggaaaattggctgaacaataacacacagttttgcatcaaagtcctgaatccgtatatgcccagcgttattgagaagatggaagccctccagagacagtacggcggggcgctggtgcgcaaccctctttccagaaattctacccacgagatgtactgggtgagcaacgccacgggaaatatcgtctcctctgtgaacatgatcagcagaatgctgattaatcgcttcaccatgaaacacaagaaagctacatatgagcccgacgttgatctcggctccgggacccggaacatcggaattgaaagcgagatccctaacctggacattatcggcaagagaattgaaaagatcaaacaagagcatgaaatctcttggcactacgaccaggatcatccctataagacatgggcctaccacggctcctatgagaccaaacagacagggagcgcttcttccatggtgaatggagtcgtgcgcctgctcaccaagccgtgggacgttgtgcctatggtcacgcagatggccatgacagataccaccccctttggccaacagcgggtgttcaaagagaaggtggacacaagaacgcaggaacctaaggaggggaccaagaaacttatgaaaattacagctgaatggctgtggaaagagctgggcaagaagaaaacaccccgcatgtgtacaagagtcgagtttaccaagaaggttcggagcaacgccgcgctcggcgccatcttcacagatgaaaataaatggaagtctgctcgcgaggccgtggaagacgggagattttgggagctggtggatcgggaaagaaaccttcacctggagggaaaatgcgagacctgtgtctacaatatgatgggcaagcgggagaaaaagctcggcgagttcgggaaggctaaaggatcccgcgccatttggtatatgtggctgggcgccagatttctggagttcgaggcgctcgggtttctgaacgaagaccattggttcagccggggaaattcccttagcggcgtggagggggagggcctgcaccgcctcggatacatcctgagagatgttggcaagaaagaagggggagctatgtacgccgacgatacggccggctgggacacccggattacacttgaggacctgaagaacgaagagatggtgaccaatcatatgaaaggggaacacaagaagctcgctgaggccatctttaaactgacatatcagaacaaggtcgtgcgcgttcaaagacctacaccccggggaacggtgatggatatcatttctcgcagagaccagcggggcagcgggcaggtcggcacatacggactgaataccttcacaaacatggaggctcaactcatccgccagatggaaggcgaggggattttcaaatccatccagcatctgaccgccacggaagagattgcggtgcagaattggcttgccagagttggacgggagcgcctgtctagaatggctatcagcggcgatgactgcgtggtcaagccgatcgatgaccggtttgcctccgctctcaccgccctgaacgatatggggaaagtgagaaaggacattcaacagtgggaaccttctcgcggatggaatgattggacacaggtccccttctgcagccaccactttcatgagcttgtgatgaaggacggccgggttctggtggtcccctgtagaaaccaggatgaactcatcgggcgcgcgcggatttcccaaggcgccggatggtctctgaaagagaccgcttgcctgggcaagagctatgcccagatgtggacactcatgtacttccacagacgcgacctgcggcttgctgccaacgctatctgttccgccgtgcctagccattgggtgccgacctctagaacaacctggtccattcacgcgaaacacgaatggatgacgacagaggatatgctggccgtttggaatcgcgtgtggatccaggagaacccctggatggaagacaagacccctgtcgagagctgggaagaggtgccctatctcgggaaacgggaagaccagtggtgcggatctctgattggccttacctccagagctacatgggccaagaatatccaaaccgccatcaaccaggttcgcagcctgattgggaatgaggagtacacagattatatgccttccatgaagcggtttagacgggaagaggaagaggctggagtgctctggtga

SEQ ID NO: 19771 - RNA, 9876 nt, synthetic construct
  misc_feature 1..9876: note = derived and/or modified CDS sequence (opt5) from DENV-2__FJ639835__SS-prME
  source 1..9876: mol_type = other RNA
accgccggcgtgatcgtcatgctgattcccaccgctatggccttccacctcacgaccagaaatggggaacctcatatgatcgttggacggcaggaaaagggcaaaagcctgctttttaagaccgaagacggggtgaatatgtgcaccctgatggcgattgatctcggagaactgtgtgaagacacgatcacctacaaatgcccgcttctgcgccaaaatgaacccgaggatattgactgttggtgcaattccacatctacctgggtgacgtatggcacctgtacaaccacaggggagcacagacgggaaaagcgcagcgtcgctctcgtgcctcatgttggaatgggcctggagaccagaacggaaacatggatgtcctctgagggcgcctggaaacacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaagaacaggacaaacgctttatctgcaagcattccatggtggatagaggctggggcaacgggtgtggactgttcggcaaaggagggattgtcacatgcgccatgtttacgtgcaaaaagaatatggaaggcaaagttgtgcagcctgagaacctcgaatacaccatcgtgattacaccccacagcggggaggagcatgcggtcggaaatgacaccggcaagcacggcaaagaaatcaagatcacacctcagtcttccattaccgaggccgaactgacggggtatggaaccgtgacaatggagtgtagcccccggaccggccttgatttcaacgaaatggttctgctccaaatggaggacaaggcttggctggtgcaccgccagtggtttcttgatctgccgctcccttggctgcccggggccgacacacagggatctaattggatccagaaggagaccctggtcacgttcaagaaccctcatgctaaaaagcaagacgtggttgtgctcggctcccaggaaggggccatgcacacagccctgaccggcgctacagagattcagatgagctccggaaatcttctgtttaccggccatctcaaatgcagactgcggatggataaacttcaactgaaagggatgtcttacagcatgtgtaccggaaagttcaagatcgtcaaagaaattgcggagacacagcacggcacgatcgtgatcagagtccagtatgagggggacggatccccctgcaagattcccttcgaaatcaccgatctcgagaaacgccatgtgctgggccggctgattacagttaaccctatcgtgaccgaaaaggacagcccggtcaacattgaggccgaacccccttttggggattcttacatcattatcggcgtggagcccggacagctcaaactgaattggttcaagaagggctccagcatcgggcaaatgtttgagacaaccatgagaggagctaaacgcatggccattcttggcgacacggcctgggatttcgggtctctgggaggcgtttttacaagcatcgggaaggctctccaccaggtgttcggcgccatttacggagcggctttttccggcgtctcttggaccatgaaaatcctgattggggtgatcatcacctggattggaatgaacagccggtccacaagcctgtctgtgtcccttgttctcgtcggcgtggtgaccctgtatctgggggccgtcgtgcaggccgacagcggatgtgttgtgtcttggaagaataaagaactcaagtgcggctccgggatcttcattacagataacgtccacacgtggaccgagcagtacaagtttcaacctgaaagcccctccaaactggcttctgccatccagaaggctcatgaggaaggcatttgtggaatcagaagcgtgacacgccttgagaatctgatgtggaaacagatcaccccggagctcaaccacattctgtccgaaaatgaggttaagctgacaatcatgaccggcgacattaaagggatcatgcaggccggaaagcggtctcttagacctcaacccacggaactcaaatatagctggaagacctggggcaaggcgaaaatgctgtccacagagagccataaccagaccttcctgattgatgggcctgaaacagccgagtgccccaataccaaccgcgcttggaactctctcgaggtggaagactacggatttggcgtcttcacaaccaacatctggctgaaacttcgggagaaacaggacgtgttttgtgattccaagctgatgagcgccgctatcaaagacaatagagccgttcacgcggatatgggctattggattgaatctgccctcaacgacacgtggaagatggagaaggcttccttcatcgaggtgaaaagctgccactggcctaagtctcatacactgtggagcaatggggtcctggaatccgagatggtgattcccaaaaacttcgccggaccggtgagccagcacaactaccgccctggctatcatacccaaaccgctgggccctggcaccttggaaagctcgaaatggattttgacttctgtgagggcacaaccgtcgttgtgacggaagattgcgggaatcggggaccctctctgagaacaaccacagcctccggcaaactgatcaccgagtggtgctgtcggagctgcacactccctccgctgcgctacagaggcgaggacgggtgttggtacggaatggaaattcggccccttaaggagaaggaagagaacctggtgaatagcctcgtcaccgccggccatgggcagatcgataacttttctctgggagtgctgggcatggctcttttcctcgaagagatgctgagaacgcgcattgggaccaaacacgcgatcctgctcgttgccgtgagctttgtcacactgatcaccggaaatatgtccttccgggaccttggcagagtgatggttatggtgggcgctacaatgaccgatgacattgggatgggagtcacgtatctggccctcctggccgcttttaaggtgcgccctacattcgccgcgggcctgcttctgagaaaactcacctctaaggagctgatgatggctacaatcgggattgccctcctgagccagtccaccatccccgaaaccattcttgagctgacagatgccctcgctctgggaatgatggttctgaaaatcgtgcggaacatggaaaagtaccaacttgccgtcacgatcatggcgatttcttgcgtgcctaatgctgtgatcctgcagaacgcctggaaggtcagctgtaccattctcgccgctgtttccgtgagccccctgctcctgacatcttcccagcagaaagccgactggatccctcttgctctgaccattaagggcctcaatcccacagccatctttctgaccacgctgagccgcacatctaaaaagagatcctggccgcttaacgaggcgatcatggccgtggggatggtcagcattctggcttcttccctcctgaaaaatgacatccctatgaccggacccctcgtggccggcggcctgcttaccgtttgctatgtgctgacagggcggagcgctgatctggaactcgagcgcgccgccgacgtcaagtgggaggatcaagctgaaatttccggaagctctcctatcctgagcattaccatctccgaggacggctctatgagcattaaaaacgaagaggaggaacagacacttacgatcctgatcagaaccgggctcctggtgatttccggagttttccccgtgtctatcccgattacagcggccgcttggtacctctgggaggtcaagaagcagcgggccggcgtgctgtgggatgtcccttctccccctcccgtggaaaaagccgagcttgaagacggggcttatcgcatcaagcagagagggattctgggctactcccaaatcggcgccggggtttataaagagggaacctttcacacaatgtggcatgtgacccggggcgcggtcctgatgcaccgcgggaagagaatcgagccctcctgggctgatgtgaaaaaggacctcattagctacggaggcgggtggaagctggaaggagagtggaaagaaggcgaggaagttcaggtgcttgccctggagcctggcaagaatccgcgggccgtccagacgaaacccgggatcttcaagaccaacacaggaaccattggcgctgtgtccctcgattttagccctgggacatctggatcccccatcgtggacagaaaaggcaaggttgtcgggctgtacggaaatggcgtggtgacccgcagcggcgcctatgtctctgcgattgctcagacagagaagtccatcgaagataaccctgagatcgaagacgatattttccggaaaaagagactcacgatcatggacctgcatcccggggccggaaaaaccaagcgctaccttcctgccattgtgcgggaggctatcaaaagaggcctgcgcacactgattctcgccccgacccgggttgtggctgccgaaatggaggaggcgctgagagggcttcccatccgctatcaaacccctgccattaagacagaacacacgggacgggagatcgtcgacctgatgtgtcatgctaccttcacaatgagactcctgagccccgtgcgggttcctaactacaatctcatcattatggatgaagcccactttaccgaccccgcttccatcgccgcccgcggctatatttctacaagagtggagatgggggaggctgcgggcatcttcatgaccgccacgccgcctggaagccgggatccctttccccagtccaacgctcctattatggacgaagaaagagaaatccccgagagaagctggaactctggccacgaatgggtcacagatttcaaggggaaaaccgtgtggtttgttccttccatcaaggccggaaacgacattgccgcttgcctgcggaaaaatggcaagaaagtgatccagcttagcagaaagaccttcgattctgagtacgtcaagacacgcgccaacgactgggattttgtggtgaccacagacattagcgagatgggggcgaatttcaaagctgaacgggtcatcgatccgagacgctgtatgaagcccgttattctgaccgacggagaggaacgggtgatcctggccggccctatgcccgtgacgcattcctctgccgctcaaagacgcgggcggatcggcagaaaccctaaaaatgagaacgaccagtatatttacatgggagaacccctcgagaatgatgaggactgcgcccactggaaggaagcgaaaatgctgcttgataacatcaatacaccggagggcattatccctagcatgtttgaacccgagcgcgaaaaggtcgacgccattgatggggagtacagactgcggggagaggctcgcaaaaccttcgtggacctcatgagacggggcgatctgcctgtttggctggcctataaggtggctgccgaagggatcaactacgctgaccgcaagtggtgttttgatggaattaaaaataaccagatcctcgaggaaaacatggaggtcgagatctggacaaaggaaggcgagcgcaagaaacttaaaccccggtggctggacgccagaatttattccgatcctctggcgctcaaggagttcaaggagttcgccgctgggcgcaaatctctgacccttaatctgatcacggaaatgggccggctccccacctttatgacacagaaggccagaaacgctctggacaatctggccgtgctccataccgccgaggctggaggccgcgcgtacaaccacgcccttagcgagctgccggaaacactggagaccctcctgcttctgacactcctggctaccgttacagggggaattttcctgtttctcatgtccggcaaaagcatcgggaagatgacacttggaatgtgctgcattatcaccgcctctatcctgctgtggcacgcccaaattcagcctcattggatcgctgcctccattatcctcgagttctttctgattgtgcttctgatccccgagcccgaaaaacagcggacccctcaggataatcaactcacatatgtcgtgatcgcgattctgaccgtcgtggccgctacaatggccaacgagatgggcttcctggagaagacgaagaaagacctcggccttgggagcatcaccacacaggaatccgagtctaatattctggacatcgatctgagaccggctagcgcctggaccctctacgcggttgccacaacctttgtgacgcccatgctgcggcactccattgaaaactctagcgtgaatgtctcccttaccgctatcgccaaccaggctacagttctgatgggactcggcaaggggtggcctctgagcaaaatggacattggagtgcccctgctcgccatcggctgttattctcaggtgaatcctatcacccttacagctgccctgctgctcctggtcgcgcattacgccattatcgggcccggacttcaagctaaggccacccgcgaggctcagaaaagagccgccgcgggcattatgaagaaccctacggtggatggcatcacagttattgacctggaaccgatcccctacgatcctaagttcgagaaacagctcggacaggtgatgctgctgatcctctgcgtcacccaagtgcttatgatgcggacaacctgggctctgtgtgaggccctgaccctcgctacaggacccatttccacgctgtgggaaggcaatcctgggcgcttttggaacaccacaatcgccgtcagcatggccaatattttcagaggatcttatcttgctggcgccgggctgctcttttccatcatgaagaacaccacaagcacccggcgcggaacgggcaatattggcgagacactgggggaaaaatggaagtctagactgaacgcgctcggaaaaagcgagttccagatctacaagaaatccggcatccaggaggtggaccggacccttgccaaggaagggattaagcgcggagagaccgatcaccatgctgtttctagaggcagcgccaaactgcggtggtttgtggaaagaaacatggtcacacccgaggggaaggtggttgacctgggatgcggccgcggcgggtggtcctattactgtggaggcctcaaaaatgtgcgggaagtcaaggggctgaccaaaggaggcccggggcacgaggagcctatccccatgagcacatatggatggaaccttgtgagactgcaatccggcgtggatgttttcttcacgccccctgaaaagtgcgacaccctcctgtgtgatattggcgagtctagccccaatcctacaatcgaagctgggcgcaccctgcgggtcctcaaccttgtggagaattggctgaacaataacacacagttttgcattaaggtgctgaatccgtacatgccctccgtcatcgagaagatggaggccctccagagacagtatggaggcgcgctggttcgcaaccctctttctcggaatagcacccacgagatgtactgggtgtccaacgccacggggaatatcgtgtctagcgtcaacatgatttccagaatgctgatcaatcgcttcaccatgaagcataaaaaggctacatacgaacccgacgtggatctcggaagcggcacccggaacattgggatcgagaacgaaattcctaatctggacatcattggaaaaagaatcgagaagatcaagcaagaacacgagatttcttggcattatgaccaggatcacccctacaaaacatgggcctatcacggctcctacgagaccaagcagacaggcagcgcttcttccatggttaacggggtggtccgcctgctcaccaaaccgtgggacgtggttcctatggtgacgcagatggccatgacagataccaccccctttggacaacagcgggtcttcaaggaaaaagtggacacaagaacgcaggagcctaaggaaggcaccaagaaacttatgaagatcacagctgagtggctgtggaaagagctggggaagaaaaagacaccccgcatgtgtacaagagaagagtttacccggaaagtgcgcagcaatgccgcgctcggagccattttcacagatgaaaacaagtggaagtctgctagagaggccgtcgaagacggccggttttgggagctggttgatagagagcggaatcttcatctggaagggaaatgcgagacctgtgtgtataacatgatgggaaagcgcgagaagaagctcggcgagttcggcaaagctaaggggtccagagccatctggtacatgtggctgggagcccggtttctggagttcgaggcgctcggctttctgaatgaggaccactggttcagccgcgggaactcccttagcggagtggaaggcgaggggctgcatagactcggctatattctgcgggatgtcggaaagaaagaaggcggggctatgtacgccgacgatacggccggatgggacacccgcatcacacttgaggacctgaagaatgaagagatggtgaccaaccacatgaaaggcgagcataagaaactcgctgaagccatctttaagctgacataccagaataaggttgtgagagtccaacggcctacaccccgcgggacggtgatggatattatctctagacgggaccagcgcggaagcggccaggttgggacatatggcctgaacaccttcacaaatatggaggctcaactcattagacagatggaaggagagggcatcttcaaatccattcagcacctgaccgccacggaggaaatcgcggtgcagaactggcttgcccgggtcgggcgcgagagactgtctcggatggctatcagcggagatgactgcgtggttaagccgattgatgacagatttgcctccgctctcaccgccctgaatgatatgggcaaagtgcgcaaggacatccaacagtgggaaccttctcgggggtggaacgattggacacaggtccccttctgcagccaccattttcacgagcttgtgatgaaagacggaagagtcctggtggttccctgtcgcaaccaggatgaactcattggccgggcgagaatctcccaaggggccggctggtctctgaaggagaccgcttgcctgggaaagagctacgcccagatgtggacactcatgtatttccatcgccgggacctgagacttgctgccaatgctatttgttccgccgtgcctagccactgggtcccgacctctcgcacaacctggtccatccacgcgaaacatgagtggatgacgacagaagatatgctggccgtgtggaaccgggtgtggattcaggagaatccctggatggaagacaagacccctgttgagagctgggaagaggtgccctacctcggcaaaagagaggaccagtggtgcgggtctctgatcggacttacctcccgcgctacatgggccaagaacatccaaaccgccattaatcaggtccggagcctgatcggcaacgaagagtatacagattacatgccttccatgaaaagatttcggagagaagaggaagaggctggggtgctctggtga

SEQ ID NO: 19772 - RNA, 9876 nt, synthetic construct
  misc_feature 1..9876: note = derived and/or modified CDS sequence (opt5) from DENV-2__FJ850050__SS-prME
  source 1..9876: mol_type = other RNA
acagccggcgtgatcgtcatgctgattcccacagctatggccttccacctcacgacacggaatggggagcctcatatgatcgttggacggcaggaaaagggcaaaagcctgctttttaagacagaggacggggtgaatatgtgcaccctgatggcgattgatctcggagaactgtgtgaggacacaatcacctacaaatgcccccttctgcgccaaaacgaacccgaggatattgactgttggtgcaattccacatctacctgggtgacgtatggcacctgtacaaccacaggggagcacagacgggaaaagcgcagcgtcgctctcgtgcctcatgttggaatgggcctggagaccagaacggaaacatggatgtcctctgagggcgcctggaaacacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaggaacaagacaaacgctttatctgcaagcattccatggtggatagaggctggggcaacgggtgtggactgttcggcaaagggggaattgtcacatgcgccatgtttacgtgcaaaaagaatatggaaggcaaagttgtgcagcctgagaacctcgaatacaccatcgtgattacaccccacagcggggaggagcatgcggtcggaaatgacaccggcaagcacggcaaagaaatcaagatcacacctcagtcttccattaccgaggccgaactgacggggtatggaaccgtgacaatggagtgtagcccccggaccggccttgatttcaacgaaatggttctgctccaaatggaggacaaggcttggctggtgcaccgccagtggtttcttgatctgccgctcccttggctgcccggggccgacacacagggatctaattggatccagaaggagaccctggtcacgttcaagaaccctcatgctaaaaagcaagacgtggttgtgctcggctcccaggaaggggccatgcacacagccctgaccggcggaacagagattcagatgagctccggcaatcttctgtttaccgggcatctcaaatgcagactgcggatggataaacttcaactgaaaggaatgtcttacagcatgtgtaccggcaagttcaagatcgtcaaagaaattgctgagacacagcacgggacgatcgtgatcagagtccagtatgagggagacggctccccctgcaagattcccttcgaaatcaccgatctcgagaaacgccatgtgctggggcggctgattacagttaaccctatcgtgaccgaaaaggacagcccggtcaacattgaggcggaacccccttttggcgattcttacatcattatcggagtggagcccggccagctcaaactgaattggttcaagaaggggtccagcatcggacaaatgtttgagacaaccatgagaggcgccaaacgcatggctattcttggggacacggcctgggatttcggatctctgggcggggtttttacaagcatcggcaaggccctccaccaggtgttcggagctatttacggcgccgcgttttccggggtctcttggaccatgaaaatcctgattggagtgatcatcacctggattggcatgaacagccggtccacaagcctgtctgtgtcccttgttctcgtcggggtggtgaccctgtatctgggagctgtcgtgcaggccgacagcggctgtgttgtgtcttggaagaataaagaactcaagtgcgggtccggcatcttcattacagataacgtccacacgtggaccgagcagtacaagtttcaacctgaaagcccctccaaactggcctctgctatccagaaggcccatgaggaaggaatttgtggcatcagaagcgtgacacgccttgagaatctgatgtggaaacagatcaccccggagctcaaccacattctgtccgaaaatgaggttaagctgacaatcatgaccggggacattaaaggaatcatgcaggctggcaagcggtctcttagacctcaacccacggaactcaaatatagctggaagacctgggggaaggccaaaatgctgtccacagagagccataaccagaccttcctgattgatggacctgaaacagcggagtgccccaataccaaccgcgcctggaactctctcgaggtggaagactacggctttggcgtcttcacaaccaacatctggctgaaacttcgggagaaacaggacgtgttttgtgattccaagctgatgagcgctgccatcaaatataatagagctgttcacgccgacatggggtactggattgaatctgcgccttgcgattcctgggagatgcagaaggccagcttcatcgaggtgatttcttgtcactggcccaagagcctcacgctgtggtccaacggagtcctggaaagcgagatgatcattccgaaaaatttcgctggccctgtgtctcaacataactatcgccccgggtaccacacacagaccgccggaccctggcatcttggcaagctcgaaatggactttgatttctgcgaggggaccacagtggtcgttaccgaagactgcggaaaccggggcccttccctgagaacgacaaccgctagcggcaaactgatcacagagtggtgttgccggtcctgtaccctcccgcccctgcgctacagaggggaggatggatgctggtatggcatggaaattcggcctcttaaggagaaagaagagaatctggtgaactctctcgtgacagccgggcacggacagatcgacaattttagcctgggcgtcctggggatggcccttttcctcgaagagatgctgagaacccgcatcggaacgaagcatgctattctgctcgtggcggtttcctttgtgaccctgatcacaggcaacatgtctttccgggatcttggcagagtcatggtgatggttggggccaccatgacagacgatattggaatgggcgtgacctacctggctctcctggccgcctttaaggtccgccccacgttcgctgccgggctgcttctgagaaaactcacaagcaaggagctgatgatggcgaccatcggaattgctctcctgtcccaatctacaatccctgaaaccatccttgagctgaccgacgccctcgccctgggcatgatggtgctgaaaattgttcggaatatggaaaagtatcagcttgctgtgacaatcatggccattagctgtgtccccaacgcggtgatcctgcagaatgcttggaaagtgtcctgcacgattctcgccgccgtcagcgtttctcctctgctcctgacctccagccagcaaaaggctgattggatcccccttgccctgacaatcaaggggctcaacccgaccgctatttttctgacaaccctgtctcgcacgtccaaaaagagaagctggcctcttaatgaggccatcatggcggtgggaatggtgtctattctggcctccagcctcctgaaaaacgacatccccatgacaggccctctcgtcgctggcgggctgcttaccgtgtgttacgttctgaccggacggtccgccgacctggaactcgagcgcgctgccgatgtgaagtgggaggaccaggccgaaattagcggctctagccccatcctgtccattacaatctctgaggatgggagcatgtccatcaaaaatgaagaggaggaacagacccttacaattctgatcagaacgggactcctggtcatttctggcgtgttcccggttagcatccctattaccgctgcggcctggtatctctgggaggtgaagaaacagcgggctggggtcctgtgggacgtgccctcccctccgcccgtcgaaaaggccgagcttgaagatggagcctaccgcatcaagcaaagaggcatcctgggctattctcagattggggctggagtgtacaaagagggcacatttcacaccatgtggcacgttacaagaggggccgtgctgatgcatcgcggaaagagaatcgagcctagctgggcggacgtcaaaaaggatctcatttcctacggcgggggatggaaactggaaggcgagtggaaggaaggcgaggaagtgcaggttcttgctctggagccggggaagaacccccgggccgtgcagaccaaacctggaatcttcaagacgaataccggcacaattggggccgtcagcctcgacttttctcccggaacctccggcagccctatcgtggatagaaaagggaaggtggttggactgtatggcaacggcgtcgtgacacgctctggggcttacgtgtccgccatcgcgcaaaccgagaaaagcattgaagacaatcccgagatcgaagatgacattttccggaagaagagactcacaatcatggatctgcaccctggagctggcaaaacgaagcgctatcttccggccattgtccgggaggccatcaaaagagggctgcgcaccctgattctcgctcccacacgggtggttgccgctgaaatggaggaggccctgagaggacttcctatccgctaccagacccccgcgatcaagaccgaacatacaggccgggagattgtggacctgatgtgccacgccacgttcaccatgagactcctgtcccctgtccgggtgcccaactataacctcatcattatggacgaagctcattttacagatccggcctctatcgctgcccgcgggtacattagcaccagagttgagatgggcgaggccgctggaatcttcatgacagcgacccctcccggctcccgggacccctttcctcagagcaatgcccccatcatggatgaagaaagagaaattcctgagagatcttggaactccgggcacgaatgggtgacggacttcaaaggaaagacagtctggtttgtgccgagcatcaaggctggcaatgatattgccgcctgtctgcggaaaaacgggaagaaagttatccaactttctagaaagaccttcgacagcgagtatgtgaaaacccgcgctaatgattgggactttgtcgtgacaaccgatatttccgagatgggagccaacttcaaggcggaacgggtgatcgaccccagacgctgcatgaagcctgtcatcctgacagatggcgaggaacgggttattctggctgggcccatgcctgtgacccactctagcgccgcccagagacgcggccggatcggaagaaatcccaaaaacgagaatgaccagtacatttacatgggcgaaccgctcgagaacgacgaggattgtgctcattggaaggaagccaaaatgctgcttgacaatatcaacacgcctgaggggattatcccctccatgtttgaacctgagcgcgaaaaggtggatgcgattgacggagagtatagactgcggggcgaggcccgcaaaacattcgtcgatctcatgagaagaggggacctgcccgtgtggctggcttacaaggttgccgctgaaggaatcaattatgccgatcgcaaatggtgctttgacggcatcaagaacaatcagattctcgaggaaaacatgcaagagcagatctggaccaaggagggggaacgcaagaaacttaaacctcggtggctggatgctagaatttactctgaccccctggccctcaaggagttcaaagagttcgcggccggccgcaagagcctgacacttaacctgatcaccgagatgggacggctcccgacgtttatgacccagaaggctagaaatgccctggataacctggctgtgctccacacagccgaagccggcgggcgcgcttataatcatgcgctttccgagctgcctgagaccctggaaacactcctgcttctgaccctcctggccacagtcaccggaggcattttcctgtttctcatgagcgggaaaggaatcggcaagatgacgcttggcatgtgctgtatcattacagcttctatcctgctgtggtacgcccagattcaaccccactggatcgccgcttccattatcctcgagttctttctgatcgtgcttctgattcccgaacctgagaaacagcggaccccgcaggacaaccagctcacctatgttgtgatcgccattctgacagtcgtggcggccaccatggctaatgaaatggggttcctggagaagaccaagaaggatctcggacttggcagcatcacgacccaagagtccgaatctaacattctggacatcgacctgagacccgccagcgcttggacactctacgccgtcgcgaccacatttgtgacccctatgctgcggcactccattgaaaattctagcgttaacgtgtcccttacggccatcgctaatcaggccaccgtgctgatggggctcggaaagggctggcccctgagcaaaatggatatcggggtccctctgctcgctattggatgctactctcaggttaaccccatcacacttaccgccgctctgctgctcctggtggcccattatgcgattatcggccctggccttcaggccaaggctacacgcgaagcccagaagcgggctgccgccgggattatgaagaatccgaccgtggacggaatcacggtcatcgatctggagcccattccttacgaccccaaattcgaaaagcagctcggccaggtgatgctgctgatcctctgtgttacacaagtgcttatgatgcggaccacatgggcgctgtgcgaggctctgaccctcgccaccgggcctatttccacactgtgggagggaaaccccggccgcttttggaatacgaccatcgctgtcagcatggccaacattttcagagggtcttatcttgccggagctggcctgctcttttccatcatgaagaatacaaccagcacacggcgcggcaccgggaacatcggagaaacgctgggcgagaaatggaagtctagactgaatgccctcgggaaaagcgagttccagatttacaagaaatccggaatccaggaggtggatcggacacttgcgaaggagggcattaaacgcggggaaaccgaccaccatgccgtctctagaggaagcgctaagctgcggtggtttgtggagagaaacatggttaccccggaaggcaaggtggtcgatctgggctgtgggcgcggaggctggtcctattactgcgggggactcaaaaacgtgcgggaggttaagggcctgacaaaagggggacctggccacgaagaacccatccccatgagcacctatggctggaatcttgtgagactgcagtccggggtcgacgtgttcttcacacctcccgagaagtgtgatacgctcctgtgcgacattggagaatctagccctaacccgaccatcgaggccggccgcacactgcgggtgctcaatcttgttgaaaactggctgaataacaatacccaattttgtatcaaagtcctgaacccctacatgccttccgtgattgagaagatggaagctctccagagacagtacgggggagccctggtgcgcaatcccctttctcggaacagcacacatgagatgtattgggtctccaatgcgaccggcaacatcgtttctagcgtgaatatgatttccagaatgctgatcaaccgcttcacgatgaagcacaaaaaggccacctacgagcctgatgtggacctcgggagcggaacacggaatattggcatcgaatctgagattcccaacctggatatcatcggcaaaagaattgaaaagatcaaacaggagcacgaaatttcctggcattatgaccaagaccacccgtacaagacctgggcttatcatgggagctacgagacaaagcagaccggatctgcctccagcatggtcaacggcgtggttcgcctgctcacaaaaccttgggatgtggtccccatggtgacccagatggctatgacggacacaaccccttttgggcagcaacgggttttcaaggagaaagtggataccagaacacaggaacccaaggagggaacgaagaaacttatgaaaatcaccgccgaatggctgtggaaagagctgggcaagaaaaagacacctcgcatgtgcaccagagaggaatttaccaagaaggtccggtctaatgctgccctcggggcgattttcaccgacgagaacaaatggaagtccgcccgcgaagctgtggaggatggaagattttgggaactggtggaccgggagagaaatcttcacctggagggcaagtgtgaaacatgcgtctataacatgatgggcaaacgggagaagaaactcggggagttcggaaaggccaaaggcagccgcgctatctggtacatgtggctgggggccagatttctggagttcgaagccctcggatttctgaatgaggatcactggttctcccggggcaacagcctttctggggttgagggcgaaggactgcatcgcctcggctacatcctgagagacgtggggaagaaggagggaggcgcgatgtatgctgatgacaccgccgggtgggatacgcggattacccttgaagacctgaaaaatgaggaaatggtgacaaaccacatgaagggagagcataaaaagctcgccgaggctatctttaaactgacctaccagaataaggtcgtgcgcgttcaaagacccacaccgcggggcaccgtgatggacattatcagccgcagagatcagcgggggtccggccaggtcggaacgtatggcctgaacacattcaccaatatggaagcccagctcattcgccaaatggagggggaaggaatcttcaagtctatccagcacctgacagctaccgaggagattgccgtgcagaactggcttgcgagagttggccgggaacgcctgagcagaatggccatctccggggacgattgcgtggtcaaacctattgacgatcggtttgcttctgccctcacggctctgaatgacatgggaaaggtgagaaaagatatccagcaatgggagcccagccgcggctggaacgactggacccaggttcccttctgttcccatcactttcacgaacttgtgatgaaggatgggcgggtcctggtggtcccttgcagaaatcaggacgagctcattggccgcgcccggatctctcagggagcgggctggagcctgaaagaaacagcctgtctggggaagtcctacgctcaaatgtggaccctcatgtatttccatagacgcgatctgcggcttgccgctaacgccatttgcagcgctgtgccgtctcactgggttcccacatccagaaccacatggagcatccatgccaagcacgagtggatgaccacggaggacatgctggcggtgtggaaccgcgtctggatccaggaaaatccttggatggaggataaaacacccgtggaatcttgggaggaagtgccttacctcggaaagcgggaggaccagtggtgtggctccctgattgggcttaccagcagagccacctgggctaaaaacatccagacagccattaatcaagttcgctccctgatcggaaacgaggaatataccgactacatgccctctatgaagcggtttagacgggaggaagaggaagccggcgtgctctggtga

SEQ ID NO: 19773 - RNA, 9876 nt, synthetic construct
  misc_feature 1..9876: note = derived and/or modified CDS sequence (opt5) from DENV-2__FJ639837__SS-prME
  source 1..9876: mol_type = other RNA
accgccggcgtgatcgtcatgctgattcccaccgctatggccttccacctcacgaccagaaatggggaacctcatatgatcgttggacggcaggaaaagggcaagagcctgctttttaagaccgaggacggggtgaatatgtgcaccctgatggcgattgatctcggagaactgtgtgaggacacgatcacctacaagtgcccgcttctgcgccaaaatgaacccgaggatattgactgttggtgcaattccacatctacctgggtgacgtatggcacctgtacaaccacaggggagcacagacgggaaaagcgcagcgtcgctctcgtgcctcatgttggaatgggcctggagaccagaacggaaacatggatgtcctctgagggcgcctggaaacacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaagaacaggacaaacgctttatctgcaagcattccatggtggatagaggctggggcaacgggtgtggactgttcggcaaaggagggattgtcacatgcgccatgtttacgtgcaaaaagaatatggaaggcaaagttgtgcagcctgagaacctcgaatacaccatcgtgattacaccccacagcggggaggagcatgcggtcggaaatgacaccggcaagcacggcaaagaaatcaagatcacacctcagtcttccattaccgaggccgaactgacggggtatggaaccgtgacaatggagtgtagcccccggaccggccttgatttcaacgaaatggttctgctccaaatggaggacaaggcttggctggtgcaccgccagtggtttcttgatctgccgctcccttggctgcccggggccgacacacagggatctaattggatccagaaggagaccctggtcacgttcaagaaccctcatgctaaaaagcaagacgtggttgtgctcggctcccaggaaggggccatgcacacagccctgaccggcgctacagagattcagatgagctccggaaatcttctgtttaccggccatctcaaatgcagactgcggatggataaacttcaactgaaagggatgtcttacagcatgtgtaccggaaagttcaagatcgtcaaagaaattgcggagacacagcacggcacgatcgtgatcagagtccagtatgagggggacggatccccctgcaagattcccttcgaaatcaccgatctcgagaaacgccatgtgctgggccggctgattacagttaaccctatcgtgaccgaaaaggacagcccggtcaacattgaggccgaacccccttttggggattcttacatcattatcggcgtggagcccggacagctcaaactgaattggttcaagaagggctccagcatcgggcaaatgtttgagacaaccatgagaggagctaaacgcatggccattcttggcgacacggcctgggatttcgggtctctgggaggcgtttttacaagcatcgggaaggctctccaccaggtgttcggcgccatttacggagcggctttttccggcgtctcttggaccatgaaaatcctgattggggtgatcatcacctggattggaatgaacagccggtccacaagcctgtctgtgtcccttgttctcgtcggcgtggtgaccctgtatctgggggccgtcgtgcaggccgacagcggatgtgttgtgtcttggaagaataaagaactcaagtgcggctccgggatcttcattacagataacgtccacacgtggaccgagcagtacaagtttcaacctgaaagcccctccaaactggcttctgccatccagaaggctcatgaggaaggcatttgtggaatcagaagcgtgacacgccttgagaatctgatgtggaaacagatcaccccggagctcaaccacattctgtccgaaaatgaggttaagctgacaatcatgaccggcgacattaaagggatcatgcaggccggaaagcggtctcttagacctcaacccacggaactcaaatatagctggaagacctggggcaaggcgaaaatgctgtccacagagagccataaccagaccttcctgattgatgggcctgaaacagccgagtgccccaataccaaccgcgcttggaactctctcgaggtggaagactacggatttggcgtcttcacaaccaacatctggctgaaacttcgggagaaacaggacgtgttttgtgattccaagctgatgagcgccgctatcaaagacaatagagccgttcacgcggatatgggctattggattgaatctgccctcaacgacacgtggaagatggagaaggcttccttcatcgaggtgaaaagctgccactggcctaagtctcatacactgtggagcaatggggtcctggaatccgagatggtgattcccaaaaacttcgccggaccggtgagccagcacaactaccgccctggctatcatacccaaaccgctgggccctggcaccttggaaagctcgaaatggattttgacttctgtgagggcacaaccgtcgttgtgacggaagattgcgggaatcggggaccctctctgagaacaaccacagcctccggcaaactgatcaccgagtggtgctgtcggagctgcacactccctccgctgcgctacagaggcgaggacgggtgttggtacggaatggaaattcggccccttaaggagaaggaagagaacctggtgaatagcctcgtcaccgccggccatgggcagatcgataacttttctctgggagtgctgggcatggctcttttcctcgaagagatgctgagaacgcgcattgggaccaaacacgcgatcctgctcgttgccgtgagctttgtcacactgatcaccggaaatatgtccttccgggaccttggcagagtgatggttatggtgggcgctacaatgaccgatgacattgggatgggagtcacgtatctggccctcctggccgcttttaaggtgcgccctacattcgccgcgggcctgcttctgagaaaactcacctctaaggagctgatgatggctacaatcgggattgccctcctgagccagtccaccatccccgaaaccattcttgagctgacagatgccctcgctctgggaatgatggttctgaaaatcgtgcggaacatggaaaagtaccaacttgccgtcacgatcatggcgatttcttgcgtgcctaatgctgtgatcctgcagaacgcctggaaggtcagctgtaccattctcgccgctgtttccgtgagccccctgctcctgacatcttcccagcagaaagccgactggatccctcttgctctgaccattaagggcctcaatcccacagccatctttctgaccacgctgagccgcacatctaaaaagagatcctggccgcttaacgaggcgatcatggccgtggggatggtcagcattctggcttcttccctcctgaaaaatgacatccctatgaccggacccctcgtggccggcggcctgcttaccgtttgctatgtgctgacagggcggagcgctgatctggaactcgagcgcgccgccgacgtcaagtgggaggatcaagctgaaatttccggaagctctcctatcctgagcattaccatctccgaggacggctctatgagcattaaaaacgaagaggaggaacagacacttacgatcctgatcagaaccgggctcctggtgatttccggagttttccccgtgtctatcccgattacagcggccgcttggtacctctgggaggtcaagaagcagcgggccggcgtgctgtgggatgtcccttctccccctcccgtggaaaaagccgagcttgaagacggggcttatcgcatcaagcagagagggattctgggctactcccaaatcggcgccggggtttataaagagggaacctttcacacaatgtggcatgtgacccggggcgcggtcctgatgcaccgcgggaagagaatcgagccctcctgggctgatgtgaaaaaggacctcattagctacggaggcgggtggaagctggaaggagagtggaaagaaggcgaggaagttcaggtgcttgccctggagcctggcaagaatccgcgggccgtccagacgaaacccgggatcttcaagaccaacacaggaaccattggcgctgtgtccctcgattttagccctgggacatctggatcccccatcgtggacagaaaaggcaaggttgtcgggctgtacggaaatggcgtggtgacccgcagcggcgcctatgtctctgcgattgctcagacagagaagtccatcgaagataaccctgagatcgaagacgatattttccggaaaaagagactcacgatcatggacctgcatcccggggccggaaaaaccaagcgctaccttcctgccattgtgcgggaggctatcaaaagaggcctgcgcacactgattctcgccccgacccgggttgtggctgccgaaatggaggaggcgctgagagggcttcccatccgctatcaaacccctgccattaagacagaacacacgggacgggagatcgtcgacctgatgtgtcatgctaccttcacaatgagactcctgagccccgtgcgggttcctaactacaatctcatcattatggatgaagcccactttaccgaccccgcttccatcgccgcccgcggctatatttctacaagagtggagatgggggaggctgcgggcatcttcatgaccgccacgccgcctggaagccgggatccctttccccagtccaacgctcctattatggacgaagaaagagaaatccccgagagaagctggaactctggccacgaatgggtcacagatttcaaggggaaaaccgtgtggtttgttccttccatcaaggccggaaacgacattgccgcttgcctgcggaaaaatggcaagaaagtgatccagcttagcagaaagaccttcgattctgagtacgtcaagacacgcgccaacgactgggattttgtggtgaccacagacattagcgagatgggggcgaatttcaaagctgaacgggtcatcgatccgagacgctgtatgaagcccgttattctgaccgacggagaggaacgggtgatcctggccggccctatgcccgtgacgcattcctctgccgctcaaagacgcgggcggatcggcagaaaccctaaaaatgagaacgaccagtatatttacatgggagaacccctcgagaatgatgaggactgcgcccactggaaggaagcgaaaatgctgcttgataacatcaatacaccggagggcattatccctagcatgtttgaacccgagcgcgaaaaggtcgacgccattgatggggagtacagactgcggggagaggctcgcaaaaccttcgtggacctcatgagacggggcgatctgcctgtttggctggcctataaggtggctgccgaagggatcaactacgctgaccgcaagtggtgttttgatggaattaaaaataaccagatcctcgaggaaaacatggaggtcgagatctggacaaaggaaggcgagcgcaagaaacttaaaccccggtggctggacgccagaatttattccgatcctctggcgctcaaggagttcaaggagttcgccgctgggcgcaaatctctgacccttaatctgatcacggaaatgggccggctccccacctttatgacacagaaggccagaaacgctctggacaatctggccgtgctccataccgccgaggctggaggccgcgcgtacaaccacgcccttagcgagctgccggaaacactggagaccctcctgcttctgacactcctggctaccgttacagggggaattttcctgtttctcatgtccggcaaaagcatcgggaagatgacacttggaatgtgctgcattatcaccgcctctatcctgctgtggcacgcccaaattcagcctcattggatcgctgcctccattatcctcgagttctttctgattgtgcttctgatccccgagcccgaaaaacagcggacccctcaggataatcaactcacatatgtcgtgatcgcgattctgaccgtcgtggccgctacaatggccaacgagatgggcttcctggagaagacgaagaaagacctcggccttgggagcatcaccacacaggaatccgagtctaatattctggacatcgatctgagaccggctagcgcctggaccctctacgcggttgccacaacctttgtgacgcccatgctgcggcactccattgaaaactctagcgtgaatgtctcccttaccgctatcgccaaccaggctacagttctgatgggactcggcaaggggtggcctctgagcaaaatggacattggagtgcccctgctcgccatcggctgttattctcaggtgaatcctatcacccttacagctgccctgctgctcctggtcgcgcattacgccattatcgggcccggacttcaagctaaggccacccgcgaggctcagaaaagagccgccgcgggcattatgaagaaccctacggtggatggcatcacagttattgacctggctccgatcccctacgatcctaagttcgaaaaacagctcggacaggtgatgctgctgatcctctgcgtcacccaagtgcttatgatgcggacaacctgggccctgtgtgaggctctgaccctcgccacaggacccatttccacgctgtgggagggcaatcctgggcgcttttggaacaccacaatcgccgtcagcatggctaatattttcagaggatcttatcttgccggcgcggggctgctcttttccatcatgaagaacaccacaagcacccggcgcggaacgggcaatattggcgaaacactgggggagaaatggaagtctagactgaacgccctcggaaaaagcgagttccagatctacaagaaatccggcatccaggaggtggaccggacccttgctaaggaggggattaagcgcggagaaaccgatcaccatgccgtttctagaggcagcgctaaactgcggtggtttgtggagagaaacatggtcacacccgaagggaaggtggttgacctgggatgcggccgcggcgggtggtcctattactgtggaggcctcaaaaatgtgcgggaggtcaaggggctgaccaaaggaggcccggggcacgaagaacctatccccatgagcacatatggatggaaccttgtgagactgcaatccggcgtggatgttttcttcacgccccctgagaagtgcgacaccctcctgtgtgatattggcgaatctagccccaatcctacaatcgaggccgggcgcaccctgcgggtcctcaaccttgtggaaaattggctgaacaataacacacagttttgcattaaggtgctgaatccgtacatgccctccgtcatcgagaaaatggaagcgctccagagacagtatggaggcgccctggttcgcaaccctctttctcggaatagcacccacgagatgtactgggtgtccaacgctacggggaatatcgtgtctagcgtcaacatgatttccagaatgctgatcaatcgcttcaccatgaagcataaaaaggccacatacgagcccgacgtggatctcggaagcggcacccggaacattgggatcgaaaacgagattcctaatctggacatcattggaaaaagaatcgaaaagatcaagcaagagcacgaaatttcttggcattatgaccaggatcacccctacaaaacatgggcttatcacggctcctacgagaccaagcagacaggcagcgcctcttccatggttaacggggtggtccgcctgctcaccaaaccgtgggacgtggttcctatggtgacgcagatggctatgacagataccaccccctttggacaacagcgggtcttcaaggagaaagtggacacaagaacgcaggaacctaaggagggcaccaagaaacttatgaagatcacagccgaatggctgtggaaagagctggggaagaaaaagacaccccgcatgtgtacaagagaggaatttacccggaaagtgcgcagcaatgcggccctcggagctattttcacagatgagaacaagtggaagtctgccagagaagctgtcgaggacggccggttttgggaactggttgatagagagcggaatcttcatctggaggggaaatgcgaaacctgtgtgtataacatgatgggaaagcgcgagaaaaagctcggcgagttcggcaaagccaaggggtccagagccatctggtacatgtggctgggagcgcggtttctggagttcgaagctctcggctttctgaatgaggaccactggttcagccgcgggaactcccttagcggagtggagggcgaagggctgcatagactcggctatattctgcgggatgtcgccaagaaagagggaggcgccatgtacgctgacgatacggccgggtgggacacccgcatcacacttgaagacctgaagaatgaggaaatggtgaccaaccacatgaaaggagagcataagaaactcgctgaggccatctttaagctgacataccagaataaggttgtgagagtccaacggcctacaccccgcggcacggtgatggatattatctctagacgggaccagcgcgggagcggacaggttggcacatatgggctgaacaccttcacaaatatggaagcgcaactcattagacagatggagggcgaaggaatcttcaaatccattcagcacctgaccgccacggaggagatcgctgtgcagaactggcttgcccgggtcggccgcgaaagactgtctcggatggctatcagcggggatgactgcgtggttaagccgattgatgacagatttgcctccgcgctcaccgccctgaatgatatgggaaaagtgcgcaaggacatccaacagtgggagccttctcggggctggaacgattggacacaggtccccttctgcagccaccattttcacgaacttgtgatgaaagacgggagagtcctggtggttccctgtcgcaaccaggatgagctcattggacgggctagaatctcccaaggcgccgggtggtctctgaaggaaaccgcttgcctgggcaagagctacgcccagatgtggacactcatgtatttccatcgccgggacctgagacttgctgccaatgcgatttgttccgccgtgcctagccactgggtcccgacctctcgcacaacctggtccatccacgctaaacatgagtggatgacgacagaggatatgctggccgtgtggaaccgggtgtggattcaggaaaatccctggatggaggacaagacccctgttgaaagctgggaggaagtgccctacctcggaaaaagagaggaccagtggtgcggctctctgatcgggcttacctcccgcgccacatgggctaagaacatccaaaccgccattaatcaggtccggagcctgatcggaaacgaggaatatacagattacatgccttccatgaaaagatttcggagagaggaagaggaagcgggcgtgctctggtga

SEQ ID NO: 19774 - RNA, 9876 nt, synthetic construct
  misc_feature 1..9876: note = derived and/or modified CDS sequence (opt5) from DENV-2__FJ744706__SS-prME
  source 1..9876: mol_type = other RNA
accgccggagtgatcgtcatgctgattcccaccgctatggccttccacctcacgacccggaatggggagcctcatatgatcgttggacggcaggaaaagggaaagagcctgctttttaagacagaggacggggtgaatatgtgcaccctgatggcgattgatctcggagaactgtgtgaggacacaatcacctacaagtgcccgcttctgcgccaaaatgaacccgaggatattgactgttggtgcaattccacatctacctgggtgacgtatggcacctgtacaaccacaggggagcaccggcgggaaaagcgcagcgtcgctctcgtgcctcatgttggaatgggcctggagacccggacggaaacatggatgtcctctgagggcgcctggaaacacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaagaacaggacaaacgctttatctgcaagcattccatggtggatagaggctggggcaacgggtgtggactgttcggcaaagggggaattgtcacatgcgccatgtttacgtgcaaaaagaatatggaaggcaaagttgtgcagcctgagaacctcgaatacaccatcgtgattacaccccacagcggggaggagcatgcggtcggaaatgacaccggcaagcacggcaaagaaatcaagatcacacctcagtcttccattaccgaggccgaactgacggggtatggaaccgtgacaatggagtgtagcccccggaccggccttgatttcaacgaaatggttctgctccaaatggaggacaaggcttggctggtgcaccgccagtggtttcttgatctgccgctcccttggctgcccggggccgacacacagggatctaattggatccagaaggagaccctggtcacgttcaagaaccctcatgctaaaaagcaagacgtggttgtgctcggctcccaggaaggggccatgcacacagccctgaccggcgctacagagattcagatgagctccggaaatcttctgtttaccggccatctcaaatgcagactgcggatggataaacttcaactgaaagggatgtcttacagcatgtgtaccggaaagttcaagatcgtcaaagaaattgcggagacacagcacggcacgatcgtgatcagagtccagtatgagggggacggatccccctgcaagattcccttcgaaatcaccgatctcgagaaacgccatgtgctgggccggctgattacagttaaccctatcgtgaccgaaaaggacagcccggtcaacattgaggccgaacccccttttggggattcttacatcattatcggcgtggagcccggacagctcaaactgaattggttcaagaagggctccagcatcgggcaaatgtttgagacaaccatgagaggagctaaacgcatggccattcttggcgacacggcctgggatttcgggtctctgggaggcgtttttacaagcatcgggaaggctctccaccaggtgttcggcgccatttacggagcggctttttccggcgtctcttggaccatgaaaatcctgattggggtgatcatcacctggattggaatgaacagccggtccacaagcctgtctgtgtcccttgttctcgtcggcgtggtgaccctgtatctgggggccgtcgtgcaggccgacagcggatgtgttgtgtcttggaagaataaagaactcaagtgcggctccgggatcttcattacagataacgtccacacgtggaccgagcagtacaagtttcaacctgaaagcccctccaaactggcttctgccatccagaaggctcatgaggaaggcatttgtggaatcagaagcgtgacacgccttgagaatctgatgtggaaacagatcaccccggagctcaaccacattctgtccgaaaatgaggttaagctgacaatcatgaccggcgacattaaagggatcatgcaggccggaaagcggtctcttagacctcaacccacggaactcaaatatagctggaagacctggggcaaggcgaaaatgctgtccacagggagccataaccagaccttcctgattgatggacctgagacagccgaatgccccaataccaaccgcgcttggaactctctcgaggtggaggactacggctttggcgtcttcacaaccaacatctggctgaaacttcgggaaaaacaggacgtgttttgtgattccaagctgatgagcgccgctatcaaagacaatagagccgttcacgcggatatggggtattggattgagtctgccctcaacgacacgtggaagatggaaaaggcttccttcatcgaggtgaaaagctgccactggcctaagtctcatacactgtggagcaatggagtcctggagtccgaaatgattatccccaaaaacttcgccggcccggtgagccagcacaactaccgccctgggtatcatacccaaaccgctggaccctggcaccttggcaagctcgagatggattttgacttctgtgaagggacaaccgtggtcgttacggaggattgcggaaatcggggcccctctctgagaacaaccacagcctccggcaaactgattaccgaatggtgctgtcggagctgcacactccctccgctgcgctacagaggggaggacggatgttggtacggcatggagatccggccccttaaggaaaaggaggaaaacctggtgaatagcctcgtgaccgccgggcatggacagattgataacttttctctgggcgtcctggggatggctcttttcctcgaggaaatgctgagaacgcgcatcggaaccaaacacgcgatcctgctcgtggccgttagctttgtgacactgattaccggcaatatgtccttccgggaccttggcagagtcatggtgatggttggggctacaatgaccgatgacatcggaatgggcgtgacgtatctggccctcctggccgcttttaaggtccgccctacattcgccgcggggctgcttctgagaaaactcacctctaaggagctgatgatggctacaattggaatcgccctcctgagccagtccaccattcccgagaccatccttgaactgacagatgccctcgctctgggcatgatggtgctgaaaatcgttcggaacatggagaagtaccaacttgccgtgacgattatggcgatctcttgcgtccctaatgctgtgattctgcagaacgcctggaaggtgagctgtaccatcctcgccgctgtctccgttagccccctgctcctgacatcttcccagcagaaagccgactggattcctcttgctctgaccatcaaggggctcaatcccacagccatctttctgaccacgctgagccgcacatctaaaaagagatcctggccgcttaacgaagcgattatggccgtgggaatggtgagcatcctggcttcttccctcctgaaaaatgacattcctatgaccggccccctcgtcgccggcgggctgcttaccgtgtgctatgttctgacaggacggagcgctgatctggagctcgaacgcgccgccgacgtgaagtgggaggatcaagctgagatctccggcagctctcctattctgagcatcaccatttccgaagacgggtctatgagcatcaaaaacgaggaagaggagcagacacttacgatcctgattagaaccggactcctggtcatctccggcgtgttccccgtttctattccgatcacagcggccgcttggtacctctgggaagtgaagaagcagcgggccggggtcctgtgggatgtgccttctccccctcccgtcgagaaagccgaacttgaggacggagcttatcgcattaagcagagaggcatcctgggctactcccaaatcggggccggagtgtataaagaaggcacctttcacacaatgtggcatgttaccagaggggcggtgctgatgcaccgcggaaagagaattgagccctcctgggctgatgtcaaaaaggacctcatcagctacggcgggggatggaagctggagggcgaatggaaagagggcgaagaggtgcaggttcttgccctggaacctgggaagaatccgcgggccgtgcagacgaaacccggaattttcaagaccaacacaggcaccatcggggctgtctccctcgattttagccctggaacatctggctcccccattgtggacagaaaagggaaggtggttggactgtacggcaatggcgtcgtgacccgcagcggggcctatgtgtctgcgatcgctcagacagagaagtccatcgaggataaccctgaaattgaggacgatatcttccggaaaaagagactcacgattatggacctgcatcccggagccggcaaaaccaagcgctaccttcctgccatcgtccgggaagctattaaaagagggctgcgcacactgatcctcgccccgacccgggtggttgctgccgagatggaagaggcgctgagaggacttcccattcgctatcaaacccctgccatcaagacagagcacacgggccgggaaatcgtggacctgatgtgtcatgctaccttcacaatgagactcctgagccccgtccgggtgcctaactacaatctcattatcatggatgaggcccactttaccgaccccgcttccattgccgcccgcgggtatatctctacaagagttgaaatgggcgaggctgcgggaattttcatgaccgccacgccgcctggcagccgggatccctttccccagtccaacgctcctatcatggacgaggaacgcgagatccccgaaagaagctggaactctgggcacgagtgggtgacagatttcaagggaaaaaccgtctggtttgtgccttccattaaggccggcaacgacatcgccgcttgcctgcggaaaaatgggaagaaagttattcagcttagcagaaagaccttcgattctgaatacgtgaagacacgcgccaacgactgggattttgtcgtgaccacagacatcagcgagatgggagcgaatttcaaagctgagcgggtgattgatccgagacgctgtatgaagcccgtcatcctgaccgacggcgaagaacgggttatcctggccgggcctatgcccgtgacgcattcctctgccgctcaaagacgcggccggattggaagaaaccctaaaaatgaaaacgaccagtatatctacatgggcgagcccctcgaaaatgatgaggactgcgcccactggaaggaggcgaaaatgctgcttgataacattaatacaccggaagggatcattcctagcatgtttgagcccgaacgcgagaaggtggacgccatcgatggagaatacagactgcggggcgaggctcgcaaaaccttcgtcgacctcatgagaagaggggatctgcctgtgtggctggcctataaggttgctgccgagggaattaactacgctgaccgcaagtggtgttttgatggcatcaaaaataaccagatcctcgaagagaacatggaagtggagatttggacaaaggagggggaacgcaagaaacttaaaccccggtggctggacgccagaatctattccgatcctctggcgctcaaggagttcaaggagttcgccgctggccgcaaatctctgacccttaatctgattacggagatgggacggctccccacctttatgacacagaaggccagaaacgctctggacaatctggccgtcctccataccgccgaagctggcgggcgcgcgtacaaccacgcccttagcgagctgccggagacactggaaaccctcctgcttctgacactcctggctaccgtgacgggaggcatcttcctgtttctcatgtccgggaaaggaattggcaagatgacacttggcatgtgctgcatcatcaccgccagcattctgctgtggtatgcccaaatccagcctcactggattgctgcctctatcattctcgagttctttctgatcgttcttctgatccccgaacccgagaaacagcggacccctcaggataatcaactcacatacgtggtcattgcgatcctgaccgtggtcgccgctacaatggccaacgaaatggggttcctggagaagacgaagaaagacctcggacttggctccattaccacacaggagagcgaatccaatatcctggacattgatctgagaccggcttctgcctggaccctctatgcggtggccacaacctttgttacgcccatgctgcggcatagcatcgagaactcctctgtgaatgtgagccttaccgctattgccaaccaggctacagtcctgatggggctcggaaagggctggcctctgtccaaaatggacatcggggttcccctgctcgccatcggatgttacagccaggtgaatcctattacccttacagctgccctgctgctcctggtggcgcactacgccatcattggccccggccttcaagctaaggccacccgcgaagctcagaaaagagccgccgcggggatcatgaagaaccctacggtcgatggaattacagtgatcgacctggagccgatcccctatgatcctaagttcgaaaaacagctcggccaggttatgctgctgattctctgcgtgacccaagtccttatgatgcggacaacctgggctctgtgtgaggccctgaccctcgctacagggcccatctctacgctgtgggagggaaatcctggccgcttttggaacaccacaattgccgtgtccatggccaatatcttcagagggagctaccttgctggagccggcctgctcttttctattatgaagaacaccacatccacccggcgcggcacggggaatatcggagaaacactgggcgagaaatggaaaagcagactgaacgcgctcgggaaatctgagttccagatctataagaaaagcggcattcaggaggtcgaccggacccttgccaaggagggcatcaagcgcggggaaaccgatcatcacgctgtgtccagaggatctgccaaactgcggtggtttgttgagagaaacatggtgacacccgaaggcaaggtcgtggacctgggctgcgggcgcggaggctggagctactattgtgggggactcaaaaatgttcgggaggtgaagggcctgaccaaagggggaccgggccatgaagaacctattcccatgtccacatacggctggaaccttgtcagactgcaaagcggggtggatgtgttcttcacgccccctgagaagtgcgacaccctcctgtgtgatatcggagaatcctctcccaatcctacaattgaggctggccgcaccctgcgggttctcaaccttgtcgaaaattggctgaacaataacacacagttttgcatcaaggtgctgaatccgtatatgcccagcgtgatcgagaaaatggaagccctccagagacagtacgggggagcgctggtccgcaaccctctttccagaaattctacccacgagatgtactgggttagcaacgccacgggcaatattgtgtcctctgtgaacatgatcagcagaatgctgattaatcgcttcaccatgaagcacaaaaaggctacatatgagcccgacgtcgatctcgggtccggaacccggaacatcggcattgaaagcgagatccctaacctggacattatcggcaaaagaatcgaaaagattaagcaagagcatgaaatctcttggcactacgaccaggatcatccctataaaacatgggcctaccacgggtcctatgagaccaagcagacaggaagcgcttcttccatggtgaatggcgttgtgcgcctgctcaccaaaccgtgggacgtcgtgcctatggttacgcagatggccatgacagataccaccccctttgggcaacagcgggtgttcaaggagaaagtcgacacaagaacgcaggaacctaaggagggaaccaagaaacttatgaagattacagctgaatggctgtggaaagagctgggcaagaaaaagacccccagaatgtgtacaagagaggaatttaccaaaaaggtgcgggggaacgccgcgctcggagccatcttcacagatgagaataagtggaaaagcgctcgcgaagccgtggaggacggcagattttgggaactggtcgatcgggagagaaaccttcacctggagggcaagtgcgaaacctgtgtttacaatatgatggggaaacgggagaagaaactcggagagttcggcaaggctaaggggtctcgcgccatttggtatatgtggctgggagccagatttctggagttcgaagcgctcggctttctgaacgaggaccattggttctcccgggggaatagcctttccggcgtggagggagaaggcctgcaccgcctcgggtacatcctgagagatgtgggcaagaaggagggcggggctatgtacgccgacgatacggccggatgggacacccggatcacacttgaagacctgaaaaacgaggaaatggtcaccaatcatatgaagggcgagcacaaaaagctcgctgaggccatttttaagctgacatatcagaacaaagtggttcgcgtgcaaagacctacaccccgggggacggtcatggatatcattagccgcagagaccagcggggctctggacaggtgggcacatacgggctgaataccttcacaaacatggaagctcaactcatccgccagatggagggagaaggcattttcaagagcatccagcatctgaccgccacggaggagatcgcggttcagaattggcttgccagagtggggcgggaacgcctgtccagaatggctatttctggagatgactgcgtcgtgaaaccgatcgatgaccggtttgccagcgctctcaccgccctgaacgatatgggcaaggttagaaaagacattcaacagtgggagccttcccgcgggtggaatgattggacacaggtgcccttctgctctcaccactttcatgaacttgtcatgaaggacggccgggtgctggtcgtgccctgtagaaaccaggatgagctcatcggacgcgcgcggattagccaaggcgccgggtggtccctgaaggaaaccgcttgcctgggaaaatcttatgcccagatgtggacactcatgtacttccacagacgcgacctgcggcttgctgccaacgctatctgtagcgccgttccttcccattgggtgccgaccagcagaacaacctggtctattcacgcgaagcacgagtggatgacgacagaggatatgctggccgtctggaatcgcgtgtggatccaggaaaacccctggatggaggacaaaacccctgtggaatcctgggaggaagttccctatctcggcaagcgggaggaccagtggtgcgggagcctgatcggacttacctctagagctacatgggccaaaaatattcaaaccgccatcaaccaggtgcgctccctgattggcaatgaggaatacacagattatatgcctagcatgaagcggtttagacgggaggaagaggaagctggggtcctctggtga

SEQ ID NO: 19775 - RNA, 9876 nt, synthetic construct
  misc_feature 1..9876: note = derived and/or modified CDS sequence (opt5) from DENV-2__FJ744707__SS-prME
  source 1..9876: mol_type = other RNA
accgccggcgtgatcgtcatgctgattcccaccgctatggccttccacctcacgacccggaatggggaacctcatatgatcgttggacggcaggaaaagggcaagagcctgctttttaagaccgaagacggggtgaatatgtgcaccctgatggcgattgatctcggagaactgtgtgaggacacgatcacctacaagtgcccgcttctgcgccaaaatgaacccgaggatattgactgttggtgcaattccacatctacctgggtgacgtatggcacctgtacaaccacaggggagcacagacgggaaaagcgcagcgtcgctctcgtgcctcatgttggaatgggcctggagaccagaacggaaacatggatgtcctctgagggcgcctggaaacacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaagaacaggacaaacgctttatctgcaagcattccatggtggatagaggctggggcaacgggtgtggactgttcggcaaaggcgggattgtcacatgcgccatgtttacgtgcaaaaagaatatggaagggaaagttgtgcagcctgagaacctcgaatacaccatcgtgattacaccccacagcggggaggagcatgcggtcggaaatgacaccggcaagcacggcaaagaaatcaagatcacacctcagtcttccattaccgaggccgaactgacggggtatggaaccgtgacaatggagtgtagcccccggaccggccttgatttcaacgaaatggttctgctccaaatggaggacaaggcttggctggtgcaccgccagtggtttcttgatctgccgctcccttggctgcccggggccgacacacagggatctaattggatccagaaggagaccctggtcacgttcaagaaccctcatgctaaaaagcaagacgtggttgtgctcggctcccaggaaggggccatgcacacagccctgaccggcgctacagagattcagatgagctccggaaatcttctgtttaccggccatctcaaatgcagactgcggatggataaacttcaactgaaagggatgtcttacagcatgtgtaccggaaagttcaagatcgtcaaagaaattgcggagacacagcacggcacgatcgtgatcagagtccagtatgagggggacggatccccctgcaagattcccttcgaaatcaccgatctcgagaaacgccatgtgctgggccggctgattacagttaaccctatcgtgaccgaaaaggacagcccggtcaacattgaggccgaacccccttttggggattcttacatcattatcggcgtggagcccggacagctcaaactgaattggttcaagaagggctccagcatcgggcaaatgtttgagacaaccatgagaggagctaaacgcatggccattcttggcgacacggcctgggatttcgggtctctgggaggcgtttttacaagcatcgggaaggctctccaccaggtgttcggcgccatttacggagcggctttttccggcgtctcttggaccatgaaaatcctgattggggtgatcatcacctggattggaatgaacagccggtccacaagcctgtctgtgtcccttgttctcgtcggcgtggtgaccctgtatctgggggccgtcgtgcaggccgacagcggatgtgttgtgtcttggaagaataaagaactcaagtgcggctccgggatcttcattacagataacgtccacacgtggaccgagcagtacaagtttcaacctgaaagcccctccaaactggcttctgccatccagaaggctcatgaggaaggcatttgtggaatcagaagcgtgacacgccttgagaatctgatgtggaaacagatcaccccggagctcaaccacattctgtccgaaaatgaggttaagctgacaatcatgaccggcgacattaaagggatcatgcaggccggaaagcggtctcttagacctcaacccacggaactcaaatatagctggaagacctggggcaaggcgaaaatgctgtccacagagagccataaccagaccttcctgattgatgggcctgaaacagccgagtgccccaataccaaccgcgcttggaactctctcgaggtggaagactacggatttggcgtcttcacaaccaacatctggctgaaacttcgggagaaacaggacgtgttttgtgattccaagctgatgagcgccgctatcaaagacaatagagccgttcacgcggatatgggctattggattgaatctgccctcaacgacacgtggaagatggagaaggcttccttcatcgaggtgaaaagctgccactggcctaagtctcatacactgtggagcaatggggtcctggaatccgagatgattatccccaaaaacttcgccggaccggtgagccagcacaactaccgccctggctatcatacccaaaccgctgggccctggcaccttggaaagctcgaaatggattttgacttctgtgagggcacaaccgtggtcgttacggaagattgcgggaatcggggaccctctctgagaacaaccacagcctccggcaaactgattaccgagtggtgctgtcggagctgcacactccctccgctgcgctacagaggcgaggacgggtgttggtacggaatggaaatccggccccttaaggagaaggaagagaacctggtgaatagcctcgtgaccgccggccatgggcagattgataacttttctctgggagtcctgggcatggctcttttcctcgaagagatgctgagaacgcgcatcgggaccaaacacgcgatcctgctcgtggccgttagctttgtgacactgattaccggaaatatgtccttccgggaccttggcagagtcatggtgatggttggcgctacaatgaccgatgacatcgggatgggagtgacgtatctggccctcctggccgcttttaaggtccgccctacattcgccgcgggcctgcttctgagaaaactcacctctaaggagctgatgatggctacaattgggatcgccctcctgagccagtccaccattcccgaaaccatccttgagctgacagatgccctcgctctgggaatgatggtgctgaaaatcgttcggaacatggaaaagtaccaacttgccgtgacgattatggcgatctcttgcgtccctaatgctgtgattctgcagaacgcctggaaggtgagctgtaccatcctcgccgctgtctccgttagccccctgctcctgacatcttcccagcagaaagccgactggattcctcttgctctgaccatcaagggcctcaatcccacagccatctttctgaccacgctgagccgcacatctaaaaagagatcctggccgcttaacgaggcgattatggccgtggggatggtgagcatcctggcttcttccctcctgaaaaatgacattcctatgaccggacccctcgtcgccggcggcctgcttaccgtgtgctatgttctgacagggcggagcgctgatctggaactcgagcgcgccgccgacgtgaagtgggaggatcaagctgaaatctccggaagctctcctattctgagcatcaccatttccgaggacggctctatgagcatcaaaaacgaagaggaggaacagacacttacgatcctgattagaaccgggctcctggtcatctccggagtgttccccgtttctattccgatcacagcggccgcttggtacctctgggaggtgaagaagcagcgggccggcgtcctgtgggatgtgccttctccccctcccgtcgaaaaagccgagcttgaagacggggcttatcgcattaagcagagaggaatcctgggctactcccaaatcggcgccggggtgtataaagagggaacctttcacacaatgtggcatgttacccggggcgcggtgctgatgcaccgcgggaagagaattgagccctcctgggctgatgtcaaaaaggacctcatcagctacggaggcgggtggaagctggaaggagagtggaaagaaggcgaggaagtgcaggttcttgccctggagcctggcaagaatccgcgggccgtgcagacgaaacccgggattttcaagaccaacacaggaaccatcggcgctgtctccctcgattttagccctgggacatctggatcccccattgtggacagaaaaggcaaggtggttgggctgtacggaaatggcgtcgtgacccgcagcggcgcctatgtgtctgcgatcgctcagacagagaagtccatcgaagataaccctgagattgaagacgatatcttccggaaaaagagactcacgattatggacctgcatcccggggccggaaaaaccaagcgctaccttcctgccatcgtccgggaggctattaaaagaggcctgcgcacactgatcctcgccccgacccgggtggttgctgccgaaatggaggaggcgctgagagggcttcccattcgctatcaaacccctgccatcaagacagaacacacgggacgggagatcgtggacctgatgtgtcatgctaccttcacaatgagactcctgagccccgtccgggtgcctaactacaatctcattatcatggatgaagcccactttaccgaccccgcttccattgccgcccgcggctatatctctacaagagttgagatgggggaggctgcgggcattttcatgaccgccacgccgcctggaagccgggatccctttccccagtccaacgctcctatcatggacgaagaaagagaaatccccgagagaagctggaactctggccacgaatgggtgacagatttcaaggggaaaaccgtctggtttgtgccttccattaaggccggaaacgacatcgccgcttgcctgcggaaaaatggcaagaaagttattcagcttagcagaaagaccttcgattctgagtacgtgaagacacgcgccaacgactgggattttgtcgtgaccacagacatcagcgagatgggggcgaatttcaaagctgaacgggtgattgatccgagacgctgtatgaagcccgtcatcctgaccgacggagaggaacgggttatcctggccggccctatgcccgtgacgcattcctctgccgctcaaagacgcgggcggattggcagaaaccctaaaaatgagaacgaccagtatatctacatgggagaacccctcgagaatgatgaggactgcgcccactggaaggaagcgaaaatgctgcttgataacattaatacaccggagggcatcattcctagcatgtttgaacccgagcgcgaaaaggtggacgccatcgatggggagtacagactgcggggagaggctcgcaaaaccttcgtcgacctcatgagacggggcgatctgcctgtgtggctggcctataaggttgctgccgaagggattaactacgctgaccgcaagtggtgttttgatggaatcaaaaataaccagatcctcgaggaaaacatggaggtggagatttggacaaaggaaggcgagcgcaagaaacttaaaccccggtggctggacgccagaatctattccgatcctctggcgctcaaggagttcaaggagttcgccgctgggcgcaaatctctgacccttaatctgattacggaaatgggccggctccccacctttatgacacagaaggccagaaacgctctggacaatctggccgtcctccataccgccgaggctggaggccgcgcgtacaaccacgcccttagcgagctgccggaaacactggagaccctcctgcttctgacactcctggctaccgtgacagggggaatcttcctgtttctcatgtccggcaaagggattggaaagatgacacttggcatgtgctgcatcatcaccgccagcattctgctgtggtatgcccaaatccagcctcactggattgctgcctctatcattctcgagttctttctgatcgttcttctgatccccgagcccgaaaaacagcggacccctcaggataatcaactcacatacgtggtcattgcgatcctgaccgtggtcgccgctacaatggccaacgagatgggcttcctggagaagacgaagaaagacctcgggcttggatccattaccacacaggaaagcgagtccaatatcctggacattgatctgagaccggcttctgcctggaccctctatgcggtggccacaacctttgttacgcccatgctgcggcatagcatcgaaaactcctctgtgaatgtgagccttaccgctattgccaaccaggctacagtcctgatgggcctcgggaagggatggcctctgtccaaaatggacatcggcgttcccctgctcgccatcgggtgttacagccaggtgaatcctattacccttacagctgccctgctgctcctggtggcgcactacgccatcattggacccggccttcaagctaaggccacccgcgaggctcagaaaagagccgccgcgggcatcatgaagaaccctacggtcgatgggattacagtgatcgacctggaaccgatcccctatgatcctaagttcgagaaacagctcggacaggttatgctgctgattctctgcgtgacccaagtccttatgatgcggacaacctgggctctgtgtgaggccctgaccctcgctacaggccccatctctacgctgtgggaagggaatcctggacgcttttggaacaccacaattgccgtgtccatggccaatatcttcagaggcagctaccttgctggggccggactgctcttttctattatgaagaacaccacatccacccggcgcggcacgggcaatatcggggagacactgggagaaaaatggaaaagcagactgaacgcgctcggcaaatctgagttccagatctataagaaaagcgggattcaggaggtcgaccggacccttgccaaggaaggaatcaagcgcggcgagaccgatcatcacgctgtgtccagagggtctgccaaactgcggtggtttgttgaaagaaacatggtgacacccgagggaaaggtcgtggacctgggctgcggccgcgggggatggagctactattgtggcgggctcaaaaatgttcgggaagtgaagggactgaccaaaggcgggccgggacatgaggagcctattcccatgtccacatacggctggaaccttgtcagactgcaaagcggcgtggatgtgttcttcacgccccctgaaaagtgcgacaccctcctgtgtgatatcggggagtcctctcccaatcctacaattgaagctggacgcaccctgcgggttctcaaccttgtcgagaattggctgaacaataacacacagttttgcatcaaggtgctgaatccgtatatgcccagcgtgatcgagaagatggaggccctccagagacagtacggcggggcgctggtccgcaaccctctttccagaaattctacccacgagatgtactgggttagcaacgccacgggaaatattgtgtcctctgtgaacatgatcagcagaatgctgattaatcgcttcaccatgaagcacaaaaaggctacatatgaacccgacgtcgatctcggctccgggacccggaacatcggaattgagagcgaaatccctaacctggacattatcggcaaaagaatcgagaagattaagcaagaacatgagatctcttggcactacgaccaggatcatccctataaaacatgggcctaccacggctcctatgagaccaagcagacagggagcgcttcttccatggtgaatggagttgtgcgcctgctcaccaaaccgtgggacgtcgtgcctatggttacgcagatggccatgacagataccaccccctttggccaacagcgggtgttcaaggaaaaagtcgacacaagaacgcaggagcctaaggaagggaccaagaaacttatgaagattacagctgagtggctgtggaaagagctgggaaagaaaaagacaccccgcatgtgtacaagagaagagtttaccaaaaaggtgcggagcaacgccgcgctcggcgccatcttcacagatgaaaataagtggaaatctgctcgcgaggccgtggaagacgggagattttgggagctggtcgatcgggagagaaaccttcacctggaaggaaagtgcgagacctgtgtttacaatatgatgggcaaacgggaaaagaaactcggcgagttcgggaaggctaagggatcccgcgccatttggtatatgtggctgggcgccagatttctggagttcgaggcgctcgggtttctgaacgaggaccattggttcagccggggaaattcccttagcggcgtggaaggggagggcctgcaccgcctcggatacatcctgagagatgtgggcaaaaaggaagggggagctatgtacgccgacgatacggccggctgggacacccggatcacacttgaggacctgaaaaacgaagagatggtcaccaatcatatgaagggggagcacaaaaagctcgctgaagccatttttaagctgacatatcagaacaaagtggttcgcgtgcaaagacctacaccccggggaacggtcatggatatcatttctcgcagagaccagcggggcagcggacaggtgggcacatacggactgaataccttcacaaacatggaggctcaactcatccgccagatggaaggcgaggggattttcaagtccatccagcatctgaccgccacggaggaaatcgcggttcagaattggcttgccagagtgggacgggagcgcctgtctagaatggctattagcggcgatgactgcgtcgtgaaaccgatcgatgaccggtttgcctccgctctcaccgccctgaacgatatggggaaggttagaaaagacattcaacagtgggaaccttctcgcggatggaatgattggacacaggtgcccttctgcagccaccactttcatgagcttgtcatgaaggacggccgggtgctggtcgcgccctgtagaaaccaggatgaactcatcgggcgcgcccggatttcccaaggcgctggatggtctctgaaggagaccgcctgcctgggcaaaagctatgctcagatgtggacactcatgtacttccacagacgcgacctgcggcttgccgctaacgccatctgttccgcggtgcctagccattgggttccgacctctagaacaacctggtccattcacgccaagcacgagtggatgacgacagaagatatgctggctgtgtggaatcgcgtctggatccaggagaacccctggatggaagacaaaacccctgtggagagctgggaagaggtgccctatctcgggaagcgggaggaccagtggtgcggatctctgatcggccttacctccagagccacatgggccaaaaatattcaaaccgctatcaaccaggttcgcagcctgattgggaatgaagagtacacagattatatgccttccatgaagcggtttagacgggaagaggaagaggccggagtgctctggtga

SEQ ID NO: 19776 - RNA, 9876 nt, synthetic construct
  misc_feature 1..9876: note = derived and/or modified CDS sequence (opt5) from DENV-2__FJ744704__SS-prME
  source 1..9876: mol_type = other RNA
accgccggcgtgatcgtcatgctgattcccacggctatggccttccacctcacgaccagaaatggggaacctcatatgatcgttggacggcaggaaaagggcaagagcctgctttttaagacagaggacggggtgaatatgtgcaccctgatggcgattgatctcggagaactgtgtgaggacacaatcacctacaagtgcccgcttctgcgccaaaatgaacccgaggatattgactgttggtgcaatagcacatctacctgggtgacgtatggcacctgtacaaccacaggggagcacagacgggaaaagcgcagcgtcgctctcgtgcctcatgttggaatgggcctggagaccagaacggaaacatggatgtcctctgagggcgcctggaaacacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaggaacaggacaaacgctttatctgcaagcattccatggtggatagaggctggggcaacgggtgtggactgttcggcaaagggggaattgtcacatgcgccatgtttacgtgcaaaaagaatatggaaggcaaagttgtgcagcctgagaacctcgaatacaccatcgtgattacaccccacagcggggaggagcatgcggtcggaaatgacaccggcaagcacggcaaagaaatcaagatcacacctcagtcttccattaccgaggccgaactgacggggtatggaaccgtgacaatggagtgtagcccccggaccggccttgatttcaacgaaatggttctgctccaaatggaggacaaggcttggctggtgcaccgccagtggtttcttgatctgccgctcccttggctgcccggggccgacacacagggatctaattggatccagaaggagaccctggtcacgttcaagaaccctcatgctaaaaagcaagacgtggttgtgctcggctcccaggaaggggccatgcacacagccctgaccggcgctacagagattcagatgagctccggaaatcttctgtttaccggccatctcaaatgcagactgcggatggataaacttcaactgaaagggatgtcttacagcatgtgtaccggaaagttcaagatcgtcaaagaaattgcggagacacagcacggcacgatcgtgatcagagtccagtatgagggggacggatccccctgcaagattcccttcgaaatcaccgatctcgagaaacgccatgtgctgggccggctgattacagttaaccctatcgtgaccgaaaaggacagcccggtcaacattgaggccgaacccccttttggggattcttacatcattatcggcgtggagcccggacagctcaaactgaattggttcaagaagggctccagcatcgggcaaatgtttgagacaaccatgagaggagctaaacgcatggccattcttggcgacacggcctgggatttcgggtctctgggaggcgtttttacaagcatcgggaaggctctccaccaggtgttcggcgccatttacggagcggctttttccggcgtctcttggaccatgaaaatcctgattggggtgatcatcacctggattggaatgaacagccggtccacaagcctgtctgtgtcccttgttctcgtcggcgtggtgaccctgtatctgggggccatggtccaggccgacagcggatgtgtggtttcttggaagaataaagaactcaagtgcggctccgggatcttcattacagataacgtgcacacgtggaccgagcagtacaagtttcaacctgaaagcccctccaaactggcttctgccatccagaaggctcatgaggaaggcatttgtggaatcagaagcgtcacacgccttgagaatctgatgtggaaacagatcaccccggagctcaaccacattctgtccgaaaatgaggtgaagctgacaatcatgaccggcgacattcgggggatcatgcaggccggaaaaagatctcttcgccctcaacccacggaactcaagtatagctggaaaacctggggcaaggcgaagatgctgtccacagagagccataaccagaccttcctgattgatgggcctgaaacagccgagtgccccaataccaaccgggcttggaactctctcgaggttgaagactacggatttggcgtgttcacaaccaacatctggctgaaacttagagagaagcaggacgtcttttgtgattccaaactgatgagcgccgctatcaaggacaatcgcgccgtgcacgcggatatgggctattggattgaatctgccctcaacgacacgtggaaaatggagaaggcttccttcatcgaggttaagagctgccactggcctaaatctcatacactgtggagcaatggggtgctggaatccgagatgattatccccaagaacttcgccggaccggtcagccagcacaactaccggcctggctatcatacccaaaccgctgggccctggcaccttggaaaactcgaaatggattttgacctgtgtgagggcacaaccgtggtggtcacggaagattgcgggaatagaggaccctctctgcggacaaccacagcctccggcaagctcattaccgagtggtgctgtcgcagctgcacactgcctccgcttagataccggggcgaggacgggtgttggtacggaatggaaatcagacccctgaaagagaaggaagagaacctcgttaattccctggtgaccgccggccatgggcagattgataacttctctctgggagtgcttggcatggctctctttctggaagagatgctgcgcacgcggatcgggaccaagcacgcgatcctcctggtcgccgtgagcttcgttacacttattaccggaaatatgtcctttagagacctgggccgcgtgatggtcatggtgggcgctacaatgaccgatgacatcgggatgggagttacgtatctcgccctgctggccgctttcaaagtgagacctacatttgccgcgggccttctgctccggaagctgacctctaaagagctcatgatggctacaattgggatcgccctgcttagccagtccaccattcccgaaaccatcctggagctcacagatgccctggctctgggaatgatggtccttaagatcgtgcgcaacatggaaaaataccaactggccgttacgattatggcgatctcttgcgtgcctaatgctgtcattctccagaacgcctggaaggtgagctgtaccatcctggccgctgtgtccgtcagccccctcctgcttacatcttcccagcagaaggccgactggattcctctggctctcaccatcaaaggcctgaatcccacagccatcttcctgaccacgcttagcagaacatctaagaaacggtcctggccgctgaacgaggcgattatggccgttgggatggtgagcatcctcgcttcttccctgctcaagaatgacattcctatgaccggacccctggtggccggcggccttctgaccgtctgctatgtgctgacagggcgcagcgctgatctcgaactggagagagccgccgacgttaaatgggaggatcaagctgaaatctccggaagctctcctattcttagcatcaccatttccgaggacggctctatgagcatcaagaacgaagaggaggaacagacactgacgatcctcattcggaccgggctgctcgtgatctccggagtctttcccgtgtctattccgatcacagcggccgcttggtacctgtgggaggttaaaaagcagcgcgccggcgtgctttgggatgtcccttctccccctcccgtggaaaaggccgagctggaagacggggcttatagaattaaacagcggggaatcctgggctactcccaaatcggcgccggggtctataaggagggaaccttccacacaatgtggcatgtgacccgcggcgcggttctcatgcacagagggaaacggattgagccctcctgggctgatgtgaagaaagacctgatcagctacggaggcgggtggaaacttgaaggagagtggaaggaaggcgaggaagtccaggtgctggccctcgagcctggcaaaaatccgagagccgttcagacgaagcccgggatgtttaaaaccaacacaggaaccattggcgctgtgtccctggatttcagccctgggacatctggatcccccatcgtcgaccgcaagggcaaagtggtggggctctacggaaatggcgttgtcacccggagcggcgcctatgtgtctgcgattgctcagacagagaagtccatcgaagataaccctgagatcgaagacgatatttttagaaagaaacgcctgacgatcatggaccttcatcccggggccggaaagaccaaacggtacctgcctgccattgtgagagaggctatcaagcgcggcctgcggacactcattctggccccgaccagagtcgtggctgccgaaatggaggaggcgcttcgcgggctgcccatccggtatcaaacccctgccattaaaacagaacacacgggaagagagatcgttgacctcatgtgtcatgctaccttcacaatgcggctgctcagccccgtgcgcgtccctaactacaatctgatcattatggatgaagcccacttcaccgaccccgcttccatcgccgccagaggctatatttctacacgggtggagatgggggaggctgcgggcatctttatgaccgccacgccgcctggaagccgcgatcccttcccccagtccaacgctcctattatggacgaagagagagaaatccccgagcggagctggaactctggccacgaatgggttacagattttaaggggaagaccgtgtggttcgtcccttccatcaaagccggaaacgacattgccgcttgccttagaaagaatggcaaaaaggtgatccagctgagccgcaaaacctttgattctgagtacgttaagacacgggccaacgactgggatttcgtggtcaccacagacattagcgagatgggggcgaattttaaggctgaaagagtgatcgatccgcgccggtgtatgaaacccgtgattctgaccgacggagaggaaagagtcatcctcgccggccctatgcccgttacgcattcctctgccgctcaacgccgggggagaatcggccgcaaccctaagaatgagaacgaccagtatatttacatgggagaacccctggagaatgatgaggactgcgcccactggaaagaagcgaagatgcttctggataacatcaatacaccggagggcattatccctagcatgttcgaacccgagagagaaaaagtggacgccattgatggggagtaccggctccgcggagaggctagaaagacctttgtggacctgatgcggcgcggcgatctgcctgtctggctcgcctataaagtggctgccgaagggatcaactacgctgacagaaagtggtgtttcgatggaattaagaataaccagatccttgaggaaaacatggaggttgagatctggacaaaagaaggcgagcggaagaaactgaagcccagatggctggacgcccgcatttattccgatcctctcgcgctgaaagaatttaaggagttcgccgctgggcggaagtctcttaccctgaatctcatcacggaaatgggcagactgcccaccttcatgacacagaaagcccgcaacgctctggacaatctcgccgtgcttcataccgccgaggctggaggccgggcgtacaaccacgccctgagcgagctgccggaaacactcgagaccctgcttctgctcacactgctggctaccgtcacagggggaatttttctcttccttatgtccggcaaggggatcggaaaaatgacactgggcatgtgctgcattatcaccgccagcatcctgctctggtatgcccaaattcagcctcactggatcgctgcctctattatcctggaatttttccttattgtgctgctcatccccgagcccgaaaagcagagaacccctcaggataatcaactgacatacgttgtgatcgcgattctgaccgtcgtggccgctacaatggccaacgagatgggctttctcgagaaaacgaagaaggaccttgggctgggatccatcaccacacaggaaagcgagtccaatattctggacatcgatctccggccggcttctgcctggaccctgtatgcggtcgccacaaccttcgtgacgcccatgcttcgccatagcattgaaaactcctctgttaatgtgagcctgaccgctatcgccaaccaggctacagtgctcatgggcctggggaaaggatggcctctgtccaagatggacattggcgtccccctccttgccatcgggtgttacagccaggttaatcctatcaccctgacagctgccctgctcctgcttgtggcgcactacgccattatcggacccggcctgcaagctaaagccaccagagaggctcagaagcgggccgccgcgggcattatgaaaaaccctacggtggatgggatcacagtcattgacctcgaaccgatcccctatgatcctaagtttgagaagcagctgggacaggtgatgctgctcatcctttgcgttacccaagtgctgatgatgcgcacaacctgggctctgtgtgaggccctcaccctggctacaggccccatttctacgctttgggaagggaatcctggaagattctggaacaccacaatcgccgtctccatggccaatatttttcggggcagctacctggctggggccggactcctgttctctatcatgaaaaacaccacaaatacccgcagaggcacgggcaacattggggagacactgggagaaaagtggaaatcccggctcaacgcgcttggcaagagcgagtttcagatctataaaaagtctgggatccaggaggtggaccgcaccctggccaaagaaggaattaagagaggcgagaccgatcatcacgctgtcagccgggggtccgccaagctgagatggttcgtggaacgcaatatggttacacccgagggaaaagtggtcgacctcggctgcggcagagggggatggtcttactattgtggcgggctgaagaacgtgcgggaagttaaaggacttaccaagggcgggccgggacatgaggagcctatccccatgagcacatacggctggaatctggtgcgcctccaatccggcgtcgatgtgtttttcacgccccctgaaaaatgcgacaccctgctgtgtgatattggggagagctcccccaaccctacaatcgaagctggacggaccctcagagtgcttaatctggttgagaactggctgaataacaatacacagttctgcattaaggtcctcaacccgtatatgccctctgtgatcgaaaagatggaggccctgcagcgcaaatacggcggggcgcttgtgcggaatcctctgagcagaaactccacccacgagatgtactgggtctctaatgccacgggaaacatcgttagctccgtgaatatgatttctcgcatgctcatcaaccggtttaccatgaagcacaaaaaggctacatatgaacccgacgtggatctgggcagcgggaccagaaacattggaatcgagtccgaaattcctaatctggacatcattggcaaacgcatcgagaagatcaagcaggaacatgagacaagctggcactacgaccaagatcatccctataaaacctgggcctaccacggctcttatgagacaaagcagaccgggtccgctagctctatggtcaacggagtggttcggctccttacgaaaccgtgggacgtggtccctatggtgacacagatggccatgaccgataccacacccttcggccagcaaagagtttttaaggaaaaagtggacacgcgcacccaggagcctaaggaagggacaaagaaactgatgaagattaccgctgagtggctgtggaaagagctcggaaagaaaaagacacccagaatctgtacccgggaagagttcacacgcaaagtcagatccaatgccgcgctgggcgccatttttaccgatgaaaacaagtggaaaagcgctcgggaggccgtggaagacgggagattctgggagcttgtggatcgggagcgcaatctgcacctcgaaggaaaatgcgagacgtgtgtctacaacatgatgggcaagagagagaagaagctgggcgagtttgggaaagctaagggatctcgggccatctggtatatgtggctgggcgcccgcttcctcgaatttgaggcgctggggttccttaatgaggaccattggttttccagagaaaacagcctgtccggagttgagggcgaagggctccaccggctgggctacattcttcgcgatgtgggaaagaaagagggcggggctatgtacgccgacgataccgccggatgggacacaagaatcaccctggaagacctcaagaatgaggagatggtgacaaaccatatgaaaggcgaacacaagaaactggctgaggccatcttcaagctgacctatcagaataaggtcgtgcgggttcagcgccctacgcccagagggacagtgatggatattatcagccggcgcgaccaaagaggatctggccaggtcgggacctacggcctcaacacatttaccaatatggaagctcagctgattcggcaaatggagggagagggcatcttcaaaagcattcagcatcttacggccaccgaagagatcgcggtgcagaactggctggcccgcgttgggagagaacggctctccagaatggctatctctggagatgactgcgtggtcaagccgattgatgaccgcttcgccagcgctctgacagcccttaatgatatgggcaaagtgcggaaggacatccagcaatgggagccttccagagggtggaacgattggacccaggttcccttttgctctcaccacttccatgaactggtgatgaaagacggacgcgtcctcgtggtcccctgtcggaaccaggatgagctgattggcagagcgcgcatcagccagggggccggctggtccctgaaggagacagcttgcctcggaaagtcttatgcccaaatgtggaccctgatgtactttcaccggagagaccttcgcctggctgccaatgctatttgtagcgccgtgcctccgcattgggttcccacatcccggaccacgtggagcatccacgcgaaacacgaatggatgacaaccgaggatatgctcgccgtgtggaacagagtctggattcaggaaaatccttggatggaggacaagacccccgtggaatcttgggaggaggtgccttatctgggcaaacgcgaagaccagtggtgcgggtcccttatcggactgacaagccgggctacctgggccaagaacatccagacagccattaatcaagttagatctctcatcggcaacgaggaatacacggattatatgccctccatgaaacggttcagacgcgaggaagaggaggctggggtgctgtggtga

SEQ ID NO: 19777 - RNA, 9876 nt, synthetic construct
  misc_feature 1..9876: note = derived and/or modified CDS sequence (opt5) from DENV-2__FJ744745__SS-prME
  source 1..9876: mol_type = other RNA
acagccggagtgatcgtcatgctgattcccacggctatggccttccacctcacgaccagaaatggggagcctcatatgatcgttggacggcaggaaaagggaaaaagcctgctttttaagacagaggacggggtgaatatgtgcaccctgatggcgattgatctcggagaactgtgtgaggacacaatcacctacaaatgcccgcttctgcgccaaaatgaacccgaggatattgactgttggtgcaatagcacatctacctgggtgacgtatggcacctgtacaaccacaggggagcacagacgggaaaagcgcagcgtcgctctcgtgcctcatgttggaatgggcctggagaccagaacggaaacatggatgtcctctgagggcgcctggaaacacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaagaacaggacaaacgctttatctgcaagcattccatggtggatagaggctggggcaacgggtgtggactgttcggcaaagggggaattgtcacatgcgccatgtttacgtgcaaaaagaatatggaaggcaaagttgtgcagcctgagaacctcgaatacaccatcgtgattacaccccacagcggggaggagcatgcggtcggaaatgacaccggcaagcacggcaaagaaatcaagatcacacctcagtcttccattaccgaggccgaactgacggggtatggaaccgtgacaatggagtgtagcccccggaccggccttgatttcaacgaaatggttctgctccaaatggaggacaaggcttggctggtgcaccgccagtggtttcttgatctgccgctcccttggctgcccggggccgacacacagggatctaattggatccagaaggagaccctggtcacgttcaagaaccctcatgctaaaaagcaagacgtggttgtgctcggctcccaggaaggggccatgcacacagccctgaccggcgctacagagattcagatgagctccggaaatcttctgtttaccggccatctcaaatgcagactgaagatggataaacttcaactgaaggggatgtcttacagcatgtgtaccggaaagttcaaaatcgtcaaggaaattgcggagacacagcacggcacgatcgtgatccgggtccagtatgagggggacggatccccctgcaaaattcccttcgaaatcaccgatctcgagaagagacatgtgctgggccgcctgattacagttaaccctatcgtgaccgaaaaagacagcccggtcaacattgaggccgaacccccttttggggattcttacatcattatcggcgtggagcccggacagctcaagctgaattggttcaagaaaggctccagcatcgggcaaatgtttgagacaaccatgcggggagctaagagaatggccattcttggcgacacggcctgggatttcgggtctctgggaggcgtttttacaagcatcgggaaagctctccaccaggtgttcggcgccatttacggagcggctttttccggcgtctcttggaccatgaagatcctgattggggtgatcatcacctggattggaatgaacagccgctccacaagcctgtctgtgtcccttgttctcgtcggcgtggtgaccctgtatctgggggccatggtccaggccgacagcggatgtgtggtttcttggaaaaataaggaactcaagtgcggctccgggatcttcattacagataacgtgcacacgtggaccgagcagtacaaatttcaacctgaaagcccctccaagctggcttctgccatccagaaagctcatgaggaaggcatttgtggaatccggagcgtcacaagacttgagaatctgatgtggaagcagatcaccccggagctcaaccacattctgtccgaaaatgaggtgaaactgacaatcatgaccggcgacattcgcgggatcatgcaggccggaaagcggtctcttagacctcaacccacggaactcaaatatagctggaagacctggggcaaggcgaaaatgctgtccacagagagccataaccagaccttcctgattgatgggcctgaaacagccgagtgccccaataccaaccgcgcttggaactctctcgaggttgaagactacggatttggcgtgttcacaaccaacatctggctgaaacttcgggagaaacaggacgtcttttgtgattccaagctgatgagcgccgctatcaaagacaatagagccgtgcacgcggatatgggctattggattgaatctgccctcaacgacacgtggaagatggagaaggcttccttcatcgaggttaaaagctgccactggcctaagtctcatacactgtggagcaatggggtgctggaatccgagatgattatccccaaaaacttcgccggaccggtcagccagcacaactaccgccctggctatcatacccaaaccgctgggccctggcaccttggaaagctcgaaatggattttgacctgtgtgagggcacaaccgtggtggtcacggaagattgcgggaatcggggaccctctctgagaacaaccacagcctccggcaaactcattaccgagtggtgctgtcggagctgcacactgcctccgcttcgctacagaggcgaggacgggtgttggtacggaatggaaatccggcccctgaaggagaaggaagagaacctcgttaattccctggtgaccgccggccatgggcagattgataacttctctctgggagtgcttggcatggctctctttctggaagagatgctgagaacgcgcatcgggaccaaacacgcgatcctcctggtcgccgtgagcttcgttacacttattaccggaaatatgtcctttcgggacctgggcagagtgatggtcatggtgggcgctacaatgaccgatgacatcgggatgggagttacgtatctcgccctgctggccgctttcaaggtgcgccctacatttgccgcgggccttctgctcagaaaactgacctctaaggagctcatgatggctacaattgggatcgccctgcttagccagtccaccattcccgaaaccatcctggagctcacagatgccctggctctgggaatgatggtccttaaaatcgtgcggaacatggaaaagtaccaactggccgttacgattatggcgatctcttgcgtgcctaatgctgtcattctccagaacgcctggaaggtgagctgtaccatcctggccgctgtgtccgtcagccccctcctgcttacatcttcccagcagaaagccgactggattcctctggctctcaccatcaagggcctgaatcccacagccatcttcctgaccacgcttagccgcacatctaaaaagagatcctggccgctgaacgaggcgattatggccgttgggatggtgagcatcctcgcttcttccctgctcaaaaatgacattcctatgaccggacccctggtggccggcggccttctgaccgtctgctatgtgctgacagggcggagcgctgatctcgaactggagcgcgccgccgacgttaagtgggaggatcaagctgaaatctccggaagctctcctattcttagcatcaccatttccgaggacggctctatgagcatcaaaaacgaagaggaggaacagacactgacgatcctcattagaaccgggctgctcgtgatctccggagtctttcccgtgtctattccgatcacagcggccgcttggtacctgtgggaggttaagaagcagcgggccggcgtgctttgggatgtcccttctccccctcccgtggaaaaagccgagctggaagacggggcttatcgcattaagcagagaggaatcctgggctactcccaaatcggcgccggggtctataaagagggaaccttccacacaatgtggcatgtgacccggggcgcggttctcatgcaccgcgggaagagaattgagccctcctgggctgatgtgaaaaaggacctgatcagctacggaggcgggtggaaacttgaaggagagtggaaagaaggcgaggaagtccaggtgctggccctcgagcctggcaagaatccgcgggccgttcagacgaaacccgggatttttaagaccaacacaggaaccatcggcgctgtgtccctggatttcagccctgggacatctggatcccccattgtcgacagaaaaggcaaggtggtggggctctacggaaatggcgttgtcacccgcagcggcgcctatgtgtctgcgatcgctcagacagagaagtccatcgaagataaccctgagattgaagacgatatctttcggaaaaagagactgacgattatggaccttcatcccggggccggaaaaaccaagcgctacctgcctgccatcgtgcgggaggctattaaaagaggcctgcgcacactcatcctggccccgacccgggtcgtggctgccgaaatggaggaggcgcttagagggctgcccattcgctatcaaacccctgccatcaagacagaacacacgggacgggagatcgttgacctcatgtgtcatgctaccttcacaatgagactgctcagccccgtgcgggtccctaactacaatctgattatcatggatgaagcccacttcaccgaccccgcttccattgccgcccgcggctatatctctacaagagtggagatgggggaggctgcgggcatttttatgaccgccacgccgcctggaagccgggatcccttcccccagtccaacgctcctatcatggacgaagagagagaaatccccgagagaagctggaactctggccacgaatgggttacagattttaaggggaaaaccgtgtggttcgtcccttccattaaggccggaaacgacatcgccgcttgccttcggaaaaatggcaagaaagtgattcagctgagcagaaagacctttgattctgagtacgttaagacacgcgccaacgactgggatttcgtggtcaccacagacatcagcgagatgggggcgaattttaaagctgaacgggtgattgatccgagacgctgtatgaagcccgtgatcctgaccgacggagaggaacgggtcatcctcgccggccctatgcccgttacgcattcctctgccgctcaaagacgcgggcggattggcagaaaccctaaaaatgagaacgaccagtatatctacatgggagaacccctggagaatgatgaggactgcgcccactggaaggaagcgaaaatgcttctggataacattaatacaccggagggcatcattcctagcatgttcgaacccgagcgcgaaaaggtggacgccatcgatggggagtacagactccggggagaggctcgcaaaacctttgtggacctgatgagacggggcgatctgcctgtctggctcgcctataaggtggctgccgaagggattaactacgctgaccgcaagtggtgtttcgatggaatcaaaaataaccagatccttgaggaaaacatggaggttgagatttggacaaaggaaggcgagcgcaagaagctgaaaccccggtggctggacgccagaatctattccgatcctctcgcgctgaaggaatttaaggagttcgccgctgggcgcaaatctcttaccctgaatctcattacggaaatgggccggctgcccaccttcatgacacagaaggccagaaacgctctggacaatctcgccgtgcttcataccgccgaggctggaggccgcgcgtacaaccacgccctgagcgagctgccggaaacactcgagaccctgcttctgctcacactgctggctaccgtcacagggggaatctttctcttccttatgtccggcaaagggattggaaagatgacactgggcatgtgctgcatcatcaccgccagcaccctgctctggtatgcccaaattcagcctcactggatcgctgcctctattatcctggaatttttccttattgtgctgctcatccccgagcccgaaaaacagcggacacctcaggataatcaactgacctacgttgtgatcgcgattctgacagtcgtggccgctacgatggccaacgagatgggctttctcgagaagaccaagaaagaccttgggctgggatccatcacaacccaggaaagcgagtccaatattctggacatcgatctcagaccggcttctgcctggacactgtatgcggtcgccaccacgttcgtgacccccatgcttcggcatagcattgaaaactcctctgttaatgtgagcctgacagctatcgccaaccaggctaccgtgctcatgggcctggggaagggatggcctctgtccaaaatggacattggcgtccccctccttgccatcgggtgttacagccaggttaatcctatcacactgaccgctgccctgctcctgcttgtggcgcactacgccattatcggacccggcctgcaagctaaggccacgcgcgaggctcagaaaagagccgccgcgggcattatgaagaaccctacagtggatgggatcaccgtcattgacctcgaaccgatcccctatgatcctaagtttgagaaacagctgggacaggtgatgctgctcatcctttgcgttacacaagtgctgatgatgcggaccacctgggctctgtgtgaggccctcacactggctacgggccccatttctaccctttgggaagggaatcctggacgcttctggaacacaaccatcgccgtctccatggccaatatttttagaggcagctacctggctggggccggactcctgttctctatcatgaagaacacaaccaatacgcggcgcggcacaggcaacattggggagaccctgggagaaaaatggaagtccagactcaacgcgcttggcaaaagcgagtttcagatctataagaaatctgggatccaggaggtggaccggaccctggccaaggaaggaattaagcgcggcgagacagatcatcacgctgtcagcagagggtccgccaaactgcggtggttcgtggaaagaaatatggttacccccgagggaaaggtggtcgacctcggctgcggccgcgggggatggtcttactattgtggcgggctgaaaaacgtgcgggaagttaagggacttacaaaaggcgggccgggacatgaggagcctatccccatgagcacgtacggctggaatctggtgagactccaatccggcgtcgatgtgtttttcacaccccctgaaaagtgcgacaccctgctgtgtgatattggggagagctcccccaaccctaccatcgaagctggacgcacactccgggtgcttaatctggttgagaactggctgaataacaatacccagttctgcattaaggtcctcaacccgtatatgccctctgtgatcgagaagatggaggccctgcagagaaagtacggcggggcgcttgtgcgcaatcctctgagccggaactccacgcacgagatgtactgggtctctaatgccagcggaaacatcgtttcctctgtgaatatgattagcagaatgctcatcaaccgctttaccatgaaacacaagaaagctacatatgaacccgacgtggatctgggctccgggacccggaacattggaatcgagagcgaaattcctaatctggacatcattggcaagagaatcgagaagatcaaacaggaacatgagacatcttggcactacgaccaagatcatccctataagacctgggcctaccacggctcctatgagacaaaacagaccgggagcgcttcttccatggtcaacggagtggttcgcctccttacgaagccgtgggacgtggtccctatggtgacacagatggccatgaccgataccacacccttcggccagcaacgggtttttaaagaaaaggtggacacgagaacccaggagcctaaggaagggaccaaaaagctgatgaaaattaccgctgagtggctgtggaaggagctcggcaaaaagaaaacaccccgcatgtgtaccagagaagagttcacacggaaggtccgcagcaatgccgcgctgggcgccatctttaccgatgaaaacaagtggaaatctgctagagaggccgtggaagactcccggttctgggagcttgtggatagagagcggaatctgcacctcgaagggaagtgcgagacgtgtgtctacaacatgatgggaaaacgcgaaaagaaactgggcgagtttggcaaggctaaggggagcagagccatttggtatatgtggctgggagcccggttcctcgaatttgaggcgctgggcttccttaatgaggaccattggttttcccgcgggaacagcctgtctggagttgaaggcgaggggctccacagactgggctacatccttcgggatgtgggcaaaaaggaaggcggggctatgtacgccgacgataccgccggatgggacacacgcattaccctggaggacctcaaaaatgaagagatggtgacaaaccatatgaagggcgagcacaaaaagctggctgaagccatcttcaagctgacctatcagaataaagtcgtgagagttcagcggcctacgccccgcgggacagtgatggatatcattagcagacgggaccaacgcggatccggccaggtcgggacctacggcctcaacacatttaccaatatggaggctcagctgatcagacaaatggaaggagagggcattttcaagtctatccagcatcttacggccaccgaggaaattgcggtgcagaactggctggcccgggttgggcgcgagagactcagccggatggctatctccggagatgactgcgtggtcaaaccgatcgatgacagattcgcctctgctctgacagcccttaatgatatgggcaaggtgcgcaaagacattcagcaatgggaacctagccgggggtggaacgattggacccaggttcccttttgctcccaccacttccatgagctggtgatgaaggacggaagagtcctcgtggtcccctgtcgcaaccaggatgaactgatcggccgggcgagaatttctcagggggccggctggagcctgaaggagacagcttgcctcggaaaatcctatgcccaaatgtggaccctgatgtactttcaccgccgggaccttagactggctgccaatgctatctgtagcgccgtgcctccgcattgggttcccacatctcgcaccacgtggtccattcacgcgaagcacgagtggatgacaaccgaagatatgctcgccgtgtggaaccgggtctggatccaggagaatccttggatggaagacaaaacccccgtggagagctgggaagaggtgccttatctgggcaagagagaggaccagtggtgcgggtctcttattggactgacatcccgcgctacctgggccaaaaacatccagacagccatcaatcaagttcggagcctcattggcaacgaagagtacacggattatatgccctccatgaagagattccggagagaagaggaagaggctggggtgctgtggtga

SEQ ID NO: 19778 - RNA, 9876 nt, synthetic construct
  misc_feature 1..9876: note = derived and/or modified CDS sequence (opt5) from DENV-2__FJ744705__SS-prME
  source 1..9876: mol_type = other RNA
accgccggagtgatcgtcatgctgattcccacagctatggccttccacctgacgaccagaaatggggaacctcatatgatcgttggacggcaggaaaagggcaagagcctgctttttaagacagaggacggggtgaatatgtgcaccctgatggcgattgatctcggagaactgtgtgaggacacaatcacctacaaatgcccgcttctgcgccaaaatgaacccgaggatattgactgttggtgcaatagcacatctacctgggtgacgtatggcacctgtacaaccacaggggagcacagacgggaaaagcgcagcgtcgctctcgtgcctcatgttggaatgggcctggagaccagaacggaaacatggatgtcctctgagggcgcctggaaacacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaggaacaggacaaacgctttatctgcaagcattccatggtggatagaggctggggcaacgggtgtggactgttcggcaaaggcgggattgtcacatgcgccatgtttacgtgcaaaaagaatatggaagggaaagttgtgcagcctgagaacctcgaatacaccatcgtgattacaccccacagcggggaggagcatgcggtcggaaatgacaccggcaagcacggcaaagaaatcaagatcacacctcagtcttccattaccgaggccgaactgacggggtatggaaccgtgacaatggagtgtagcccccggaccggccttgatttcaacgaaatggttctgctccaaatggaggacaaggcttggctggtgcaccgccagtggtttcttgatctgccgctcccttggctgcccggggccgacacacagggatctaattggatccagaaggagaccctggtcacgttcaagaaccctcatgctaaaaagcaagacgtggttgtgctcggctcccaggaaggggccatgcacacagccctgaccggcgctacagagattcagatgagctccggaaatcttctgtttaccggccatctcaaatgcagactgcggatggataaacttcaactgaaagggatgtcttacagcatgtgtaccggaaagttcaagatcgtcaaagaaattgcggagacacagcacggcacgatcgtgatcagagtccagtatgagggggacgattccccctgcaagattcccttcgaaatcaccgacctcgagaaacgccatgtgctgggacggctgattacagttaaccctatcgtgaccgaaaaggatagcccggtcaacattgaggccgaacccccttttggcgactcttacatcattatcggggtggagcccggccagctcaaactgaattggttcaagaagggatccagcatcggccaaatgtttgagacaaccatgagaggggctaaacgcatggccattcttggagatacggcctgggacttcggctctctcgggggagtttttacaagcatcggcaaggctctccaccaggtgttcggggccatttacggcgcggctttttccggagtctcttggaccatgaaaatcctgattggcgtgatcatcacctggattgggatgaacagccggtccacaagcctgtctgtgtcccttgttctcgtcggagtggtgaccctgtatctgggcgccatggtccaggccgatagcgggtgtatcgtgtcttggaagaataaagaactcaagtgcggatccggcattttcatcacagacaacgttcacacgtggaccgagcagtacaagtttcaacctgaaagcccctccaaactggcttctgccattcagaaggctcatgaggaagggatctgtggcatcagaagcgtgacacgccttgagaatctgatgtggaaacagattaccccggagctcaaccacatcctgtccgaaaatgaggtcaagctgacaattatgaccggagatatccggggcattatgcaggccgggaaaagatctcttcgccctcaacccacggaactcaagtatagctggaaaacctggggaaaggcgaagatgctgtccacagagagccataaccagaccttcctgatcgacggccctgaaacagtggagtgccccaataccaaccgggcctggaactctctcgaggttgaagactacgggtttggagtgttcacaaccaacatctggctgaaacttagagagaagcaggatgtcttttgtgactccaaactgatgagcgctgccattaaggataatcgcgctgtgcacgccgacatgggctattggatcgaatctgcgctcaacgatacgtggaaaatggagaaggcctccttcattgaggttaagagctgccactggcctaaatctcatacactgtggagcaatggcgtgctggaatccgagatgatcattcccaagaacttcgctgggccggtcagccagcacaactaccggcctggatatcatacccaaaccgccggcccctggcaccttgggaaactcgaaatggactttgatctgtgtgagggaacaaccgtggtggtcacggaagactgcggcaatagagggccctctctgcggacaaccacagcttccggaaagctcatcaccgagtggtgctgtcgcagctgcacactgcctccgcttagataccggggcgaggatggctgttggtacgggatggaaattagacccctgaaagagaaggaagagaacctcgttaattccctggtgaccgccggacatggccagatcgacaacttctctctgggggtgcttggaatggccctctttctggaagagatgctgcgcacgcggatcggcaccaagcacgctattctcctggtcgcggtgagcttcgttacacttatcaccgggaatatgtcctttagagatctgggacgcgtgatggtcatggtgggcgccacaatgaccgacgatattggcatgggggttacgtatctcgctctgctggccgccttcaaagtgagacctacatttgctgccggacttctgctccggaagctgacctctaaagagctcatgatggcgacaatcggcattgctctgcttagccagtccaccatccccgaaaccatcctggagctcacagacgccctggccctggggatgatggtccttaagattgtgcgcaacatggaaaaataccaactggctgttacgatcatggccatttcttgcgtgcctaatgcggtcatcctccagaacgcttggaaggtgagctgtaccattctggccgccgtgtccgtcagccccctcctgcttacatcttcccagcagaaggctgactggatccctctggccctcaccatcaaaggactgaatcccacagctattttcctgaccacgcttagcagaacatctaagaaacggtcctggccgctgaacgaggccatcatggcggttggcatggtgagcattctcgcctcttccctgctcaagaatgatatccctatgaccgggcccctggtggctggaggccttctgaccgtctgctatgtgctgacaggccgcagcgccgacctcgaactggagagagctgccgatgttaaatgggaggaccaagccgaaatttccgggagctctcctatccttagcattaccatctccgaggatggatctatgagcatcaagaacgaagaggaggaacagacactgacgattctcatccggaccggcctgctcgtgatttccggggtctttcccgtgtctatcccgattacagctgcggcctggtacctgtgggaggttaaaaagcagcgcgctggagtgctttgggacgtcccttctccccctcccgtggaaaaggccgagctggaagatggcgcctatagaatcaaacagcgggggatcctgggatactcccaaattggcgctggcgtctataaggaggggaccttccacacaatgtggcatgtgacccgcggagccgttctcatgcacagaggcaaacggatcgagccctcctgggcggacgtgaagaaagatctgattagctacgggggaggctggaaacttgaaggggagtggaaggaaggagaggaagtccaggtgctggctctcgagcctggcaaaaatccgagagccgttcagacgaagcccggcatctttaaaaccaacacagggaccattggagccgtgtccctggacttcagccctggcacatctgggtcccccatcgtcgatcgcaagggaaaagtggtgggcctctacgggaatggagttgtcacccggagcggcgcttatgtgtctgccatcgcgcagacagagaagtccattgaagacaaccctgagatcgaagatgacatttttagaaagaaacgcctgacgatcatggaccttcatcccggcgctgggaagaccaaacggtacctgcctgccattgtgagagaggccatcaagcgcggactgcggacactcattctggctccgaccagagtcgtggccgctgaaatggaggaggcccttcgcggcctgcccatccggtatcaaacccctgcgatcaaaacagaacacacggggagagagattgttgatctcatgtgtcatgccaccttcacaatgcggctgctcagccccgtgcgcgtccctaactacaatctgatcattatggacgaagctcacttcaccgatcccgcctccatcgctgccagaggatatatttctacacgggtggagatgggcgaggccgctgggatctttatgaccgcgacgccgcctggcagccgcgaccccttcccccagtccaacgcccctatcatggatgaagagagagaaattcccgagcggagctggaactctggacacgaatgggttacagactttaagggcaagaccgtgtggttcgtcccttccatcaaagctgggaacgatattgccgcctgccttagaaagaatggcaagaaggtgatccagctgagccgcaaaacctttgactctgagtacgttaagacacgggctaacgattgggacttcgtggtcaccacagatattagcgagatgggcgccaattttaaggcggaaagagtgatcgacccgcgccggtgtatgaaacccgtgatcctgaccgacggggaggaaagagtcattctcgctggacctatgcccgttacgcattcctctgccgcccaacgccggggcagaatcgggcgcaaccctaagaatgagaacgatcagtatatttacatgggcgaacccctggagaatgacgaggattgcgctcactggaaagaagccaagatgcttctggacaacatcaatacaccggagggaattatccctagcatgttcgaacccgagagagaaaaagtggatgcgattgacggcgagtaccggctccgcggggaggccagaaagacctttgtggatctgatgcggcgcggagacctgcctgtctggctcgcttataaagtggccgctgaaggcatcaactacgccgatagaaagtggtgtttcgacgggatcaagaataaccagattcttgaggaaaacatggaggttgagatctggacaaaagaaggagagcggaagaaactgaagcccagatggctggatgctcgcatttattccgaccctctcgccctgaaagaatttaaggagttcgcggccggccggaagtctcttaccctgaatctcatcacggaaatggggagactgcccaccttcatgacacagaaagctcgcaacgccctggataatctcgctgtgcttcataccgccgaggccggcggacgggcttacaaccacgcgctgagcgagctgccggaaacactcgagaccctgcttctgctcacactgctggccaccgtcacgggcgggatttttctcttccttatgtccggaaagggcatcgggaaaatgacactgggaatgtgctgcatcattaccgctagcatcctgctctggtatgcccaaattcagcctcactggatcgccgcttctattatcctggaatttttccttatcgtgctgctcattcccgagcccgaaaagcagagaacccctcaggacaatcaactgacatacgttgtgatcgccattctgaccgtcgtggcggccacaatggctaacgagatgggctttctcgagaaaacgaagaaggaccttggcctggggtccatcaccacacaggaaagcgagtccaatattctggatatcgacctccggccggcctctgcttggaccctgtatgccgtcgcgacaaccttcgtgacgcccatgcttcgccatagcattgaaaactcctctgttaatgtgagcctgaccgccatcgctaaccaggccacagtgctcatgggactgggcaaagggtggcctctgtccaagatggatatcggagtccccctccttgctattggctgttacagccaggttaatcctatcaccctgacagccgctctgctcctgcttgtggcccactacgcgattatcgggcccggactgcaagccaaagctaccagagaggcccagaagcgggctgccgccggcattatgaaaaaccctacggtggacggcatcacagtcatcgatctcgaaccgattccctatgaccctaagtttgagaagcagctgggacaggtgatgctgctcatcctttgcgttacccaagtgctgatgatgcgcacaacctgggcgctgtgtgaggctctcaccctggccacaggacccatttctacgctttgggaaggcaatcctgggagattctggaacaccacaatcgctgtctccatggccaatatttttcggggaagctacctggccggcgctgggctcctgttctctatcatgaaaaacaccacaaatacccgcagaggaacgggcaacatcggcgagacactgggggaaaagtggaaatcccggctcaacgcccttggaaagagcgagtttcagatttataaaaagtctggcatccaggaggtggatcgcaccctggcgaaagaagggattaagagaggagagaccgaccatcacgccgtcagccggggctccgctaagctgagatggttcgtggaacgcaatatggttacacccgaggggaaagtggtcgatctcggatgcggccggggcgggtggtcttactattgtggaggcctgaagaacgtgagagaagttaaagggcttaccaagggaggcccggggcatgaggagcctatccccatgagcacatacggatggaatctggtgcgcctccaatccggcgtcgacgtgtttttcacgccccctgaaaaatgcgataccctgctgtgtgacattggcgagagctcccccaaccctacaatcgaagccgggcggaccctcagagtgcttaatctggttgagaactggctgaataacaatacacagttctgcatcaaggtcctcaacccgtatatgccctctgtgattgaaaagatggaggctctgcagcgcaaatacggaggcgcccttgtgcggaatcctctgagcagaaactccacccacgagatgtactgggtctctaatgcgacggggaacatcgttagctccgtgaatatgatttctcgcatgctcatcaaccggtttaccatgaagcacaaaaaggccacatatgaacccgatgtggacctgggaagcggcaccagaaacattgggatcgagtccgaaattcctaatctggacatcatcggaaaacgcattgagaagatcaagcaggaacatgagacaagctggcactacgatcaagaccatccctataaaacctgggcttaccacggctcttatgagacaaagcagaccggctccgccagctctatggtcaacggggtggttcggctccttacgaaaccgtgggatgtggtccctatggtgacacagatggctatgaccgacaccacacccttcggacagcaaagagtttttaaggaaaaagtggatacgcgcacccaggagcctaaggaaggcacaaagaaactgatgaagattaccgccgagtggctgtggaaagagctcgggaagaaaaagacacccagaatgtgtacccgggaagagttcacacgcaaagtcagatccaatgctgccctgggagcgatctttaccgacgaaaacaagtggaaaagcgcccgggaggctgtggaagatggcagattctgggagcttgtggaccgggagcgcaatctgcacctcgaagggaaatgcgagacgtgtgtctacaacatgatgggaaagagagagaagaagctgggcgagtttggcaaagccaaggggtctcgggctatttggtatatgtggctgggagcccgcttcctcgaatttgaggccctgggcttccttaatgaggatcattggttttccagagggaacagcctgtccggagttgaaggcgaggggctccaccggctgggctacatccttcgcgacgtgggaaagaaagaaggcggggcgatgtacgctgatgacaccgccggatgggacacaagaatcaccctggaggatctcaagaatgaagagatggtgacaaaccatatgaaaggcgagcacaagaaactggccgaagctattttcaagctgacctatcagaataaggtcgtgcgggttcagcgccctacgcccagagggacagtgatggacatcattagccggcgcgatcaaagaggatctggccaggtcgggacctacggcctcaacacatttaccaatatggaggcccagctgatccggcaaatggaaggagagggcattttcaaaagcatccagcatcttacggctaccgaggaaatcgccgtgcagaactggctggcgcgcgttgggagagagcggctctccagaatggccatttctggagacgattgcgtggtcaagccgatcgacgatcgcttcgctagcgccctgacagctcttaatgacatgggcaaagtgcggaaggatattcagcaatgggaaccttccagagggtggaacgactggacccaggttcccttttgctctcaccacttccatgagctggtgatgaaagatggacgcgtcctcgtggtcccctgtcggaaccaggacgaactgatcggcagagcccgcattagccagggggcgggctggtccctgaaggagacagcctgcctcggaaagtcttatgctcaaatgtggaccctgatgtactttcaccggagagatcttcgcctggccgctaatgccatctgtagcgctgtgcctccgcattgggttcccacatcccggaccacgtggagcattcacgccaaacacgagtggatgacaaccgaagacatgctcgcggtgtggaacagagtctggatccaggagaatccttggatggaagacaagacccccgtggagtcttgggaagaggtgccttatctgggcaaacgcgaggatcagtggtgcgggtcccttatcggactgacaagccgggccacctgggctaagaacattcagacagccatcaatcaagttagatctctcattggcaacgaagagtacacggactatatgccctccatgaaacggttcagacgcgaagaggaagaggccggggtgctgtggtga

SEQ ID NO: 19779 - RNA, 9876 nt, synthetic construct
  misc_feature 1..9876: note = derived and/or modified CDS sequence (opt5) from DENV-2__FJ744744__SS-prME
  source 1..9876: mol_type = other RNA
accgccggagtgatcgtcatgctgattcccaccgctatggccttccacctcacgaccagaaatggggagcctcatatgatcgttggacggcaggaaaagggaaaaagcctgctttttaagaccgaggacggggtgaatatgtgcaccctgatggcgattgatctcggagaactgtgtgaggacacgatcacctacaaatgcccgcttctgcgccaaaatgaacccgaggatattgactgttggtgcaattccacatctacctgggtgacgtatggcacctgtacaaccacaggggagcacagacgggaaaagcgcagcgttgctctcgtgcctcatgttggaatgggcctggagaccagaacggaaacatggatgtcctctgagggcgcctggaaacacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaagaacaggacaaacgctttatctgcaagcattccatggtggatagaggctggggcaacgggtgtggactgttcggcaaagggggaattgtcacatgcgccatgtttacgtgcaaaaagaatatggaaggcaaagttgtgcagcctgagaacctcgaatacaccatcgtgattacaccccacagcggggaggagcatgcggtcggaaatgacaccggcaagcacggcaaagaaatcaagatcacacctcagtcttccattaccgaggccgaactgacggggtatggaaccgtgacaatggagtgtagcccccggaccggccttgatttcaacgaaatggttctgctccaaatggaggacaaggcttggctggtgcaccgccagtggtttcttgatctgccgctcccttggctgcccggggccgacacacagggatctaattggatccagaaggagaccctggtcacgttcaagaaccctcatgctaaaaagcaagacgtggttgtgctcggctcccaggaaggggccatgcacacagccctgaccggcgctacagagattcagatgagctccggaaatcttctgtttaccggccatctcaaatgcagactgaagatggataaacttcaactgaaggggatgtcttacagcatgtgtaccggaaagttcaaaatcgtcaaggaaattgcggagacacagcacggcacgatcgtgatccgggtccagtatgagggggacggatccccctgcaaaattcccttcgaaatcaccgatctcgagaagagacatgtgctgggccgcctgattacagttaaccctatcgtgaccgaaaaagacagcccggtcaacattgaggccgaacccccttttggggattcttacatcattatcggcgtggagcccggacagctcaagctgaattggttcaagaaaggctccagcatcgggcaaatgtttgagacaaccatgcggggagctaagagaatggccattcttggcgacacggcctgggatttcgggtctctgggaggcgtttttacaagcatcgggaaagctctccaccaggtgttcggcgccatttacggagcggctttttccggcgtctcttggaccatgaagatcctgattggggtgatcatcacctggattggaatgaacagccgctccacaagcctgtctgtgtcccttgttctcgtcggcgtggtgaccctgtatctgggggccatggtccaggccgacagcggatgtgtggtttcttggaaaaataaggaactcaagtgcggctccgggatcttcattacagataacgtgcacacgtggaccgagcagtacaaatttcaacctgaaagcccctccaagctggcttctgccatccagaaagctcatgaggaaggcatttgtggaatccggagcgtcacaagacttgagaatctgatgtggaagcagatcaccccggagctcaaccacattctgtccgaaaatgaggtgaaactgacaatcatgaccggcgacattcgcgggatcatgcaggccggaaagcggtctcttagacctcaacccacggaactcaaatatagctggaagacctggggcaaggcgaaaatgctgtccacagagagccataaccagaccttcctgattgatgggcctgaaacagccgagtgccccaataccaaccgcgcttggaactctctcgaggttgaagactacggatttggcgtgttcacaaccaacatctggctgaaacttcgggagaaacaggacgtcttttgtgattccaagctgatgagcgccgctatcaaagacaatagagccgtgcacgcggatatgggctattggattgaatctgccctcaacgacacgtggaagatggagaaggcttccttcatcgaggttaaaagctgccactggcctaagtctcatacactgtggagcaatggggtgctggaatccgagatgattatccccaaaaacttcgccggaccggtcagccagcacaactaccgccctggctatcatacccaaaccgctgggccctggcaccttggaaagctcgaaatggattttgacctgtgtgagggcacaaccgtggtggtcacggaagattgcgggaatcggggaccctctctgagaacaaccacagcctccggcaaactcattaccgagtggtgctgtcggagctgcacactgcctccgcttcgctacagaggcgaggacgggtgttggtacggaatggaaatccggcccctgaaggagaaggaagagaacctcgttaattccctggtgaccgccggccatgggcagattgataacttctctctgggagtgcttggcatggctctctttctggaagagatgctgagaacgcgcatcgggaccaaacacgcgatcctcctggtcgccgtgagcttcgttacacttattaccggaaatatgtcctttcgggacctgggcagagtgatggtcatggtgggcgctacaatgaccgatgacatcgggatgggagttacgtatctcgccctgctggccgctttcaaggtgcgccctacatttgccgtcggccttctgctcagaaaactgacctctaaggagctcatgatggcgacaattgggatcgctctgcttagccagtccaccattcccgaaaccatcctggagctcacagatgccctggccctgggaatgatggtgcttaaaatcgttcggaacatggaaaagtaccaactggctgtgacgattatggccatctcttgcgtccctaatgcggtgattctccagaacgcttggaaggtgagctgtaccatcctggccgtcgtttccgtgagccccctcctgcttacatcttcccagcagaaagccgactggattcctctggctctcaccatcaagggcctgaatcccacagccatcttcctgaccacgcttagccgcacatctaaaaagagatcctggccgctgaacgaggctattatggccgtggggatggtcagcatcctcgcgtcttccctgctcaaaaatgacattcctatgaccggacccctggtggccggcggccttctgaccgtttgctatgtgctgacagggcggagcgctgatctcgaactggagcgcgccgctgacgtcaagtgggaggatcaagccgaaatctccggaagctctcctattcttagcatcaccatttccgaggacggctctatgagcatcaaaaacgaagaggaggaacagacactgacgatcctcattagaaccgggctgctcgtgatctccggagtttttcccgtgtctattccgatcacagccgctgcgtggtacctgtgggaggtcaagaagcagcgggccggcgtgctttgggatgtcccttctccccctcccgtggaaaaagctgagctggaagacggggcctatcgcattaagcagagaggaatcctgggctactcccaaatcggcgccggggtttataaagagggaaccttccacacaatgtggcatgtgacccggggcgctgtcctcatgcaccgcgggaagagaattgagccctcctgggccgatgtgaaaaaggacctgatcagctacggaggcgggtggaaacttgaaggagagtggaaagaaggcgaggaagttcaggtgctggcgctcgagcctggcaagaatccgcgggctgtccagacgaaacccgggatttttaagaccaacacaggaaccatcggcgccgtgtccctggatttcagccctgggacatctggatcccccattgtggacagaaaaggcaaggttgtcgggctctacggaaatggcgtggtgacccgcagcggcgcctatgtctctgctatcgcccagacagagaagtccatcgaagataaccctgagattgaagacgatatctttcggaaaaagagactgacgattatggaccttcatcccggggcgggaaaaaccaagcgctacctgcctgctatcgtgcgggaggccattaaaagaggcctgcgcacactcatcctggccccgacccgggttgtggctgccgaaatggaggaggctcttagagggctgcccattcgctatcaaacccctgccatcaagacagaacacacgggacgggagatcgtcgacctcatgtgtcatgcgaccttcacaatgagactgctcagccccgtgcgggttcctaactacaatctgattatcatggatgaagcccacttcaccgaccccgcttccattgccgctcgcggctatatctctacaagagtggagatgggggaggccgccggcatttttatgaccgctacgccgcctggaagccgggatcccttcccccagtccaacgcgcctatcatggacgaagagagagaaatccccgagagaagctggaactctggccacgaatgggtcacagattttaaggggaaaaccgtgtggttcgttccttccattaaggccggaaacgacatcgctgcctgccttcggaaaaatggcaagaaagtgattcagctgagcagaaagacctttgattctgagtacgtcaagacacgcgccaacgactgggatttcgtggtgaccacagacatcagcgagatgggggctaattttaaagccgaacgggtcattgatccgagacgctgtatgaagcccgttatcctgaccgacggagaggaacgggtgatcctcgcgggccctatgcccgtgacgcattcctctgctgcccaaagacgcgggcggattggcagaaaccctaaaaatgagaacgaccagtatatctacatgggagaacccctggagaatgatgagaactgcgcccactggaaggaagctaaaatgcttctggacaatattaacacaccggagggcatcattcctagcatgttcgaacccgagcgcgaaaaggtcgatgccatcgacggggagtacagactccggggagaggcgcgcaaaacctttgtggatctgatgagacggggcgacctgcctgtttggctcgcctataaggtggctgccgaagggattaattacgctgatcgcaagtggtgtttcgacggaatcaaaaacaaccagatccttgaggaaaatatggaggtcgagatttggacaaaggaaggcgagcgcaagaagctgaaaccccggtggctggatgccagaatctattccgaccctctcgctctgaaggaatttaaggagttcgccgcggggcgcaaatctcttaccctgaacctcattacggaaatgggccggctgcccaccttcatgacacagaaggccagaaatgctctggataacctcgccgtgcttcataccgctgaggccggaggccgcgcctacaatcacgctctgagcgagctgccggaaacactcgagaccctgcttctgctcacactgctggcgaccgttacagggggaatctttctcttccttatgtccggcaaagggattggaaagatgacactgggcatgtgctgcatcatcaccgccagcattctgctctggtatgctcaaatccagcctcactggattgccgcctctatcattctggaatttttccttatcgtgctgctcatccccgagcccgaaaaacagcggacccctcaggacaaccaactgacatacgtcgtgattgctatcctgaccgtcgtggccgcgacaatggccaatgagatgggctttctcgagaagacgaagaaagatcttgggctgggatccattaccacacaggaaagcgagtccaacatcctggacattgacctcagaccggcttctgcctggaccctgtatgctgttgccacaaccttcgtgacgcccatgcttcggcatagcatcgaaaattcctctgtgaacgtcagcctgaccgcgattgccaatcaggctacagttctcatgggcctggggaagggatggcctctgtccaaaatggatatcggcgtgcccctccttgccatcgggtgttacagccaggtgaaccctattaccctgacagctgccctgctcctgcttgtcgctcactacgccatcattggacccggcctgcaagcgaaggccacccgcgaggctcagaaaagagccgctgccggcatcatgaagaatcctacggtggacgggattacagttatcgatctcgaaccgatcccctatgaccctaagtttgagaaacagctgggacaggtgatgctgctcattctttgcgtcacccaagtgctgatgatgcggacaacctgggccctgtgtgaggcgctcaccctggctacaggccccatctctacgctttgggaagggaaccctggacgcttctggaataccacaattgccgtctccatggctaacatctttagaggcagctacctggccggggccggactcctgttctctattatgaagaataccacaaacacccggcgcggcacgggcaacatcggggagacactgggagaaaaatggaagtccagactcaatgctcttggcaaaagcgagtttcagatctataagaaatctgggattcaggaggtggatcggaccctggccaaggaaggaatcaagcgcggcgagaccgaccatcacgcggttagcagagggtccgccaaactgcggtggttcgtggaaagaaacatggtcacacccgagggaaaggtggttgatctcggctgcggccgcgggggatggtcttactattgtggcgggctgaaaaatgtgcgggaagtcaagggacttaccaaaggcgggccgggacatgaggagcctattcccatgagcacatacggctggaacctggtgagactccaatccggcgtggacgtctttttcacgccccctgaaaagtgcgataccctgctgtgtgacatcggggagagctcccccaatcctacaattgaagctggacgcaccctccgggtccttaacctggtggagaattggctgaacaataacacacagttctgcatcaaggtgctcaatccgtatatgccctctgtcatcgagaagatggaggccctgcagagaaagtacggcggggctcttgttcgcaaccctctgagccggaatagcacccacgagatgtactgggtgtctaacgccagcggaaatattgtgtcctctgtcaacatgatcagcagaatgctcattaaccgctttacgatgaaacacaagaaagcgacctatgaacccgatgtggacctgggctccgggacacggaatatcggaattgagagcgaaatccctaacctggatattatcggcaagagaatcgagaagattaaacaggaacatgagacctcttggcactacgaccaagaccatccctataagacatgggcctaccacggctcctatgagaccaaacagacagggagcgcttcttccatggttaatggagtggtccgcctccttaccaagccgtgggatgtggttcctatggtgacgcagatggccatgacagacaccacccccttcggccagcaacgggtctttaaagaaaaggtggatacaagaacgcaggagcctaaggaagggaccaaaaagctgatgaaaatcacagctgagtggctgtggaaggagctcggcaaaaagaaaacaccccgcatgtgtacaagagaagagttcacccggaaggtgcgcagcaacgccgctctgggcgccatttttacagacgaaaataagtggaaatctgcgagagaggccgtcgaagattcccggttctgggagcttgttgacagagagcggaacctgcacctcgaagggaagtgcgagacctgtgtgtacaatatgatgggaaaacgcgaaaagaaactgggcgagtttggcaaggctaaggggagcagagccatctggtatatgtggctgggagctcggttcctcgaatttgaggccctgggcttccttaacgaggatcattggttttcccgcgggaatagcctgtctggagtggaaggcgaggggctccacagactgggctacattcttcgggacgtcggcaaaaaggaaggcggggccatgtacgcggatgacacggctggatgggatacccgcatcacactggaggacctcaaaaacgaagagatggtgaccaatcatatgaagggcgagcacaaaaagctggccgaagccatcttcaagctgacatatcagaacaaagttgtgagagtccagcggcctacaccccgcgggacggtgatggacattatcagcagacgggatcaacgcggatccggccaggttgggacatacggcctcaatacctttacaaacatggaggctcagctgattagacaaatggaaggagagggcatcttcaagtctattcagcatcttaccgccacggaggaaatcgctgtgcagaattggctggcccgggtcgggcgcgagagactcagccggatggcgatctccggagacgattgcgtggttaaaccgattgacgatagattcgcctctgctctgaccgcccttaacgacatgggcaaggtgcgcaaagatatccagcaatgggaacctagccgggggtggaacgactggacacaggtccccttttgctcccaccacttccatgagctggtgatgaaggatggaagagtcctcgtggttccctgtcgcaatcaggacgaactgattggccgggctagaatctctcagggggccggctggagcctgaaggagaccgcgtgcctcggaaaatcctatgcccaaatgtggacactgatgtactttcaccgccgggatcttagactggctgccaacgctatttgtagcgccgtgcctccgcattgggtccccacctctcgcacaacctggtccatccacgctaagcacgagtggatgacgacagaagacatgctcgccgtgtggaatcgggtgtggattcaggagaacccttggatggaagataaaacccccgttgagagctgggaagaggtgccttatctgggcaagagagaggaccagtggtgcgggtctcttatcggactgacctcccgcgcgacatgggccaaaaatatccagaccgctattaaccaagtccggagcctcatcggcaatgaagagtacacagactatatgccctccatgaagagattccggagagaagaggaagaggccggggtgctgtggtga

SEQ ID NO: 19780 - RNA, 9876 nt, synthetic construct
  misc_feature 1..9876: note = derived and/or modified CDS sequence (opt5) from DENV-2__GQ868646__SS-prME
  source 1..9876: mol_type = other RNA
accgccggagtgatcgtcatgctgattcccacagctatggccttccacctcacgaccagaaatggggaacctcatatgatcgttggacggcaggaaaagggcaaaagcctgctttttaagacagaggacggggtgaatatgtgcaccctgatggcgattgatctcggagaactgtgtgaggacacaatcacctacaaatgcccgcttctgagacaaaatgaacccgaggatattgactgttggtgcaatagcacatctacctgggtgacgtatggcacctgtacaaccacaggggagcacagacgggaaaagagaagcgtcgctctcgtgcctcatgttggaatgggcctggagaccagaacggaaacatggatgtcctctgagggcgcctggaaacacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaagaacaggacaaacgctttatctgcaagcattccatggtggatagaggctggggcaacgggtgtggactgttcggcaaaggcgggattgtcacatgcgccaaatttacgtgcaagaaaaatatggaagggaaggttgtgcagcctgagaacctcgaatacaccatcgtgattacaccccacagcggggaggagcatgcggtcggaaatgacaccggcaaacacggcaaggaaatcaaaatcacacctcagtcttccattaccgaggccgaactgacggggtatggaaccgtgacaatggagtgtagcccccggaccggccttgatttcaacgaaatggttctgctccaaatggaggacaaggcttggctggtgcaccgccagtggtttcttgatctgccgctcccttggctgcccggggccgacacacagggatctaattggatccagaaggagaccctggtcacgttcaaaaaccctcatgctaagaaacaagacgtggttgtgctcggctcccaggaaggggccatgcacacagccctgaccggcgctacagagattcagatgagctccggaaatcttctgtttaccggccatctcaagtgcagactgcggatggataaacttcaactgaaggggatgtcttacagcatgtgtaccggaaagttcaaaatcgtcaaggaaattgcggagacacagcacggcacgatcgtgatcagagtccagtatgagggggacggatccccctgcaaaattcccttcgaaatcaccgatctcgagaagcgccatgtgctgggccggctgattacagttaaccctatcgtgaccgaaaaagacagcccggtcaacattgaggccgaacccccttttggggattcttacatcattatcggcgtggagcccggacagctcaagctgaattggttcaagaaaggctccagcatcgggcaaatgtttgagacaaccatgagaggagctaagcgcatggccattcttggcgacacggcctgggatttcgggtctctgggaggcgtttttacaagcatcgggaaagctctccaccaggtgttcggcgccatttacggagcggctttttccggcgtctcttggaccatgaagatcctgattggggtgatcatcacctggattggaatgaacagccggtccacaagcctgtctgtgtcccttgttctcgtcggcgtggtgaccctgtatctgggggccatggtccaggccgacagcggatgtgtggtttcttggaaaaataaggaactcaagtgcggctccgggatcttcattacagataacgtgcacacgtggaccgagcagtacaaatttcaacctgaaagcccctccaagctggcttctgccatccagaaagctcatgaggaaggcatttgtggaatcagaagcgtcacacgccttgagaatctgatgtggaagcagatcaccccggagctcaaccacattctgtccgaaaatgaggtgaaactgacaatcatgaccggcgacattcgggggatcatgcaggccggaaagagatctcttcgccctcaacccacggaactcaaatatagctggaagacctggggcaaggcgaaaatgctgtccacagagagccataaccagaccttcctgattgatgggcctgaaacagccgagtgccccaataccaaccgggcttggaactctctcgaggttgaagactacggatttggcgtgttcacaaccaacatctggctgaaacttagagacaaacaggatgtcttttgtgactccaagctgatgagcgccgctatcaaagataatcgcgccgtgcacgcggacatgggctattggattgagtctgccctcaacgatacgtggaagatggaaaaggcttccttcatcgaggttaaaagctgccactggcctaagtctcatacactgtggagcaatggggtgctggagtccgaaatgattatccccaaaaacttcgccggaccggtcagccagcacaactaccggcctggctatcatacccaaaccgctgggccctggcaccttggaaagctcgagatggactttgatctgtgtgaaggcacaaccgtggtggtcacggaggactgcgggaatagaggaccctctctgcggacaaccacagcctccggcaaactcattaccgaatggtgctgtcgcagctgcacactgcctccgcttagataccggggcgaggatgggtgttggtacggaatggagatcagacccctgaaggaaaaggaggaaaacctcgttaattccctggtgaccgccggccatgggcagattgacaacttctctctgggagtgcttggcatggctctcctgctggaggaaatgctccgcacgcggatcgggaccaaacacgcgatcctgcttgtcgccgtgagctttgttacactgattaccggaaatatgtccttcagagatctcggccgcgtgatggtcatggtgggcgctacaatgaccgacgatatcgggatgggagttacgtatctggccctgcttgccgcttttaaggtgagacctacattcgccgcgggcctgctcctgcggaaactcacctctaaggagctgatgatggctacaattgggatcgcccttctgagccagtccaccattcccgagaccatcctcgaactgacagacgccctggctcttggaatgatggtcctgaaaatcgtgcgcaacatggagaagtaccaactcgccgttacggtgatggcgatttcttgcgtccctaatgctgtgatcctgcagaacgcctggaaggtgagctgtaccattctcgccgctgtctccgttagccccctgcttctgacatcttcccagcagaaagccgactggatccctctcgctctgaccattaagggcctgaatcccacagccatctttcttaccacgctgagcagaacatctaaaaagcggtcctggccgctcaacgaagcgatcatggccgtggggatggtgagcattctggcttcttccctcctgaaaaatgatatccctatgaccggaccccttgtcgccggcggcctgctgaccgtgtgctatgttctcacagggcgcagcgctgacctggagcttgaaagagccgccgatgtgaagtgggaggaccaagctgagatttccggaagctctcctatcctgagcattaccatctccgaagatggctctatgagcattaaaaacgaggaagaggagcagacactcacgatcctgatccggaccgggctcctggtcatttccggagtgttccccgtttctatcccgattacagcggccgcttggtacctttgggaagtgaagaagcagcgcgccggcgtcctgtgggacgtgccttctccccctcccgtcgagaaagccgaactggaggatggggcttatagaatcaagcagcggggcattctcggctactcccaaatcggcgccggggtgtataaagaaggaacctttcacacaatgtggcatgttacccgcggcgcggtgctgatgcacagagggaagcggatcgagccctcctgggctgacgtcaaaaaggatcttattagctacggaggcgggtggaagctggagggagaatggaaagagggcgaagaggtgcaggttctcgccctggaacctggcaagaatccgagagccgtgcagacgaaacccgggatcttcaagaccaacacaggaaccattggcgctgtctccctcgactttagccctgggacatctggatcccccatcgtggatcgcaaaggcaaggtggttgggctgtacggaaatggcgtcgtgacccggagcggcgcctatgtgtctgcgattgctcagacagagaagtccatcgaggacaaccctgaaatcgaggatgacattttccgcaagaagcgccttacgatcatggacctgcatcccggggccggaaaaaccaagcggtacctgcctgccattgtcagagaagctatcaaacgcggcctccggacactgattcttgccccgaccagagtggttgctgccgagatggaagaggcgctgcgcgggctccccatccggtatcaaaccacagccattaagacggagcacaccggaagagaaatcgtggatctgatgtgtcatgctacatttaccatgcggctcctgagccctgtccgcgtgcccaactacaatcttatcattatggacgaggcccacttcacagatcctgcttccatcgccgccagaggctatatttctacccgggttgaaatgggggaggctgcgggcatcttcatgacggccacacccccgggaagccgcgacccttttccccagtccaacgctcccattatggatgaggaaagagagatccctgaacggagctggaactctggccacgagtgggtgaccgacttcaaggggaaaaccgtctggtttgtgccctccatcaaggccggaaacgatattgccgcttgcctgcgcaagaatggcaagaaagttatccagctgagccgcaagacattcgactctgaatacgtgaagacccgggccaacgattgggactttgtcgtgacaaccgatattagcgagatgggggcgaatttcaaagctgagagagtgatcgaccctcgccggtgtatgaagccggtcattctcacggacggagaagagagagttatcctggccggccccatgcctgtgacacattcctctgccgctcaacgccgggggagaatcggccgcaaccccaaaaatgaaaacgatcagtatatttacatgggagagcctcttgaaaatgacgaggattgcgcccactggaaggaggcgaaaatgctgctcgacaacatcaatacccccgaaggcattatcccgagcatgtttgagcctgaaagagagaaggtggatgccattgacggggaataccggctgcgcggagaggctagaaaaacattcgtcgatctgatgcggcgcggcgacctccccgtgtggcttgcctataaggttgctgccgaggggatcaactacgctgatagaaagtggtgttttgacggaattaaaaataaccagatcctggaagagaacatggaagtggagatctggaccaaggagggcgaacggaaaaagctgaaacctagatggctcgatgcccgcatttattccgaccccctggcgcttaaggagttcaaggaatttgccgctgggcggaaatctctgacgctcaatctgatcaccgagatgggcagactgcctacattcatgacccagaaggcccgcaacgctctcgataatcttgccgtcctgcatacagccgaagctggaggccgggcgtacaaccacgccctgagcgagctccccgagaccctggaaacacttctgctcctgaccctgctcgctacggtgacagggggaattttcctttttctgatgtccggcaaagggatcggaaagatgaccctgggcatgtgctgcattatcaccgccagcatcctcctgtggtatgcccaaattcagccgcactggatcgctgcctctattatccttgagttctttctgattgttctcctgatccctgaacccgagaaacagagaacaccccaggacaatcaactgacctacgtggtcatcgcgattctcacagtggtcgccgctacgatggccaacgaaatgggcttccttgagaagaccaagaaagacctggggctgggatccatcacaacccaggagagcgaatccaatattctcgatatcgacctgcggcctgcttctgcctggacactttatgcggtggccaccacgtttgttaccccgatgctgcgccatagcattgagaactcctctgtgaatgtgagcctcacagctatcgccaaccaggctaccgtcctgatgggcctggggaagggatggcccctctccaaaatggatattggcgttcctcttctggccatcgggtgttacagccaggtgaatcccatcacactgaccgctgccctcctgcttctggtggcgcactacgccattatcggacctggcctccaagctaaggccacgagagaagctcagaaacgggccgccgcgggcattatgaagaaccccacagtcgacgggatcaccgtgattgatctggagcctatcccgtatgaccccaagttcgaaaaacagctgggacaggttatgctccttatcctgtgcgtgacacaagtcctgatgatgcgcaccacctgggctctctgtgaggccctgacacttgctacgggccctatttctaccctgtgggaggggaatcccggaagattttggaacacaaccatcgccgtgtccatggccaatattttccggggcagctacctcgctggggccggactgctgttttctatcatgaagaacacaaccaatacgcgcagaggcacaggcaacattggggaaaccctcggagagaaatggaagtcccggcttaacgcgctgggcaaaagcgagttccagatctataagaaatctgggatccaggaggtcgatcgcaccctggccaaggagggaattaagagaggcgaaacagaccatcacgctgtgagccgggggtccgccaaactcagatggtttgttgagcgcaatatggtgacccctgaaggaaaggtcgtggatctgggctgcggcagagggggatggtcttactattgtggcgggcttaaaaacgttcgggaggtgaagggactgacaaaaggcgggcccggacatgaagaaccgatccctatgagcacgtacggctggaatctcgtccgcctgcaatccggcgtggacgtgttctttacccctcccgagaagtgcgatacactgctctgtgacattggggaaagctcccccaaccccaccatcgaggctggacggacacttagagttctgaatctggtcgaaaactggctcaataacaatacccagttctgcattaaggtgctgaacccttatatgccgtctgtgatcgagaaaatggaagcccttcagcgcaagtacggcggggcgctggtccggaatcccctcagcagaaactccacgcacgagatgtactgggtttctaatgccaccggaaacatcgtgagctccgtgaatatgatttctcgcatgctgatcaaccggttcacaatgaaacacaagaaagctacctatgagcctgatgtcgacctgggcagcgggacaagaaacattggaatcgaatccgagattcccaatctcgacatcattggcaagcgcatcgaaaagatcaaacaggagcatgaaaccagctggcactacgatcaagaccatccttataagacatgggcctaccacggctcttatgagaccaaacagacggggtccgctagctctatggtgaacggagttgtgcggcttctgacaaagccctgggatgtcgtgccgatggttacccagatggccatgaccgacacaacgccttttggccagcaaagagtgttcaaagagaaggtcgatacccgcacacaggaacccaaggaggggaccaaaaagctgatgaaaattacagctgaatggctctggaaggagctgggaaaagagaagacccctagaatgtgtacacgggaagagtttacccgcaaagtgagatccaatgccgcgcttggcgccatcttcacggacgaaaacaagtggaaaagcgctcgggaggccgtggaagatgggagattttgggagctggtcgaccgggagcgcaatctccacctggaaggaaaatgcgagacctgtgtttacaacatgatgggcaagagagagaagaagctgggcgagttcgggaaagctaagggatctcgggccatttggtatatgtggctcggcgcccgctttctggagttcgaggcgcttgggtttctgaatgaggatcattggttctccagaggaaacagcctctccggcgtggaaggggagggcctgcaccggcttggatacatcctgcgcgacgtgggcaagaaagaagggggagctatgtacgccgatgacacagccggctgggacaccagaattacactcgaggatctgaagaatgaagagatggtcaccaaccatatgaaaggggagcacaagaaactggctgaagccatctttaagctcacgtatcagaataaggtggttcgggtgcagcgccccacacctagaggaaccgtcatggacatcattagccggcgcgatcaaagaggctctggacaggtgggcacatacggactgaacaccttcacgaatatggaggctcagcttatccggcaaatggaaggcgaggggatttttaaaagcatccagcatctgaccgccacagaggaaattgcggttcagaactggctcgcccgcgtgggaagagagcggctgtccagaatggctatctctggcgacgattgcgtcgtgaagcccatcgacgatcgcttcgccagcgctcttaccgccctgaatgacatggggaaagttcggaaggatattcagcaatgggaaccgtccagaggatggaacgactggacacaggtgcctttctgctctcaccactttcatgagctcgtcatgaaagatggccgcgtgctggtcgtgccctgtcggaaccaggacgaactgatcgggagagcgcgcattagccagggcgccggatggtccctcaaggagaccgcttgcctgggcaagtcttatgcccaaatgtggacacttatgtacttccaccggagagatctgcgcctcgctgccaatgctatctgtagcgccgttccctcccattgggtgcctaccagccggacgacatggtctattcacgcgaaacacgagtggatgaccaccgaagacatgctggccgtctggaacagagtgtggatccaggagaatccgtggatggaagacaagacacccgtggagtcctgggaagaggttccttatcttgggaaacgcgaggatcagtggtgcggaagcctgattggcctcacctctcgggctacatgggccaagaacatccagacggccatcaatcaagtgagatccctgattgggaacgaagagtacaccgactatatgcccagcatgaaacggtttagacgcgaagaggaagaggctggagtcctgtggtga

SEQ ID NO: 19781 - RNA, 9876 nt, synthetic construct
  misc_feature 1..9876: note = derived and/or modified CDS sequence (opt5) from DENV-2__FJ906961__SS-prME
  source 1..9876: mol_type = other RNA
accgccggcgtgatcgtcatgctgattcccacagctatggccttccacctcacgaccagaaacggggagcctcatatgatcgttggacggcaggaaaagggcaaaagcctgctttttaagacagaggacggggtgaatatgtgcaccctgatggcgattgatctcggagaactgtgtgaggacacaatcacctacaaatgcccgcttctgcgccaaaacgaacccgaggatattgactgttggtgcaattccacatctacctgggtgacgtatggcacctgtacaaccacaggggagcacagacgggaaaagcgcagcgtcgctctcgtgcctcatgttggaatgggcctggagaccagaacggaaacatggatgtcctctgagggcgcctggaaacacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaagagcaggacaaacgctttatctgcaagcattccatggtggatagaggctggggcaacgggtgtggactgttcggcaaggggggaattgtcacatgcgccatgtttacgtgcaaaaagaatatggaaggcaaagttgtgcagcctgagaacctcgaatacaccatcgtgattacaccccacagcggggaggagcatgcggtcggaaatgacaccggcaagcacggcaaagaaatcaagatcacacctcagtcttccattaccgaggccgaactgacggggtatggaaccgtgacaatggagtgtagcccccggaccggccttgatttcaacgaaatggttctgctccaaatggaggacaaagcttggctggtgcaccgccagtggtttcttgatctgccgctcccttggctgcccggggccgacacacagggatctaattggatccagaaggagaccctggtcacgttcaagaaccctcatgctaaaaagcaagacgtggttgtgctcggctcccaggaaggggccatgcacacagccctgaccggcgctacagagattcagatgagctccggaaatcttctgtttaccggccatctcaaatgcagactgcggatggataagcttcaactgaaagggatgtcttacagcatgtgtaccggaaagttcaagatcgtcaaagaaattgcggagacacagcacggcacgatcgtgatcagagtccagtatgagggggacggatccccctgcaagattcccttcgaaatcaccgatctcgagaaacgccatgtgctgggccggctgattacagttaaccctatcgtgaccgaaaaggacagcccggtcaacattgaggccgaacccccttttggggattcttacatcattatcggcgtggagcccggacagctcaaactgaattggttcaagaagggctccagcatcgggcaaatgtttgagacaaccatgagaggagctaaacgcatggccattcttggcgacacggcctgggatttcgggtctctgggaggcgtttttacaagcatcgggaaggctctccaccaggtgttcggcgccatttacggagcggctttttccggcgtctcttggaccatgaaaatcctgattggggtgatcatcacctggattggaatgaacagccggtccacaagcctgtctgtgtcccttgttctcgtcggcgtggtgaccctgtatctgggggccatggtccaggccgacagcggatgtgtggtttcttggaagaataaagaactcaagtgcggctccgggatcttcattacagataacgtgcacacgtggaccgagcagtacaagtttcaacctgaaagcccctccaaactggcttctgccatccagaaggctcatgaggaaggcatttgtggaatcagaagcgtcacacgccttgagaatctgatgtggaaacagatcaccccggagctcaaccacattctgtccgaaaatgaggtgaagctgacaatcatgaccggcgacattcgggggatcatgcaggccggaaaaagatctcttcgccctcaacccacggaactcaagtatagctggaaaacctggggcaaggcgaagatgctgtccacagagcctcataaccagaccttcctgattgatgggcccgaaacagccgagtgccctaataccaaccgggcttggaatagcctcgaggttgaagactacggatttggcgtgttcacaaccaacatctggctgaaacttagagagaagcaggaagtcttttgtgactctaaactgatgtccgccgctatcaaggataatcgcgccgtgcacgcggacatgggctattggattgagagcgccctcaacgatacgtggaaaatggagaaggcttctttcatcgaagttaagtcctgccactggcccaaaagccatacactgtggtctaatggggtgctggagagcgaaatgattatcccgaagaacttcgccggacctgtctcccagcacaactaccggcccggctatcatacccaaaccgctgggccctggcaccttggaaaactcgagatggactttgatctgtgtgaaggcacaaccgtggtggtcacggaggactgcgggaatagaggacctagcctgcggacaaccacagcctctggcaagctcattaccgagtggtgctgtcgctcctgcacactgccgccccttagataccggggcgaagatgggtgttggtacggaatggagatcagacctctgaaagaaaaggaggaaaacctcgttaatagcctggtgaccgccggccatgggcagattgacaacttctccctgggagtgcttggcatggctctctttctggaggagatgctgcgcacgcggatcgggaccaagcacgcgatcctcctggtcgccgtgtctttcgttacacttattaccggaaatatgagctttagagatctgggccgcgtgatggtcatggtgggcgctacaatgaccgacgatatcgggatgggagttacgtatctcgccctgctggccgctttcaaagtgagacccacatttgccgcgggccttctgctccggaagctgacctccaaagaactcatgatggctacaattgggatcgccctgctttctcagagcaccattcctgagaccatcctggaactcacagacgccctggctctgggaatgatggtccttaagatcgtgcgcaacatggagaaataccaactggccgttacgattatggcgatctcctgcgtgcccaatgctgtcattctccagaacgcctggaaggtgtcttgtaccatcctggccgctgtgagcgtctcccctctcctgcttacaagctctcagcagaaggccgattggattcccctggctctcaccatcaaaggcctgaatccgacagccatcttcctgaccacgctttccagaacaagcaagaaacggtcttggcctctgaacgaagcgattatggccgttgggatggtgtccatcctcgctagctctctgctcaagaatgacattcccatgaccggacctctggtggccggcggccttctgaccgtctgctatgtgctgacagggcgctccgctgacctcgagctggagagagccgccgatgttaaatgggaagaccaagctgagatcagcggatccagccccattctttctatcaccattagcgaagatggctccatgtctatcaagaacgaggaggaagagcagacactgacgatcctcattcggaccgggctgctcgtgatcagcggagtctttccggtgtccattcctatcacagcggccgcttggtacctgtgggaagttaaaaagcagcgcgccggcgtgctttgggacgtcccctctcctccccccgtggagaaggccgaactggaggatggggcttatagaattaaacagcggggaatcctgggctacagccaaatcggcgccggggtctataaggagggaaccttccacacaatgtggcatgtgacccgcggcgcggttctcatgcacagagggaaacggattgaaccttcctgggctgacgtgaagaaagatctgatctcttacggaggcgggtggaagcttgagggagaatggaaggagggcgaagaggtccaggtgctggccctcgagccgggcaaaaatcccagagccgttcagacgaagcctgggatttttaaaaccaacacaggaaccatcggcgctgtgagcctggacttctcccccgggacaagcggatctcctattgtcgatcgcaagggcaaagtggtggggctctacggaaatggcgttgtcacccggtccggcgcctatgtgagcgcgatcgctcagacagaaaagtctatcgaggacaaccccgaaattgaggatgacatctttagaaagaaacgcctgacgattatggatcttcatcctggggccggaaagaccaaacggtacctgccggccatcgtgagagaagctattaagcgcggcctgcggacactcatcctggcccccaccagagtcgtggctgccgagatggaggaagcgcttcgcgggctgcctattcggtatcaaaccacagccatcaaaacggagcacaccggaagagaaatcgttgacctcatgtgtcatgctacattcaccatgcggctgctctcccccgtgcgcgtccctaactacaatctgattatcatggacgaggcccacttcacagatcccgctagcattgccgccagaggctatatctccacccgggtggagatgggggaagctgcgggcatttttatgacggccacaccgcctggatctcgcgaccccttcccccagagcaacgctcctatcatggatgaggaaagagagatccccgaacggtcctggaatagcggccacgagtgggttaccgactttaaggggaagaccgtgtggttcgtcccttctattaaagccggaaacgatatcgccgcttgccttagaaagaatggcaaaaaggtgattcagctgtcccgcaaaacatttgacagcgagtacgttaagacccgggccaacgattgggacttcgtggtcacaaccgatatctctgaaatgggggcgaattttaaggctgagagagtgattgacccgcgccggtgtatgaaacccgtgatcctgacggatggagaagagagagtcatcctcgccggccctatgcccgttacacatagctccgccgctcaacgccgggggagaattggccgcaaccctaagaatgaaaacgaccagtatatctacatgggagagcccctggagaatgacgaagattgcgcccactggaaagaggcgaagatgcttctggacaacattaataccccggaaggcatcattccttctatgttcgagcccgaaagagagaaagtggatgccatcgacggggagtaccggctccgcggagaagctagaaagacatttgtggatctgatgcggcgcggcgacctgcctgtctggctcgcctataaagtggctgccgaggggattaactacgctgatagaaagtggtgtttcgacggaatcaagaataaccagatccttgaagagaacatggaggttgaaatttggaccaaagagggcgaacggaagaaactgaagcccagatggctggatgcccgcatctatagcgaccctctcgcgctgaaagagtttaaggaattcgccgctgggcggaagtcccttacgctgaatctcattaccgagatgggcagactgcccacattcatgacccagaaagcccgcaacgctctggataatctcgccgtgcttcatacagccgaggctggaggccgggcgtacaaccacgccctgtctgaactgccggagaccctcgaaacactgcttctgctcaccctgctggctacggtcacagggggaatctttctcttccttatgagcggcaaggggattggaaaaatgaccctgggcatgtgctgcatcatcaccgcctccattctgctctggtatgcccaaatccagcctcactggattgctgccagcatcattctggagtttttccttatcgtgctgctcatccccgaacccgagaagcagagaacacctcaggacaatcaactgacctacgttgtgattgcgatcctgacagtcgtggccgctacgatggccaacgagatgggctttctcgaaaaaaccaagaaggatcttgggctgggatctattacaacccaggagtccgaaagcaatatcctggacattgacctccggccggcttccgcctggacactgtatgcggtcgccaccacgttcgtgacccccatgcttcgccattctatcgagaacagctccgttaatgtgtctctgacagctattgccaaccaggctaccgtgctcatgggcctggggaaaggatggcctctgagcaagatggatatcggcgtccccctccttgccatcgggtgttactcccaggttaatcctattacactgaccgctgccctgctcctgcttgtggcgcactacgccatcattggacccggcctgcaagctaaagccacgagagaagctcagaagcgggccgccgcgggcatcatgaaaaaccctacagtggacgggattaccgtcatcgatctcgagccgatcccctatgaccctaagtttgagaagcagctgggacaggtgatgctgctcattctttgcgttacacaagtgctgatgatgcgcaccacctgggctctgtgtgaagccctcacactggctacgggccccatcagcaccctttgggaggggaatcctggaagattctggaacacaaccattgccgtctctatggccaatatctttcggggctcctacctggctggggccggactcctgttcagcattatgaaaaacacaaccaatacgcgcagaggcacaggcaacatcggggaaaccctgggagagaagtggaaatctcggctcaacgcgcttggcaagtccgagtttcagatctataaaaagagcgggattcaggaagtggatcgcaccctggccaaagagggaatcaagagaggcgaaacagaccatcacgctgtctctcgggggagcgccaagctgagatggttcgtggagcgcaatatggttacccccgaaggaaaagtggtcgatctcggctgcggccgggggggatggtcctactattgtggcgggctgaagaacgtgagagaggttaaaggacttacaaagggcgggccgggacatgaggaacctattcccatgtctacgtacggctggaatctggtgcgcctccaaagcggcgtcgacgtgtttttcaccccccctgagaaatgcgatacactgctgtgtgacatcggggaatccagccccaaccctaccattgaggctggacggacactcagagtgcttaatctggttgaaaactggctgaataacaatacccagttctgcatcaaggtcctcaacccgtatatgccctccgtgatcgagaagatggaggccctgcagcgcaaatacggcggggcgcttgtgcggaatcctctgtctagaaacagcacgcacgaaatgtactgggtctccaatgccaccggaaacattgtttctagcgtgaatatgatctcccgcatgctcattaaccggtttacaatgaagcacaaaaaggctacctatgagcccgatgtggacctgggctctgggacaagaaacatcggaattgaaagcgagatccctaatctggatattatcggcaaacgcatcgaaaagattaagcaggagcatgagacctcctggcactacgaccaagaccatccctataaaacatgggcctaccacggcagctatgaaaccaagcagacggggtctgcttccagcatggtcaacggagtggttcggctccttacaaaaccgtgggatgtggtccctatggtgacccagatggccatgaccgacacaacgcccttcggccagcaaagagtttttaaggagaaagtggatacccgcacacaggaacctaaggaggggaccaagaaactgatgaagatcacagctgagtggctgtggaaagaactcggaaagaaaaagacccccagaatgtgtacacgggaggaattcacccgcaaagtcagatctaatgccgcgctgggcgccatttttacggacgagaacaagtggaagtccgctcgggaagccgtggaggatgggagattctgggagcttgtggaccgggaacgcaatctgcacctcgagggaaaatgcgaaacctgtgtctacaacatgatgggcaagagagagaaaaagctgggcgaatttgggaaagctaagggaagccgggccatctggtatatgtggctgggcgcccgcttcctcgagtttgaggcgctggggttccttaatgaagatcattggttttctagaggaaactccctgagcggcgttgagggggaaggcctccaccggctgggatacattcttcgcgacgtgggcaagaaagaggggggagctatgtacgccgatgacacagccggctgggataccagaatcacactggaagacctcaagaatgaggagatggtgaccaaccatatgaaaggggaacacaagaaactggctgaggccatcttcaagctgacgtatcagaataaggtcgtgcgggttcagcgccctacacccagaggaaccgtgatggacattatctcccggcgcgatcaaagaggcagcgggcaggtcggcacatacggactcaacacctttacgaatatggaagctcagctgattcggcaaatggagggcgaggggatcttcaaatctattcagcatcttaccgccacagaagagatcgcggtgcagaactggctggcccgcgttggaagagaacggctcagcagaatggctatctccggcgacgattgcgtggtcaagccgattgacgatcgcttcgcctctgctctgaccgcccttaatgacatggggaaagtgcggaaggatatccagcaatgggagcctagcagaggatggaacgactggacacaggttcccttttgctcccaccacttccatgaactggtgatgaaagatggccgcgtcctcgtggtcccctgtcggaaccaggacgagctgattgggagagcgcgcatctctcagggcgccggatggagcctgaaggagaccgcttgcctcggcaagtcctatgcccaaatgtggacactgatgtactttcaccggagagatcttcgcctggctgccaatgctatttgttctgccgtgcctagccattgggttccgacctcccggacgacatggagcatccacgcgaaacacgaatggatgaccaccgaggacatgctcgccgtgtggaacagagtctggattcaggaaaatccctggatggaggataagacacctgtggaatcttgggaggaggtgccctatctggggaaacgcgaagaccagtggtgcggatcccttatcggcctgaccagccgggctacatgggccaagaacatccagacggccattaatcaagttagatctctcatcgggaacgaggaatacaccgactatatgccttccatgaaacggttcagacgcgaggaagaggaggctggagtgctgtggtga

SEQ ID NO: 19782 - RNA, 9876 nt, synthetic construct
  misc_feature 1..9876: note = derived and/or modified CDS sequence (opt5) from DENV-2__FJ906962__SS-prME
  source 1..9876: mol_type = other RNA
accgccggcgtgatcgtgatgctgattcccaccgctatggccttccacctcacgaccagaaatggggaacctcatatgatcgttggacggcaggaaaagggcaagagcctgctttttaagacggaggacggggtgaatatgtgcaccctgatggcgattgatctcggagaactgtgtgaggacacaatcacctacaagtgcccccttctgcgccaaaacgaacccgaggatattgactgttggtgcaatagcacatctacctgggtgacgtatggcacctgtacaaccacaggggagcacagacgggaaaagcgcagcgtcgctctcgtgcctcatgttggaatgggcctggagaccagaacggaaacatggatgtcctctgagggcgcctggaaacacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaggaacaggacaaacgctttatctgcaagcattccatggtggatagaggctggggcaacgggtgtggactgttcggcaaaggcgggattgtcacatgcgccatgtttacgtgcaaaaagaatatggaagggaaagttgtgcagcctgagaacctcgaatacaccatcgtgattacaccccacagcggggaggagcatgcggtcggaaatgacaccggcaagcacggcaaagaaatcaagatcacacctcagtcttccattaccgaggccgaactgacggggtatggaaccgtgacaatggagtgtagcccccggaccggccttgatttcaacgaaatggttctgctccaaatggaggacaaggcttggctggtgcaccgccagtggtttcttgatctgccgctcccttggctgcccggggccgacacacagggatctaattggatccagaaggagaccctggtcacgttcaagaaccctcatgctaaaaagcaagacgtggttgtgctcggctcccaggaaggggccatgcacacagccctgaccggcgctacagagattcagatgagctccggaaatcttctgtttaccggccatctcaaatgcagactgcggatggataaacttcaactgaaagggatgtcttacagcatgtgtaccggaaagttcaagatcgtcaaagaaattgcggagacacagcacggcacgatcgtgatcagagtccagtatgagggggacggatccccctgcaagattcccttcgaaatcaccgatctcgagaaacgccatgtgctgggccggctgattacagttaaccctatcgtgaccgaaaaggacagcccggtcaacattgaggccgaacccccttttggggattcttacatcattatcggcgtggagcccggacagctcaaactgaattggttcaagaagggctccagcatcgggcaaatgtttgagacaaccatgagaggagctaaacgcatggccattcttggcgacacggcctgggatttcgggtctctgggaggcgtttttacaagcatcgggaaggctctccaccaggtgttcggcgccatttacggagcggctttttccggcgtctcttggaccatgaaaatcctgattggggtgatcatcacctggattggaatgaacagccggtccacaagcctgtctgtgtcccttgttctcgtcggcgtggtgaccctgtatctgggggccatggtccaggccgacagcggatgtgtggtttcttggaagaataaagaactcaagtgcggctccgggatcttcattacagataacgtgcacacgtggaccgagcagtacaagtttcaacctgaaagcccctccaaactggcttctgccatccagaaggctcatgaggaaggcatttgtggaatcagaagcgtcacacgccttgagaatctgatgtggaaacagatcaccccggagctcaaccacattctgtccgaaaatgagatcaagctgacaattatgaccggcgacatccgggggattatgcaggccggaaaaagatctcttcgccctcaacccacggaactcaagtatagctggaaaacctggggcaaggcgaagatgctgtccacagagagccataaccagaccttcctgatcgatgggcctgaaacagccgagtgccccaataccaaccgggcttggaactctctcgaggtggaagactacggatttggcgttttcacaaccaacatctggctgaaacttagagagaagcaggacgtgttttgtgattccaaactgatgagcgccgctattaaggacaatcgcgccgtccacgcggatatgggctattggatcgaatctgccctcaacgacacgtggaaaatggagaaggcttccttcattgaggtcaagagctgccactggcctaaatctcatacactgtggagcaatggggttctggaatccgagatgatcattcccaagaacttcgccggaccggtgagccagcacaactaccggcctggctatcatacccaaaccgctgggccctggcaccttggaaaactcgaaatggattttgacctgtgtgagggcacaaccgtcgtggtgacggaagattgcgggaatagaggaccctctctgcggacaaccacagcctccggcaagctcatcaccgagtggtgctgtcgcagctgcacactgcctccgcttagataccggggcgaggacgggtgttggtacggaatggaaattagacccctgaaagagaaggaagagaacctcgtcaattccctggttaccgccggccatgggcagatcgataacttctctctgggagtgcttggcatggctctctttctggaagagatgctgcgcacgcggatcgggaccaagcacgcgattctcctggtggccgtcagcttcgtgacacttatcaccggaaatatgtcctttagagacctgggccgcgttatggtgatggtcggcgctacaatgaccgatgacattgggatgggagtgacgtatctcgccctgctggccgctttcaaagttagacctacatttgccgcgggccttctgctccggaagctgacctctaaagagctcatgatggctacaatcgggattgccctgcttagccagtccaccatccccgaaaacatcctggagctcaccgatgccctggctctgggaatgatggtgcttaagattgtccgcaatatggaaaaataccaactggccgtgacaatcatggcgatttcttgcgttcctaacgctgtgatcctccagaatgcctggaaggtcagctgtacgattctggccgctgtgtccgtgagccccctcctgcttacctcttcccagcagaaggccgactggatccctctggctctcacaatcaaaggcctgaaccccaccgccattttcctgacaacccttagcagaacgtctaagaaacggtcctggccgctgaatgaggcgatcatggccgtcgggatggttagcattctcgcttcttccctgctcaagaacgacatccctatgacaggacccctggtggccggcggccttctgaccgtgtgctatgtcctgaccgggcgcagcgctgatctcgaactggagagagccgccgacgtgaaatgggaggatcaagctgaaatttccggaagctctcctatccttagcattacaatctccgaggacggctctatgagcatcaagaatgaagaggaggaacagaccctgacaattctcatccggacggggctgctcgttatttccggagtgtttcccgtctctatcccgattaccgcggccgcttggtacctgtgggaggtgaaaaagcagcgcgccggcgttctttgggatgtgccttctccccctcccgtcgaaaaggccgagctggaagacggggcttatagaatcaaacagcggggaatcctgggctactcccaaattggcgccggggtgtataaggagggaacattccacaccatgtggcatgtcacacgcggcgcggtgctcatgcacagagggaaacggatcgagccctcctgggctgatgttaagaaagacctgattagctacggaggcgggtggaaacttgaaggagagtggaaggaaggcgaggaagtgcaggtcctggccctcgagcctggcaaaaacccgagagccgtgcagaccaagcccgggatctttaaaacgaataccggaacaattggcgctgtttccctggatttcagccctgggacctctggatcccccatcgtggaccgcaagggcaaagtcgtggggctctacggaaacggcgtggttacacggagcggcgcctatgtctctgcgatcgctcagaccgagaagtccattgaagataaccctgagatcgaagacgatatttttagaaagaaacgcctgacaatcatggaccttcatcccggggccggaaagacgaaacggtacctgcctgccattgtgagagaggctatcaagcgcggcctgcggaccctcattctggccccgacaagagtggtcgctgccgaaatggaggaggcgcttcgcgggctgcccatccggtatcaaaccaccgccatcaaaacagaacacacgggaagagagattgtggacctcatgtgtcatgctaccttcacaatgcggctgctcagccctgttcgcgtgcccaattacaacctgatcattatggatgaagcccacttcaccgaccctgcttccatcgccgccagaggctatatttctacacgggtcgagatgggggaggctgcgggcatctttatgaccgccacgcccccgggaagccgcgatcctttcccccagtccaatgctcccatcatggacgaagagagagaaattcctgagcggagctggaactctggccacgaatgggtgacagattttaaggggaagaccgtttggttcgtgccctccatcaaagccggaaatgacattgccgcttgccttagaaagaacggcaaaaaggtcatccagctgagccgcaaaacctttgattctgagtacgtgaagacacgggccaatgactgggatttcgttgtgaccacagacattagcgagatgggggcgaactttaaggctgaaagagtcatcgatcctcgccggtgtatgaaaccggtgatcctgaccgacggagaggaaagagtgattctcgccggccccatgcctgtcacgcattcctctgccgctcaacgccgggggagaatcggccgcaatcccaagaacgagaatgaccagtatatttacatgggagaacctctggagaacgatgaggactgcgcccactggaaagaagcgaagatgcttctggataatatcaacacacccgagggcattatcccgagcatgttcgaacctgagagagaaaaagttgacgccattgatggggagtaccggctccgcggagaggctagaaagacctttgtggacctgatgcggcgcggcgatctgcccgtgtggctcgcctataaagtcgctgccgaagggatcaattacgctgacagaaagtggtgtttcgatggaatcaagaacaaccagattcttgaggaaaatatggaggtggagatctggacaaaagaaggcgagcggaagaaactgaagcctagatggctggacgcccgcatttattccgatcccctcgcgctgaaagaatttaaggagttcgccgctgggcggaagtctcttaccctgaacctcatcacggaaatgggcagactgcctaccttcatgacacagaaagcccgcaatgctctggacaacctcgccgttcttcataccgccgaggctggaggccgggcgtacaatcacgccctgagcgagctgcccgaaacactcgagaccctgcttctgctcacactgctggctaccgtgacagggggaatttttctcttccttatgtccggcaaggggatcggaaaaatgacactgggcatgtgctgcatcattaccgccagcatcctgctctggtatgcccaaattcagccgcactggatcgctgcctctattatcctggaatttttccttatcgtcctgctcattcctgagcccgaaaagcagagaacaccccaggataaccaactgacatacgtggttatcgcgattctgaccgtggtcgccgctacaatggccaatgagatgggctttctcgagaaaacgaagaaggaccttgggctgggatccatcaccacacaggaaagcgagtccaacattctggacatcgatctccggcctgcttctgcctggaccctgtatgcggtggccacaaccttcgtcacgccgatgcttcgccatagcattgaaaattcctctgtgaacgttagcctgaccgctatcgccaatcaggctacagtgctcatgggcctggggaaaggatggcccctgtccaagatggacatcggcgtgcctctccttgccattgggtgttacagccaggtcaaccccatcaccctgacagctgccctgctcctgcttgttgcgcactacgccattatcggacctggcctgcaagctaaagccaccagagaggctcagaagcgggccgccgcgggcattatgaaaaatcccacggtggatgggatcacagtgatcgacctcgaacctattccgtatgatcccaagtttgagaagcagctgggacaggtcatgctgctcatcctttgcgtgacccaagttctgatgatgcgcacaacctgggctctgtgtgaggccctcaccctggctacaggccctatttctacgctttgggaagggaaccccggaagattctggaataccacaatcgccgtgtccatggccaacatttttcggggcagctacctggctggggccggactcctgttctctatcatgaaaaataccacaaacacccgcagaggcacgggcaacatcggggagacactgggagaaaagtggaaatcccggctcaatgcgcttggcaagagcgagtttcagatttataaaaagtctgggatccaggaggtcgaccgcaccctggccaaagaaggaattaagagaggcgagaccgatcatcacgctgtgagccgggggtccgccaagctgagatggttcgtcgaacgcaacatggtgacacctgagggaaaagttgtggacctcggctgcggcagagggggatggtcttactattgtggcgggctgaagaatgtccgggaagtgaaaggacttaccaagggcgggcccggacatgaggagccgatccctatgagcacatacggctggaacctggttcgcctccaatccggcgtggatgtctttttcacgccgcccgaaaaatgcgacaccctgctgtgtgatattggggagagctcccctaatcccacaatcgaagctggacggaccctcagagtgcttaacctggtggagaattggctgaacaataacacacagttctgcatcaaggttctcaatccttatatgccgtctgtcattgaaaagatggaggccctgcagcgcaaatacggcggggcgcttgtgcggaaccccctgagcagaaattccacccacgagatgtactgggtgtctaacgccacgggaaatatcgtcagctccgttaacatgatttctcgcatgctcatcaaccggtttaccatgaagcacaaaaaggctacatatgaacctgacgtggatctgggcagcgggaccagaaatattggaatcgagtccgaaattcccaacctggacatcatcggcaaacgcattgagaagatcaagcaggaacatgagacaagctggcactacgaccaagatcatccttataaaacctgggcctaccacggctcttatgagacaaagcagaccgggtccgctagctctatggtgaatggagtcgtgcggctccttacgaaaccctgggacgttgtgccgatggtcacacagatggccatgaccgataccacacctttcggccagcaaagagtgtttaaggaaaaagttgacacgcgcacccaggagcccaaggaagggacaaagaaactgatgaagattaccgctgagtggctgtggaaagagctcggaaagaaaaagacacctagaatgtgtacccgggaagagttcacacgcaaagtgagatccaacgccgcgctgggcgccatctttaccgatgaaaataagtggaaaagcgctcgggaggccgtcgaagacgggagattctgggagcttgtggatcgggagcgcaacctgcacctcgaaggaaaatgcgagacgtgtgtgtacaatatgatgggcaagagagagaagaagctgggcgagtttgggaaagctaagggatctcgggccatttggtatatgtggctgggcgcccgcttcctcgaatttgaggcgctggggttccttaacgaggaccattggttttccagaggaaatagcctgtccggcgtcgaaggggagggcctccaccggctgggatacatccttcgcgatgttggcaagaaagaagggggagctatgtacgccgacgataccgccggctgggacacaagaatcaccctggaggacctcaagaacgaagagatggtgacaaatcatatgaaaggggagcacaagaaactggctgaagccattttcaagctgacctatcagaacaaggtggtccgggtgcagcgccccacgcctagaggaacagttatggatatcattagccggcgcgaccaaagaggctctggacaggtgggcacctacggactcaatacatttaccaacatcgaggctcagctgattcggcaaatggaaggcgaggggatcttcaaaagcatccagcatcttacggccaccgaggaaattgcggtccagaattggctggcccgcgtgggaagagagcggctctccagaatggctatctctggcgatgactgcgttgtgaagcccattgatgaccgcttcgccagcgctctgacagcccttaacgatatggggaaagtccggaaggacatccagcaatgggaaccgtccagaggatggaacgattggacccaggtgcctttttgctctcaccacttccatgagctggttatgaaagacggccgcgtgctcgtcgtgccctgtcggaatcaggatgaactgattgggagagcgcgcatcagccagggcgccggatggtccctgaaggagacagcttgcctcggcaagtcttatgcccaaatgtggaccctgatgtactttcaccggagagaccttcgcctggctgccaacgctatttgtagcgccgtcccctcccattgggtgcctacaagccggaccacgtggtctatccacgcgaaacacgagtggatgacaaccgaagatatgctcgccgtttggaatagagtgtggatccaggagaacccgtggatggaagacaagacccccgtcgagtcctgggaagaggtgccttatctggggaaacgcgaggaccagtggtgcggaagccttattggcctgacatctcgggctacctgggccaagaatatccagacagccattaaccaagtgagatccctcatcgggaatgaagagtacacggattatatgcccagcatgaaacggttcagacgcgaagaggaagaggctggagttctgtggtga

SEQ ID NO: 19783 - RNA, 9876 nt, synthetic construct
  misc_feature 1..9876: note = derived and/or modified CDS sequence (opt5) from DENV-2__FJ850053__SS-prME
  source 1..9876: mol_type = other RNA
accgccggcgtgatcgtcatgctgattcccacagctatggccttccacctcacgaccagaaacggggaacctcatatgatcgttggacggcaggaaaagggcaagagcctgctttttaagaccgaggacggggtgaatatgtgcaccctgatggcgattgatctcggagaactgtgtgaggacacaatcacctacaaatgcccccttctgcgccaaaacgaacccgaggatattgactgttggtgcaattccacatctacctgggtgacgtatggcacctgtacaaccacaggggagcaccggcgggaaaagcgcagcgtcgctctcgtgcctcatgttggaatgggcctggagaccagaacggaaacatggatgtcctctgagggcgcctggaaacacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaggaacaggacaaacgctttatctgcaagcattccatggtggatagaggctggggcaacgggtgtggactgttcggcaaagggggaattgtcacatgcgccatgtttacgtgcaaaaagaatatggaaggcaaagttgtgcagcctgagaacctcgaatacaccatcgtgattacaccccacagcggggaggagcatgcggtcggaaatgacaccggcaagcacggcaaagaaatcaagatcacacctcagtcttccattaccgaggccgaactgacggggtatggaaccgtgacaatggagtgtagcccccggaccggccttgatttcaacgaaatggttctgctccaaatggaggacaaggcttggctggtgcaccgccagtggtttcttgatctgccgctcccttggctgcccggggccgacacacagggatctaattggatccagaaggagaccctggtcacgttcaagaaccctcatgctaaaaagcaagacgtggttgtgctcggctcccaggaaggggccatgcacacagccctgaccggcgctacagagattcagatgagctccggaaatcttctgtttaccggccatctcaaatgcagactgcggatggataaacttcaactgaaagggatgtcttacagcatgtgtaccggaaagttcaagatcgtcaaagaaattgcggagacacagcacggcacgatcgtgatcagagtccagtatgagggggacggatccccctgcaagattcccttcgaaatcaccgatctcgagaaacgccatgtgctgggccggctgattacagttaaccctatcgtgaccgaaaaggacagcccggtcaacattgaggccgaacccccttttggggattcttacatcattatcggcgtggagcccggacagctcaaactgaattggttcaagaagggctccagcatcgggcaaatgtttgagacaaccatgagaggagctaaacgcatggccattcttggcgacacggcctgggatttcgggtctctgggaggcgtttttacaagcatcgggaaggctctccaccaggtgttcggcgccatttacggagcggctttttccggcgtctcttggaccatgaaaatcctgattggggtgatcatcacctggattggaatgaacagccggtccacaagcctgtctgtgtcccttgttctcgtcggcgtggtgaccctgtatctgggggccatggtccaggccgacagcggatgtgtggtttcttggaagaataaagaactcaagtgcggctccgggatcttcattacagataacgtgcacacgtggaccgagcagtacaagtttcaacctgaaagcccctccaaactggcttctgccatccagaaggctcatgaggaaggcatttgtggaatcagaagcgtcacacgccttgagaatctgatgtggaaacagatcaccccggagctcaaccacattctgtccgaaaatgaggtgaagctgacaatcatgaccggcgacattcgggggatcatgcaggccggaaaaagatctcttcgccctcaacccacggaactcaagtatagctggaaaacctggggcaaggcgaagatgctgtccacagagcctcataaccagaccttcctgattgatgggcccgaaacagccgagtgccctaataccaaccgggcttggaatagcctcgaggttgaagactacggatttggcgtgttcacaaccaacatctggctgaaacttagagagaagcaggacgtcttttgtgattctaaactgatgtccgccgctatcaaggacaatcgcgccgtgcacgcggatatgggctattggattgaaagcgccctcaacgacacgtggaaaatggagaaggcttctttcatcgaggttaagtcctgccactggcccaaaagccatacactgtggtctaatggggtgctggaaagcgagatgattatcccgaagaacttcgccggacctgtctcccagcacaactaccggcccggctatcatacccaaaccgctgggccctggcaccttggaaaactcgaaatggattttgacctgtgtgagggcacaaccgtggtggtcacggaagattgcgggaatagaggacctagcctgcggacaaccacagcctctggcaagctcattaccgagtggtgctgtcgctcctgcacactgccgccccttagataccggggcgaggacgggtgttggtacggaatggaaatcagacctctgaaagagaaggaagagaacctcgttaatagcctggtgaccgccggccatgggcagattgataacttctccctgggagtgcttggcatggctctctttctggaagagatgctgcgcacgcggatcgggaccaagcacgcgatcctcctggtcgccgtgtctttcgttacacttattaccggaaatatgagctttagagacctgggccgcgtgatggtcatggtgggcgctacaatgaccgatgacatcgggatgggagttacgtatctcgccctgctggccgctttcaaagtgagacccacatttgccgcgggccttctgctccggaagctgacctccaaagagctcatgatggctacaattgggatcgccctgctttctcagagcaccattcctgaaaccatcctggagctcacagatgccctggctctgggaatgatggtccttaagatcgtgcgcaacatggaaaaataccaactggccgttacgattatggcgatctcctgcgtgcccaatgctgtcattctccagaacgcctggaaggtgtcttgtaccatcctggccgctgtgagcgtctcccctctcctgcttacaagctctcagcagaaggccgactggattcccctggctctcaccatcaaaggcctgaatccgacagccatcttcctgaccacgctttccagaacaagcaagaaacggtcttggcctctgaacgaggcgattatggccgttgggatggtgtccatcctcgctagctctctgctcaagaatgacattcccatgaccggacctctggtggccggcggccttctgaccgtctgctatgtgctgacagggcgctccgctgatctcgaactggagagagccgccgacgttaaatgggaggatcaagctgaaatcagcggatccagccccattctttctatcaccattagcgaggacggctccatgtctatcaagaacgaagaggaggaacagacactgacgatcctcattcggaccgggctgctcgtgatcagcggagtctttccggtgtccattcctatcacagcggccgcttggtacctgtgggaggttaaaaagcagcgcgccggcgtgctttgggatgtcccctctcctccgcccgtggaaaaggccgagctggaagacggggcttatagaattaaacagcggggaatcctgggctacagccaaatcggcgccggggtctataaggagggaaccttccacacaatgtggcatgtgacccgcggcgcggttctcatgcacagagggaaacggattgagccttcctgggctgatgtgaagaaagacctgatctcttacggaggcgggtggaaacttgaaggagagtggaaggaaggcgaggaagtccaggtgctggccctcgagccgggcaaaaatcccagagccgttcagacgaagcctgggatttttaaaaccaacacaggaaccatcggcgctgtgagcctggatttctcccccgggacaagcggatctcctattgtcgaccgcaagggcaaagtggtggggctctacggaaatggcgttgtcacccggtccggcgcctatgtgagcgcgatcgctcagacagagaagtctatcgaagataaccccgagattgaagacgatatctttagaaagaaacgcctgacgattatggaccttcatcctggggccggaaagaccaaacggtacctgccggccatcgtgagagaggctattaagcgcggcctgcggacactcatcctggcccccaccagagtcgtggctgccgaaatggaggaggcgcttcgcgggctgcctattcggtatcaaaccacagccatcaaaacggaacacaccggaagagagatcgttgacctcatgtgtcatgctacattcaccatgcggctgctctcccccgtgcgcgtccctaactacaatctgattatcatggatgaagcccacttcacagaccccgctagcattgccgccagaggctatatctccacccgggtggagatgggggaggctgcgggcatttttatgacggccacaccgcctggatctcgcgatcccttcccccagagcaacgctcctatcatggacgaagagagagaaatccccgagcggtcctggaatagcggccacgaatgggttaccgattttaaggggaagaccgtgtggttcgtcccttctattaaagccggaaacgacatcgccgcttgccttagaaagaatggcaaaaaggtgattcagctgtcccgcaaaacatttgatagcgagtacgttaagacccgggccaacgactgggatttcgtggtcacaaccgacatctctgagatgggggcgaattttaaggctgaaagagtgattgatccgcgccggtgtatgaaacccgtgatcctgacggacggagaggaaagagtcatcctcgccggccctatgcccgttacacatagctccgccgctcaacgccgggggagaattggccgcaaccctaagaatgagaacgaccagtatatctacatgggagaacccctggagaatgatgaggactgcgcccactggaaagaagcgaagatgcttctggataacattaataccccggagggcatcattccttctatgttcgaacccgagagagaaaaagtggacgccatcgatggggagtaccggctccgcggagaggctagaaagacatttgtggacctgatgcggcgcggcgatctgcctgtctggctcgcctataaagtggctgccgaagggattaactacgctgacagaaagtggtgtttcgatggaatcaagaataaccagatccttgaggaaaacatggaggttgagatttggaccaaagaaggcgagcggaagaaactgaagcccagatggctggacgcccgcatctatagcgatcctctcgcgctgaaagaatttaaggagttcgccgctgggcggaagtcccttacgctgaatctcattaccgaaatgggcagactgcccacattcatgacccagaaagcccgcaacgctctggacaatctcgccgtgcttcatacagccgaggctggaggccgggcgtacaaccacgccctgtctgagctgccggaaaccctcgagacactgcttctgctcaccctgctggctacggtcacagggggaatctttctcttccttatgagcggcaaggggattggaaaaatgaccctgggcatgtgctgcatcatcaccgcctccattctgctctggtatgcccaaatccagcctcactggattgctgccagcatcattctggaatttttccttatcgtgctgctcatccccgagcccgaaaagcagagaacacctcaggataatcaactgacctacgttgtgattgcgatcctgacagtcgtggccgctacgatggccaacgagatgggctttctcgagaaaaccaagaaggaccttgggctgggatctattacaacccaggaatccgagagcaatatcctggacattgatctccggccggcttccgcctggacactgtatgcggtcgccaccacgttcgtgacccccatgcttcgccattctatcgaaaacagctccgttaatgtgtctctgacagctattgccaaccaggctaccgtgctcatgggcctggggaaaggatggcctctgagcaagatggacatcggcgtccccctccttgccatcgggtgttactcccaggttaatcctattacactgaccgctgccctgctcctgcttgtggcgcactacgccatcattggacccggcctgcaagctaaagccacgagagaggctcagaagcgggccgccgcgggcatcatgaaaaaccctacagtggatgggattaccgtcatcgacctcgaaccgatcccctatgatcctaagtttgagaagcagctgggacaggtgatgctgctcattctttgcgttacacaagtgctgatgatgcgcaccacctgggctctgtgtgaggccctcacactggctacgggccccatcagcaccctttgggaagggaatcctggaagattctggaacacaaccattgccgtctctatggccaatatctttcggggctcctacctggctggggccggactcctgttcagcattatgaaaaacacaaccaatacgcgcagaggcacaggcaacatcggggagaccctgggagaaaagtggaaatctcggctcaacgcgcttggcaagtccgagtttcagatctataaaaagagcgggattcaggaggtggaccgcaccctggccaaagaaggaatcaagagaggcgagacagatcatcacgctgtctctcgggggagcgccaagctgagatggttcgtggaacgcaatatggttacccccgagggaaaagtggtcgacctcggctgcggcagagggggatggtcctactattgtggcgggctgaagaacgtgagagaagttaaaggacttacaaagggcgggccgggacatgaggagcctattcccatgtctacgtacggctggaatctggtgcgcctccaaagcggcgtcgatgtgtttttcacaccccctgaaaaatgcgacacactgctgtgtgatatcggggagtccagccccaaccctaccattgaagctggacggacactcagagtgcttaatctggttgagaactggctgaataacaatacccagttctgcatcaaggtcctcaacccgtatatgccctccgtgatcgaaaagatggaggccctgcagcgcaaatacggcggggcgcttgtgcggaatcctctgtctagaaacagcacgcacgagatgtactgggtctccaatgccaccggaaacattgtttctagcgtgaatatgatctcccgcatgctcattaaccggtttacaatgaagcacaaaaaggctacctatgaacccgacgtggatctgggctctgggacaagaaacatcggaattgagagcgaaatccctaatctggacattatcggcaaacgcatcgagaagattaagcaggaacatgagacctcctggcactacgaccaagatcatccctataaaacatgggcctaccacggcagctatgagaccaagcagacggggtctgcttccagcatggtcaacggagtggttcggctccttacaaaaccgtgggacgtggtccctatggtgacccagatggccatgaccgatacaacgcccttcggccagcaaagagtttttaaggaaaaagtggacacccgcacacaggagcctaaggaagggaccaagaaactgatgaagatcacagctgagtggctgtggaaagagctcggaaagaaaaagacccccagaatgtgtacacgggaagagttcacccgcaaagtcagatctaatgccgcgctgggcgccatttttacggatgaaaacaagtggaagtccgctcgggaggccgtggaagacgggagattctgggagcttgtggatcgggagcgcaatctgcacctcgaaggaaaatgcgagacctgtgtctacaacatgatgggcaagagagagaagaagctgggcgagtttgggaaagctaagggaagccgggccatctggtatatgtggctgggcgcccgcttcctcgaatttgaggcgctggggttccttaatgaggaccattggttttctagaggaaactccctgagcggcgttgaaggggagggcctccaccggctgggatacattcttcgcgatgtgggcaagaaagaagggggagctatgtacgccgacgatacagccggctgggacaccagaatcacactggaggacctcaagaatgaagagatggtgaccaaccatatgaaaggggagcacaagaaactggctgaagccatcttcaagctgacgtatcagaataaggtcgtgcgggttcagcgccctacacccagaggaaccgtgatggatattatctcccggcgcgaccaaagaggcagcgggcaggtcggcacatacggactcaacacctttacgaatatggaggctcagctgattcggcaaatggaaggcgaggggatcttcaaatctattcagcatcttaccgccacagaggaaatcgcggtgcagaactggctggcccgcgttggaagagagcggctcagcagaatggctatctccggcgatgactgcgtggtcaagccgattgatgaccgcttcgcctctgctctgaccgcccttaatgatatggggaaagtgcggaaggacatccagcaatgggaacctagcagaggatggaacgattggacacaggttcccttttgctcccaccacttccatgagctggtgatgaaagacggccgcgtcctcgtggtcccctgtcggaaccaggatgaactgattgggagagcgcgcatctctcagggcgccggatggagcctgaaggagaccgcttgcctcggcaagtcctatgcccaaatgtggacactgatgtactttcaccggagagaccttcgcctggctgccaatgctatttgttctgccgtgcctagccattgggttccgacctcccggacgacatggagcatccacgcgaaacacgagtggatgaccaccgaagatatgctcgccgtgtggaacagagtctggattcaggagaatccctggatggaagacaagacacctgtggagtcttgggaagaggtgccctatctggggaaacgcgaggaccagtggtgcggatcccttatcggcctgaccagccgggctacatgggccaagaacatccagacggccattaatcaagttagatctctcatcgggaacgaagagtacaccgattatatgccttccatgaaacggttcagacgcgaagaggaagaggctggagtgctgtggtga

SEQ ID NO: 19784 - RNA, 9876 nt, synthetic construct
  misc_feature 1..9876: note = derived and/or modified CDS sequence (opt5) from DENV-2__JN819420__SS-prME
  source 1..9876: mol_type = other RNA
accgccggagtgatcgtgatgctgattcccaccgctatggccttccacctcacgacccggaatggggaacctcatatgatcgttggacggcaggaaaagggcaaaagcctgctttttaagacagaagacggggtgaatatgtgcaccctgatggcgattgatctcggagaactgtgtgaggacacaatcacctacaaatgcccgcttctgcgccaaaatgaacccgaggatattgactgttggtgcaattccacatctacctgggtgacgtatggcacctgtacaaccacaggggagcacagacgggaaaagcgcagcgtcgctctcgtgcctcatgttggaatgggcctggagaccagaacggaaacatggatgtcctctgagggcgcctggaaacacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaagaacaggacaaacgctttatctgcaagcattccatggtggatagaggctggggcaacgggtgtggactgttcggcaaaggcgggattgtcacatgcgccatgtttacgtgcaaaaagaatatggaagggaaagttgtgcagcctgagaacctcgaatacaccatcgtgattacaccccacagcggggaggagcatgcggtcggaaatgacaccggcaagcacggcaaagaaatcaagatcacacctcagtcttccattaccgaggccgaactgacggggtatggaaccgtgacaatggagtgtagcccccggaccggccttgatttcaacgaaatggttctgctccaaatggaggacaaggcttggctggtgcaccgccagtggtttcttgatctgccgctcccttggctgcccggggccgacacacagggatctaattggatccagaaggagaccctggtcacgttcaagaaccctcatgctaaaaagcaagacgtggttgtgctcggctcccaggaaggggccatgcacacagccctgaccggcgctacagagattcagatgagctccggaaatcttctgtttaccggccatctcaaatgcagactgcggatggataaacttcaactgaaagggatgtcttacagcatgtgtaccggaaagttcaagatcgtcaaagaaattgcggagacacagcacggcacgatcgtgatcagagtccagtatgagggggacggatccccctgcaagattcccttcgaaatcaccgatctcgagaaacgccatgtgctgggccggctgattacagttaaccctatcgtgaccgaaaaggacagcccggtcaacattgaggccgaacccccttttggggattcttacatcattatcggcgtggagcccggacagctcaaactgaattggttcaagaagggctccagcatcgggcaaatgtttgagacaaccatgagaggagctaaacgcatggccattcttggcgacacggcctgggatttcgggtctctgggaggcgtttttacaagcatcgggaaggctctccaccaggtgttcggcgccatttacggagcggctttttccggcgtctcttggaccatgaaaatcctgattggggtgatcatcacctggattggaatgaacagccggtccacaagcctgtctgtgtcccttgttctcgtcggcgtggtgaccctgtatctgggggccgtcgtgcaggccgacagcggatgtgttgtgtcttggaagaataaagaactcaagtgcggctccgggatcttcattacagataacgtccacacgtggaccgagcagtacaagtttcaacctgaaagcccctccaaactggcttctgccatccagaaggctcatgaggaaggcatttgtggaatcagaagcgtgacacgccttgagaatctgatgtggaaacagatcaccccggagctcaaccacattctgtccgaaaatgaggttaagctgacaatcatgaccggcgacattaaagggatcatgcaggccggaaagcggtctcttagacctcaacccacggaactcaaatatagctggaagacctggggcaaggcgaaaatgctgtccacagagagccataaccagaccttcctgattgatgggcctgaaacagccgagtgccccaataccaaccgcgcttggaactctctcgaggtggaagactacggatttggcgtcttcacaaccaacatctggctgaaacttcgggagaaacaggacgtgttttgtgattccaagctgatgagcgccgctatcaaagacaatagagccgttcacgcggatatgggctattggattgaatctgccctcaacgacacgtggaagatggagcgcgcttccttcatcgaggtcaagagctgccactggcctaaatctcatacactgtggagcaatggggtcctggaatccgagatgattatccccaagaacttcgccggaccggtgagccagcacaactaccggcctggctatcatacccaaaccgctgggccctggcaccttggaaaactcgaaatggattttgacttctgtgagggcacaaccgtggtcgttacggaagattgcgggaatagaggaccctctctgcggacaaccacagcctccggcaagctgattaccgagtggtgctgtcgcagctgcacactccctccgctgagataccggggcgaggacgggtgttggtacggaatggaaatcagaccccttaaagagaaggaagagaacctggtgaatagcctcgtgaccgccggccatgggcagattgataacttttctctgggagtcctgggcatggctcttttcctcgaagagatgctgcgcacgcggatcgggaccaagcacgcgatcctgctcgtggccgttagctttgtgacactgattaccggaaatatgtccttcagagaccttggccgcgtcatggtgatggttggcgctacaatgaccgatgacatcgggatgggagtgacgtatctggccctcctggccgcttttaaagtcagacctacattcgccgcgggcctgcttctgcggaagctcacctctaaagagctgatgatggctacaattgggatcgccctcctgagccagtccaccattcccgaaaccatccttgagctgacagatgccctcgctctgggaatgatggtgctgaagatcgttcgcaacatggaaaaataccaacttgccgtgacgattatggcgatctcttgcgtccctaatgctgtgattctgcagaacgcctggaaggtgagctgtaccatcctcgccgctgtctccgttagccccctgctcctgacatcttcccagcagaaggccgactggattcctcttgctctgaccatcaaaggcctcaatcccacagccatctttctgaccacgctgagcagaacatctaagaaacggtcctggccgcttaacgaggcgattatggccgtggggatggtgagcatcctggcttcttccctcctgaagaatgacattcctatgaccggacccctcgtcgccggcggcctgcttaccgtgtgctatgttctgacagggcgcagcgctgatctggaactcgagagagccgccgacgtgaaatgggaggatcaagctgaaatctccggaagctctcctattctgagcatcaccatttccgaggacggctctatgagcatcaagaacgaagaggaggaacagacacttacgatcctgattcggaccgggctcctggtcatctccggagtgttccccgtttctattccgatcacagcggccgcttggtacctctgggaggtgaaaaagcagcgcgccggcgtcctgtgggatgtgccttctccccctcccgtcgaaaaggccgagcttgaagacggggcttatagaattaaacagcggggaatcctgggctactcccaaatcggcgccggggtgtataaggagggaacctttcacacaatgtggcatgttacccgcggcgcggtgctgatgcacagagggaaacggattgagccctcctgggctgatgtcaagaaagacctcatcagctacggaggcgggtggaagctggaaggagagtggaaggaaggcgaggaagtgcaggttcttgccctggagcctggcaaaaatccgagagccgtgcagacgaagcccgggattttcaaaaccaacacaggaaccatcggcgctgtctccctcgattttagccctgggacatctggatcccccattgtggaccgcaagggcaaagtggttgggctgtacggaaatggcgtcgtgacccggagcggcgcctatgtgtctgcgatcgctcagacagagaagtccatcgaagataaccctgagattgaagacgatatcttcagaaagaaacgcctcacgattatggacctgcatcccggggccggaaagaccaaacggtaccttcctgccatcgtcagagaggctattaagcgcggcctgcggacactgatcctcgccccgaccagagtggttgctgccgaaatggaggaggcgctgcgcgggcttcccattcggtatcaaacccctgccatcaaaacagaacacacgggaagagagatcgtggacctgatgtgtcatgctaccttcacaatgcggctcctgagccccgtccgcgtgcctaactacaatctcattatcatggatgaagcccactttaccgaccccgcttccattgccgccagaggctatatctctacacgggttgagatgggggaggctgcgggcattttcatgaccgccacgccgcctggaagccgcgatccctttccccagtccaacgctcctatcatggacgaagagagagaaatccccgagcggagctggaactctggccacgaatgggtgacagatttcaaggggaagaccgtctggtttgtgccttccattaaagccggaaacgacatcgccgcttgcctgagaaagaatggcaaaaaggttattcagcttagccgcaaaaccttcgattctgagtacgtgaagacacgggccaacgactgggattttgtcgtgaccacagacatcagcgagatgggggcgaatttcaaggctgaaagagtgattgatccgcgccggtgtatgaaacccgtcatcctgaccgactccgaggaaagagttatcctggccggacctatgcccgtgacgcattctagcgccgctcaacgccggggcagaattgggcgcaaccctaagaatgagaacgaccagtatatctacatgggcgaacccctcgagaatgatgaggactgcgcccactggaaagaagcgaagatgctgcttgataacattaatacaccggagggaatcattccttccatgtttgaacccgagagagaaaaagtggacgccatcgatggcgagtaccggctgcgcggggaggctagaaagaccttcgtcgacctcatgcggcgcggagatctgcctgtgtggctggcctataaagttgctgccgaaggcattaactacgctgacagaaagtggtgttttgatgggatcaagaataaccagatcctcgaggaaaacatggaggtggagatttggacaaaagaaggagagcggaagaaacttaagcccagatggctggacgcccgcatctattctgatcctctggcgctcaaagagttcaaggagttcgccgctggcagaaagagcctgacccttaatctgattacggaaatggggagactccccacctttatgacacagaaagcccgcaacgctctggacaatctggccgtcctccataccgccgaggctggcggacgggcgtacaaccacgccctttccgagctgccggaaacactggagaccctcctgcttctgacactcctggctaccgtgacgggcgggatcttcctgtttctcatgagcggaaagggcattgggaaaatgacacttggaatgtgctgcatcatcaccgcctctattctgctgtggtatgcccaaatccagcctcactggattgctgcctccatcattctcgagttctttctgatcgttcttctgatccccgagcccgaaaagcagagaacccctcaggataatcaactcacatacgtggtcattgcgatcctgaccgtggtcgccgctacaatggccaacgagatgggcttcctggagaaaacgaagaaggacctcggccttgggagcattaccacacaggaatccgagtctaatatcctggacattgatctgcggccggctagcgcctggaccctctatgcggtggccacaacctttgttacgcccatgctgcgccattccatcgaaaactctagcgtgaatgtgtcccttaccgctattgccaaccaggctacagtcctgatgggactcggcaaagggtggcctctgagcaagatggacatcggagttcccctgctcgccatgggctgttactctcagttcaaacctatcacccttacagctgccctgctgctcctggtggcgcactacgccattatcgggcccggacttcaagctaaggccaccagagaggctcagaaacgggccgccgcgggcattatgaagaatcctacggtggatggcatcacagtcattgacctggaaccgatcccctatgatcctaagtttgagaaacagctcggacaggtgatgctgctgatcctctgcgttacccaagtgcttatgatgcgcacaacctgggctctgtgtgaggccctgaccctcgctacaggacccatttccacgctgtgggaaggcaaccctgggagattctggaataccacaatcgccgtcagcatggccaacatttttcggggatcttaccttgctggcgccgggctcctgttctccatcatgaagaataccacaagcacccgcagaggaacgggcaacattggcgagacactgggggaaaaatggaagtctcggctgaatgcgctcggaaaaagcgagtttcagatctataagaaatccggcatccaggaggtggaccgcacccttgccaaggaagggattaagagaggagagaccgatcatcacgctgtctctcggggcagcgccaaactgagatggttcgtggaacgcaacatggttacacccgaggggaaggtggtcgacctgggatgcggccggggcgggtggtcctactattgtggaggcctcaaaaacgtgagagaagttaaggggctgaccaaaggaggcccggggcatgaggagcctatccccatgagcacatacggatggaatcttgtgcgcctgcaatccggcgtcgatgtgttctttacgccccctgaaaagtgcgacaccctcctgtgtgatattggcgagtctagccccaaccctacaatcgaagctgggcggaccctgagagtgctcaatcttgttgagaactggctgaataacaatacacagttctgcattaaggtcctgaacccgtatatgccctccgtgatcgagaagatggaggccctccagcgccagtacggaggcgcgctggtgcggaatcctctttctagaaacagcacccacgagatgtactgggtctccaatgccacggggaacatcgtttctagcgtgaatatgatttcccgcatgctgatcaaccggtttaccatgaagcacaaaaaggctacatatgaacccgacgtggatctcggaagcggcaccagaaatattgggatcgagtctgaaattcctaacctggacatcattggaaaacgcatcgagaagatcaagcaagaacatgagatttcctggcactacgaccaggatcatccctataaaacatgggcctaccacggcagctatgagaccaagcagacaggctctgcttccagcatggtcaacggggtggttcggctgctcaccaaaccgtgggacgtggtccctatggtgacgcagatggccatgacagataccacccccttcggacaacagagagtttttaaggaaaaagtggacacacgcacgcaggagcctaaggaaggcaccaagaaacttatgaagatcacagctgagtggctgtggaaagagctggggaagaaaaagacccccagaatgtgtacacgggaagagttcaccaaaaaggtccgctctaatgccgcgctcggagccatttttacagatgaaaacaagtggaaatccgctagagaggccgtggaagacggccggttctgggagctggtggatagagagcggaatcttcacctggaagggaagtgcgagacctgtgtctacaacatgatgggaaaacgcgaaaagaaactcggcgagtttggcaaggctaaggggagcagagccatctggtatatgtggctgggagcccggttcctggaatttgaggcgctcggcttcctgaatgaggaccattggttttcccgcgggaacagcctttctggagttgaaggcgaggggctgcacagactcggctacattctgcgggatgtgggcaagaaggaaggcggggctatgtacgccgacgatacggccggatgggacacccgcatcacacttgaggacctgaaaaatgaagagatggtgaccaaccatatgaagggcgagcacaaaaagctcgctgaagccatcttcaagctgacatatcagaataaagtcgtgagagttcaacggcctacaccccgcgggacggtgatggatattatcagcagacgggaccagcgcggatccggccaggtcgggacatacggcctgaacaccttcacaaatatggaggctcaactcattagacagatggaaggagagggcatctttaagtctattcagcatctgaccgccacggaggaaatcgcggtgcagaactggcttgcccgggttgggcgcgagagactgagccggatggctatctccggagatgactgcgtggtcaaaccgattgatgacagattcgcctctgctctcaccgccctgaatgatatgggcaaggtgcgcaaagacatccaacagtgggaacctagccgggggtggaacgattggacacaggttcccttttgctcccaccacttccatgagcttgtgatgaaggacggaagagtcctggtggtcccctgtcgcaatcaggatgaactcattggccgggcgagaatctctcaaggggccggctggagcctgaaggagaccgcttgcctgggaaaatcctatgcccagatgtggacactcatgtactttcaccgccgggacctgagacttgctgccaacgctatttgtagcgccgtgccttctcattgggttccgacctcccgcacaacctggagcatccacgcgaagcacgagtggatgacgacagaagatatgctggccgtgtggaaccgggtctggattcaggagaatccctggatggaagacaaaacccctgtggagtcttgggaagaggtgccctatctcggcaagagagaggaccagtggtgcgggtccctgatcggacttaccagccgcgctacatgggccaaaaacatccaaaccgccattaatcaggttcggtccctgatcggcaacgaagagtacacagattatatgccttctatgaagagattccggagagaagaggaagaggctggggtgctctggtga

SEQ ID NO: 19785 - RNA, 9876 nt, synthetic construct
  misc_feature 1..9876: note = derived and/or modified CDS sequence (opt5) from DENV-2__FJ850118__SS-prME
  source 1..9876: mol_type = other RNA
accgccggcgtgatcgtcatgctgattcccacggctatggccttccacctcacgaccagaaatggggaacctcatatgatcgttggacggcaggaaaagggcaagagcctgctttttaagacagaggacggggtgaatatgtgcaccctgatggcgattgatctcggagaactgtgtgaggacacaatcacctacaagtgcccgcttctgcgccaaaatgaacccgaggatattgactgttggtgcaatagcacatctacctgggtgacgtatggcacctgtacaaccacaggggagcacagacgggaaaagcgcagcgtcgctctcgtgcctcatgttggaatgggcctggagaccagaacggaaacatggatgtcctctgagggcgcctggaaacacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaggaacaggacaaacgctttatctgcaagcattccatggtggatagaggctggggcaacgggtgtggactgttcggcaaagggggaattgtcacatgcgccatgtttacgtgcaaaaagaatatggaaggcaaagttgtgcagcctgagaacctcgaatacaccatcgtgattacaccccacagcggggaggagcatgcggtcggaaatgacaccggcaagcacggcaaagaaatcaagatcacacctcagtcttccattaccgaggccgaactgacggggtatggaaccgtgacaatggagtgtagcccccggaccggccttgatttcaacgaaatggttctgctccaaatggaggacaaggcttggctggtgcaccgccagtggtttcttgatctgccgctcccttggctgcccggggccgacacacagggatctaattggatccagaaggagaccctggtcacgttcaagaaccctcatgctaaaaagcaagacgtggttgtgctcggctcccaggaaggggccatgcacacagccctgaccggcgctacagagattcagatgagctccggaaatcttctgtttaccggccatctcaaatgcagactgcggatggataaacttcaactgaaagggatgtcttacagcatgtgtaccggaaagttcaagatcgtcaaagaaattgcggagacacagcacggcacgatcgtgatcagagtccagtatgagggggacggatccccctgcaagattcccttcgaaatcaccgatctcgagaaacgccatgtgctgggccggctgattacagttaaccctatcgtgaccgaaaaggacagcccggtcaacattgaggccgaacccccttttggggattcttacatcattatcggcgtggagcccggacagctcaaactgaattggttcaagaagggctccagcatcgggcaaatgtttgagacaaccatgagaggagctaaacgcatggccattcttggcgacacggcctgggatttcgggtctctgggaggcgtttttacaagcatcgggaaggctctccaccaggtgttcggcgccatttacggagcggctttttccggcgtctcttggaccatgaaaatcctgattggggtgatcatcacctggattggaatgaacagccggtccacaagcctgtctgtgtcccttgttctcgtcggcgtggtgaccctgtatctgggggccatggtccaggccgacagcggatgtgtggtttcttggaagaataaagaactcaagtgcggctccgggatcttcattacagataacgtgcacacgtggaccgagcagtacaagtttcaacctgaaagcccctccaaactggcttctgccatccagaaggctcatgaggaaggcatttgtggaatcagaagcgtcacacgccttgagaatctgatgtggaaacagatcaccccggagctcaaccacattctgtccgaaaatgaggtgaagctgacaatcatgaccggcgacattcgggggatcatgcaggccggaaaaagatctcttcgccctcaacccacggaactcaagtatagctggaaaacctggggcaaggcgaagatgctgtccacagagagccataaccagaccttcctgattgatgggcctgaaacagccgagtgccccaataccaaccgggcttggaactctctcgaggttgaagactacggatttggcgtgttcacaaccaacatctggctgaaacttagagagaagcaggacgtcttttgtgattccaaactgatgagcgccgctatcaaggacaatcgcgccgtgcacgcggatatgggctattggattgaatctgccctcaacgacacgtggaaaatggagaaggcttccttcatcgaggttaagagctgccactggcctaaatctcatacactgtggagcaatggggtgctggaatccgagatgattatccccaagaacttcgccggaccggtcagccagcacaactaccggcctggctatcatacccaaaccgctgggccctggcaccttggaaaactcgaaatggattttgacctgtgtgagggcacaaccgtggtggtcacggaagattgcgggaatagaggaccctctctgcggacaaccacagcctccggcaagctcattaccgagtggtgctgtcgcagctgcacactgcctccgcttagataccggggcgaggacgggtgttggtacggaatggaaatcagacccctgaaagagaaggaagagaacctcgttaattccctggtgaccgccggctatgggcagattgataacttctctctgggagtgcttggcatggctctctttctggaagagatgctgcgcacgcggatcgggaccaagcatgcgatcctcctggtcgccgtgagcttcgttacacttattaccggaaatatgtcctttagagacctgggccgcgtgatggtcatggtgggcgctacaatgaccgatgacatcgggatgggagttacgtacctcgccctgctggccgctttcaaagtgagacctacatttgccgcgggccttctgctccggaagctgacctctaaagagctcatgatggctacaattgggatcgccctgcttagccagtccaccattcccgaaaccatcctggagctcacagatgccctggctctgggaatgatggtccttaagatcgtgcgcaacatggaaaaatatcaactggccgttacgattatggcgatctcttgcgtgcctaatgctgtcattctccagaacgcctggaaggtgagctgtaccatcctggccgctgtgtccgtcagccccctcctgcttacatcttcccagcagaaggccgactggattcctctggctctcaccatcaaaggcctgaatcccacagccatcttcctgaccacgcttagcagaacatctaagaaacggtcctggccgctgaacgaggcgattatggccgttgggatggtgagcatcctcgcttcttccctgctcaagaatgacattcctatgaccggacccctggtggccggcggccttctgaccgtctgctacgtgctgacagggcgcagcgctgatctcgaactggagagagccgccgacgttaaatgggaggatcaagctgaaatctccggaagctctcctattcttagcatcaccatttccgaggacggctctatgagcatcaagaacgaagaggaggaacagacactgacgatcctcattcggaccgggctgctcgtgatctccggagtctttcccgtgtctattccgatcacagcggccgcttggtatctgtgggaggttaaaaagcagcgcgccggcgtgctttgggatgtcccttctccccctcccgtggaaaaggccgagctggaagacggggcttacagaattaaacagcggggaatcctgggctattcccaaatcggcgccggggtctacaaggagggaaccttccacacaatgtggcacgtgacccgcggcgcggttctcatgcatagagggaaacggattgagccctcctgggctgatgtgaagaaagacctgatcagctacggaggcgggtggaaacttgaaggagagtggaaggaaggcgaggaagtccaggtgctggccctcgagcctggcaaaaatccgagagccgttcagacgaagcccgggatttttaaaaccaacacaggaaccatcggcgctgtgtccctggatttcagccctgggacatctggatcccccattgtcgaccgcaagggcaaagtggtggggctctatggaaatggcgttgtcacccggagcggcgcctacgtgtctgcgatcgctcagacagagaagtccatcgaagataaccctgagattgaagacgatatctttagaaagaaacgcctgacgattatggaccttcaccccggggccggaaagaccaaacggtatctgcctgccatcgtgagagaggctattaagcgcggcctgcggacactcatcctggccccgaccagagtcgtggctgccgaaatggaggaggcgcttcgcgggctgcccattcggtaccaaacccctgccatcaaaacagaacatacgggaagagagatcgttgacctcatgtgtcacgctaccttcacaatgcggctgctcagccccgtgcgcgtccctaactataatctgattatcatggatgaagcccatttcaccgaccccgcttccattgccgccagaggctacatctctacacgggtggagatgggggaggctgcgggcatttttatgaccgccacgccgcctggaagccgcgatcccttcccccagtccaacgctcctatcatggacgaagagagagaaatccccgagcggagctggaactctggccacgaatgggttacagattttaaggggaagaccgtgtggttcgtcccttccattaaagccggaaacgacatcgccgcttgccttagaaagaatggcaaaaaggtgattcagctgagccgcaaaacctttgattctgagtatgttaagacacgggccaacgactgggatttcgtggtcaccacagacatcagcgagatgggggcgaattttaaggctgaaagagtgattgatccgcgccggtgtatgaaacccgtgatcctgaccgacggagaggaaagagtcatcctcgccggccctatgcccgttacgcactcctctgccgctcaacgccgggggagaattggccgcaaccctaagaatgagaacgaccagtacatctacatgggagaacccctggagaatgatgaggactgcgcccattggaaagaagcgaagatgcttctggataacattaatacaccggagggcatcattcctagcatgttcgaacccgagagagaaaaagtggacgccatcgatggggagtatcggctccgcggagaggctagaaagacctttgtggacctgatgcggcgcggcgatctgcctgtctggctcgcctacaaagtggctgccgaagggattaactatgctgacagaaagtggtgtttcgatggaatcaagaataaccagatccttgaggaaaacatggaggttgagatttggacaaaagaaggcgagcggaagaaactgaagcccagatggctggacgcccgcatctactccgatcctctcgcgctgaaagaatttaaggagttcgccgctgggcggaagtctcttaccctgaatctcattacggaaatgggcagactgcccaccttcatgacacagaaagcccgcaacgctctggacaatctcgccgtgcttcacaccgccgaggctggaggccgggcgtataaccatgccctgagcgagctgccggaaacactcgagaccctgcttctgctcacactgctggctaccgtcacagggggaatctttctcttccttatgtccggcaaggggattggaaaaatgacactgggcatgtgctgcatcatcaccgccagcattctgctctggtacgcccaaatccagcctcactggattgctgcctctatcattctggaatttttccttatcgtgctgctcatccccgagcccgaaaagcagagaacccctcaggataatcaactgacatatgttgtgattgcgatcctgaccgtcgtggccgctacaatggccaacgagatgggctttctcgagaaaacgaagaaggaccttgggctgggatccattaccacacaggaaagcgagtccaatatcctggacattgatctccggccggcttctgcctggaccctgtacgcggtcgccacaaccttcgtgacgcccatgcttcgccacagcatcgaaaactcctctgttaatgtgagcctgaccgctattgccaaccaggctacagtgctcatgggcctggggaaaggatggcctctgtccaagatggacatcggcgtccccctccttgccatcgggtgttacagccaggttaatcctattaccctgacagctgccctgctcctgcttgtggcgcattatgccatcattggacccggcctgcaagctaaagccaccagagaggctcagaagcgggccgccgcgggcatcatgaaaaaccctacggtggatgggattacagtcatcgacctcgaaccgatcccctacgatcctaagtttgagaagcagctgggacaggtgatgctgctcattctttgcgttacccaagtgctgatgatgcgcacaacctgggctctgtgtgaggccctcaccctggctacaggccccatctctacgctttgggaagggaatcctggaagattctggaacaccacaattgccgtctccatggccaatatctttcggggcagctatctggctggggccggactcctgttctctattatgaaaaacaccacaaatacccgcagaggcacgggcaacatcggggagacactgggagaaaagtggaaatcccggctcaacgcgcttggcaagagcgagtttcagatctacaaaaagtctgggattcaggaggtggaccgcaccctggccaaagaaggaatcaagagaggcgagaccgatcaccatgctgtcagccgggggtccgccaagctgagatggttcgtggaacgcaatatggttacacccgagggaaaagtggtcgacctcggctgcggcagagggggatggtcttattactgtggcgggctgaagaacgtgcgggaagttaaaggacttaccaagggcgggccgggacacgaggagcctattcccatgagcacatatggctggaatctggtgcgcctccaatccggcgtcgatgtgtttttcacgccccctgaaaaatgcgacaccctgctgtgtgatatcggggagagctcccccaaccctacaattgaagctggacggaccctcagagtgcttaatctggttgagaactggctgaataacaatacacagttctgcatcaaggtcctcaacccgtacatgccctctgtgatcgaaaagatggaggccctgcagcgcaaatacggcggggcgcttgtgcggaatcctctgagcagaaactccacccatgagatgtattgggtctctaatgccacgggaaacattgttagctccgtgaatatgatctctcgcatgctcattaaccggtttaccatgaagcacaaaaaggctacatacgaacccgacgtggatctgggcagcgggaccagaaacatcggaattgagtccgaaatccctaatctggacattatcggcaaacgcatcgagaagattaagcaggaacacgagacaagctggcattatgaccaagatcacccctacaaaacctgggcctatcatggctcttacgagacaaagcagaccgggtccgctagctctatggtcaacggagtggttcggctccttacgaaaccgtgggacgtggtccctatggtgacacagatggccatgaccgataccacacccttcggccagcaaagagtttttaaggaaaaagtggacacgcgcacccaggagcctaaggaagggacaaagaaactgatgaagatcaccgctgagtggctgtggaaagagctcggaaagaaaaagacacccagaatgtgtacccgggaagagttcacacgcaaagtcagatccaatgccgcgctgggcgccatttttaccgatgaaaacaagtggaaaagcgctcgggaggccgtggaagacgggagattctgggagcttgtggatcgggagcgcaatctgcacctcgaaggaaaatgcgagacgtgtgtctataacatgatgggcaagagagagaagaagctgggcgagtttgggaaagctaagggatctcgggccatctggtacatgtggctgggcgcccgcttcctcgaatttgaggcgctggggttccttaatgaggaccactggttttccagaggaaacagcctgtccggcgttgaaggggagggcctccatcggctgggatacattcttcgcgatgtgggcaagaaagaagggggagctatgtatgccgacgataccgccggctgggacacaagaatcaccctggaggacctcaagaatgaagagatggtgacaaaccacatgaaaggggagcataagaaactggctgaagccatcttcaagctgacctaccagaataaggtcgtgcgggttcagcgccctacgcccagaggaacagtgatggatattatcagccggcgcgaccaaagaggctctgggcaggtcggcacctatggactcaacacatttaccaatatggaggctcagctgattcggcaaatggaaggcgaggggatcttcaaaagcattcagcaccttacggccaccgaggaaatcgcggtgcagaactggctggcccgcgttggaagagagcggctctccagaatggctatctctggcgatgactgcgtggtcaagccgattgatgaccgcttcgccagcgctctgacagcccttaatgatatggggaaagtgcggaaggacatccagcaatgggaaccttccagaggatggaacgattggacccaggttcccttttgctctcatcacttccacgagctggtgatgaaagacggccgcgtcctcgtggtcccctgtcggaaccaggatgaactgattgggagagcgcgcatcagccagggcgccggatggtccctgaaggagacagcttgcctcggcaagtcttacgcccaaatgtggaccctgatgtattttcatcggagagaccttcgcctggctgccaatgctatttgtagcgccgtgcctccgcactgggttcccacatcccggaccacgtggagcatccatgcgaaacacgagtggatgacaaccgaagatatgctcgccgtgtggaacagagtctggattcaggagaatccttggatggaagacaagacccccgtggagtcttgggaagaggtgccttacctggggaaacgcgaggaccagtggtgcggatcccttatcggcctgacaagccgggctacctgggccaagaacatccagacagccattaatcaagttagatctctcatcgggaacgaagagtatacggattacatgccctccatgaaacggttcagacgcgaagaggaagaggctggagtgctgtggtga

SEQ ID NO: 19786 - RNA, 9876 nt, synthetic construct
  misc_feature 1..9876: note = derived and/or modified CDS sequence (opt5) from DENV-2__JN819416__SS-prME
  source 1..9876: mol_type = other RNA
acagccggagtgatcgtcatgctgattcccacggctatggccttccacctcacgaccagaaatggggagcctcatatgatcgttggacggcaggaaaagggaaaaagcctgctttttaagacagaggacggggtgaatatgtgcaccctgatggcgattgatctcggagaactgtgtgaggacacaatcacctacaaatgcccgcttctgcgccaaaatgaacccgaggatattgactgttggtgcaatagcacatctacctgggtgacgtatggcacctgtacaaccacaggggagcacagacgggaaaagcgcagcgtcgctctcgtgcctcatgttggaatgggcctggagaccagaacggaaacatggatgtcctctgagggcgcctggaaacacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaagaacaggacaaacgctttatctgcaagcattccatggtggatagaggctggggcaacgggtgtggactgttcggcaaagggggaattgtcacatgcgccatgtttacgtgcaaaaagaatatggaaggcaaagttgtgcagcctgagaacctcgaatacaccatcgtgattacaccccacagcggggaggagcatgcggtcggaaatgacaccggcaagcacggcaaagaaatcaagatcacacctcagtcttccattaccgaggccgaactgacggggtatggaaccgtgacaatggagtgtagcccccggaccggccttgatttcaacgaaatggttctgctccaaatggaggacaaggcttggctggtgcaccgccagtggtttcttgatctgccgctcccttggctgcccggggccgacacacagggatctaattggatccagaaggagaccctggtcacgttcaagaaccctcatgctaaaaagcaagacgtggttgtgctcggctcccaggaaggggccatgcacacagccctgaccggcgctacagagattcagatgagctccggaaatcttctgtttaccggccatctcaaatgcagactgcggatggataaacttcaactgaaagggatgtcttacagcatgtgtaccggaaagttcaagatcgtcaaagaaattgcggagacacagcacggcacgatcgtgatcagagtccagtatgagggggacggatccccctgcaagattcccttcgaaatcaccgatctcgagaaacgccatgtgctgggccggctgattacagttaaccctatcgtgaccgaaaaggacagcccggtcaacattgaggccgaacccccttttggggattcttacatcattatcggcgtggagcccggacagctcaaactgaattggttcaagaagggctccagcatcgggcaaatgtttgagacaaccatgagaggagctaaacgcatggccattcttggcgacacggcctgggatttcgggtctctgggaggcgtttttacaagcatcgggaaggctctccaccaggtgttcggcgccatttacggagcggctttttccggcgtctcttggaccatgaaaatcctgattggggtgatcatcacctggattggaatgaacagccggtccacaagcctgtctgtgtcccttgttctcgtcggcgtggtgaccctgtatctgggggccatggtccaggccgacagcggatgtgtggtttcttggaagaataaagaactcaagtgcggctccgggatcttcattacagataacgtgcacacgtggaccgagcagtacaagtttcaacctgaaagcccctccaaactggcttctgccatccagaaggctcatgaggaaggcatttgtggaatcagaagcgtcacacgccttgagaatctgatgtggaaacagatcaccccggagctcaaccacattctgtccgaaaatgaggtgaagctgacaatcatgaccggcgacattaaagggatcatgcaggccggaaagcggtctcttagacctcaacccacggaactcaaatatagctggaagacctggggcaaggcgaaaatgctgtccacagagagccataaccagaccttcctgattgatgggcctgaaacagccgagtgccccaataccaaccgcgcttggaactctctcgaggttgaagactacggatttggcgtgttcacaaccaacatctggctgaaacttcgggagaaacaggacgtcttttgtgattccaagctgatgagcgccgctatcaaagacaatagagccgtgcacgcggatatgggctattggattgaatctgccctcaacgacacgtggaagatggagaaggcttccttcatcgaggttaaaagctgccactggcctaagtctcatacactgtggagcaatggggtgctggaatccgagatgattatccccaaaaacttcgccggaccggtcagccagcacaactaccgccctggctatcatacccaaaccgctgggccctggcaccttggaaagctcgaaatggattttgacctgtgtgagggcacaaccgtggtggtcacggaagattgcgggaatcggggaccctctctgagaacaaccacagcctccggcaaactcattaccgagtggtgctgtcggagctgcacactgcctccgcttcgctacagaggcgaggacgggtgttggtacggaatggaaatccggcccctgaaggagaaggaagagaacctcgttaattccctggtgaccgccggccatgggcagattgataacttctctctgggagtgcttggcatggctctctttctggaagagatgctgagaacgcgcatcgggaccaaacacgcgatcctcctggtcgccgtgagcttcgttacacttattaccggaaatatgtcctttcgggacctgggcagagtgatggtcatggtgggcgctacaatgaccgatgacatcgggatgggagttacgtatctcgccctgctggccgctttcaaggtgcgccctacatttgccgcgggccttctgctcagaaaactgacctctaaggagctcatgatggctacaattgggatcgccctgcttagccagtccaccattcccgaaaccatcctggagctcacagatgccctggctctgggaatgatggtccttaaaatcgtgcggaacatggaaaagtaccaactggccgttacgattatggcgatctcttgcgtgcctaatgctgtcattctccagaacgcctggaaggtgagctgtaccatcctggccgctgtgtccgtcagccccctcctgcttacatcttcccagcagaaagccgactggattcctctggctctcaccatcaagggcctgaatcccacagccatcttcctgaccacgcttagccgcacatctaaaaagagatcctggccgctgaacgaggcgattatggccgttgggatggtgagcatcctcgcttcttccctgctcaaaaatgacattcctatgaccggacccctggtggccggcggccttctgaccgtctgctatgtgctgacagggcggagcgctgatctcgaactggagcgcgccgccgacgttaagtgggaggatcaagctgaaatctccggaagctctcctattcttagcatcaccatttccgaggacggctctatgagcatcaaaaacgaagaggaggaacagacactgacgatcctcattagaaccgggctgctcgtgatctccggagtctttcccgtgtctattccgatcacagcggccgcttggtacctgtgggaggttaagaagcagcgggccggcgtgctttgggatgtcccttctccccctcccgtggaaaaagccgagctggaagacggggcttatcgcattaagcagagaggaatcctgggctactcccaaatcggcgccggggtctataaagagggaaccttccacacaatgtggcatgtgacccggggcgcggttctcatgcaccgcgggaagagaattgagccctcctgggctgatgtgaaaaaggacctgatcagctacggaggcgggtggaaacttgaaggagagtggaaagaaggcgaggaagtccaggtgctggccctcgagcctggcaagaatccgcgggccgttcagacgaaacccgggatttttaagaccaacacaggaaccatcggcgctgtgtccctggatttcagccctgggacatctggatcccccattgtcgacagaaaaggcaaggtggtggggctctacggaaatggcgttgtcacccgcagcggcgcctatgtgtctgcgatcgctcagacagagaagtccatcgaagataaccctgagattgaagacgatatctttcggaaaaagagactgacgattatggaccttcatcccggggccggaaaaaccaagcgctacctgcctgccatcgtgcgggaggctattaaaagaggcctgcgcacactcatcctggccccgacccgggtcgtggctgccgaaatggaggaggcgcttagagggctgcccattcgctatcaaacccctgccatcaagacagaacacacgggacgggagatcgttgacctcatgtgtcatgctaccttcacaatgagactgctcagccccgtgcgggtccctaactacaatctgattatcatggatgaagcccacttcaccgaccccgcttccattgccgcccgcggctatatctctacaagagtggagatgggggaggctgcgggcatttttatgaccgccacgccgcctggaagccgggatcccttcccccagtccaacgctcctatcatggacgaagagagagaaatccccgagagaagctggaactctggccacgaatgggttacagattttaaggggaaaaccgtgtggttcgtcccttccattaaggccggaaacgacatcgccgcttgccttcggaaaaatggcaagaaagtgattcagctgagcagaaagacctttgattctgagtacgttaagacacgcgccaacgactgggatttcgtggtcaccacagacatcagcgagatgggggcgaattttaaagctgaacgggtgattgatccgagacgctgtatgaagcccgtgatcctgaccgacggagaggaacgggtcatcctcgccggccctatgcccgttacgcattcctctgccgctcaaagacgcgggcggattggcagaaaccctaaaaatgagaacgaccagtatatctacatgggagaacccctggagaatgatgaggactgcgcccactggaaggaagcgaaaatgcttctggataacattaatacaccggagggcatcattcctagcatgttcgaacccgagcgcgaaaaggtggacgccatcgatggggagtacagactccggggagaggctcgcaaaacctttgtggacctgatgagacggggcgatctgcctgtctggctcgcctataaggtggctgccgaagggattaactacgctgaccgcaagtggtgtttcgatggaatcaaaaataaccagatccttgaggaaaacatggaggttgagatttggacaaaggaaggcgagcgcaagaagctgaaaccccggtggctggacgccagaatctattccgatcctctcgcgctgaaggaatttaaggagttcgccgctgggcgcaaatctcttaccctgaatctcattacggaaatgggccggctgcccaccttcatgacacagaaggccagaaacgctctggacaatctcgccgtgcttcataccgccgaggctggaggccgcgcgtacaaccacgccctgagcgagctgccggaaacactcgagaccctgcttctgctcacactgctggctaccgtcacagggggaatctttctcttccttatgtccggcaaagggattggaaagatgacactgggcatgtgctgcatcatcaccgccagcattctgctctggtatgcccaaatccagcctcactggattgctgcctctatcattctggaatttttccttatcgtgctgctcatccccgagcccgaaaaacagcggacccctcaggataatcaactgacatacgttgtgattgcgatcctgaccgtcgtggccgctacaatggccaacgagatgggctttctcgagaagacgaagaaagaccttgggctgggatccattaccacacaggaaagcgagtccaatatcctggacattgatctcagaccggcttctgcctggaccctgtatgcggtcgccacaaccttcgtgacgcccatgcttcggcatagcatcgaaaactcctctgttaatgtgagcctgaccgctattgccaaccaggctacagtgctcatgggcctggggaagggatggcctctgtccaaaatggacatcggcgtccccctccttgccatcgggtgttacagccaggttaatcctattaccctgacagctgccctgctcctgcttgtggcgcactacgccatcattggacccggcctgcaagctaaggccacccgcgaggctcagaaaagagccgccgcgggcatcatgaagaaccctacggtggatgggattacagtcatcgacctcgaaccgatcccctatgatcctaagtttgagaaacagctgggacaggtgatgctgctcattctttgcgttacccaagtgctgatgatgcggacaacctgggctctgtgtgaggccctcaccctggctacaggccccatctctacgctttgggaagggaatcctggacgcttctggaacaccacaattgccgtctccatggccaatatctttagaggcagctacctggctggggccggactcctgttctctattatgaagaacaccacaaatacccggcgcggcacgggcaacatcggggagacactgggagaaaaatggaagtccagactcaacgcgcttggcaaaagcgagtttcagatctataagaaatctgggattcaggaggtggaccggaccctggccaaggaaggaatcaagcgcggcgagaccgatcatcacgctgtcagcagagggtccgccaaactgcggtggttcgtggaaagaaatatggttacacccgagggaaaggtggtcgacctcggctgcggccgcgggggatggtcttactattgtggcgggctgaaaaacgtgcgggaagttaagggacttaccaaaggcgggccgggacatgaggagcctattcccatgagcacatacggctggaatctggtgagactccaatccggcgtcgatgtgtttttcacgccccctgaaaagtgcgacaccctgctgtgtgatatcggggagagctcccccaaccctacaattgaagctggacgcaccctccgggtgcttaatctggttgagaactggctgaataacaatacacagttctgcatcaaggtcctcaacccgtatatgccctctgtgatcgagaagatggaggccctgcagagaaagtacggcggggcgcttgtgcgcaatcctctgagccggaactccacccacgagatgtactgggtctctaatgccacgggaaacattgttagctccgtgaatatgatctctagaatgctcattaaccgctttaccatgaaacacaagaaagctacatatgaacccgacgtggatctgggcagcgggacccggaacatcggaattgagtccgaaatccctaatctggacattatcggcaagagaatcgagaagattaaacaggaacatgagacaagctggcactacgaccaagatcatccctataagacctgggcctaccacggctcttatgagacaaaacagaccgggtccgctagctctatggtcaacggagtggttcgcctccttacgaagccgtgggacgtggtccctatggtgacacagatggccatgaccgataccacacccttcggccagcaacgggtttttaaagaaaaggtggacacgagaacccaggagcctaaggaagggaccaagaagctgatgaaaatcaccgctgagtggctgtggaaggagctcggcaaaaagaaaacaccccgcatgtgtaccagagaagagttcacacggaaggtccgctccaatgccgcgctgggcgccatttttaccgatgaaaacaagtggaaaagcgctagagaggccgtggaagactctcggttctgggagcttgtggatagagagcggaatctgcacctcgaagggaagtgcgagacgtgtgtctacaacatgatgggaaaacgcgaaaagaaactgggcgagtttggcaaggctaaggggtccagagccatctggtatatgtggctgggagcccggttcctcgaatttgaggcgctgggcttccttaatgaggaccattggtttagccgcgggaactccctgagcggagttgaaggcgaggggctccacagactgggctacattcttcgggatgtgggcaaaaaggaaggcggggctatgtacgccgacgataccgccggatgggacacacgcatcaccctggaggacctcaaaaatgaagagatggtgacaaaccatatgaagggcgagcacaaaaagctggctgaagccatcttcaagctgacctatcagaataaagtcgtgagagttcagcggcctacgccccgcgggacagtgatggatattatctctagacgggaccaacgcggaagcggccaggtcgggacctacggcctcaacacatttaccaatatggaggctcagctgattagacaaatggaaggagagggcatcttcaagtccattcagcatcttacggccaccgaggaaatcgcggtgcagaactggctggcccgggttgggcgcgagagactctctcggatggctatcagcggagatgactgcgtggtcaaaccgattgatgacagattcgcctccgctctgacagcccttaatgatatgggcaaggtgcgcaaagacatccagcaatgggaaccttctcgggggtggaacgattggacccaggttcccttttgcagccaccacttccatgagctggtgatgaaggacggaagagtcctcgtggtcccctgtcgcaaccaggatgaactgattggccgggcgagaatctcccagggggccggctggtctctgaaggagacagcttgcctcggaaaaagctatgcccaaatgtggaccctgatgtactttcaccgccgggaccttagactggctgccaatgctatttgttccgccgtgcctccgcattgggttcccacaagccgcaccacgtggtctatccacgcgaagcacgagtggatgacaaccgaagatatgctcgccgtgtggaaccgggtctggattcaggagaatccttggatggaagacaaaacccccgtggagtcctgggaagaggtgccttatctgggcaagagagaggaccagtggtgcgggagccttatcggactgacatctcgcgctacctgggccaaaaacatccagacagccattaatcaagttcggtccctcatcggcaacgaagagtacacggattatatgcccagcatgaagagattccggagagaagaggaagaggctggggtgctgtggtga

SEQ ID NO: 19787 - RNA, 9876 nt, synthetic construct
  misc_feature 1..9876: note = derived and/or modified CDS sequence (opt5) from DENV-2__FJ850119__SS-prME
  source 1..9876: mol_type = other RNA
acagccggagtgatcgtcatgctgattcccacggctatggccttccacctcacgaccagaaatggggagcctcatatgatcgttggacggcaggaaaagggcaaaagcctgctttttaagacagaggacgggattaatatgtgcaccctgatggcgatcgatctcggagaactgtgtgaggacacaattacctacaaatgcccgcttctgcgccaaaatgaacccgaggatatcgactgttggtgcaatagcacatctacctgggtgacgtatggcacctgtacaaccacaggggagcacagacgggaaaagcgcagcgtggctctcgtccctcatgtgggaatgggcctggagaccagaacggaaacatggatgtcctctgagggcgcctggaaacacgttcagcggatcgagacctggattctgcgccatcccgggttcacaatcatggccgctattctcgcctacaccatcggaaccacacactttcagagagctctgattttcatccttctgacggccgtggcgcctagcatgaccatgcggtgcattggcatctccaaccgcgattttgtcgaaggggtgtctggaggcagctgggttgacatcgtgctcgagcacgggtcctgtgtcacaaccatggccaagaataagcccacactggatttcgaacttattaaaaccgaggctaagcagcctgccacgctgagaaaatattgcatcgaagctaagctcacaaacaccaccacagagagccggtgtccgacccaaggagagccctctctgaatgaagaacaggacaaacgctttatttgcaagcattccatggtggatagaggctggggcaacgggtgtggactgttcggcaaaggcgggatcgtgacatgcgccatgtttacgtgcaaaaagaatatggaagggaaagtcgttcagcctgagaacctcgaatacaccattgtgatcacaccccacagcggggaggagcatgcggtgggaaatgacaccggcaagcacggcaaagaaatcaagattacacctcagtcttccatcaccgaggccgaactgacggggtatggaaccgtcacaatggagtgtagcccccggaccggccttgatttcaacgaaatggtgctgctccaaatggaggacaaggcttggctggttcaccgccagtggtttcttgatctgccgctcccttggctgcccggggccgacacacagggatctaattggattcagaaggagaccctggtgacgttcaagaaccctcatgctaaaaagcaagacgtcgtggttctcggctcccaggaaggggccatgcacacagccctgaccggcgctacagagatccagatgagctccggaaatcttctgtttaccggccatctcaaatgcagactgcggatggataaacttcaactgaaagggatgtcttacagcatgtgtaccggaaagttcaagattgtgaaagaaatcgcggagacacagcacggcacgatcgtcattagagtgcagtatgagggggacggatccccctgcaagatccccttcgaaattaccgatctcgagaaacgccatgtcctgggccggctgatcacagtgaaccctattgttaccgaaaaggacagcccggtgaacatcgaggccgaacccccttttggggattcttacattatcatcggcgtcgagcccggacagctcaaactgaattggttcaagaagggctccagcattgggcaaatgtttgagacaaccatgagaggagctaaacgcatggccatccttggcgacacggcctgggatttcgggtctctgggaggcgtgtttacaagcattgggaaggctctccaccaggttttcggcgccatctacggagcggctttttccggcgtgtcttggaccatgaaaattctgatcggggtcatcattacctggatcggaatgaacagccggtccacaagcctgtctgtgtcccttgtgctcgttggcgtcgtgaccctgtatctgggggccatggtgcaggccgacagcggatgtgtcgtgtcttggaagaataaagaactcaagtgcggctccgggattttcatcacagataacgttcacacgtggaccgagcagtacaagtttcaacctgaaagcccctccaaactggcttctgccattcagaaggctcatgaggaaggcatctgtggaatcagaagcgtgacacgccttgagaatctgatgtggaaacagattaccccggagctcaaccacatcctgtccgaaaatgaggtcaagctgacaattatgaccggcgacatcaaagggattatgcaggccggaaagcggtctcttagacctcaacccacggaactcaaatatagctggaagacctggggcaaggcgaaaatgctgtccacagagagccataaccagaccttcctgatcgatgggcctgaaacagccgagtgccccaataccaaccgcgcttggaactctctcgaggtggaagactacggatttggcgttttcacaaccaacatctggctgaaacttcgggagaaacaggacgtgttttgtgattccaagctgatgagcgccgctattaaagacaatagagccgtccacgcggatatgggctattggatcgaatctgccctcaacgacacgtggaagatggagaaggcttccttcattgaggtgaaaagctgccactggcctaagtctcatacactgtggagcaatggggttctggaatccgagatgatcattcccaaaaacttcgccggaccggtgagccagcacaactaccgccctggctatcatacccaaaccgctgggccctggcaccttggaaagctcgaaatggattttgacctgtgtgagggcacaaccgtcgtggtgacggaagattgcgggaatcggggaccctctctgagaacaaccacagcctccggcaaactcatcaccgagtggtgctgtcggagctgcacactgcctccgcttcgctacagaggcgaggacgggtgttggtacggaatggaaattcggcccctgaaggagaaggaagagaacctcgtcaattccctggttaccgccggccatgggcagatcgataacttctctctgggagtgcttggcatggctctctttctggaagagatgctgagaacgcgcatcgggaccaaacacgcgattctcctggtggccgtcagcttcgtgacacttatcaccggaaatatgtcctttcgggacctgggcagagttatggtgatggtcggcgctacaatgaccgatgacattgggatgggagtgacgtatctcgccctgctggccgctttcaaggttcgccctacatttgccgcgggccttctgctcagaaaactgacctctaaggagctcatgatggctacaatcgggattgccctgcttagccagtccaccatccccgaaaccatcctggagctcacagatgccctggctctgggaatgatggtgcttaaaattgtccggaacatggaaaagtaccaactggccgtgacgatcatggcgatttcttgcgttcctaatgctgtgatcctccagaacgcctggaaggtcagctgtaccattctggccgctgtgtccgtgagccccctcctgcttacatcttcccagcagaaagccgactggatccctctggctctcaccatcaagggcctgaatcccacagccattttcctgaccacgcttagccgcacatctaaaaagagatcctggccgctgaacgaggcgatcatggccgtcgggatggttagcattctcgcttcttccctgctcaaaaatgacatccctatgaccggacccctggtggccggcggccttctgaccgtgtgctatgtcctgacagggcggagcgctgatctcgaactggagcgcgccgccgacgtgaagtgggaggatcaagctgaaatttccggaagctctcctatccttagcattaccatctccgaggacggctctatgagcatcaaaaacgaagaggaggaacagacactgacgattctcatcagaaccgggctgctcgttatttccggagtgtttcccgtctctatcccgattacagcggccgcttggtacctgtgggaggtgaagaagcagcgggccggcgttctttgggatgtgccttctccccctcccgtcgaaaaagccgagctggaagacggggcttatcgcatcaagcagagaggaatcctgggctactcccaaattggcgccggggtgtataaagagggaaccttccacacaatgtggcatgtcacccggggcgcggtgctcatgcaccgcgggaagagaatcgagccctcctgggctgatgttaaaaaggacctgattagctacggaggcgggtggaaacttgaaggagagtggaaagaaggcgaggaagtgcaggtcctggccctcgagcctggcaagaatccgcgggccgtgcagacgaaacccgggatctttaagaccaacacaggaaccattggcgctgtttccctggatttcagccctgggacatctggatcccccatcgtggacagaaaaggcaaggtcgtggggctctacggaaatggcgtggttacccgcagcggcgcctatgtctctgcgatcgctcagacagagaagtccattgaagataaccctgagatcgaagacgatatttttcggaaaaagagactgacgatcatggaccttcatcccggggccggaaaaaccaagcgctacctgcctgccattgtgcgggaggctatcaaaagaggcctgcgcacactcattctggccccgacccgggtggtcgctgccgaaatggaggaggcgcttagagggctgcccatccgctatcaaacccctgccatcaagacagaacacacgggacgggagattgtggacctcatgtgtcatgctaccttcacaatgagactgctcagccccgttcgggtgcctaactacaatctgatcattatggatgaagcccacttcaccgaccccgcttccatcgccgcccgcggctatatttctacaagagtcgagatgggggaggctgcgggcatctttatgaccgccacgccgcctggaagccgggatcccttcccccagtccaacgctcctatcatggacgaagagagagaaattcccgagagaagctggaactctggccacgaatgggtgacagattttaaggggaaaaccgtttggttcgtgccttccatcaaggccggaaacgacattgccgcttgccttcggaaaaatggcaagaaagtcatccagctgagcagaaagacctttgattctgagtacgtgaagacacgcgccaacgactgggatttcgttgtgaccacagacattagcgagatgggggcgaattttaaagctgaacgggtcatcgatccgagacgctgtatgaagcccgtgatcctgaccgacggagaggaacgggtgattctcgccggccctatgcccgtcacgcattcctctgccgctcaaagacgcgggcggatcggcagaaaccctaaaaatgagaacgaccagtatatttacatgggagaacccctggagaatgatgaggactgcgcccactggaaggaagcgaaaatgcttctggataacatcaatacaccggagggcattatccctagcatgttcgaacccgagcgcgaaaaggttgacgccattgatggggagtacagactccggggagaggctcgcaaaacctttgtggacctgatgagacggggcgatctgcctgtgtggctcgcctataaggtcgctgccgaagggatcaactacgctgaccgcaagtggtgtttcgatggaatcaaaaataaccagattcttgaggaaaacatggaggtggagatctggacaaaggaaggcgagcgcaagaagctgaaaccccggtggctggacgccagaatttattccgatcctctcgcgctgaaggaatttaaggagttcgccgctgggcgcaaatctcttaccctgaatctcatcacggaaatgggccggctgcccaccttcatgacacagaaggccagaaacgctctggacaatctcgccgttcttcataccgccgaggctggaggccgcgcgtacaaccacgccctgagcgagctgccggaaacactcgagaccctgcttctgctcacactgctggctaccgtgacagggggaatttttctcttccttatgtccggcaaagggatcggaaagatgacactgggcatgtgctgcatcattaccgccagcatcctgctctggtatgcccaaattcagcctcactggatcgctgcctctattatcctggaatttttccttatcgtcctgctcattcccgagcccgaaaaacagcggacccctcaggataatcaactgacatacgtggttatcgcgattctgaccgtggtcgccgctacaatggccaacgagatgggctttctcgagaagacgaagaaagaccttgggctgggatccatcaccacacaggaaagcgagtccaatattctggacatcgatctcagaccggcttctgcctggaccctgtatgcggtggccacaaccttcgtcacgcccatgcttcggcatagcattgaaaactcctctgtgaatgttagcctgaccgctatcgccaaccaggctacagtgctcatgggcctggggaagggatggcctctgtccaaaatggacatcggcgtgcccctccttgccattgggtgttacagccaggtcaatcctatcaccctgacagctgccctgctcctgcttgttgcgcactacgccattatcggacccggcctgcaagctaaggccacccgcgaggctcagaaaagagccgccgcgggcattatgaagaaccctacggtggatgggatcacagtgatcgacctcgaaccgattccctatgatcctaagtttgagaaacagctgggacaggtcatgctgctcatcctttgcgtgacccaagttctgatgatgcggacaacctgggctctgtgtgaggccctcaccctggctacaggccccatttctacgctttgggaagggaatcctggacgcttctggaacaccacaatcgccgtgtccatggccaatatttttagaggcagctacctggctggggccggactcctgttctctatcatgaagaacaccacaaatacccggcgcggcacgggcaacatcggggagacactgggagaaaaatggaagtccagactcaacgcgcttggcaaaagcgagtttcagatttataagaaatctgggatccaggaggtcgaccggaccctggccaaggaaggaattaagcgcggcgagaccgatcatcacgctgtgagcagagggtccgccaaactgcggtggttcgtcgaaagaaatatggtgacacccgagggaaaggttgtggacctcggctgcggccgcgggggatggtcttactattgtggcgggctgaaaaacgtccgggaagtgaagggacttaccaaaggcgggccgggacatgaggagcctatccccatgagcacatacggctggaatctggttagactccaatccggcgtggatgtctttttcacgccccctgaaaagtgcgacaccctgctgtgtgatattggggagagctcccccaaccctacaatcgaagctggacgcaccctccgggtgcttaatctggtggagaactggctgaataacaatacacagttctgcatcaaggttctcaacccgtatatgccctctgtcattgagaagatggaggccctgcagagaaagtacggcggggcgcttgtgcgcaatcctctgagccggaactccacccacgagatgtactgggtgtctaatgccacgggaaacatcgtcagctccgttaatatgatttctagaatgctcatcaaccgctttaccatgaaacacaagaaagctacatatgaacccgacgtggatctgggcagcgggacccggaacattggaatcgagtccgaaattcctaatctggacatcatcggcaagagaattgagaagatcaaacaggaacatgagacaagctggcactacgaccaagatcatccctataagacctgggcctaccacggctcttatgagacaaaacagaccgggtccgctagctctatggtgaacggagtcgtgcgcctccttacgaagccgtgggacgttgtgcctatggtcacacagatggccatgaccgataccacacccttcggccagcaacgggtgtttaaagaaaaggttgacacgagaacccaggagcctaaggaagggaccaagaagctgatgaaaattaccgctgagtggctgtggaaggagctcggcaaaaagaaaacaccccgcatgtgtaccagagaagagttcacacggaaggtgcgctccaatgccgcgctgggcgccatctttaccgatgaaaacaagtggaaaagcgctagagaggccgtcgaagacgggcggttctgggagcttgtggatagagagcggaatctgcacctcgaaggaaagtgcgagacgtgtgtgtacaacatgatgggcaaacgcgaaaagaaactgggcgagtttgggaaggctaagggatctagagccatttggtatatgtggctgggcgcccggttcctcgaatttgaggcgctggggttccttaatgaggaccattggttttcccgcggaaacagcctgtccggcgtcgaaggggagggcctccacagactgggatacatccttcgggatgttggcaaaaaggaagggggagctatgtacgccgacgataccgccggctgggacacacgcatcaccctggaggacctcaaaaatgaagagatggtgacaaaccatatgaagggggagcacaaaaagctggctgaagccattttcaagctgacctatcagaataaagtggtcagagtgcagcggcctacgccccgcggaacagttatggatatcattagcagacgggaccaacgcggctctggacaggtgggcacctacggactcaacacatttaccaatatggaggctcagctgatcagacaaatggaaggcgaggggattttcaagagcatccagcatcttacggcctccgaggaaaccgcggtccagaactggctggcccgggtgggacgcgagagactctctcggatggctatcagcggcgatgactgcgttgtgaaaccgattgatgacagattcgcctccgctctgacagcccttaatgatatggggaaggtccgcaaagacatccagcaatgggaaccttctcggggatggaacgattggacccaggtgcccttttgcagccaccacttccatgagctggttatgaaggacggcagagtgctcgtcgtgccctgtcgcaaccaggatgaactgattgggcgggcgagaatctcccagggcgccggatggtctctgaaggagacagcttgcctcggcaaaagctatgcccaaatgtggaccctgatgtactttcaccgccgggaccttagactggctgccaatgctatttgttccgccgtccctccgcattgggtgcccacaagccgcaccacgtggtctatccacgcgaagcacgagtggatgacaaccgaagatatgctcgccgtttggaaccgggtgtggattcaggagaatccttggatggaagacaaaacccccgtcgagtcctgggaagaggtgccttatctggggaagagagaggaccagtggtgcggaagccttatcggcctgacatctcgcgctacctgggccaaaaacatccagacagccattaatcaagtgcggtccctcatcgggaacgaagagtacacggattatatgcccagcatgaagagattccggagagaagaggaagaggctggagttctgtggtga

SEQ ID NO: 19788 - RNA, 9876 nt, synthetic construct
  misc_feature 1..9876: note = derived and/or modified CDS sequence (opt5) from DENV-2__FJ850064__SS-prME
  source 1..9876: mol_type = other RNA
acagccggagtgatcgtcatgctgattcccacggctatggccttccacctcacgaccagaaatggggagcctcatatgatcgttggacggcaggaaaagggcaaaagcctgctttttaagacagaggacggggtgaatatgtgcaccctgatggcgattgatctcggagaactgtgtgaggacacaatcacctacaaatgcccgcttctgagacaaaatgaacccgaggatattgactgttggtgcaatagcacatctacctgggtgacgtatggcacctgtacaaccacaggggagcacagacgggaaaagcgcagcgtcgctctcgtgcctcatgttggaatgggcctggagaccagaacggaaacatggatgtcctctgagggcgcctggaaacacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaggaacaggacaaacgctttatctgcaagcattccatggtggatagaggctggggcaacgggtgtggactgttcggcaaaggcgggattgtcacatgcgccatgtttacgtgcaaaaagaatatggaagggaaagttgtgcagcctgagaacctcgaatacaccatcgtgattacaccccacagcggggaggagcatgcggtcggaaatgacaccggcaagcacggcaaagaaatcaagatcacacctcagtcttccattaccgaggccgaactgacggggtatggaaccgtgacaatggagtgtagcccccggaccggccttgatttcaacgaaatggttctgctccaaatggaggacaaggcttggctggtgcaccgccagtggtttcttgatctgccgctcccttggctgcccggggccgacacacagggatctaattggatccagaaggagaccctggtcacgttcaagaaccctcatgctaaaaagcaagacgtggttgtgctcggctcccaggaaggggccatgcacacagccctgaccggcgctacagagattcagatgagctccggaaatcttctgtttaccggccatctcaaatgcagactgcggatggataaacttcaactgaaagggatgtcttacagcatgtgtaccggaaagttcaagatcgtcaaagaaattgcggagacacagcacggcacgatcgtgatcagagtccagtatgagggggacggatccccctgcaagattcccttcgaaatcaccgatctcgagaaacgccatgtgctgggccggctgattacagttaaccctatcgtgaccgaaaaggacagcccggtcaacattgaggccgaacccccttttggggattcttacatcattatcggcgtggagcccggacagctcaaactgaattggttcaagaagggctccagcatcgggcaaatgtttgctacaaccatgagaggagccaaacgcatggccattcttggcgacacggcttgggatttcgggtctctgggaggcgtttttacaagcatcgggaaggccctccaccaggtgttcggcgcgatttacggagctgccttttccggcgtctcttggaccatgaaaatcctgattggggtgatcatcacctggattggaatgaacagccggtccacaagcctgtctgtgtcccttgttctcgtcggcgtggtgaccctgtatctgggggccatggtccaggctgacagcggatgtgtggtttcttggaagaataaagagctcaagtgcggctccgggatcttcattacagataacgtgcacacgtggaccgaacagtacaagtttcaacctgagagcccctccaaactggcctctgctatccagaaggcccatgaagagggcatttgtggaatcagaagcgtcacacgccttgaaaatctgatgtggaaacagatcaccccggagctcaaccacattctgtccgagaatgaagtgaagctgacaatcatgaccggcgacattaaagggatcatgcaggcgggaaagcggtctcttagacctcaacccacggagctcaaatatagctggaagacctggggcaaggccaaaatgctgtccacagaaagccataaccagaccttcctgattgatgggcctgagacagctgaatgccccaataccaaccgcgcctggaactctctcgaggttgaggactacggatttggcgtgttcacaaccaacatctggctgaaacttcgggaaaaacaggacgtcttttgtgattccaagctgatgagcgctgccatcaaagacaatagagcggtgcacgccgatatgggctattggattgagtctgctctcaacgacacgtggaagatggaaaaggcctccttcatcgaggttaaaagctgccactggcctaagtctcatacactgtggagcaatggggtgctggagtccgaaatgattatccccaaaaacttcgctggaccggtcagccagcacaactaccgccctggctatcatacccaaaccgccgggccctggcaccttggaaagctcgagatggattttgacctgtgtgaaggcacaaccgtggtggtcacggaggattgcgggaatcggggaccctctctgagaacaaccacagcctccggcaaactcattaccgaatggtgctgtcggagctgcacactgcctccgcttcgctacagaggcgaggacgggtgttggtacggaatggagatccggcccctgaaggaaaaggaggaaaacctcgttaattccctggtgaccgctggccatgggcagattgataacttctctctgggagtgcttggcatggcgctctttctggaggaaatgctgagaacgcgcatcgggaccaaacacgccatcctcctggtcgctgtgagcttcgttacacttattaccggaaatatgtcctttcgggacctgggcagagtgatggtcatggtgggcgccacaatgaccgatgacatcgggatgggagttacgtatctcgccctgctggctgccttcaaggtgcgccctacatttgcggctggccttctgctcagaaaactgacctctaaggagctcatgatggccacaattgggatcgccctgcttagccagtccaccattcccgagaccatcctggaactcacagatgctctggccctgggaatgatggtccttaaaatcgtgcggaacatggagaagtaccaactggcggttacgattatggctatctcttgcgtgcctaatgccgtcattctccagaacgcctggaaggtgagctgtaccatcctggctgccgtgtccgtcagccccctcctgcttacatcttcccagcagaaagctgactggattcctctggccctcaccatcaagggcctgaatcccacagcgatcttcctgaccacgcttagccgcacatctaaaaagagatcctggccgctgaacgaagccattatggctgttgggatggtgagcatcctcgcctcttccctgctcaaaaatgacattcctatgaccggacccctggtggctggcggccttctgaccgtctgctatgtgctgacagggcggagcgccgatctcgagctggaacgcgccgctgacgttaagtgggaggatcaagcggagatctccggaagctctcctattcttagcatcaccatttccgaagacggctctatgagcatcaaaaacgaggaagaggagcagacactgacgatcctcattagaaccgggctgctcgtgatctccggagtctttcccgtgtctattccgatcacagccgctgcctggtacctgtgggaagttaagaagcagcgggccggcgtgctttgggatgtcccttctccccctcccgtggagaaagctgaactggaggacggggcctatcgcattaagcagagaggaatcctgggctactcccaaatcggcgcgggggtctataaagaaggaaccttccacacaatgtggcatgtgacccggggcgctgttctcatgcaccgcgggaagagaattgagccctcctgggccgatgtgaaaaaggacctgatcagctacggaggcgggtggaaacttgagggagaatggaaagagggcgaagaggtccaggtgctggccctcgaacctggcaagaatccgcgggctgttcagacgaaacccgggatttttaagaccaacacaggaaccatcggcgccgtgtccctggatttcagccctgggacatctggatcccccattgtcgacagaaaaggcaaggtggtggggctctacggaaatggcgttgtcacccgcagcggcgcgtatgtgtctgctatcgcccagacagagaagtccatcgaggataaccctgaaattgaggacgatatctttcggaaaaagagactgacgattatggaccttcatcccggggccggaaaaaccaagcgctacctgcctgctatcgtgcgggaagccattaaaagaggcctgcgcacactcatcctggctccgacccgggtcgtggccgcggagatggaagaggcccttagagggctgcccattcgctatcaaacccctgctatcaagacagagcacacgggacgggaaatcgttgacctcatgtgtcatgccaccttcacaatgagactgctcagccccgtgcgggtccctaactacaatctgattatcatggatgaggctcacttcaccgaccccgcctccattgccgctcgcggctatatctctacaagagtggaaatgggggaggcggccggcatttttatgaccgctacgccgcctggaagccgggatcccttcccccagtccaacgcccctatcatggacgaggaacgcgagatccccgaaagaagctggaactctggccacgagtgggttacagattttaaggggaaaaccgtgtggttcgtcccttccattaaggccggaaacgacatcgctgcctgccttcggaaaaatggcaagaaagtgattcagctgagcagaaagacctttgattctgaatacgttaagacacgcgcgaacgactgggatttcgtggtcaccacagacatcagcgagatgggggctaattttaaagccgagcgggtgattgatccgagacgctgtatgaagcccgtgatcctgaccgacggagaagaacgggtcatcctcgccggccctatgcccgttacgcattcctctgctgcccaaagacgcgggcggattggcagaaaccctaaaaatgaaaacgaccagtatatctacatgggagagcccctggaaaatgatgaggactgcgcgcactggaaggaggccaaaatgcttctggataacattaatacaccggaaggcatcattcctagcatgttcgagcccgaacgcgagaaggtggacgctatcgatggggaatacagactccggggagaggcccgcaaaacctttgtggacctgatgagacggggcgatctgcctgtctggctcgcttataaggtggccgctgaggggattaactacgccgaccgcaagtggtgtttcgatggaatcaaaaataaccagatccttgaagagaacatggaagttgagatttggacaaaggagggcgaacgcaagaagctgaaaccccggtggctggacgcgagaatctattccgatcctctcgccctgaaggagtttaaggagttcgctgccgggcgcaaatctcttaccctgaatctcattacggagatgggccggctgcccaccttcatgacacagaaggctagaaacgccctggacaatctcgccgtgcttcataccgctgaagcgggaggccgcgcctacaaccacgctctgagcgagctgccggagacactcgaaaccctgcttctgctcacactgctggccaccgtcacagggggaatctttctcttccttatgtccggcaaagggattggaaagatgacactgggcatgtgctgcatcatcaccgccagcattctgctctggtatgctcaaatccagcctcactggattgccgcgtctatcattctggagtttttccttatcgtgctgctcatccccgaacccgagaaacagcggacccctcaggataatcaactgacatacgttgtgattgccatcctgaccgtcgtggctgccacaatggctaacgaaatgggctttctcgagaagacgaagaaagaccttgggctgggatccattaccacacaggagagcgaatccaatatcctggacattgatctcagaccggcctctgcgtggaccctgtatgccgtcgctacaaccttcgtgacgcccatgcttcggcatagcatcgagaactcctctgttaatgtgagcctgaccgccattgctaaccaggccacagtgctcatgggcctggggaagggatggcctctgtccaaaatggacatcggcgtccccctccttgctatcgggtgttacagccaggttaatcctattaccctgacagccgcgctgctcctgcttgtggcccactacgctatcattggacccggcctgcaagccaaggctacccgcgaagcccagaaaagagccgcggctggcatcatgaagaaccctacggtggatgggattacagtcatcgacctcgagccgatcccctatgatcctaagtttgaaaaacagctgggacaggtgatgctgctcattctttgcgttacccaagtgctgatgatgcggacaacctgggccctgtgtgaggctctcaccctggccacaggccccatctctacgctttgggaggggaatcctggacgcttctggaacaccacaattgccgtctccatggctaatatctttagaggcagctacctggccggggcgggactcctgttctctattatgaagaacaccacaaatacccggcgcggcacgggcaacatcggggaaacactgggagagaaatggaagtccagactcaacgcccttggcaaaagcgaatttcagatctataagaaatctgggattcaggaggtggaccggaccctggctaaggagggaatcaagcgcggcgaaaccgatcatcacgccgtcagcagagggtccgctaaactgcggtggttcgtggagagaaatatggttacacccgaaggaaaggtggtcgacctcggctgcggccgcgggggatggtcttactattgtggcgggctgaaaaacgtgcgggaggttaagggacttaccaaaggcgggccgggacatgaggaacctattcccatgagcacatacggctggaatctggtgagactccaatccggcgtcgatgtgtttttcacgccccctgagaagtgcgacaccctgctgtgtgatatcggggaaagctcccccaaccctacaattgaggccggacgcaccctccgggtgcttaatctggttgaaaactggctgaataacaatacacagttctgcatcaaggtcctcaacccgtatatgccctctgtgatcgagaaaatggaagcgctgcagagaaagtacggcggggcccttgtgcgcaatcctctgagccggaactccacccacgagatgtactgggtctctaatgctacgggaaacattgttagctccgtgaatatgatctctagaatgctcattaaccgctttaccatgaaacacaagaaagccacatatgagcccgacgtggatctgggcagcgggacccggaacatcggaattgaatccgaggtccctaatctggacatcattggcaagagaatcgaaaagatcaaacaggagcatgaaacaagctggcactacgaccaagatcatccctataagacctgggcttaccacggctcttatgagacaaaacagaccgggtccgccagctctatggtgaacggagttgtgcgcctccttacgaagccgtgggacgtcgtgcctatggttacacagatggctatgaccgataccacacccttcggccagcaacgggtgtttaaagagaaggtcgacacgagaacccaggaacctaaggaggggaccaagaagctgatgaaaattaccgccgaatggctgtggaaggagctcggcaagaagaaaacaccccgcatgtgtaccagagaggagttcacacggaaggtgcgctccaatgcggccctgggcgctatctttaccgatgagaacaagtggaaaagcgccagagaagctgtggaggacgggcggttctgggaacttgtcgatagagagcggaatctgcacctcgagggaaagtgcgaaacgtgtgtttacaacatgatgggcaaacgcgagaagaaactgggcgaatttgggaaggccaagggatctagagccatttggtatatgtggctgggcgcgcggttcctcgagtttgaagctctggggttccttaatgaggaccattggttttcccgcggaaacagcctgtccggcgtggagggggaaggcctccacagactgggatacatccttcgggatgtgggcaaaaaggaagggggagccatgtacgccgacgataccgctggctgggacacacgcattaccctggaagacctcaaaaatgaggaaatggtcacaaaccatatgaagggggagcacaaaaagctggccgaggctatcttcaagctgacctatcagaataaagtggttagagtgcagcggcctacgccccgcggaacagtcatggatatcattagcagacgggaccaacgcggctctggacaggtgggcacctacggactcaacacatttaccaatatggaagcccagctgatcagacaaatggagggcgaagggattttcaagagcatccagcatcttacggcgaccgaggagattgccgttcagaactggctggctcgggtgggacgcgaaagactctcccggatggccatctctggcgatgactgcgtcgtgaaaccgatcgatgacagattcgctagcgccctgacagcgcttaatgatatggggaaggttcgcaaagacattcagcaatgggagccttcccggggatggaacgattggacccaggtgcccttttgctctcaccacttccatgaactggtcatgaaggacggcagagtgctcgtcgtgccctgtcgcaaccaggatgagctgatcgggcgggccagaattagccagggcgctggatggtccctgaaggaaacagcctgcctcggcaaatcttatgctcaaatgtggaccctgatgtactttcaccgccgggaccttagactggccgctaatgccatctgtagcgcggttcctccgcattgggtgcccacatcccgcaccacgtggagcattcacgccaagcacgagtggatgacaaccgaggatatgctcgctgtctggaaccgggtgtggatccaggaaaatccttggatggaggacaaaacccccgtggaatcttgggaggaagttccttatctggggaagagagaggaccagtggtgcggatcccttattggcctgacaagccgcgccacctgggccaaaaacatccagacagctatcaatcaagtgcggtctctcattgggaacgaggaatacacggattatatgccctccatgaagagattccggagagaggaagaggaagccggagtcctgtggtga

SEQ ID NO: 19789 - RNA, 9876 nt, synthetic construct
  misc_feature 1..9876: note = derived and/or modified CDS sequence (opt5) from DENV-2__FJ850065__SS-prME
  source 1..9876: mol_type = other RNA
accgccggagtgatcgtcatgctgattcccacagctatggccttccacctcacgaccagaaatggggagcctcatatgatcgttggacggcaggaaaagggcaagagcctgctttttaagacagaggacggggtgaatatgtgcaccctgatggcgattgatctcggagaactgtgtgaggacacaatcacctacaaatgcccgcttctgcgccaaaatgaacccgaggatattgactgttggtgcaatagcacatctacctgggtgacgtatggcacctgtacaaccacaggggagcacagacgggaaaagcgcagcgtcgctctcgtgcctcatgttggaatgggcctggagaccagaacggaaacatggatgtcctctgagggcgcctggaaacacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcacagaagctaagctcaccaacaccacaaccgagagccggtgtccgacacaaggagagccctctctgaatgaggaacaggacaaacgctttatttgcaagcattccatggtggatagaggctggggcaacgggtgtggactgttcggcaaagggggaatcgtcacgtgcgccatgtttacctgcaaaaagaatatggaaggcaaagttgtgcagcctgagaacctcgaatacacaattgtgatcacaccccacagcggggaggagcatgcggtcggaaatgacacaggcaagcacggcaaagaaattaagatcacccctcagtcttccatcacggaggccgaactgaccgggtatggaacagtgaccatggagtgtagcccccggacaggccttgatttcaacgaaatggttctgctccaaatggaggacaaggcttggctggtgcaccgccagtggtttcttgatctgccgctcccttggctgcccggggccgacacccagggatctaattggattcagaaggagacgctggtcacattcaagaaccctcatgctaaaaagcaagacgtggttgtgctcggctcccaggaaggggccatgcacaccgccctgacaggcgctaccgagatccagatgagctccggaaatcttctgtttaccggccatctcaaatgcagactgcggatggataaacttcaactgaaagggatgtcttacagcatgtgtacaggaaagttcaagattgtcaaagaaatcgcggagacgcagcacggcaccattgtgatcagagtccagtatgagggggacggatccccctgcaagatccccttcgaaattacagatctcgagaaacgccatgtgctgggccggctgatcaccgttaaccctattgtgacagaaaaggacagcccggtcaacatcgaggccgaacccccttttggggattcttacattatcattggcgtggagcccggacagctcaaactgaattggttcaagaagggctccagcatcgggcaaatgtttgagaccacgatgagaggagctaaacgcatggccatccttggcgacacagcctgggatttcgggtctctgggaggcgtttttaccagcattgggaaggctctccaccaggtgttcggcgccatctacggagcggctttttccggcgtctcttggaccatgaaaattctgatcggggtgattatcacatggatcggaatgaacagccggtccaccagcctgtctgtgtcccttgttctcgtcggcgtggtgacactgtatctgggggccatggtccaggccgacagcggatgtgtggtttcttggaagaataaagaactcaagtgcggctccgggattttcatcacggataacgtgcacacctggacagagcagtacaagtttcaacctgaaagcccctccaaactggcttctgccattcagaaggctcatgaggaaggcatctgtggaattagaagcgtcacccgccttgagaatctgatgtggaaacagatcacaccggagctcaaccacatcctgtccgaaaatgaggtgaagctgaccattatgacgggcgacatcaaagggattatgcaggccggaaagcggtctcttagacctcaacccaccgaactcaaatatagctggaagacatggggcaaggcgaaaatgctgtccaccgagagccataaccagacattcctgatcgatgggcctgaaaccgccgagtgccccaatacaaaccgcgcttggaactctctcgaggttgaagactacggatttggcgtgttcaccacgaacatttggctgaaacttcgggagaaacaggacgtcttttgtgattccaagctgatgagcgccgctatcaaagacaatagagccgtgcacgcggatatgggctattggatcgaatctgccctcaacgacacatggaagatggagaaggcttccttcattgaggttaaaagctgccactggcctaagtctcataccctgtggagcaatggggtgctggaatccgagatgatcattcccaaaaacttcgccggaccggtcagccagcacaactaccgccctggctatcatacccaaacagctgggccctggcaccttggaaagctcgaaatggattttgacctgtgtgagggcaccacggtggtggtcacagaagattgcgggaatcggggaccctctctgagaaccacaaccgcctccggcaaactcatcacagagtggtgctgtcggagctgcaccctgcctccgcttcgctacagaggcgaggacgggtgttggtacggaatggaaattcggcccctgaaggagaaggaagagaacctcgttaattccctggtgacggccggccatgggcagatcgataacttctctctgggagtgcttggcatggctctctttctggaagagatgctgagaacccgcattgggacaaaacacgcgatcctcctggtcgccgtgagcttcgttacccttatcacaggaaatatgtcctttcgggacctgggcagagtgatggtcatggtgggcgctaccatgacggatgacattgggatgggagttacatatctcgccctgctggccgctttcaaggtgcgccctacctttgccgcgggccttctgctcagaaaactgacatctaaggagctcatgatggctaccatcgggattgccctgcttagccagtccaccatccccgaaacaattctggagctcacggatgccctggctctgggaatgatggtccttaaaatcgtgcggaacatggaaaagtaccaactggccgttaccatcatggcgatttcttgcgtgcctaatgctgtcatcctccagaacgcctggaaggtgagctgtacaattctggccgctgtgtccgtcagccccctcctgcttacctcttcccagcagaaagccgactggatccctctggctctcacaattaagggcctgaatcccaccgccatcttcctgacgacacttagccgcacctctaaaaagagatcctggccgctgaacgaggcgatcatggccgttgggatggtgagcattctcgcttcttccctgctcaaaaatgacatccctatgaccggacccctggtggccggcggccttctgacagtctgctatgtgctgaccgggcggagcgctgatctcgaactggagcgcgccgccgacgttaagtgggaggatcaagctgaaatttccggaagctctcctatccttagcattacaatctccgaggacggctctatgagcattaaaaacgaagaggaggaacagacgctgaccatcctcatcagaacagggctgctcgtgatttccggagtctttcccgtgtctatcccgattaccgcggccgcttggtacctgtgggaggttaagaagcagcgggccggcgtgctttgggatgtcccttctccccctcccgtggaaaaagccgagctggaagacggggcttatcgcatcaagcagagaggcattctgggatactcccaaatcggcgccggggtctataaagagggaacattccacaccatgtggcatgtgacgcggggcgcggttctcatgcaccgcgggaagagaatcgagccctcctgggctgatgtgaaaaaggacctgattagctacggaggcgggtggaaacttgaaggagagtggaaagaaggcgaggaagtccaggtgctggccctcgagcctggcaagaatccgcgggccgttcagaccaaacccgggatctttaagacaaacaccggaacaattggcgctgtgtccctggatttcagccctgggacctctggatcccccatcgtcgacagaaaaggcaaggtggtggggctctacggaaatggcgttgtcacacgcagcggcgcctatgtgtctgcgattgctcagacggagaagtccatcgaagataaccctgagatcgaagaggacatttttcggaaaaagagactgaccatcatggatcttcatcccggggccggaaaaacaaagcgctacctgcctgccattgtgcgggaagctatcaaaagaggcctgcgcaccctcattctggccccgacccgggtcgtggctgccgagatggaggaagcgcttagagggctgcccatccgctatcaaacccctgccattaagacggagcacaccggacgggaaatcgttgacctcatgtgtcatgctacattcaccatgagactgctcagccccgtgcgggtccctaactacaatctgatcattatggacgaggcccacttcacagatcccgcttccatcgccgcccgcggctatatttctaccagagtggagatgggggaagctgcgggcatctttatgacggccacaccgcctggaagccgggaccccttcccccagtccaacgctcctattatggatgaggaacgcgagatccccgaaagaagctggaactctggccacgagtgggttaccgactttaaggggaaaaccgtgtggttcgtcccttccatcaaggccggaaacgatattgccgcttgccttcggaaaaatggcaagaaagtgatccagctgagcagaaagacatttgactctgagtacgttaagacccgcgccaacgattgggacttcgtggtcacaaccgatattagcgaaatgggggcgaattttaaagctgagcgggtgatcgacccgagacgctgtatgaagcccgtgattctgacggatggagaagaacgggtcatcctcgccggccctatgcccgttacacattcctctgccgctcaaagacgcgggcggatcggcagaaaccctaaaaatgaaaacgaccagtatatttacatgggagagcccctggagaatgacgaagattgcgcccactggaaggaggcgaaaatgcttctggacaacatcaataccccggaaggcattatccctagcatgttcgagcccgaacgcgagaaggtggatgccattgacggggagtacagactccggggagaagctcgcaaaacatttgtggatctgatgagacggggcgacctgcctgtctggctcgcctataaggtggctgccgaggggatcaactacgctgatcgcaagtggtgtttcgacggaattaaaaataaccagatccttgaagagaacatggaggttgaaatctggaccaaggagggcgaacgcaagaagctgaaaccccggtggctggatgccagaatttattccgaccctctcgcgctgaaggagtttaaggagttcgccgctgggcgcaaatctcttacgctgaatctcatcaccgagatgggccggctgcccacattcatgacccagaaggccagaaacgctctggataatctcgccgtgcttcatacagccgaggctggaggccgcgcgtacaaccacgccctgagcgaactgccggagaccctcgaaacactgcttctgctcaccctgctggctacggtcacagggggaatttttctcttccttatgtccggcaaagggatcggaaagatgaccctgggcatgtgctgcattatcaccgccagcatcctgctctggtatgcccaaattcagcctcactggatcgctgcctctattatcctggagtttttccttattgtgctgctcatccccgaacccgagaaacagcggacacctcaggacaatcaactgacctacgttgtgatcgcgattctgacagtcgtggccgctacgatggccaacgagatgggctttctcgaaaagaccaagaaagatcttgggctgggatccatcacaacccaggagagcgaatccaatattctggacatcgacctcagaccggcttctgcctggacactgtatgcggtcgccaccacgttcgtgacccccatgcttcggcatagcattgagaactcctctgttaatgtgagcctgacagctatcgccaaccaggctaccgtgctcatgggcctggggaagggatggcctctgtccaaaatggatattggcgtccccctccttgccatcgggtgttacagccaggttaatcctatcacactgaccgctgccctgctcctgcttgtggcgcactacgccattatcggacccggcctgcaagctaaggccacgcgcgaagctcagaaaagagccgccgcgggcattatgaagaaccctacagtggacgggatcaccgtcattgatctcgagccgatcccctatgaccctaagtttgagaaacagctgggacaggtgatgctgctcatcctttgcgttacacaagtgctgatgatgcggaccacctgggctctgtgtgaagccctcacactggctacgggccccatttctaccctttgggaggggaatcctggacgcttctggaacacaaccatcgccgtctccatggccaatatttttagaggcagctacctggctggggccggactcctgttctctatcatgaagaacacaaccaatacgcggcgcggcacaggcaacattggggaaaccctgggagagaaatggaagtccagactcaacgcgcttggcaaaagcgagtttcagatctataagaaatctgggatccaggaagtggatcggaccctggccaaggagggaattaagcgcggcgaaacagaccatcacgctgtcagcagagggtccgccaaactgcggtggttcgtggagagaaatatggttacccccgaaggaaaggtggtcgatctcggctgcggccgcgggggatggtcttactattgtggcgggctgaaaaacgtgcgggaggttaagggacttacaaaaggcgggccgggacatgaggaacctatccccatgagcacgtacggctggaatctggtgagactccaatccggcgtcgacgtgtttttcacaccccctgagaagtgcgataccctgctgtgtgacattggggaaagctcccccaaccctaccatcgaggctggacgcacactccgggtgcttaatctggttgaaaactggctgaataacaatacccagttctgcattaaggtcctcaacccgtatatgccctctgtgatcgagaaaatggaggccctgcagagaaagcacggcggggcgcttgtgcgcaatcctctgagccggaactccacgcacgaaatgtactgggtctctaatgccaccggaaacatcgttagctccgtgaatatgatttctagaatgctcatcaaccgctttacaatgaaacataagaaagctacctacgagcccgatgtggacctgggcagcgggacacggaacattggaatcgaatccgagattcctaatctggatatcattggcaagagaatcgaaaagatcaaacaggagcacgagaccagctggcattatgaccaagaccacccctacaagacatgggcctatcacggctcttacgaaaccaaacagacggggtccgctagctctatggtcaacggagtggttcgcctccttacaaagccgtgggatgtggtccctatggtgacccagatggccatgaccgacacaacgcccttcggccagcaacgggtttttaaagagaaggtggataccagaacacaggaacctaaggaggggaccaaaaagctgatgaaaattacagctgagtggctgtggaaggaactcggcaagaagaaaacccccagaatgtgtacaagagaggagttcacccggaaggtccgctccaatgccgcgctgggcgccatctttacggacgagaacaagtggaaaagcgctagagaagccgtggaggatgggcggttctgggagcttgtggacagagaacggaatctgcatctcgagggaaagtgcgaaacctgtgtctataacatgatgggcaaacgcgagaagaaactgggcgaatttgggaaggctaagggatctagagccatttggtacatgtggctgggcgcccggttcctcgagtttgaggcgctggggttccttaatgaagatcactggttttcccgcggaaacagcctgtccggcgttgagggggaaggcctccatagactgggatatatccttcgggacgtgggcaaaaaggaagggggagctatgtacgccgatgacacagccggctgggatacccgcattacactggaagacctcaaaaatgaggagatggtgaccaaccacatgaagggggaacataaaaagctggctgaggccatcttcaagctgacgtaccagaataaagtcgtgagagttcagcggcctacaccccgcggaaccgtgatggacatcattagcagacgggatcaacgcggctctgggcaggtcggcacatatggactcaacacctttacgaatatggaagctcagctgatcagacaaatggagggcgaggggattttcaagagcatccagcaccttaccgccacagaagagattgcggtgcagaactggctggcccgggttggacgcgaaagactctcccggatggctatctctggcgacgattgcgtggtcaaaccgatcgacgatagattcgccagcgctctgaccgcccttaatgacatggggaaggtgcgcaaagatattcagcaatgggagccttcccggggatggaacgactggacacaggttcccttttgctctcaccatttccacgaactggtgatgaaggatggcagagtcctcgtggtcccctgtcgcaaccaggacgagctgatcgggcgggcgagaattagccagggcgccggatggtccctgaaggagaccgcttgcctcggcaaatcttacgcccaaatgtggacactgatgtattttcatcgccgggatcttagactggctgccaatgctatctgtagcgccgtgcctccgcactgggttcccacctcccgcacgacatggagcattcacgcgaagcatgaatggatgaccaccgaggacatgctcgccgtgtggaaccgggtctggatccaggaaaatccttggatggaggataaaacacccgtggaatcttgggaggaggtgccttacctggggaagagagaagaccagtggtgcggatcccttattggcctgaccagccgcgctacatgggccaaaaacatccagacggccatcaatcaagttcggtctctcattgggaacgaggaatataccgactacatgccctccatgaagagattccggagagaggaagaggaggctggagtgctgtggtga

SEQ ID NO: 19790 - RNA, 9876 nt, synthetic construct
  misc_feature 1..9876: note = derived and/or modified CDS sequence (opt5) from DENV-2__FJ873808__SS-prME
  source 1..9876: mol_type = other RNA
accgccggcgtgatcgtcatgctgattcccaccgctatggccttccacctcacgaccagaaatggggagcctcatatgatcgttggacggcaggaaaagggcaagagcctgctttttaagacagaggacggggtgaatatgtgcaccctgatggcgattgatctcggagaactgtgtgaggacacaatcacctacaaatgcccgcttctgcgccaaaatgaacccgaggatattgactgttggtgcaatagcacatctacctgggtgacgtatggcacctgtacaaccacaggggagcacagacgggaaaagcgcagcgtcgctctcgtgcctcatgttggaatgggcctggagaccagaacggaaacatggatgtcctctgagggcgcctggaaacacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaggaacaggacaaacgctttatctgcaagcattccatggtggatagaggctggggcaacgggtgtggactgttcggcaaagggggaattgtcacatgcgccatgtttacgtgcaaaaagaatatggaaggcaaagttgtgcagcctgagaacctcgaatacaccatcgtgattacaccccacagcggggaggagcatgcggtcggaaatgacaccggcaagcacggcaaagaaatcaagatcacacctcagtcttccattaccgaggccgaactgacggggtatggaaccgtgacaatggagtgtagcccccggaccggccttgatttcaacgaaatggttctgctccaaatggaggacaaggcttggctggtgcaccgccagtggtttcttgatctgccgctcccttggctgcccggggccgacacacagggatctaattggatccagaaggagaccctggtcacgttcaagaaccctcatgctaaaaagcaagacgtggttgtgctcggctcccaggaaggggccatgcacacagccctgaccggcgctacagagattcagatgagctccggaaatcttctgtttaccggccatctcaaatgcagactgcggatggataaacttcaactgaaagggatgtcttacagcatgtgtaccggaaagttcaagatcgtcaaagaaattgcggagacacagcacggcacgatcgtgatcagagtccagtatgagggggacggatccccctgcaagattcccttcgaaatcaccgatctcgagaaacgccatgtgctgggccggctgattacagttaaccctatcgtgaccgaaaaggacagcccggtcaacattgaggccgaacccccttttggggattcttacatcattatcggcgtggagcccggacagctcaaactgaattggttcaagaagggctccagcatcgggcaaatgtttgagacaaccatgagaggagctaaacgcatggccattcttggcgacacggcctgggatttcgggtctctgggaggcgtttttacaagcatcgggaaggctctccaccaggtgttcggcgccatttacggagcggctttttccggcgtctcttggaccatgaaaatcctgattggggtgatcatcacctggattggaatgaacagccggtccacaagcctgtctgtgtcccttgttctcgtcggcgtggtgaccctgtatctgggggccatggtccaggccgacagcggatgtgtggtttcttggaagaataaagaactcaagtgcggctccgggatcttcattacagataacgtgcacacgtggaccgagcagtacaagtttcaacctgaaagcccctccaaactggcttctgccatccagaaggctcatgaggaaggcatttgtggaatcagaagcgtcacacgccttgagaatctgatgtggaaacagatcaccccggagctcaaccacattctgtccgaaaatgaggtgaagctgacaatcatgaccggcgacattaaagggatcatgcaggccggaaagcggtctcttagacctcaacccacggaactcaaatatagctggaagacctggggcaaggcgaaaatgctgtccacagagagccataaccagaccttcctgattgatgggcctgaaacagccgagtgccccaataccaaccgcgcttggaactctctcgaggttgaagactacggatttggcgtgttcacaaccaacatctggctgaaacttcgggagaaacaggacgtcttttgtgattccaagctgatgagcgccgctatcaaagacaatagagccgtgcacgcggatatgggctattggattgaatctgccctcaacgacacgtggaagatggagaaggcttccttcatcgaggttaaaagctgccactggcctaagtctcatacactgtggagcaatggggtgctggaatccgagatgattatccccaaaaacttcgccggaccggtcagccagcacaactaccgccctggctatcatacccaaaccgctgggccctggcaccttggaaagctcgaaatggattttgacctgtgtgagggcacaaccgtggtggtcacggaagattgcgggaatcggggaccctctctgagaacaaccacagcctccggcaaactcattaccgagtggtgctgtcggagctgcacactgcctccgcttcgctacagaggcgaggacgggtgttggtacggaatggaaatccggcccctgaaggagaaggaagagaacctcgttaattccctggtgaccgccggccatgggcagattgataacttctctctgggagtgcttggcatggctctctttctggaagagatgctgagaacgcgcatcgggaccaaacacgcgatcctcctggtcgccgtgagcttcgttacacttattaccggaaatatgtcctttcgggacctgggcagagtgatggtcatggtgggcgctacaatgaccgatgacatcgggatgggagttacgtatctcgccctgctggccgctttcaagattcgccctacatttgccgcgggccttctgctcagaaaactgacctctaaggagctcatgatggctacaatcgggattgccctgcttagccagtccaccatccccgaaaccatcctggagctcacagatgccctggctctgggaatgatggtgcttaaaattgtccggaacatggaaaagtaccaactggccgtgacgatcatggcgatttcttgcgttcctaatgctgtgatcctccagaacgcctggaaggtcagctgtgccattctggctgccgtgtccgtgagccccctcctgcttacctcttccaaacagaaggctgactggatccctctggccctcacaatcaaaggcctgaatcccaccgcgattttcctgacaacccttagccgcacgtctaagaaaagatcctggccgctgaacgaggccgtcatggctgttgggatggtgagcatcctcgcctcttccctgctcaagaatgacattcctatgacaggacccctggtggctggcggccttctgaccgtctgctatgtgctgaccgggcggagcgccgatctcgaactggagcgcgccgctgacgttaaatgggaggatcaggcggaaatctccggaagctctcctattcttagcatcacaatttccgaggacggctctatgagcatcaagaacgaagaggaggaacaaaccctgacaatcctcattagaacggggctgctcgtgatctccggagtctttcccgtgtctattccgatcaccgccgctgcctggtacctgtgggaggttaagaaacagcgggccggcgtgctttgggatgtcccttctccccctcccgtggaaaaggctgagctggaagacggggcctatcgcattaaacagagaggaatcctgggctactcccagatcggcgcgggggtctataaggagggaacattccacaccatgtggcatgtgacacggggcgctgttctcatgcaccgcgggaaaagaattgagccctcctgggccgatgtgaagaaggacctgatcagctacggaggcgggtggaaacttgaaggagagtggaaggaaggcgaggaagtccaagtgctggccctcgagcctggcaaaaatccgcgggctgttcagaccaagcccgggatttttaaaacgaacaccggaacaatcggcgccgtgtccctggatttcagccctgggacctctggatcccccattgtcgacagaaagggcaaggtggtggggctctacggaaatggcgttgtcacacgcagcggcgcgtatgtgtctgctatcgcccagaccgagaaatccatcgaagataaccctgagattgaagacgatatctttcggaagaaaagactgacaattatggaccttcatcccggggccggaaagacgaaacgctacctgcctgctatcgtgcgggaggccattaagagaggcctgcgcaccctcatcctggctccgacacgggtcgtggccgcggaaatggaggaggcccttagagggctgcccattcgctatcagacccctgctatcaagaccgaacacacaggacgggagatcgttgacctcatgtgtcatgccacgttcaccatgagactgctcagccccgtgcgggtccctaactacaatctgattatcatggatgaagctcacttcacagaccccgcctccattgccgctcgcggctatatctctaccagagtggagatgggggaggcggccggcatttttatgacagctaccccgcctggaagccgggatcccttcccccaatccaacgcccctatcatggacgaagaacgcgaaatccccgagagaagctggaactctggccacgaatgggttacggattttaaagggaagacagtgtggttcgtcccttccattaaagccggaaacgacatcgctgcctgccttcggaagaatggcaaaaaggtgattcagctgagcagaaagacctttgattctgagtacgttaaaacccgcgcgaacgactgggatttcgtggtcacaaccgacatcagcgagatgggggctaattttaaggccgaacgggtgattgatccgagacgctgtatgaaacccgtgatcctgacagacggagaggaacgggtcatcctcgccggccctatgcccgttacccattcctctgctgcccagagacgcgggcggattggcagaaaccctaagaatgagaacgaccaatatatctacatgggagaacccctggagaatgatgaggactgcgcgcactggaaagaagccaagatgcttctggataacattaatacgccggagggcatcattcctagcatgttcgaacccgagcgcgaaaaagtggacgctatcgatggggagtacagactccggggagaggcccgcaagacatttgtggacctgatgagacggggcgatctgcctgtctggctcgcttataaggtggccgctgaagggattaactacgccgaccgcaaatggtgtttcgatggaatcagaaataaccagatccttgaggaaaacatggaggttgagatttggaccaaggaaggcgagcggaaaaagctgaaacccagatggctggacgcgcgcatctattccgatcctctcgccctgaaggaatttaaggagttcgctgccgggcggaaatctcttacactgaatctcattaccgaaatgggcaagctgcccacgttcatgacccagaaagctagaaacgccctggacaatctcgccgtgcttcatacagctgaggcgggaggccgcgcctacaaccacgctctgagcgagctgccggaaaccctcgagacactgcttctgctcaccctgctggccacagtcaccgggggaatctttctcttccttatgtccggcaaggggattggaaaaatgacgctgggcatgtgctgcatcatcacagccagcattctgctctggtatgctcagatccaacctcactggattgccgcgtctatcattctggaatttttccttatcgtgctgctcatccccgagcccgaaaagcagcggacccctcaggataatcagctgacctacgttgtgattgccatcctgacagtcgtggctgccaccatggctaacgagatgggctttctcgagaagaccaagaaggaccttgggctgggatccattacgacccaagaaagcgagtccaatatcctggacattgatctcagaccggcctctgcgtggacactgtatgccgtcgctaccacattcgtgacccccatgcttcggcatagcatcgaaaactcctctgttaatgtgagcctgacggccattgctaaccaggccaccgtgctcatgggcctggggaaaggatggcctctgtccaagatggacatcggcgtccccctccttgctatcgggtgttacagccaggttaatcctattacactgaccgccgcgctgctcctgcttgtggcccactacgctatcattggacccggcctgcaggccaaagctacacgcgaggcccaaaagagagccgcggctggcatcatgaagaaccctaccgtggatgggattacggtcatcgacctcgaaccgatcccctatgatcctaaatttgagaagcagctgggacaggtgatgctgctcattctttgcgttacacaggtgctgatgatgcggaccacatgggccctgtgtgaggctctcaccctggccaccggccccatctctacactttgggaagggaatcctggacgcttctggaacacgaccattgccgtctccatggctaatatctttagaggcagctacctggccggggcgggactcctgttctctattatgaaaaacacaaccaatacacggcgcggcaccggcaacatcggggagacgctgggagaaaagtggaaatccagactcaacgcccttggcaagagcgagtttcaaatctataaaaagtctgggattcaggaggtggaccggacactggctaaggaaggaatcaaacgcggcgagaccgatcatcacgccgtcagcagagggtccgctaagctgcggtggttcgtggaaagaaatatggttacccccgagggaaaagtggtcgacctcggctgcggccgcgggggatggtcttactattgtggcgggctgaagaacgtgcgggaagttaaaggacttacaaagggcgggccgggacatgaggagcctattcccatgagcacctacggctggaatctggtgagactccagtccggcgtcgatgtgtttttcacaccccctgaaaagtgcgacacgctgctgtgtgatatcggggagagctcccccaaccctaccattgaagccggacgcacactccgggtgcttaatctggttgagaactggctgaataacaatacccaattctgcatcaaagtcctcaacccgtatatgccctctgtgatcgaaaagatggaggcgctgcagagaaaatacggcggggcccttgtgcgcaatcctctgagccggaactccacacacgagatgtactgggtctctaatgctaccggaaacattgttagctccgtgaatatgatctctagaatgctcattaaccgctttacgatgaagcacaaaaaggccacctatgaacccgacgtggatctgggcagcgggacacggaacatcggaattgagtccgaaatccctaatctggacattatcggcaagagaatcgagaaaattaagcaggaacatgagaccagctggcactacgaccaggatcatccctataaaacatgggcttaccacggctcttatgagaccaagcaaacagggtccgccagctctatggtcaacggagtggttcgcctccttaccaaaccgtgggacgtggtccctatggtgacgcagatggctatgacagataccacccccttcggccagcagcgggtttttaaggaaaaggtggacacaagaacgcaagagcctaaagaagggaccaagaaactgatgaagatcacagccgagtggctgtggaaagagctcggaaagaaaaagacaccccgcatgtgtacaagagaagagttcacccggaaggtccgctccaatgcggccctgggcgctatttttacagatgaaaacaaatggaaaagcgccagagaggctgtggaagacgggcggttctgggagcttgtggatagagagcggaatctgcacctcgaaggaaaatgcgagacctgtgtctacaacatgatgggcaagcgcgagaagaagctgggcgagtttgggaaggccaaaggatctagagccatctggtatatgtggctgggcgcgcggttcctcgaatttgaggctctggggttccttaatgaggaccattggttttcccgcggaaacagcctgtccggcgttgaaggggagggcctccacagactgggatacattcttcgggatgtgggcaagaaagaagggggagccatgtacgccgacgatacggctggctgggacacccgcatcacactggaggacctcaagaatgaagagatggtgaccaaccatatgaaaggggagcacaagaagctggccgaagctatcttcaaactgacatatcagaataaggtcgtgagagttcagcggcctacaccccgcggaacggtgatggatattatcagcagacgggaccagcgcggctctgggcaagtcggcacatacggactcaacacctttacaaatatggaggcccagctgattagacagatggaaggcgaggggatcttcaaaagcattcaacatcttaccgcgacggaggaaatcgccgtgcagaactggctggctcgggttggacgcgagagactctcccggatggccatctctggcgatgactgcgtggtcaagccgattgatgacagattcgctagcgccctgaccgcgcttaatgatatggggaaagtgcgcaaggacatccagcagtgggaaccttcccggggatggaacgattggacacaagttcccttttgctctcaccacttccatgagctggtgatgaaggacggcagagtcctcgtggtcccctgtcgcaaccaggatgaactgattgggcgggccagaatcagccagggcgctggatggtccctgaaagagaccgcctgcctcggcaagtcttatgctcagatgtggacactgatgtactttcaccgccgggaccttagactggccgctaatgccatttgtagcgcggtgcctccgcattgggttcccacctcccgcacaacctggagcatccacgccaaacacgagtggatgacgacagaagatatgctcgctgtgtggaaccgggtctggattcaagggaatccttggatggaggacaagacccccgtggaatcttgggaggaagtgccttatctgggaaaaagagaggaccagtggtgcggctcccttatcgggctgaccagccgcgccacatgggccaagaacatccagaccgctattaatcaggttcggtctctcatcggaaacgaggaatacacagattatatgccctccatgaagagattccggagagaggaagaggaagccggcgtgctgtggtga

SEQ ID NO: 19791 - RNA, 9876 nt, synthetic construct
  misc_feature 1..9876: note = derived and/or modified CDS sequence (opt5) from DENV-2__FJ850120__SS-prME
  source 1..9876: mol_type = other RNA
acagccggagtgatcgtgatgctgattcccacggctatggccttccacctcacgaccagaaacggggagcctcatatgatcgttggacggcaggaaaagggaaaaagcctgctttttaagacagaggacggggtgaatatgtgcaccctgatggcgattgatctcggagaactgtgtgaggacacaatcacctacaaatgcccgcttctgagacaaaacgaacccgaggatattgactgttggtgcaattccacatctacctgggtgacgtatggcacctgtacaaccacaggggagcacagacgggaaaagagaagcgtcgctctcgtgcctcatgttggaatgggcctggagaccagaacggaaacatggatgtcctctgagggcgcctggaaacacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaagaacaggacaaacgctttatctgcaagcattccatggtggatagaggctggggcaacgggtgtggactgttcggcaaagggggaattgtcacatgcgccatgtttacgtgcaaaaagaatatggaaggcaaagttgtgcagcctgagaacctcgaatacaccatcgtgattacaccccacagcggggaggagcatgcggtcggaaatgacaccggcaagcacggcaaagaaatcaagatcacacctcagtcttccgtgaccgaggccgaactgacggggtatggaaccgttacaatggagtgtagcccccggaccggccttgatttcaacgaaatggtgctgctccaaatggaggacaaggcttggctggtccaccgccagtggtttcttgatctgccgctcccttggctgcccggggccgacacacagggatctaattggattcagaaggagaccctggtgacgttcaagaaccctcatgctaaaaagcaagacgttgtggtcctcggctcccaggaaggggccatgcacacagccctgaccggcgctacagagatccagatgagctccggaaatcttctgtttaccggccatctcaaatgcagactgcggatggataaacttcaactgaaagggatgtcttacagcatgtgtaccggaaagttcaagattgtgaaagaaatcgcggagacacagcacggcacgattgtcatcagagtgcagtatgagggggacggatccccctgcaagatccccttcgaaattaccgatctcgagaaacgccatgttctgggccggctgatcacagtgaaccctattgtcaccgaaaaggacagcccggtgaacatcgaggccgaacccccttttggggattcttacattatcattggcgttgagcccggacagctcaaactgaattggttcaagaagggctccagcatcgggcaaatgtttgagacaaccatgagaggagctaaacgcatggccatccttggcgacacggcctgggatttcgggtctctgggaggcgtgtttacaagcattgggaaggctctccaccaggtcttcggcgccatctacggagcggctttttccggcgtgtcttggaccatgaaaattctgatcggggtgattatcacctggatcggaatgaacagccggtccacaagcctgtctgtttcccttgtcctcgtgggcgtggtcaccctgtatctgggggccatggtgcaggccgacagcggatgtgttgtgtcttggaagaataaagaactcaagtgcggctccgggattttcatcacagataacgtccacacgtggaccgagcagtacaagtttcaacctgaaagcccctccaaactggcttctgccattcagaaggctcatgaggaaggcatctgtggaattagaagcgtgacacgccttgagaatctgatgtggaaacagatcaccccggagctcaaccacatcctgtccgaaaatgaggttaagctgacaattatgaccggcgacatccgggggattatgcaggccggaaaaagatctcttcgccctcaacccacggaactcaagtatagctggaaaacctggggcaaggcgaagatgctgtccacagagagccataaccagaccttcctgatcgatgggcctgaaacagccgagtgccccaataccaaccgggcttggaactctctcgaggtggaagactacggatttggcgtcttcacaaccaacatttggctgaaacttagagagaagcaggacgtgttttgtgattccaaactgatgagcgccgctatcaaggacaatcgcgccgttcacgcggatatgggctattggatcgaatctgccctcaacgacacgtggaaaatggagaaggcttccttcattgaggtcaagagctgccactggcctaaatctcatacactgtggagcaatggggtcctggaatccgagatgatcattcccaagaacttcgccggaccggtgagccagcacaactaccggcctggctatcatacccaaaccgctgggccctggcaccttggaaaactcgaaatggattttgacctgtgtgagggcacaaccgtggtcgttacggaagattgcgggaatagaggaccctctctgcggacaaccacagcctccggcaagctcatcaccgagtggtgctgtcgcagctgcacactgcctccgcttagataccggggcgaggacgggtgttggtacggaatggaaattagacccctgaaagagaaggaagagaacctcgtgaatagcctggtgaccgccggccatgggcagatcgataacttctctctgggagtccttggcatggctctctttctggaagagatgctgcgcacgcggattgggaccaagcacgcgatcctcctggtggccgttagcttcgtgacacttatcaccggaaatatgtcctttagagacctgggccgcgtcatggtgatggttggcgctacaatgaccgatgacattgggatgggagtgacgtatctcgccctgctggccgctttcaaagtcagacctacatttgccgcgggccttctgctccggaagctgacctctaaagagctcatgatggctacaatcgggattgccctgcttagccagtccaccatccccgaaaccattctggagctcacagatgccctggctctgggaatgatggtgcttaagatcgttcgcaacatggaaaaataccaactggccgtgacgatcatggcgatttcttgcgtccctaatgctgtgatcctccagaacgcctggaaggtgagctgtaccattctggccgctgtctccgttagccccctcctgcttacatcttcccagcagaaggccgactggatccctctggctctcaccattaaaggcctgaatcccacagccatcttcctgaccacgcttagcagaacatctaagaaacggtcctggccgctgaacgaggcgatcatggccgtggggatggtgagcattctcgcttcttccctgctcaagaatgacatccctatgaccggacccctggtcgccggcggccttctgaccgtgtgctatgttctgacagggcgcagcgctgatctcgaactggagagagccgccgacgtgaaatgggaggatcaagctgaaatttccggaagctctcctatccttagcattaccatctccgaggacggctctatgagcattaagaacgaagaggaggaacagacactgacgatcctcatccggaccgggctgctcgtcatttccggagtgtttcccgtttctatcccgattacagcggccgcttggtacctgtgggaggtgaaaaagcagcgcgccggcgtcctttgggatgtgccttctccccctcccgtcgaaaaggccaaactggaggacggggcttatagaatcaagcagcgggggattctgggctactcccaaatcggcgccggggtgtataaagaaggaaccttccacacaatgtggcatgttacccgcggcgcggtgctcatgcacagagggaagcggatcgagccctcctgggctgatgtcaaaaaggacctgattagctacggaggcgggtggaaacttgagggagaatggaaagagggcgaagaggtgcaggttctggccctcgaacctggcaagaatccgagagccgtgcagacgaaacccgggatctttaagaccaacacaggaaccattggcgctgtctccctggatttcagccctgggacatctggatcccccatcgtggaccgcaaaggcaaggtggttgggctctacggaaatggcgtcgtgacccggagcggcgcctatgtgtctgcgattgctcagacagagaagaacatcgaggataaccctgaaatcgaggacgatatttttcgcaagaagcgcctgacgatcatggaccttcatcccggggccggaaaaaccaagcggtacctgcctgccattgtcagagaagctatcaaacgcggcctgcggacactcattctggccccgaccagagtggttgctgccgagatggaagaggcgcttcgcgggctgcccatccggtatcaaacccctgccattaagacagagcacacgggaagagaaatcgtggacctcatgtgtcatgctaccttcacaatgcggctgctctcccccgtccgcgtgcctaattacaacctgatcattatggatgaggcccacttcaccgaccccgctagcatcgccgccagaggctatatttccacacgggttgaaatgggggaggctgcgggcatctttatgaccgccacgccgcctggatctcgcgatcccttcccccagagcaatgctcctattatggacgaggaaagagagatccccgaacggtcctggaacagcggccacgagtgggtgacagattttaaggggaaaaccgtctggttcgtgccttctatcaaggccggaaatgacattgccgcttgccttcgcaagaatggcaagaaagttatccagctgtcccgcaagacctttgatagcgaatacgtgaagacacgggccaatgactgggatttcgtcgtgaccacagacatttctgagatgggggcgaactttaaagctgagagagtgatcgatccgcgccggtgtatgaagcccgtcattctgaccgacggagaagagagagttatcctcgccggccctatgcccgtgacgcatagctccgccgctcaacgccgggggagaatcggccgcaatcctaaaaacgaaaatgaccagtatatttacatgggagagcccctggaaaacgatgaggactgcgcccactggaaggaggcgaaaatgcttctggataatatcaacacaccggaaggcattatcccttctatgttcgagcccgaaagagagaaggtggacgccattgatggggaataccggctccgcggagaggctagaaaaacctttgtcgacctgatgcggcgcggcgatctgcctgtgtggctcgcctataaggttgctgccgaggggatcaattacgctgacagaaagtggtgtttcgatggaattaaaaacaaccagatccttgaagagaatatggaagtggagatctggacaaaggagggcgaacggaaaaagctgaaacccagatggctggacgcccgcatttatagcgatcctctcgcgctgaaggagtttaaggagttcgccgctgggcggaaatcccttaccctgaacctcatcacggagatgggcagactgcccaccttcatgacacagaaggcccgcaatgctctggacaacctcgccgtccttcataccgccgaagctggaggccgggcgtacaatcacgccctgtctgagctgccggagacactcgaaaccctgcttctgctcacactgctggctaccgtgacagggggaatttttctcttccttatgagcggcaaagggatcggaaagatgacactgggcatgtgctgcattatcaccgcctccatcctgctctggtatgcccaaattcagcctcactggatcgctgccagcattatcctggagtttttccttattgttctgctcatccccgaacccgagaaacagagaacccctcaggataaccaactgacatacgtggtcatcgcgattctgaccgtggtcgccgctacaatggccaatgaaatgggctttctcgagaagacgaagaaagaccttgggctgggatctatcaccacacaggagtccgaaagcaacattctggacatcgatctccggccggcttccgcctggaccctgtatgcggtggccacaaccttcgttacgcccatgcttcgccattctattgagaatagctccgtgaacgtgtctctgaccgctatcgccaatcaggctacagtcctcatgggcctggggaagggatggcctctgagcaaaatggacattggcgttcccctccttgccatcgggtgttactcccaggtgaaccctatcaccctgacagctgccctgctcctgcttgtggcgcactacgccattatcggacccggcctgcaagctaaggccaccagagaagctcagaaacgggccgccgcgggcattatgaagaatcctacggtcgatgggatcacagtgattgacctcgagccgatcccctatgatcctaagtttgaaaaacagctgggacaggttatgctgctcatcctttgcgtgacccaagtcctgatgatgcgcacaacctgggctctgtgtgaggccctcaccctggctacaggccccattagcacgctttgggaggggaaccctggaagattctggaataccacaatcgccgtgtctatggccaacatttttcggggctcctacctggctggggccggactcctgttcagcatcatgaagaataccacaaacacccgcagaggcacgggctctattggggaaacactgggagagaaatggaagtcccggctcaacgcgcttggcaaaagcgaatttcagatctataagaaatctgggatccaggaggtcgaccgcaccctggccaaggagggaattaagagaggcgaaaccgatcatcacgctgtgagccgggggtccgccaaactgagatggttcgttgagcgcaatatggtgacacccgaaggaaaggtcgtggacctcggctgcggccggggaggatggtcttactattgtggcgggctgaaaaacgttagagaggtgaagggacttaccaaaggcgggccgggacatgaagaacctatccccatgagcacatacggctggaatctggtccgcctccaatccggcgtggatgtgtttttcacgccccctgagaagtgcgacaccctgctgtgtgatattggggaaagctcccccaaccctacaatcgaggctggacggaccctcagagttcttaatctggtcgaaaactggctgaataacaatacacagttctgcattaaggtgctcaacccgtatatgccctctgtgatcgagaaaatggaagccctgcagcgcaagtacggcggggcgcttgtccggaatcctctgagcagaaactccacccacgagatgtactgggtttctaatgccacgggaaacatcgtgagctccgtgaatatgatttctcgcatgctcatcaaccggtttaccatgaaacacaagaaagctacatatgagcccgacgtcgatctgggcagcgggaccagaaacattggaatcgaaaatgagattcctaacctggacatcattggcaagcgcatcgaaaagatcaaacaggagcatgaaacatcctggcactacgaccaagatcatccctataagacctgggcctaccacggcagctatgagacaaaacagaccgggtctgcttccagcatggtgaatggagttgtgcggctccttacgaagccgtgggacgtcgtgcctatggttacacagatggccatgaccgataccacacccttcggccagcaaagagtgtttaaagagaaggtcgacacgcgcacccaggaacctaaggaggggaccaaaaagctgatgaaaattaccgctgaatggctgtggaaggagctcggcaaaaagaaaacacccagaatgtgtacccgggaggagttcacacgcaaggtgagatctaacgccgcgctgggcgccatctttaccgatgagaataagtggaaatccgctcgggaagccgtggaggacagcagattctgggaacttgtcgatcgggagcgcaacctgcacctcgaggggaagtgcgaaacgtgtgtttacaatatgatgggaaaaagagagaagaaactgggcgaatttggcaaggctaaggggtctcgggccatttggtatatgtggctgggagcccgcttcctcgagtttgaagcgctgggcttccttaacgaggaccattggttttccagagggaatagcctgtccggagtggagggcgaagggctccaccggctgggctacatccttcgcgatgtgggcaaaaaggagggcggggctatgtacgccgacgataccgccggatgggacacaagaattaccctggaagacctcaaaaacgaggaaatggtcacaaatcatatgaagggcgagcacaaaaagctggctgaggccatcttcaagctgacctatcagaacaaagtggttcgggtgcagcgccctacgcccagagggacagtcatggatatcattagccggcgcgaccaaagaggatctggccaggtggggacctacggcctcaatacatttaccaacatggaagctcagctgatccggcaaatggagggagaaggcattttcaagagcatccagcatcttacggccaccgaggagattgcggttcagaattggctggcccgcgtggggagagaacggctctccagaatggctatctctggagatgactgcgtcgtgaaaccgatcgatgaccgcttcgccagcgctctgacagcccttaacgatatgggcaaggttcggaaagacattcagcaatgggagccttccagagggtggaacgattggacccaggtgcccttttgctctcaccacttccatgaactggtcatgaaggacggacgcgtgctcgtcgtgccctgtcggaatcaggatgagctgatcggcagagcgcgcattagccagggggccggctggtccctgaaggaaacagcttgcctcggaaaatcttatgcccaaatgtggaccctgatgtactttcaccggagagaccttcgcctggctgccaacgctatctgtagcgccgttccttcccattgggtgccgacaagccggaccacgtggtctattcacgcgaagcacgagtggatgacaaccgaggatatgctcgccgtctggaatagagtgtggatccaggaaaacccctggatggaggacaaaacccctgtggaatcctgggaggaagttccctatctgggcaagcgcgaggaccagtggtgcgggagccttattggactgacatctcgggctacctgggccaaaaatatccagacagccatcaaccaagtgagatccctcattggcaatgaggaatacacggattatatgcctagcatgaagcggttcagacgcgaggaagaggaagctggggtcctgtggtga

SEQ ID NO: 19792 - RNA, 9876 nt, synthetic construct
  misc_feature 1..9876: note = derived and/or modified CDS sequence (opt5) from DENV-2__FJ850121__SS-prME
  source 1..9876: mol_type = other RNA
accgccggagtgatcgtcatgctgattcccacagctatggccttccacctcacgaccagaaatggggagcctcatatgatcgttggacggcaggaaaagggcaaaagcctgctttttaagacagaggacggggtgaatatgtgcaccctgatggcgattgatctcggagaactgtgtgaggacacaatcacctacaaatgcccgcttctgcgccaaaatgaacccgaggatattgactgttggtgcaatagcacatctacctgggtgacgtatggcacctgtacaaccacaggggagcacagacgggaaaagcgcagcgtcgctctcgtgcctcatgttggaatgggcctggagaccagaacggaaacatggatgtcctctgagggcgcctggaaacacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaagaacaggacaaacgctttatctgcaagcattccatggtggatagaggctggggcaacgggtgtggactgttcggcaaagggggaattgtcacatgcgccatgtttacgtgcaaaaagaatatggaaggcaaaatcgttcagcctgagaacctcgaatacaccattgtgatcacaccccacagcggggaggagcatgcggtgggaaatgacaccggcaagcacggcaaagaaatcaagattacacctcagtcttccatcaccgaggccgaactgacggggtatggaaccgtcacaatggagtgtagcccccggaccggccttgatttcaacgaaatggtgctgctccaaatggaggacaaggcttggctggttcaccgccagtggtttcttgatctgccgctcccttggctgcccggggccgacacacagggatctaattggattcagaaggagaccctggtgacgttcaagaaccctcatgctaaaaagcaagacgtcgtggttctcggctcccaggaaggggccatgcacacagccctgaccggcgctacagagatccagatgagctccggaaatcttctgtttaccggccatctcaaatgcagactgcggatggataaacttcaactgaaagggatgtcttacagcatgtgtaccggaaagttcaagattgtgaaagaaatcgcggagacacagcacggcacgatcgtcattagagtgcagtatgagggggacggatccccctgcaagatccccttcgaaattaccgatctcgagaaacgccatgtcctgggccggctgatcacagtgaaccctattgttaccgaaaaggacagcccggtgaacatcgaggccgaacccccttttggggattcttacattatcatcggcgtcgagcccggacagctcaaactgaattggttcaagaagggctccagcattgggcaaatgtttgagacaaccatgagaggagctaaacgcatggccatccttggcgacacggcctgggatttcgggtctctgggaggcgtgtttacaagcattgggaaggctctccaccaggttttcggcgccatctacggagcggctttttccggcgtgtcttggaccatgaaaattctgatcggggtcatcattacctggatcggaatgaacagccggtccacaagcctgtctgtgtcccttgtgctcgttggcgtcgtgaccctgtatctgggggccatggtgcaggccgacagcggatgtgtcgtgtcttggaagaataaagaactcaagtgcggctccgggattttcatcacagataacgttcacacgtggaccgagcagtacaagtttcaacctgaaagcccctccaaactggcttctgccattcagaaggctcatgaggaaggcatctgtggaatcagaagcgtgacacgccttgagaatctgatgtggaaacagattaccccggagctcaaccacatcctgtccgaaaatgaggtcaagctgacaattatgaccggcgacatcaaagggattatgcaggccggaaagcggtctcttagacctcaacccacggaactcaaatatagctggaagacctggggcaaggcgaaaatgctgtccacagagagccataaccagaccttcctgatcgatgggcctgaaacagccgagtgccccaataccaaccgcgcttggaactctctcgaggtggaagactacggatttggcgttttcacaaccaacatctggctgaaacttcgggagaaacaggacgtgttttgtgattccaagctgatgagcgccgctattaaagacaatagagccgtccacgcggatatgggctattggatcgaatctgccctcaacgacacgtggaagatggagaaggcttccttcattgaggtgaaaagctgccactggcctaagtctcatacactgtggagcaatggggttctggaatccgagatgatcattcccaaaaacttcgccggaccggtgagccagcacaactaccgccctggctatcatacccaaaccgctgggccctggcaccttggaaagctcgaaatggattttgacctgtgtgagggcacaaccgtcgtggtgacggaagattgcgggaatcggggaccctctctgagaacaaccacagcctccggcaaactcatcaccgagtggtgctgtcggagctgcacactgcctccgcttcgctacagaggcgaggacgggtgttggtacggaatggaaattcggcccctgaaggagaaggaagagaacctcgtcaattccctggttaccgccggccatgggcagatcgataacttctctctgggagtgcttggcatggctctctttctggaagagatgctgagaacgcgcatcgggaccaaacacgtgacactcctggtcgcggtgagcttcgttacccttattacaggaaatatgtcctttcgggacctgggcagagtgatggtcatggtgggcgccaccatgacggatgacatcgggatgggagttacatatctcgctctgctggccgccttcaaggtgcgccctacctttgctgccggccttctgctcagaaaactgacatctaaggagctcatgatggcgaccattgggatcgctctgcttagccagtccaccattcccgaaacaatcctggagctcacggatgccctggccctgggaatgatggtccttaaaatcgtgcggaacatggaaaagtaccaactggctgttaccattatggccatctcttgcgtgcctaatgcggtcattctccagaacgcttggaaggtgagctgtacaatcctggccgccgtgtccgtcagccccctcctgcttacctcttcccagcagaaagctgactggattcctctggccctcacaatcaagggcctgaatcccaccgctatcttcctgacgacacttagccgcacctctaaaaagagatcctggccgctgaacgaggccattatggcggttgggatggtgagcatcctcgcctcttccctgctcaaaaatgacattcctatgaccggacccctggtggctggcggccttctgacagtctgctatgtgctgaccgggcggagcgccgatctcgaactggagcgcgctgccgacgttaagtgggaggatcaagccgaaatctccggaagctctcctattcttagcatcacaatttccgaggacggctctatgagcatcaaaaacgaagaggaggaacagacgctgaccatcctcattagaacagggctgctcgtgatctccggagtctttcccgtgtctattccgatcaccgctgcggcctggtacctgtgggaggttaagaagcagcgggctggcgtgctttgggatgtcccttctccccctcccgtggaaaaagccgagctggaagacggggcctatcgcattaagcagagaggaatcctgggctactcccaaatcggcgctggggtctataaagagggaacattccacaccatgtggcatgtgacgcggggcgccgttctcatgcaccgcgggaagagaattgagccctcctgggcggatgtgaaaaaggacctgatcagctacggaggcgggtggaaacttgaaggagagtggaaagaaggcgaggaagtccaggtgctggctctcgagcctggcaagaatccgcgggccgttcagaccaaacccgggatttttaagacaaacaccggaacaatcggcgccgtgtccctggatttcagccctgggacctctggatcccccattgtcgacagaaaaggcaaggtggtggggctctacggaaatggcgttgtcacacgcagcggcgcttatgtgtctgccatcgcgcagacggagaagtccatcgaagataaccctgagattgaagacgatatctttcggaaaaagagactgaccattatggaccttcatcccggggctggaaaaacaaagcgctacctgcctgccatcgtgcgggaggccattaaaagaggcctgcgcaccctcatcctggctccgacccgggtcgtggccgctgaaatggaggaggcccttagagggctgcccattcgctatcaaacccctgcgatcaagacggaacacaccggacgggagatcgttgacctcatgtgtcatgccacattcaccatgagactgctcagccccgtgcgggtccctaactacaatctgattatcatggatgaagctcacttcacagaccccgcctccattgctgcccgcggctatatctctaccagagtggagatgggggaggccgctggcatttttatgacggcgacaccgcctggaagccgggatcccttcccccagtccaacgcccctatcatggacgaagagagagaaatccccgagagaagctggaactctggccacgaatgggttaccgattttaaggggaaaaccgtgtggttcgtcccttccattaaggctggaaacgacatcgccgcctgccttcggaaaaatggcaagaaagtgattcagctgagcagaaagacatttgattctgagtacgttaagacccgcgctaacgactgggatttcgtggtcacaaccgacatcagcgagatgggggccaattttaaagcggaacgggtgattgatccgagacgctgtatgaagcccgtgatcctgacggacggagaggaacgggtcatcctcgctggccctatgcccgttacacattcctctgccgcccaaagacgcgggcggattggcagaaaccctaaaaatgagaacgaccagtatatctacatgggagaacccctggagaatgatgaggactgcgctcactggaaggaagccaaaatgcttctggataacattaataccccggagggcatcattcctagcatgttcgaacccgagcgcgaaaaggtggacgcgatcgatggggagtacagactccggggagaggcccgcaaaacatttgtggacctgatgagacggggcgatctgcctgtctggctcgcttataaggtggccgctgaagggattaactacgccgaccgcaagtggtgtttcgatggaatcaaaaataaccagatccttgaggaaaacatggaggttgagatttggaccaaggaaggcgagcgcaagaagctgaaaccccggtggctggacgctagaatctattccgatcctctcgccctgaaggaatttaaggagttcgcggccgggcgcaaatctcttacgctgaatctcattaccgaaatgggccggctgcccacattcatgacccagaaggctagaaacgccctggacaatctcgctgtgcttcatacagccgaggccggaggccgcgcttacaaccacgcgctgagcgagctgccggaaaccctcgagacactgcttctgctcaccctgctggccacggtcacagggggaatctttctcttccttatgtccggcaaagggattggaaagatgaccctgggcatgtgctgcatcatcaccgctagcattctgctctggtatgcccaaatccagcctcactggattgccgcttctatcattctggaatttttccttatcgtgctgctcatccccgagcccgaaaaacagcggacacctcaggataatcaactgacctacgttgtgattgccatcctgacagtcgtggcggccacgatggctaacgagatgggctttctcgagaagaccaagaaagaccttgggctgggatccattacaacccaggaaagcgagtccaatatcctggacattgatctcagaccggcctctgcttggacactgtatgccgtcgcgaccacgttcgtgacccccatgcttcggcatagcatcgaaaactcctctgttaatgtgagcctgacagccattgctaaccaggccaccgtgctcatgggcctggggaagggatggcctctgtccaaaatggacatcggcgtccccctccttgctatcgggtgttacagccaggttaatcctattacactgaccgccgctctgctcctgcttgtggcccactacgcgatcattggacccggcctgcaagccaaggctacgcgcgaggcccagaaaagagctgccgccggcatcatgaagaaccctacagtggatgggattaccgtcatcgacctcgaaccgatcccctatgatcctaagtttgagaaacagctgggacaggtgatgctgctcattctttgcgttacacaagtgctgatgatgcggaccacctgggcgctgtgtgaggctctcacactggccacgggccccatctctaccctttgggaagggaatcctggacgcttctggaacacaaccattgctgtctccatggccaatatctttagaggcagctacctggccggggctggactcctgttctctattatgaagaacacaaccaatacgcggcgcggcacaggcaacatcggggagaccctgggagaaaaatggaagtccagactcaacgcccttggcaaaagcgagtttcagatctataagaaatctgggattcaggaggtggaccggaccctggcgaaggaaggaatcaagcgcggcgagacagatcatcacgccgtcagcagagggtccgctaaactgcggtggttcgtggaaagaaatatggttacccccgagggaaaggtggtcgacctcggctgcggccgcgggggatggtcttactattgtggcgggctgaaaaacgtgcgggaagttaagggacttacaaaaggcgggccgggacatgaggagcctattcccatgagcacgtacggctggaatctggtgagactccaatccggcgtcgatgtgtttttcacaccccctgaaaagtgcgacaccctgctgtgtgatatcggggagagctcccccaaccctaccattgaagccggacgcacactccgggtgcttaatctggttgagaactggctgaataacaatacccagttctgcatcaaggtcctcaacccgtatatgccctctgtgatcgagaagatggaggctctgcagagaaagtacggcggggcccttgtgcgcaatcctctgagccggaactccacgcacgagatgtactgggtctctaatgcgaccggaaacattgttagctccgtgaatatgatctctagaatgctcattaaccgctttacaatgaaacacaagaaagccacctatgaacccgacgtggatctgggcagcgggacacggaacatcggaattgagtccgaaatccctaatctggacattatcggcaagagaatcgagaagattaaacaggaacatgagaccagctggcactacgaccaagatcatccctataagacatgggcttaccacggctcttatgagaccaaacagacggggtccgccagctctatggtcaacggagtggttcgcctccttacaaagccgtgggacgtggtccctatggtgacccagatggctatgaccgatacaacgcccttcggccagcaacgggtttttaaagaaaaggtggacaccagaacacaggagcctaaggaagggaccaaaaagctgatgaaaatcacagccgagtggctgtggaaggagctcggcaagaagaaaacaccccgcatgtgtacaagagaagagttcacccggaaggtccgctccaatgctgccctgggcgcgatttttacggatgaaaacaagtggaaaagcgccagagaggctgtggaagacgggcggttctgggagcttgtggatagagagcggaatctgcacctcgaaggaaagtgcgagacctgtgtctacaacatgatgggcaaacgcgaaaagaaactgggcgagtttgggaaggccaagggatctagagctatctggtatatgtggctgggcgcccggttcctcgaatttgaggccctggggttccttaatgaggaccattggttttcccgcggaaacagcctgtccggcgttgaaggggagggcctccacagactgggatacattcttcgggatgtgggcaaaaaggaagggggagcgatgtacgctgacgatacagccggctgggacacccgcatcacactggaggacctcaaaaatgaagagatggtgaccaaccatatgaagggggagcacaaaaagctggccgaagctatcttcaagctgacgtatcagaataaagtcgtgagagttcagcggcctacaccccgcggaaccgtgatggatattatcagcagacgggaccaacgcggctctgggcaggtcggcacatacggactcaacacctttacgaatatggaggcccagctgattagacaaatggaaggcgaggggatcttcaagagcattcagcatcttaccgctacagaggaaatcgccgtgcagaactggctggcgcgggttggacgcgagagactctcccggatggccatctctggcgatgactgcgtggtcaaaccgattgatgacagattcgctagcgccctgaccgctcttaatgatatggggaaggtgcgcaaagacatccagcaatgggaaccttcccggggatggaacgattggacacaggttcccttttgctctcaccacttccatgagctggtgatgaaggacggcagagtcctcgtggtcccctgtcgcaaccaggatgaactgattgggcgggccagaatcagccagggcgcgggatggtccctgaaggagaccgcctgcctcggcaaatcttatgctcaaatgtggacactgatgtactttcaccgccgggaccttagactggccgctaatgccatttgtagcgctgtgcctccgcattgggttcccacctcccgcacgacatggagcatccacgccaagcacgagtggatgaccaccgaagatatgctcgcggtgtggaaccgggtctggattcaggagaatccttggatggaagacaaaacacccgtggagtcttgggaagaggtgccttatctggggaagagagaggaccagtggtgcggatcccttatcggcctgaccagccgcgccacatgggctaaaaacatccagacggccattaatcaagttcggtctctcatcgggaacgaagagtacaccgattatatgccctccatgaagagattccggagagaagaggaagaggccggagtgctgtggtga

SEQ ID NO: 19793 - RNA, 9876 nt, synthetic construct
  misc_feature 1..9876: note = derived and/or modified CDS sequence (opt5) from DENV-2__GQ199897__SS-prME
  source 1..9876: mol_type = other RNA
acagccggagtgatcgtcatgctgattcccacggctatggccttccacctcacgaccagaaatggggagcctcatatgatcgttggacggcaggaaaagggcaaaagcctgctttttaagacagaggacggggtgaatatgtgcaccctgatggcgattgatctcggagaactgtgtgaggacacaatcacctacaaatgcccgcttctgcgccaaaatgaacccgaggatattgactgttggtgcaatagcacatctacctgggtgacgtatggcacctgtacaaccacaggggagcacagacgggaaaagcgcagcgtcgctctcgtgcctcatgttggaatgggcctggagaccagaacggaaacatggatgtcctctgagggcgcctggaaacacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaagaacaggacaaacgctttatctgcaagcattccatggtggatagaggctggggcaacgggtgtggactgttcggcaaaggagggattgtcacatgcgccatgtttacgtgcaaaaagaatatggaaggcaaagttgtgcagcctgagaacctcgaatacaccatcgtgattacaccccacagcggggaggagcatgcggtcggaaatgacaccggcaagcacggcaaagaaatcaagatcacacctcagtcttccattaccgaggccgaactgacggggtatggaaccgtgacaatggagtgtagcccccggaccggccttgatttcaacgaaatggttctgctccaaatggaggacaaggcttggctggtgcaccgccagtggtttcttgatctgccgctcccttggctgcccggggccgacacacagggatctaattggatccagaaggagaccctggtcacgttcaagaaccctcatgctaaaaagcaagacgtggttgtgctcggctcccaggaaggggccatgcacacagccctgaccggcgctacagagattcagatgagctccggaaatcttctgtttaccggccatctcaaatgcagactgcggatggataaacttcaactgaaagggatgtcttacagcatgtgtaccggaaagttcaagatcgtcaaagaaattgcggagacacagcacggcacgatcgtgatcagagtccagtatgagggggacggatccccctgcaagattcccttcgaaatcaccgatctcgagaaacgccatgtgctgggccggctgattacagttaaccctatcgtgaccgaaaaggacagcccggtcaacattgaggccgaacccccttttggggattcttacatcattatcggcgtggagcccggacagctcaaactgaattggttcaagaagggctccagcatcgggcaaatgtttgagacaaccatgagaggagctaaacgcatggccattcttggcgacacggcctgggatttcgggtctctgggaggcgtttttacaagcatcgggaaggctctccaccaggtgttcggcgccatttacggagcggctttttccggcgtctcttggaccatgaaaatcctgattggggtgatcatcacctggattggaatgaacagccggtccacaagcctgtctgtgtcccttgttctcgtcggcgtggtgaccctgtatctgggggccatggtccaggccgacagcggatgtgtggtttcttggaagaataaagaactcaagtgcggctccgggatcttcattacagataacgtgcacacgtggaccgagcagtacaagtttcaacctgaaagcccctccaaactggcttctgccatccagaaggctcatgaggaaggcatttgtggaatcagaagcgtcacacgccttgagaatctgatgtggaaacagatcaccccggagctcaaccacattctgtccgaaaatgaggtgaagctgacaatcatgaccggcgacattaaagggatcatgcaggccggaaagcggtctcttagacctcaacccacggaactcaaatatagctggaagacctggggcaaggcgaaaatgctgtccacagagagccataaccagaccttcctgattgatgggcctgaaacagccgagtgccccaataccaaccgcgcttggaactctctcgaggttgaagactacggatttggcgtgttcacaaccaacatctggctgaaacttcgggagaaacaggacgtcttttgtgattccaagctgatgagcgccgctatcaaagacaatagagccgtgcacgcggatatgggctattggattgaatctgccctcaacgacacgtggaagatggagaaggcttccttcatcgaggttaaaagctgccactggcctaagtctcatacactgtggagcaatggggtgctggaatccgagatgattatccccaaaaacttcgccggaccggtcagccagcacaactaccgccctggctatcatacccaaaccgctgggccctggcaccttggaaagctcgaaatggattttgacctgtgtgagggcacaaccgtggtggtcacggaagattgcgggaatcggggaccctctctgagaacaaccacagcctccggcaaactcattaccgagtggtgctgtcggagctgcacactgcctccgcttcgctacagaggcgaggacgggtgttggtacggaatggaaatccggcccctgaaggagaaggaagagaacctcgttaattccctggtgaccgccggccatgggcagattgataacttctctctgggagtgcttggcatggctctctttctggaagagatgctgagaacgcgcatcgggaccaaacacgcgatcctcctggtcgccgtgagcttcgttacacttattaccggaaatatgtcctttcgggacctgggcagagtgatggtcatggtgggcgctacaatgaccgatgacatcgggatgggagttacgtatctcgccctgctggccgctttcaaggtgcgccctacatttgccgcgggccttctgctcagaaaactgacctctaaggagctcatgatggctacaattgggatcgccctgcttagccagtccaccattcccgaaaccatcctggagctcacagatgccctggctctgggaatgatggtccttaaaatcgtgcggaacatggaaaagtaccaactggccgttacgattatggcgatctcttgcgtgcctaatgctgtcattctccagaacgcctggaaggtgagctgtaccatcctggccgctgtgtccgtcagccccctcctgcttacatcttcccagcagaaagccgactggattcctctggctctcaccatcaagggcctgaatcccacagccatcttcctgaccacgcttagccgcacatctaaaaagagatcctggccgctgaacgaggcgattatggccgttgggatggtgagcatcctcgcttcttccctgctcaaaaatgacattcctatgaccggacccctggtggccggcggccttctgaccgtctgctatgtgctgacagggcggagcgctgatctcgaactggagcgcgccgccgacgttaagtgggaggatcaagctgaaatctccggaagctctcctattcttagcatcaccatttccgaggacggctctatgagcatcaaaaacgaagaggaggaacagacactgacgatcctcattagaaccgggctgctcgtggtctccggagtgtttcccgtttctatcccgattacagcggccgcttggtacctgtgggaggtgaagaagcagcgggccggcgtcctttgggatgtgccttctccccctcccgtcgaaaaagccgagctggaagacggggcttatcgcatcaagcagagagggattctgggctactcccaaatcggcgccggggtgtataaagagggaaccttccacacaatgtggcatgttacccggggcgcggtgctcatgcaccgcgggaagagaatcgagccctcctgggctgatgtcaaaaaggacctgattagctacggaggcgggtggaaacttgaaggagagtggaaagaaggcgaggaagtgcaggttctggccctcgagcctggcaagaatccgcgggccgtgcagacgaaacccgggatctttaagaccaacacaggaaccattggcgctgtctccctggatttcagccctgggacatctggatcccccatcgtggacagaaaaggcaaggtggttgggctctacggaaatggcgtcgtgacccgcagcggcgcctatgtgtctgcgattgctcagacagagaagtccatcgaagataaccctgagatcgaagacgatatttttcggaaaaagagactgacgatcatggaccttcatcccggggccggaaaaaccaagcgctacctgcctgccattgtccgggaggctatcaaaagaggcctgcgcacactcattctggccccgacccgggtggttgctgccgaaatggaggaggcgcttagagggctgcccatccgctatcaaacccctgccattaagacagaacacacgggacgggagatcgtggacctcatgtgtcatgctaccttcacaatgagactgctcagccccgtccgggtgcctaactacaatctgatcattatggatgaagcccacttcaccgaccccgcttccatcgccgcccgcggctatatttctacaagagttgagatgggggaggctgcgggcatctttatgaccgccacgccgcctggaagccgggatcccttcccccagtccaacgctcctattatggacgaagagagagaaatccccgagagaagctggaactctggccacgaatgggtgacagattttaaggggaaaaccgtctggttcgtgccttccatcaaggccggaaacgacattgccgcttgccttcggaaaaatggcaagaaagttatccagctgagcagaaagacctttgattctgagtacgtgaagacacgcgccaacgactgggatttcgtcgtgaccacagacattagcgagatgggggcgaattttaaagctgaacgggtgatcgatccgagacgctgtatgaagcccgtcattctgaccgacggagaggaacgggttatcctcgccggccctatgcccgtgacgcattcctctgccgctcaaagacgcgggcggatcggcagaaaccctaaaaatgagaacgaccagtatatttacatgggagaacccctggagaatgatgaggactgcgcccactggaaggaagcgaaaatgcttctggataacatcaatacaccggagggcattatccctagcatgttcgaacccgagcgcgaaaaggtggacgccattgatggggagtacagactccggggagaggctcgcaaaacctttgtcgacctgatgagacggggcgatctgcctgtgtggctcgcctataaggttgctgccgaagggatcaactacgctgaccgcaagtggtgtttcgatggaattaaaaataaccagatccttgaggaaaacatggaggtggagatctggacaaaggaaggcgagcgcaagaagctgaaaccccggtggctggacgccagaatttattccgatcctctcgcgctgaaggaatttaaggagttcgccgctgggcgcaaatctcttaccctgaatctcatcacggaaatgggccggctgcccaccttcatgacacagaaggccagaaacgctctggacaatctcgccgtccttcataccgccgaggctggaggccgcgcgtacaaccacgccctgagcgagctgccggaaacactcgagaccctgcttctgctcacactgctggctaccgtgacagggggaatttttctcttccttatgtccggcaaagggatcggaaagatgacactgggcatgtgctgcattatcaccgccagcatcctgctctggtatgcccaaattcagcctcactggatcgctgcctctattatcctggaatttttccttattgttctgctcatccccgagcccgaaaaacagcggacccctcaggataatcaactgacatacgtggtcatcgcgattctgaccgtggtcgccgctacaatggccaacgagatgggctttctcgagaagacgaagaaagaccttgggctgggatccatcaccacacaggaaagcgagtccaatattctggacatcgatctcagaccggcttctgcctggaccctgtatgcggtggccacaaccttcgttacgcccatgcttcggcatagcattgaaaactcctctgtgaatgtgagcctgaccgctatcgccaaccaggctacagtcctcatgggcctggggaagggatggcctctgtccaaaatggacattggcgttcccctccttgccatcgggtgttacagccaggtgaatcctatcaccctgacagctgccctgctcctgcttgtggcgcactacgccattatcggacccggcctgcaagctaaggccacccgcgaggctcagaaaagagccgccgcgggcattatgaagaaccctacggtcgatgggatcacagtgattgacctcgaaccgatcccctatgatcctaagtttgagaaacagctgggacaggttatgctgctcatcctttgcgtgacccaagtcctgatgatgcggacaacctgggctctgtgtgaggccctcaccctggctacaggccccatttctacgctttgggaagggaatcctggacgcttctggaacaccacaatcgccgtgtccatggccaatatttttagaggcagctacctggctggggccggactcctgttctctatcatgaagaacaccacaaatacccggcgcggcacgggcaacattggggagacactgggagaaaaatggaagtccagactcaacgcgcttggcaaaagcgagtttcagatctataagaaatctgggatccaggaggtcgaccggaccctggccaaggaaggaattaagcgcggcgagaccgatcatcacgctgtgagcagagggtccgccaaactgcggtggttcgttgaaagaaatatggtgacacccgagggaaaggtcgtggacctcggctgcggccgcgggggatggtcttactattgtggcgggctgaaaaacgttcgggaagtgaagggacttaccaaaggcgggccgggacatgaggagcctatccccatgagcacatacggctggaatctggtcagactccaatccggcgtggatgtgtttttcacgccccctgaaaagtgcgacaccctgctgtgtgatattggggagagctcccccaaccctacaatcgaagctggacgcaccctccgggttcttaatctggtcgagaactggctgaataacaatacacagttctgcattaaggtgctcaacccgtatatgccctctgtgatcgagaagatggaggccctgcagagaaagtacggcggggcgcttgtccgcaatcctctgagccggaactccacccacgagatgtactgggtttctaatgccacgggaaacatcgtgagctccgtgaatatgatttctagaatgctcatcaaccgctttaccatgaaacacaagaaagctacatatgaacccgacgtcgatctgggcagcgggacccggaacattggaatcgagtccgaaattcctaatctggacatcattggcaagagaatcgagaagatcaaacaggaacatgagacaagctggcactacgaccaagatcatccctataagacctgggcctaccacggctcttatgagacaaaacagaccgggtccgctagctctatggtgaacggagttgtgcgcctccttacgaagccgtgggacgtcgtgcctatggttacacagatggccatgaccgataccacacccttcggccagcaacgggtgtttaaagaaaaggtcgacacgagaacccaggagcctaaggaagggaccaagaagctgatgaaaattaccgctgagtggctgtggaaggagctcggcaaaaagaaaacaccccgcatgtgtaccagagaagagttcacacggaaggtgcgctccaatgccgcgctgggcgccatctttaccgatgaaaacaagtggaaaagcgctagagaggccgtggaagacgggcggttctgggagcttgtcgatagagagcggaatctgcacctcgaaggaaagtgcgagacgtgtgtttacaacatgatgggcaaacgcgaaaagaaactgggcgagtttgggaaggctaagggatctagagccatttggtatatgtggctgggcgcccggttcctcgaatttgaggcgctggggttccttaatgaggaccattggttttcccgcggaaacagcctgtccggcgtggaaggggagggcctccacagactgggatacatccttcgggatgtgggcaaaaaggaagggggagctatgtacgccgacgataccgccggctgggacacacgcattaccctggaggacctcaaaaatgaagagatggtcacaaaccatatgaagggggagcacaaaaagctggctgaagccatcttcaagctgacctatcagaataaagtggttagagtgcagcggcctacgccccgcggaacagtcatggatatcattagcagacgggaccaacgcggctctggacaggtgggcacctacggactcaacacatttaccaatatggaggctcagctgatcagacaaatggaaggcgaggggattttcaagagcatccagcatcttacggccaccgaggaaattgcggttcagaactggctggcccgggtgggacgcgagagactctcccggatggctatctctggcgatgactgcgtcgtgaaaccgatcgatgacagattcgccagcgctctgacagcccttaatgatatggggaaggttcgcaaagacattcagcaatgggaaccttcccggggatggaacgattggacccaggtgcccttttgctctcaccacttccatgagctggtcatgaaggacggcagagtgctcgtcgtgccctgtcgcaaccaggatgaactgatcgggcgggcgagaattagccagggcgccggatggtccctgaaggagacagcttgcctcggcaaatcttatgcccaaatgtggaccctgatgtactttcaccgccgggaccttagactggctgccaatgctatctgtagcgccgttcctccgcattgggtgcccacatcccgcaccacgtggagcattcacgcgaagcacgagtggatgacaaccgaagatatgctcgccgtctggaaccgggtgtggatccaggagaatccttggatggaagacaaaacccccgtggagtcttgggaagaggttccttatctggggaagagagaggaccagtggtgcggatcccttattggcctgacaagccgcgctacctgggccaaaaacatccagacagccatcaatcaagtgcggtctctcattgggaacgaagagtacacggattatatgccctccatgaagagattccggagagaagaggaagaggctggagtcctgtggtga

SEQ ID NO: 19794 - RNA, 9876 nt, synthetic construct
  misc_feature 1..9876: note = derived and/or modified CDS sequence (opt5) from DENV-2__GQ199895__SS-prME
  source 1..9876: mol_type = other RNA
acagccggagtgatcgtcatgctgattcccacggctatggccttccacctcacgaccagaaatggggagcctcatatgatcgttggacggcaggaaaagggcaaaagcctgctttttaagacagaggacggggtgaatatgtgcaccctgatggcgattgatctcggagaactgtgtgaggacacaatcacctacaaatgcccgcttctgagacaaaatgaacccgaggatattgactgttggtgcaatagcacatctacctgggtgacgtatggcacctgtacaaccacaggggagcacagacgggaaaagcgcagcgtcgctctcgtgcctcatgttggaatgggcctggagaccagaacggaaacatggatgtcctctgagggcgcctggaaacacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaggaacaggacaaacgctttatctgcaagcattccatggtggatagaggctggggcaacgggtgtggactgttcggcaaagggggaattgtcacatgcgccatgtttacgtgcaaaaagaatatggaaggcaaagttgtgcagcctgagaacctcgaatacaccatcgtgattacaccccacagcggggaggagcatgcggtcggaaatgacaccggcaagcacggcaaagaaatcaagatcacacctcagtcttccattaccgaggccgaactgacggggtatggaaccgtgacaatggagtgtagcccccggaccggccttgatttcaacgaaatggttctgctccaaatggaggacaaggcttggctggtgcaccgccagtggtttcttgatctgccgctcccttggctgcccggggccgacacacagggatctaattggatccagaaggagaccctggtcacgttcaagaaccctcatgctaaaaagcaagacgtggttgtgctcggctcccaggaaggggccatgcacacagccctgaccggcgctacagagattcagatgagctccggaaatcttctgtttaccggccatctcaaatgcagactgcggatggataaacttcaactgaaagggatgtcttacagcatgtgtaccggaaagttcaagatcgtcaaagaaattgcggagacacagcacggcacgatcgtgatcagagtccagtatgagggggacggatccccctgcaagattcccttcgaaatcaccgatctcgagaaacgccatgtgctgggccggctgattacagttaaccctatcgtgaccgaaaaggacagcccggtcaacattgaggccgaacccccttttggggattcttacatcattatcggcgtggagcccggacagctcaaactgaattggttcaagaagggctccagcatcgggcaaatgtttgagacaaccatgagaggagctaaacgcatggccattcttggcgacacggcctgggatttcgggtctctgggaggcgtttttacaagcatcgggaaggctctccaccaggtgttcggcgccatttacggagcggctttttccggcgtctcttggaccatgaaaatcctgattggggtgatcatcacctggattggaatgaacagccggtccacaagcctgtctgtgtcccttgttctcgtcggcgtggtgaccctgtatctgggggccatggtccaggccgacagcggatgtgtggtttcttggaagaataaagaactcaagtgcggctccgggatcttcattacagataacgtgcacacgtggaccgagcagtacaagtttcaacctgaaagcccctccaaactggcttctgccatccagaaggctcatgaggaaggcatttgtggaatcagaagcgtcacacgccttgagaatctgatgtggaaacagatcaccccggagctcaaccacattctgtccgaaaatgaggtgaagctgacaatcatgaccggcgacattaaagggatcatgcaggccggaaagcggtctcttagacctcaacccacggaactcaaatatagctggaagacctggggcaaggcgaaaatgctgtccacagagagccataaccagaccttcctgattgatgggcctgaaacagccgagtgccccaataccaaccgcgcttggaactctctcgaggttgaagactacggatttggcgtgttcacaaccaacatctggctgaaacttcgggagaaacaggacgtcttttgtgattccaagctgatgagcgccgctatcaaagacaatagagccgtgcacgcggatatgggctattggattgaatctgccctcaacgacacgtggaagatggagaaggcttccttcatcgaggttaaaagctgccactggcctaagtctcatacactgtggagcaatggggtgctggaatccgagatgattatccccaaaaacttcgccggaccggtcagccagcacaactaccgccctggctatcatacccaaaccgctgggccctggcaccttggaaagctcgaaatggattttgacctgtgtgagggcacaaccgtggtggtcacggaagattgcgggaatcggggaccctctctgagaacaaccacagcctccggcaaactcattaccgagtggtgctgtcggagctgcacactgcctccgcttcgctacagaggcgaggacgggtgttggtacggaatggaaatccggcccctgaaggagaaggaagagaacctcgttaattccctggtgaccgccggccatgggcagattgataacttctctctgggagtgcttggcatggctctctttctggaagagatgctgagaacgcgcatcgggaccaaacacgcgatcctcctggtcgccgtgagcttcgttacacttattaccggaaatatgtcctttcgggacctgggcagagtgatggtcatggtgggcgctacaatgaccgatgacatcgggatgggagttacgtatctcgccctgctggccgctttcaaggtgcgccctacatttgccgcgggccttctgctcagaaaactgacctctaaggagctcatgatggctacaattgggatcgccctgcttagccagtccaccattcccgaaaccatcctggagctcacagatgccctggctctgggaatgatggtccttaaaatcgtgcggaacatggaaaagtaccaactggccgttacgattatggcgatctcttgcgtgcctaatgctgtcattctccagaacgcctggaaggtgagctgtaccatcctggccgctgtgtccgtcagccccctcctgcttacatcttcccagcagaaagccgactggattcctctggctctcaccatcaagggcctgaatcccacagccatcttcctgaccacgcttagccgcacatctaaaaagagatcctggccgctgaacgaggcgattatggccgttgggatggtgagcatcctcgcttcttccctgctcaaaaatgacattcctatgaccggacccctggtggccggcggccttctgaccgtctgctatgtgctgacagggcggagcgctgatctcgaactggagcgcgccgccgacgttaagtgggaggatcaagctgaaatctccggaagctctcctattcttagcatcaccatttccgaggacggctctatgagcatcaaaaacgaagaggaggaacagacactgacgatcctcattagaaccgggctgctcgtgatctccggagtctttcccgtgtctattccgatcacagcggccgcttggtacctgtgggaggttaagaagcagcgggccggcgtgctttgggatgtcccttctccccctcccgtggaaaaagccgagctggaagacggggcttatcgcattaagcagagaggaatcctgggctactcccaaatcggcgccggggtctataaagagggaaccttccacacaatgtggcatgtgacccggggcgcggttctcatgcaccgcgggaagagaattgagccctcctgggctgatgtgaaaaaggacctgatcagctacggaggcgggtggaaacttgaaggagagtggaaagaaggcgaggaagtccaggtgctggccctcgagcctggcaagaatccgcgggccgttcagacgaaacccgggatttttaagaccaacacaggaaccatcggcgctgtgtccctggatttcagccctgggacatctggatcccccattgtcgacagaaaaggcaaggtggtggggctctacggaaatggcgttgtcacccgcagcggcgcctatgtgtctgcgatcgctcagacagagaagtccatcgaagataaccctgagattgaagaggacatctttcggaaaaagagactgacgattatggatcttcatcccggggccggaaaaaccaagcgctacctgcctgccatcgtgcgggaagctattaaaagaggcctgcgcacactcatcctggccccgacccgggtcgtggctgccgagatggaggaagcgcttagagggctgcccattcgctatcaaacccctgccatcaagacagagcacacgggacgggaaatcgttgacctcatgtgtcatgctaccttcacaatgagactgctcagccccgtgcgggtccctaactacaatctgattatcatggacgaggcccacttcaccgatcccgcttccattgccgcccgcggctatatctctacaagagtggagatgggggaagctgcgggcatttttatgaccgccacgccgcctggaagccgggaccccttcccccagtccaacgctcctatcatggatgaggaacgcgagatccccgaaagaagctggaactctggccacgagtgggttacagactttaaggggaaaaccgtgtggttcgtcccttccattaaggccggaaacgatatcgccgcttgccttcggaaaaatggcaagaaagtgattcagctgagcagaaagacctttgactctgagtacgttaagacacgcgccaacgattgggacttcgtggtcaccacagatatcagcgaaatgggggcgaattttaaagctgagcgggtgattgacccgagacgctgtatgaagcccgtgatcctgaccgatggagaagaacgggtcatcctcgccggccctatgcccgttacgcattcctctgccgctcaaagacgcgggcggattggcagaaaccctaaaaatgaaaacgaccagtatatctacatgggagagcccctggagaatgacgaagattgcgcccactggaaggaggcgaaaatgcttctggacaacattaatacaccggaaggcatcattcctagcatgttcgagcccgaacgcgagaaggtggatgccatcgacggggagtacagactccggggagaagctcgcaaaacctttgtggatctgatgagacggggcgacctgcctgtctggctcgcctataaggtggctgccgaggggattaactacgctgatcgcaagtggtgtttcgacggaatcaaaaataaccagatccttgaagagaacatggaggttgaaatttggacaaaggagggcgaacgcaagaagctgaaaccccggtggctggatgccagaatctattccgaccctctcgcgctgaaggagtttaaggagttcgccgctgggcgcaaatctcttaccctgaatctcattacggagatgggccggctgcccaccttcatgacacagaaggccagaaacgctctggataatctcgccgtgcttcataccgccgaggctggaggccgcgcgtacaaccacgccctgagcgaactgccggagacactcgaaaccctgcttctgctcacactgctggctaccgtcacagggggaatctttctcttccttatgtccggcaaagggattggaaagatgacactgggcatgtgctgcatcatcaccgccagcattctgctctggtatgcccaaatccagcctcactggattgctgcctctatcattctggagtttttccttatcgtgctgctcatccccgaacccgagaaacagcggacccctcaggacaatcaactgacatacgttgtgattgcgatcctgaccgtcgtggccgctacaatggccaacgagatgggctttctcgaaaagacgaagaaagatcttgggctgggatccattaccacacaggagagcgaatccaatatcctggacattgacctcagaccggcttctgcctggaccctgtatgcggtcgccacaaccttcgtgacgcccatgcttcggcatagcatcgagaactcctctgttaatgtgagcctgaccgctattgccaaccaggctacagtgctcatgggcctggggaagggatggcctctgtccaaaatggatatcggcgtccccctccttgccatcgggtgttacagccaggttaatcctattaccctgacagctgccctgctcctgcttgtggcgcactacgccatcattggacccggcctgcaagctaaggccacccgcgaagctcagaaaagagccgccgcgggcatcatgaagaaccctacggtggacgggattacagtcatcgatctcgagccgatcccctatgaccctaagtttgagaaacagctgggacaggtgatgctgctcattctttgcgttacccaagtgctgatgatgcggacaacctgggctctgtgtgaagccctcaccctggctacaggccccatctctacgctttgggaggggaatcctggacgcttctggaacaccacaattgccgtctccatggccaatatctttagaggcagctacctggctggggccggactcctgttctctattatgaagaacaccacaaatacccggcgcggcacgggcaacatcggggaaacactgggagagaaatggaagtccagactcaacgcgcttggcaaaagcgagtttcagatctataagaaatctgggattcaggaagtggatcggaccctggccaaggagggaatcaagcgcggcgaaaccgaccatcacgctgtcagcagagggtccgccaaactgcggtggttcgtggagagaaatatggttacacccgaaggaaaggtggtcgatctcggctgcggccgcgggggatggtcttactattgtggcgggctgaaaaacgtgcgggaggttaagggacttaccaaaggcgggccgggacatgaggaacctattcccatgagcacatacggctggaatctggtgagactccaatccggcgtcgacgtgtttttcacgccccctgagaagtgcgataccctgctgtgtgacatcggggaaagctcccccaaccctacaattgaggctggacgcaccctccgggtgcttaatctggttgaaaactggctgaataacaatacacagttctgcatcaaggtcctcaacccgtatatgccctctgtgatcgagaaaatggaggccctgcagagaaagtacggcggggcgcttgtgcgcaatcctctgagccggaactccacccacgaaatgtactgggtctctaatgccacgggaaacattgttagctccgtgaatatgatctctagaatgctcattaaccgctttaccatgaaacacaagaaagctacatatgagcccgatgtggacctgggcagcgggacccggaacatcggaattgaatccgagatccctaatctggatattatcggcaagagaatcgaaaagattaaacaggagcatgagacaagctggcactacgaccaagaccatccctataagacctgggcctaccacggctcttatgaaacaaaacagaccgggtccgctagctctatggtcaacggagtggttcgcctccttacgaagccgtgggatgtggtccctatggtgacacagatggccatgaccgacaccacacccttcggccagcaacgggtttttaaagagaaggtggatacgagaacccaggaacctaaggaggggaccaagaagctgatgaaaatcaccgctgagtggctgtggaaggaactcggcaagaagaaaacaccccgcatgtgtaccagagaggagttcacacggaaggtccgctccaatgccgcgctgggcgccatttttaccgacgagaacaagtggaaaagcgctagagaagccgtggaggatgggcggttctgggagcttgtggacagagaacggaatctgcacctcgagggaaagtgcgaaacgtgtgtctacaacatgatgggcaaacgcgagaagaaactgggcgaatttgggaaggctaagggatctagagccatctggtatatgtggctgggcgcccggttcctcgagtttgaggcgctggggttccttaatgaagatcattggttttcccgcggaaacagcctgtccggcgttgagggggaaggcctccacagactgggatacattcttcgggacgtgggcaaaaaggaagggggagctatgtacgccgatgacaccgccggctgggatacacgcatcaccctggaagacctcaaaaatgaggagatggtgacaaaccatatgaagggggaacacaaaaagctggctgaggccatcttcaagctgacctatcagaataaagtcgtgagagttcagcggcctacgccccgcggaacagtgatggacattatcagcagacgggatcaacgcggctctgggcaggtcggcacctacggactcaacacatttaccaatatggaagctcagctgattagacaaatggagggcgaggggatcttcaagagcattcagcatcttacggccaccgaagagatcgcggtgcagaactggctggcccgggttggacgcgaaagactctcccggatggctatctctggcgacgattgcgtggtcaaaccgattgacgatagattcgccagcgctctgacagcccttaatgacatggggaaggtgcgcaaagatatccagcaatgggagccttcccggggatggaacgactggacccaggttcccttttgctctcaccacttccatgaactggtgatgaaggatggcagagtcctcgtggtcccctgtcgcaaccaggacgagctgattgggcgggcgagaatcagccagggcgccggatggtccctgaaggagacagcttgcctcggcaaatcttatgcccaaatgtggaccctgatgtactttcaccgccgggatcttagactggctgccaatgctatttgtagcgccgtgcctccgcattgggttcccacatcccgcaccacgtggagcatccacgcgaagcacgaatggatgacaaccgaggacatgctcgccgtgtggaaccgggtctggattcaggaaaatccttggatggaggataaaacccccgtggaatcttgggaggaggtgccttatctggggaagagagaagaccagtggtgcggatcccttatcggcctgacaagccgcgctacctgggccaaaaacatccagacagccattaatcaagttcggtctctcatcgggaacgaggaatacacggactatatgccctccatgaagagattccggagagaggaagaggaggctggagtgctgtggtga

SEQ ID NO: 19795 - RNA, 9876 nt, synthetic construct
  misc_feature 1..9876: note = derived and/or modified CDS sequence (opt5) from DENV-2__FJ898478__SS-prME
  source 1..9876: mol_type = other RNA
acagccggagtgatcgtcatgctgattcccacggctatggccttccacctcacgacccggaatggggagcctcatatgatcgttggacggcaggaaaagggcaaaagcctgctttttaagacagaggacggggtgaatatgtgcaccctgatggcgattgatctcggagaactgtgtgaggacacaatcacctacaaatgcccgcttctgcgccaaaatgaacccgaggatattgactgttggtgcaatagcacatctacctgggtgacgtatggcacctgtacaaccacaggggagcacagacgggaaaagcgcagcgtcgctctcgtgcctcatgttggaatgggcctggagaccagaacggaaacatggatgtcctctgagggcgcctggaaacacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaagaacaggacaaacgctttatctgcaagcattccatggtggatagaggctggggcaacgggtgtggactgttcggcaaagggggaattgtcacatgcgccatgtttacgtgcaaaaagaatatggaaggcaaagttgtgcagcctgagaacctcgaatacaccatcgtgattacaccccacagcggggaggagcatgcggtcggaaatgacaccggcaagcacggcaaagaaatcaagatcacacctcagtcttccattaccgaggccgaactgacggggtatggaaccgtgacaatggagtgtagcccccggaccggccttgatttcaacgaaatggttctgctccaaatggaggacaaggcttggctggtgcaccgccagtggtttcttgatctgccgctcccttggctgcccggggccgacacacagggatctaattggatccagaaggagaccctggtcacgttcaagaaccctcatgctaaaaagcaagacgtggttgtgctcggctcccaggaaggggccatgcacacagccctgaccggcgctacagagattcagatgagctccggaaatcttctgtttaccggccatctcaaatgcagactgcggatggataaacttcaactgaaagggatgtcttacagcatgtgtaccggaaagttcaagatcgtcaaagaaattgcggagacacagcacggcacgatcgtgatcagagtccagtatgagggggacggatccccctgcaagattcccttcgaaatcaccgatctcgagaaacgccatgtgctgggccggctgattacagttaaccctatcgtgaccgaaaaggacagcccggtcaacattgaggccgaacccccttttggggattcttacatcattatcggcgtggagcccggacagctcaaactgaattggttcaagaagggctccagcatcgggcaaatgtttgagacaaccatgagaggagctaaacgcatggccattcttggcgacacggcctgggatttcgggtctctgggaggcgtttttacaagcatcgggaaggctctccaccaggtgttcggcgccatttacggagcggctttttccggcgtctcttggaccatgaaaatcctgattggggtgatcatcacctggattggaatgaacagccggtccacaagcctgtctgtgtcccttgttctcgtcggcgtggtgaccctgtatctgggggccatggtccaggccgacagcggatgtgtggtttcttggaagaataaagaactcaagtgcggctccgggatcttcattacagataacgtgcacacgtggaccgagcagtacaagtttcaacctgaaagcccctccaaactggcttctgccatccagaaggctcatgaggaaggcatttgtggaatcagaagcgtcacacgccttgagaatctgatgtggaaacagatcaccccggagctcaaccacattctgtccgaaaatgaggtgaagctgacaatcatgaccggcgacattaaagggatcatgcaggccggaaagcggtctcttagacctcaacccacggaactcaaatatagctggaagacctggggcaaggcgaaaatgctgtccacagagagccataaccagaccttcctgattgatgggcctgaaacagccgagtgccccaataccaaccgcgcttggaactctctcgaggttgaagactacggatttggcgtgttcacaaccaacatctggctgaaacttcgggagaaacaggacgtcttttgtgattccaagctgatgagcgccgctatcaaagacaatagagccgtgcacgcggatatgggctattggattgaatctgccctcaacgacacgtggaagatggagaaggcttccttcatcgaggttaaaagctgccactggcctaagtctcatacactgtggagcaatggggtgctggaatccgagatgattatccccaaaaacttcgccggaccggtcagccagcacaactaccgccctggctatcatacccaaaccgctgggccctggcaccttggaaagctcgaaatggattttgacctgtgtgagggcacaaccgtggtggtcacggaagattgcgggaatcggggaccctctctgagaacaaccacagcctccggcaaactcattaccgagtggtgctgtcggagctgcacactgcctccgcttcgctacagaggcgaggacgggtgttggtacggaatggaaatccggcccctgaaggagaaggaagagaacctcgttaattccctggtgaccgccggccatgggcagattgataacttctctctgggagtgcttggcatggctctctttctggaagagatgctgagaacgcgcatcgggaccaaacacgcgatcctcctggtcgccgtgagcttcgttacacttattaccggaaatatgtcctttcgggacctgggcagagtgatggtcatggtgggcgctacaatgaccgatgacatcgggatgggagttacgtatctcgccctgctggccgctttcaaggtgcgccctacatttgccgcgggccttctgctcagaaaactgacctctaaggagctcatgatggctacaattgggatcgccctgcttagccagtccaccattcccgaaaccatcctggagctcacagatgccctggctctgggaatgatggtccttaaaatcgtgcggaacatggaaaagtaccaactggccgttacgattatggcgatctcttgcgtgcctaatgctgtcattctccagaacgcctggaaggtgagctgtaccatcctggccgctgtgtccgtcagccccctcctgcttacatcttcccagcagaaagccgactggattcctctggctctcaccatcaagggcctgaatcccacagccatcttcctgaccacgcttagccgcacatctaaaaagagatcctggccgctgaacgaggcgattatggccgttgggatggtgagcatcctcgcttcttccctgctcaaaaatgacattcctatgaccggacccctggtggccggcggccttctgaccgtctgctatgtgctgacagggcggagcgctgatctcgaactggagcgcgccgccgacgttaagtgggaggatcaagctgaaatctccggaagctctcctattcttagcatcaccatttccgaggacggctctatgagcatcaaaaacgaagaggaggaacagacactgacgatcctcattagaaccgggctgctcgtgatctccggagtctttcccgtgtctattccgatcacagcggccgcttggtacctgtgggaggttaagaagcagcgggccggcgtgctttgggatgtcccttctccccctcccgtggaaaaagccgagctggaagacggggcttatcgcattaagcagagaggaatcctgggctactcccaaatcggcgccggggtctataaagagggaaccttccacacaatgtggcatgtgacccggggcgcggttctcatgcaccgcgggaagagaattgagccctcctgggctgatgtgaaaaaggacctgatcagctacggaggcgggtggaaacttgaaggagagtggaaagaaggcgaggaagtccaggtgctggccctcgagcctggcaagaatccgcgggccgttcagacgaaacccgggatttttaagaccaacacaggaaccatcggcgctgtgtccctggatttcagccctgggacatctggatcccccattgtcgacagaaaaggcaaggtggtggggctctacggaaatggcgttgtcacccgcagcggcgcctatgtgtctgcgatcgctcagacagagaagtccatcgaagataaccctgagattgaagacgatatctttcggaaaaagagactgacgattatggaccttcatcccggggccggaaaaaccaagcgctacctgcctgccatcgtgcgggaggctattaaaagaggcctgcgcacactcatcctggccccgacccgggtcgtggctgccgaaatggaggaggcgcttagagggctgcccattcgctatcaaacccctgccatcaagacagaacacacgggacgggagatcgttgacctcatgtgtcatgctaccttcacaatgagactgctcagccccgtgcgggtccctaactacaatctgattatcatggatgaagcccacttcaccgaccccgcttccattgccgcccgcggctatatctctacaagagtggagatgggggaggctgcgggcatttttatgaccgccacgccgcctggaagccgggatcccttcccccagtccaacgctcctatcatggacgaagagagagaaatccccgagagaagctggaactctggccacgaatgggttacagattttaaggggaaaaccgtgtggttcgtcccttccattaaggccggaaacgacatcgccgcttgccttcggaaaaatggcaagaaagtgattcagctgagcagaaagacctttgattctgagtacgttaagacacgcgccaacgactgggatttcgtggtcaccacagacatcagcgagatgggggcgaattttaaagctgaacgggtgattgatccgagacgctgtatgaagcccgtgatcctgaccgacggagaggaacgggtcatcctcgccggccctatgcccgttacgcattcctctgccgctcaaagacgcgggcggattggcagaaaccctaaaaatgagaacgaccagtatatctacatgggagaacccctggagaatgatgaggactgcgcccactggaaggaagcgaaaatgcttctggataacattaatacaccggagggcatcattcctagcatgttcgaacccgagcgcgaaaaggtggacgccatcgatggggagtacagactccggggagaggctcgcaaaacctttgtggacctgatgagacggggcgatctgcctgtctggctcgcctataaggtggctgccgaagggattaactacgctgaccgcaagtggtgtttcgatggaatcaaaaataaccagatccttgaggaaaacatggaggttgagatttggacaaaggaaggcgagcgcaagaagctgaaaccccggtggctggacgccagaatctattccgatcctctcgcgctgaaggaatttaaggagttcgccgctgggcgcaaatctcttaccctgaatctcattacggaaatgggccggctgcccaccttcatgacacagaaggccagaaacgctctggacaatctcgccgtgcttcataccgccgaggctggaggccgcgcgtacaaccacgccctgagcgagctgccggaaacactcgagaccctgcttctgctcacactgctggctaccgtcacagggggaatctttctcttccttatgtccggcaaagggattggaaagatgacactgggcatgtgctgcatcatcaccgccagcattctgctctggtatgcccaaatccagcctcactggattgctgcctctatcattctggaatttttccttatcgtgctgctcatccccgagcccgaaaaacagcggacccctcaggataatcaactgacatacgttgtgattgcgatcctgaccgtcgtggccgctacaatggccaacgagatgggctttctcgagaagacgaagaaagaccttgggctgggatccattaccacacaggaaagcgagtccaatatcctggacattgatctcagaccggcttctgcctggaccctgtatgcggtcgccacaaccttcgtgacgcccatgcttcggcatagcatcgaaaactcctctgttaatgtgagcctgaccgctattgccaaccaggctacagtgctcatgggcctggggaagggatggcctctgtccaaaatggacatcggcgtccccctccttgccatcgggtgttacagccaggttaatcctattaccctgacagctgccctgctcctgcttgtggcgcactacgccatcattggacccggcctgcaagctaaggccacccgcgaggctcagaaaagagccgccgcgggcatcatgaagaaccctacggtggatgggattacagtcatcgacctcgaaccgatcccctatgatcctaagtttgagaaacagctgggacaggtgatgctgctcattctttgcgttacccaagtgctgatgatgcggacaacctgggctctgtgtgaggccctcaccctggctacaggccccatctctacgctttgggaagggaatcctggacgcttctggaacaccacaattgccgtctccatggccaatatctttagaggcagctacctggctggggccggactcctgttctctattatgaagaacaccacatccacccggcgcggcacgggcaatatcggggagacactgggagaaaaatggaaaagcagactcaacgcgcttggcaaatctgagtttcagatctataagaaaagcgggattcaggaggtggaccggaccctggccaaggaaggaatcaagcgcggcgagaccgatcatcacgctgtctccagagggtctgccaaactgcggtggttcgtggaaagaaacatggttacacccgagggaaaggtggtcgacctcggctgcggccgcgggggatggagctactattgtggcgggctgaaaaatgtgcgggaagttaagggacttaccaaaggcgggccgggacatgaggagcctattcccatgtccacatacggctggaacctggtgagactccaaagcggcgtcgatgtgtttttcacgccccctgaaaagtgcgacaccctgctgtgtgatatcggggagtcctctcccaatcctacaattgaagctggacgcaccctccgggtgcttaacctggttgagaattggctgaacaataacacacagttctgcatcaaggtcctcaatccgtatatgcccagcgtgatcgagaagatggaggccctgcagagaaagtacggcggggcgcttgtgcgcaaccctctgtccagaaattctacccacgagatgtactgggtcagcaacgccacgggaaatattgtttcctctgtgaacatgatcagcagaatgctcattaatcgctttaccatgaaacacaagaaagctacatatgaacccgacgtggatctgggctccgggacccggaacatcggaattgagagcgaaatccctaacctggacattatcggcaagagaatcgagaagattaaacaggaacatgagacatcttggcactacgaccaagatcatccctataagacctgggcctaccacggctcctatgagacaaaacagaccgggagcgcttcttccatggtcaatggagtggttcgcctccttacgaagccgtgggacgtggtccctatggtgacacagatggccatgaccgataccacacccttcggccagcaacgggtttttaaagaaaaggtggacacgagaacccaggagcctaaggaagggaccaagaagctgatgaaaatcaccgctgagtggctgtggaaggagctcggcaagaagaaaacaccccgcatgtgtaccagagaagagttcacacggaaggtccgcagcaacgccgcgctgggcgccatttttaccgatgaaaataagtggaaatctgctagagaggccgtggaagacgggcggttctgggagcttgtggatagagagcggaacctgcacctcgaaggaaagtgcgagacgtgtgtctacaatatgatgggcaaacgcgaaaagaaactgggcgagtttgggaaggctaagggatccagagccatctggtatatgtggctgggcgcccggttcctcgaatttgaggcgctggggttccttaacgaggaccattggtttagccgcggaaattccctgagcggcgttgaaggggagggcctccacagactgggatacattcttcgggatgtgggcaaaaaggaagggggagctatgtacgccgacgataccgccggctgggacacacgcatcaccctggaggacctcaaaaacgaagagatggtgacaaatcatatgaagggggagcacaaaaagctggctgaagccatcttcaagctgacctatcagaacaaagtcgtgagagttcagcggcctacgccccgcggaacagtgatggatattatctctagacgggaccaacgcggcagcgggcaggtcggcacctacggactcaatacatttaccaacatggaggctcagctgattagacaaatggaaggcgaggggatcttcaagtccattcagcatcttacggccaccgaggaaatcgcggtgcagaattggctggcccgggttggacgcgagagactctctcggatggctatcagcggcgatgactgcgtggtcaaaccgattgatgacagattcgcctccgctctgacagcccttaacgatatggggaaggtgcgcaaagacatccagcaatgggaaccttctcggggatggaatgattggacccaggttcccttttgcagccaccacttccatgagctggtgatgaaggacggcagagtcctcgtggtcccctgtcgcaaccaggatgaactgattgggcgggcgagaatctcccagggcgccggatggtctctgaaggagacagcttgcctcggcaaaagctatgcccaaatgtggaccctgatgtactttcaccgccgggaccttagactggctgccaacgctatttgttccgccgtgcctagccattgggttccgacatctcgcaccacgtggtccatccacgcgaagcacgagtggatgacaaccgaagatatgctcgccgtgtggaatcgggtctggattcaggagaacccctggatggaagacaaaacccctgtggagagctgggaagaggtgccctatctggggaagagagaggaccagtggtgcggatctcttatcggcctgacatcccgcgctacctgggccaaaaatatccagacagccattaaccaagttcggagcctcatcgggaatgaagagtacacggattatatgccttccatgaagagattccggagagaagaggaagaggctggagtgctgtggtga

SEQ ID NO: 19796 - RNA, 9876 nt, synthetic construct
  misc_feature 1..9876: note = derived and/or modified CDS sequence (opt5) from DENV-2__GQ199869__SS-prME
  source 1..9876: mol_type = other RNA
acagccggcgtgatcgtcatgctgattcccacagctatggccttccacctcacgacccggaatggggaacctcatatgatcgttggacggcaggaaaagggcaagagcctgctttttaagacagaagacggggtgaatatgtgcaccctgatggcgattgatctcggagaactgtgtgaggacacaatcacctacaaatgcccgcttctgcgccaaaatgaacccgaggatattgactgttggtgcaattccacatctacctgggtgacgtatggcacctgtacaaccacaggggagcacagacgggaaaagcgcagcgtcgctctcgtgcctcatgttggaatgggcctggagaccagaacggaaacatggatgtcctctgagggcgcctggaaacacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaagaacaggacaaacgctttatctgcaagcattccatggtggatagaggctggggcaacgggtgtggactgttcggcaaaggcgggattgtcacatgcgccatgtttacgtgcaaaaagaatatggaagggaaagttgtgcagcctgagaacctcgaatacaccatcgtgattacaccccacagcggggaggagcatgcggtcggaaatgacaccggcaagcacggcaaagaaatcaagatcacacctcagtcttccattaccgaggccgaactgacggggtatggaaccgtgacaatggagtgtagcccccggaccggccttgatttcaacgaaatggttctgctccaaatggaggacaaggcttggctggtgcaccgccagtggtttcttgatctgccgctcccttggctgcccggggccgacatccagggatctaattggattcagaaggagacactggtcaccttcaagaaccctcatgctaaaaagcaagacgtggttgtgctcggctcccaggaaggggccatgcacacggccctgacaggcgctaccgagatccagatgagctccggaaatcttctgtttacaggccatctcaaatgcagactgcggatggataaacttcaactgaaagggatgtcttacagcatgtgtaccggaaagttcaagattgtcaaagaaatcgcggagacccagcacggcacaatcgtgattagagtccagtatgagggggacggatccccctgcaagatccccttcgaaattacggatctcgagaaacgccatgtgctgggccggctgatcaccgttaaccctattgtgacagaaaaggacagcccggtcaacatcgaggccgaacccccttttggggattcttacattatcatcggcgtggagcccggacagctcaaactgaattggttcaagaagggctccagcattgggcaaatgtttgagaccacaatgagaggagctaaacgcatggccatccttggcgacaccgcctgggatttcgggtctctgggaggcgtttttacgagcattgggaaggctctccaccaggtgttcggcgccatctacggagcggctttttccggcgtctcttggacaatgaaaattctgatcggggtgatcattacctggatcggaatgaacagccggtccaccagcctgtctgtgtcccttgttctcgtcggcgtggtgacactgtatctgggggccgtcgtgcaggccgacagcggatgtgttgtgtcttggaagaataaagaactcaagtgcggctccgggattttcatcaccgataacgtccacacatggacggagcagtacaagtttcaacctgaaagcccctccaaactggcttctgccattcagaaggctcatgaggaaggcatctgtggaatcagaagcgtgacccgccttgagaatctgatgtggaaacagattacaccggagctcaaccacatcctgtccgaaaatgaggttaagctgaccattatgacaggcgacatcaaagggattatgcaggccggaaagcggtctcttagacctcaacccaccgaactcaaatatagctggaagacgtggggcaaggcgaaaatgctgtccaccgagagccataaccagacattcctgatcgatgggcctgaaaccgccgagtgccccaatacaaaccgcgcttggaactctctcgaggtggaagactacggatttggcgtcttcaccacaaacatctggctgaaacttcgggagaaacaggacgtgttttgtgattccaagctgatgagcgccgctattaaagacaatagagccgttcacgcggatatgggctattggatcgaatctgccctcaacgacacctggaagatggagaaggcttccttcattgaggtgaaaagctgccactggcctaagtctcatacgctgtggagcaatggggtcctggaatccgagatgatcattcccaaaaacttcgccggaccggtgagccagcacaactaccgccctggctatcatacacaaaccgctgggccctggcaccttggaaagctcgaaatggattttgacttctgtgagggcaccacagtggtcgttaccgaagattgcgggaatcggggaccctctctgagaacgacaaccgcctccggcaaactgatcacagagtggtgctgtcggagctgcaccctccctccgctgcgctacagaggcgaggacgggtgttggtacggaatggaaattcggccccttaaggagaaggaagagaacctggtgaatagcctcgtgacagccggccatgggcagatcgataacttttctctgggagtcctgggcatggctcttttcctcgaagagatgctgagaacccgcatcgggacgaaacacgcgattctgctcgtggccgttagctttgtgaccctgatcacaggaaatatgtccttccgggaccttggcagagtcatggtgatggttggcgctaccatgacagatgacattgggatgggagtgacctatctggccctcctggccgcttttaaggtccgccctacgttcgccgcgggcctgcttctgagaaaactcacatctaaggagctgatgatggctaccatcgggattgccctcctgagccagtccacaatccccgaaaccatccttgagctgaccgatgccctcgctctgggaatgatggtgctgaaaattgttcggaacatggaaaagtaccaacttgccgtgacaatcatggcgatttcttgcgtccctaatgctgtgatcctgcagaacgcctggaaggtgagctgtacgattctcgccgctgtctccgttagccccctgctcctgacctcttcccagcagaaagccgactggatccctcttgctctgacaatcaagggcctcaatcccaccgccatttttctgacaaccctgagccgcacgtctaaaaagagatcctggccgcttaacgaggcgatcatggccgtggggatggtgagcattctggcttcttccctcctgaaaaatgacatccctatgacaggacccctcgtcgccggcggcctgcttaccgtgtgctatgttctgaccgggcggagcgctgatctggaactcgagcgcgccgccgacgtgaagtgggaggatcaagctgaaatttccggaagctctcctatcctgagcattacaatctccgaggacggctctatgagcatcaaaaacgaagaggaggaacagacccttacaattctgatcagaacggggctcctggtcatttccggagtgttccccgtttctatcccgattaccgcggccgcttggtacctctgggaggtgaagaagcagcgggccggcgtcctgtgggatgtgccttctccccctcccgtcgaaaaagccgagcttgaagacggggcttatcgcatcaagcagagaggaatcctgggctactcccaaattggcgccggggtgtataaagagggaacatttcacaccatgtggcatgttacacggggcgcggtgctgatgcaccgcgggaagagaatcgagccctcctgggctgatgtcaaaaaggacctcattagctacggaggcgggtggaagctggaaggagagtggaaagaaggcgaggaagtgcaggttcttgccctggagcctggcaagaatccgcgggccgtgcagaccaaacccgggatcttcaagacgaacaccggaacaattggcgctgtctccctcgattttagccctgggacctctggatcccccatcgtggacagaaaaggcaaggtggttgggctgtacggaaatggcgtcgtgacacgcagcggcgcctatgtgtctgcgatcgctcagaccgagaagtccattgaagataaccctgagatcgaagacgatattttccggaaaaagagactcacaatcatggacctgcatcccggggccggaaaaacgaagcgctaccttcctgccattgtccgggaggctatcaaaagaggcctgcgcaccctgattctcgccccgacacgggtggttgctgccgaaatggaggaggcgctgagagggcttcccatccgctatcaaacccctgccatcaagaccgaacacacaggacgggagattgtggacctgatgtgtcatgctacgttcaccatgagactcctgagccccgtccgggtgcctaactacaatctcatcattatggatgaagcccactttacagaccccgcttccatcgccgcccgcggctatatttctaccagagttgagatgggggaggctgcgggcatcttcatgacagccaccccgcctggaagccgggatccctttccccagtccaacgctcctatcatggacgaagaaagagaaattcccgagagaagctggaactctggccacgaatgggtgacggatttcaaggggaaaacagtctggtttgtgccttccatcaaggccggaaacgacattgccgcttgcctgcggaaaaatggcaagaaagttatccagcttagcagaaagaccttcgattctgagtacgtgaagacccgcgccaacgactgggattttgtcgtgacaaccgacattagcgagatgggggcgaatttcaaagctgaacgggtgatcgatccgagacgctgtatgaagcccgtcatcctgacagacggagaggaacgggttattctggccggccctatgcccgtgacccattcctctgccgctcaaagacgcgggcggatcggcagaaaccctaaaaatgagaacgaccagtatatttacatgggagaacccctcgagaatgatgaggactgcgcccactggaaggaagcgaaaatgctgcttgataacatcaatacgccggagggcattatccctagcatgtttgaacccgagcgcgaaaaggtggacgccattgatggggagtacagactgcggggagaggctcgcaaaacattcgtcgacctcatgagacggggcgatctgcctgtgtggctggcctataaggttgctgccgaagggatcaactacgctgaccgcaagtggtgttttgatggaatcaaaaataaccagattctcgaggaaaacatggaggtggagatctggaccaaggaaggcgagcgcaagaaacttaaaccccggtggctggacgccagaatttattccgatcctctggcgctcaaggagttcaaggagttcgccgctgggcgcaaatctctgacacttaatctgatcaccgaaatgggccggctccccacgtttatgacccagaaggccagaaacgctctggacaatctggccgtcctccatacagccgaggctggaggccgcgcgtacaaccacgcccttagcgagctgccggaaaccctggagacactcctgcttctgaccctcctggctacagtgaccgggggaattttcctgtttctcatgtccggcaaagggatcggaaagatgacgcttggcatgtgctgcatcattacagccagcatcctgctgtggtatgcccaaattcagcctcactggatcgctgcctctattatcctcgagttctttctgatcgttcttctgattcccgagcccgaaaaacagcggacccctcaggataatcaactcacctacgtggtcatcgcgattctgacagtggtcgccgctaccatggccaacgagatgggcttcctggagaagacaaagaaagacctcgggcttggatccatcacgacccaggaaagcgagtccaatattctggacatcgatctgagaccggcttctgcctggacactctatgcggtggccaccacatttgttacccccatgctgcggcatagcattgaaaactcctctgtgaatgtgagccttacggctatcgccaaccaggctaccgtcctgatgggcctcgggaagggatggcctctgtccaaaatggacatcggcgttcccctgctcgccattgggtgttacagccaggtgaatcctatcacacttaccgctgccctgctgctcctggtggcgcactacgccattatcggacccggccttcaagctaaggccacacgcgaggctcagaaaagagccgccgcgggcattatgaagaaccctaccgtcgatgggatcacggtgatcgacctggaaccgattccctatgatcctaagttcgagaaacagctcggacaggttatgctgctgatcctctgcgtgacacaagtccttatgatgcggaccacatgggctctgtgtgaggccctgaccctcgctaccggccccatttctacactgtgggaagggaatcctggacgcttttggaacacgaccatcgccgtgtccatggccaatattttcagaggcagctaccttgctggggccggactgctcttttctatcatgaagaacacaacctccacacggcgcggcaccggcaatatcggggagacgctgggagaaaaatggaaaagcagactgaacgcgctcggcaaatctgagttccagatttataagaaaagcgggatccaggaggtcgaccggacacttgccaaggaaggaattaagcgcggcgagaccgatcatcacgctgtgtccagagggtctgccaaactgcggtggtttgttgaaagaaacatggtgacccccgagggaaaggtcgtggacctgggctgcggccgcgggggatggagctactattgtggcgggctcaaaaatgttcgggaagtgaagggactgacaaaaggcgggccgggacatgaggagcctatccccatgtccacctacggctggaaccttgtcagactgcaaagcggcgtggatgtgttcttcacaccccctgaaaagtgcgacacgctcctgtgtgatattggggagtcctctcccaatcctaccatcgaagctggacgcacactgcgggttctcaaccttgtcgagaattggctgaacaataacacccagttttgcatcaaggtgctgaatccgtatatgcccagcgtgattgagaagatggaggccctccagagacagtacggcggggcgctggtccgcaaccctctttccagaaattctacacacgagatgtactgggttagcaacgccaccggaaatatcgtgtcctctgtgaacatgattagcagaatgctgatcaatcgcttcacgatgaagcacaaaaaggctacctatgaacccgacgtcgatctcggctccgggacacggaacattggaatcgagagcgaaattcctaacctggacatcatcggcaaaagaattgagaagatcaagcaagaacatgagatttcttggcactacgaccaggatcatccctataaaacctgggcctaccacggctcctatgagacaaagcagaccgggagcgcttcttccatggtgaatggagttgtgcgcctgctcacaaaaccgtgggacgtcgtgcctatggttacccagatggccatgacggatacaaccccctttggccaacagcgggtgttcaaggaaaaagtcgacaccagaacacaggagcctaaggaagggacgaagaaacttatgaagatcaccgctgagtggctgtggaaagagctgggaaagaaaaagacaccccgcatgtgtaccagagaagagtttaccaagaaggtgcggagcaacgccgcgctcggcgccattttcaccgatgaaaataagtggaaatctgctcgcgaggccgtggaagacgggagattttgggagctggtcgatcgggagagaaaccttcacctggaaggaaagtgcgagacatgtgtttacaatatgatgggcaaacgggaaaagaaactcggcgagttcgggaaggctaagggatcccgcgccatctggtatatgtggctgggcgccagatttctggagttcgaggcgctcgggtttctgaacgaggaccattggttcagccggggaaattcccttagcggcgtggaaggggagggcctgcaccgcctcggatacatcctgagagatgtgggcaaaaaggaagggggagctatgtacgccgacgataccgccggctgggacacgcggattacccttgaggacctgaaaaacgaagagatggtcacaaatcatatgaagggggagcacaaaaagctcgctgaagccatctttaagctgacctatcagaacaaagtggttcgcgtgcaaagacctacaccccggggaaccgtcatggatattatctctcgcagagaccagcggggcagcggacaggtgggcacgtacggactgaatacattcaccaacatggaggctcaactcattcgccagatggaaggcgaggggatcttcaagtccatccagcatctgacagccaccgaggaaattgcggttcagaattggcttgccagagtgggacgggagcgcctgtctagaatggctatcagcggcgatgactgcgtcgtgaaaccgattgatgaccggtttgcctccgctctcacggccctgaacgatatggggaaggttagaaaagacatccaacagtgggaaccttctcgcggatggaatgattggacccaggtgcccttctgcagccaccactttcatgagcttgtcatgaaggacggccgggtgctggtcgtgccctgtagaaaccaggatgaactcattgggcgcgcgcggatctcccaaggcgccggatggtctctgaaggagacagcttgcctgggcaaaagctatgcccagatgtggaccctcatgtacttccacagacgcgacctgcggcttgctgccaacgctatttgttccgccgttcctagccattgggtgccgacatctagaaccacatggtccatccacgcgaagcacgagtggatgaccacggaagatatgctggccgtctggaatcgcgtgtggatccaggagaacccctggatggaagacaaaacacctgtggagagctgggaagaggttccctatctcgggaagcgggaggaccagtggtgcggatctctgattggccttacctccagagctacctgggccaaaaatatccaaacagccattaaccaggtgcgcagcctgatcgggaatgaagagtacaccgattatatgccttccatgaagcggtttagacgggaagaggaagaggctggagtcctctggtga

SEQ ID NO: 19797 - RNA, 9876 nt, synthetic construct
  misc_feature 1..9876: note = derived and/or modified CDS sequence (opt5) from DENV-2__JX079688__SS-prME
  source 1..9876: mol_type = other RNA
accgccggcgtgatcgtcatgctgattcccaccgctatggccttccacctcacgacccggaatggggaacctcatatgatcgttggacggcaggaaaagggcaagagcctgctttttaagaccgaagacggggtgaatatgtgcaccctgatggcgattgatctcggagaactgtgtgaggacacgatcacctacaagtgcccgcttctgcgccaaaatgaacccgaggatattgactgttggtgcaattccacatctacctgggtgacgtatggcacctgtacaaccacaggggagcacagacgggaaaagcgcagcgtcgctctcgtgcctcatgttggaatgggcctggagaccagaacggaaacatggatgtcctctgagggcgcctggaaacacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaagaacaggacaaacgctttatctgcaagcattccatggtggatagaggctggggcaacgggtgtggactgttcggcaaaggcgggattgtcacatgcgccatgtttacgtgcaaaaagaatatggaagggaaagttgtgcagcctgagaacctcgaatacaccatcgtgattacaccccacagcggggaggagcatgcggtcggaaatgacaccggcaagcacggcaaagaaatcaagatcacacctcagtcttccattaccgaggccgaactgacggggtatggaaccgtgacaatggagtgtagcccccggaccggccttgatttcaacgaaatggttctgctccaaatggaggacaaggcttggctggtgcaccgccagtggtttcttgatctgccgctcccttggctgcccggggccgacacacagggatctaattggatccagaaggagaccctggtcacgttcaagaaccctcatgctaaaaagcaagacgtggttgtgctcggctcccaggaaggggccatgcacacagccctgaccggcgctacagagattcagatgagctccggaaatcttctgtttaccggccatctcaaatgcagactgcggatggataaacttcaactgaaagggatgtcttacagcatgtgtaccggaaagttcaagatcgtcaaagaaattgcggagacacagcacggcacgatcgtgatcagagtccagtatgagggggacggatccccctgcaagattcccttcgaaatcaccgatctcgagaaacgccatgtgctgggccggctgattacagttaaccctatcgtgaccgaaaaggacagcccggtcaacattgaggccgaacccccttttggggattcttacatcattatcggcgtggagcccggacagctcaaactgaattggttcaagaagggctccagcatcgggcaaatgtttgagacaaccatgagaggagctaaacgcatggccattcttggcgacacggcctgggatttcgggtctctgggaggcgtttttacaagcatcgggaaggctctccaccaggtgttcggcgccatttacggagcggctttttccggcgtctcttggaccatgaaaatcctgattggggtgatcatcacctggattggaatgaacagccggtccacaagcctgtctgtgtcccttgttctcgtcggcgtggtgaccctgtatctgggggccgtcgtgcaggccgacagcggatgtgttgtgtcttggaagaataaagaactcaagtgcggctccgggatcttcattacagataacgtccacacgtggaccgagcagtacaagtttcaacctgaaagcccctccaaactggcttctgccatccagaaggctcatgaggaaggcatttgtggaatcagaagcgtgacacgccttgagaatctgatgtggaaacagatcaccccggagctcaaccacattctgtccgaaaatgaggttaagctgacaatcatgaccggcgacattaaagggatcatgcaggccggaaagcggtctcttagacctcaacccacggaactcaaatatagctggaagacctggggcaaggcgaaaatgctgtccacagagagccataaccagaccttcctgattgatgggcctgaaacagccgagtgccccaataccaaccgcgcttggaactctctcgaggtggaagactacggatttggcgtcttcacaaccaacatctggctgaaacttcgggagaaacaggacgtgttttgtgattccaagctgatgagcgccgctatcaaagacaatagagccgttcacgcggatatgggctattggattgaatctgccctcaacgacacgtggaagatggagaaggcttccttcatcgaggtgaaaagctgccactggcctaagtctcatacactgtggagcaatggggtcctggaatccgagatgattatccccaaaaacttcgccggaccggtgagccagcacaactaccgccctggctatcatacccaaaccgctgggccctggcaccttggaaagctcgaaatggattttgacttctgtgagggcacaaccgtggtcgttacggaagattgcgggaatcggggaccctctctgagaacaaccacagcctccggcaaactgattaccgagtggtgctgtcggagctgcacactccctccgctgcgctacagaggcgaggacgggtgttggtacggaatggaaatccggccccttaaggagaaggaagagaacctggtgaatagcctcgtgaccgccggccatgggcagattgataacttttctctgggagtcctgggcatggctcttttcctcgaagagatgctgagaacgcgcatcgggaccaaacacgcgatcctgctcgtggccgttagctttgtgacactgattaccggaaatatgtccttccgggaccttggcagagtcatggtgatggttggcgctacaatgaccgatgacatcgggatgggagtgacgtatctggccctcctggccgcttttaaggtccgccctacattcgccgcgggcctgcttctgagaaaactcacctctaaggagctgatgatggctacaattgggatcgccctcctgagccagtccaccattcccgaaaccatccttgagctgacagatgccctcgctctgggaatgatggtgctgaaaatcgttcggaacatggaaaagtaccaacttgccgtgacgattatggcgatctcttgcgtccctaatgctgtgattctgcagaacgcctggaaggtgagctgtaccatcctcgccgctgtctccgttagccccctgctcctgacatcttcccagcagaaagccgactggattcctcttgctctgaccatcaagggcctcaatcccacagccatctttctgaccacgctgagccgcacatctaaaaagagatcctggccgcttaacgaggcgattatggccgtggggatggtgagcatcctggcttcttccctcctgaaaaatgacattcctatgaccggacccctcgtcgccggcggcctgcttaccgtgtgctatgttctgacagggcggagcgctgatctggaactcgagcgcgccgccgacgtgaagtgggaggatcaagctgaaatctccggaagctctcctattctgagcatcaccatttccgaggacggctctatgagcatcaaaaacgaagaggaggaacagacacttacgatcctgattagaaccgggctcctggtcatctccggagtgttccccgtttctattccgatcacagcggccgcttggtacctctgggaggtgaagaagcagcgggccggcgtcctgtgggatgtgccttctccccctcccgtcgaaaaagccgagcttgaagacggggcttatcgcattaagcagagaggaatcctgggctactcccaaatcggcgccggggtgtataaagagggaacctttcacacaatgtggcatgttacccggggcgcggtgctgatgcaccgcgggaagagaattgagccctcctgggctgatgtcaaaaaggacctcatcagctacggaggcgggtggaagctggaaggagagtggaaagaaggcgaggaagtgcaggttcttgccctggagcctggcaagaatccgcgggccgtgcagacgaaacccgggattttcaagaccaacacaggaaccatcggcgctgtctccctcgattttagccctgggacatctggatcccccattgtggacagaaaaggcaaggtggttgggctgtacggaaatggcgtcgtgacccgcagcggcgcctatgtgtctgcgatcgctcagacagagaagtccatcgaagataaccctgagattgaagacgatatcttccggaaaaagagactcacgattatggacctgcatcccggggccggaaaaaccaagcgctaccttcctgccatcgtccgggaggctattaaaagaggcctgcgcacactgatcctcgccccgacccgggtggttgctgccgaaatggaggaggcgctgagagggcttcccattcgctatcaaacccctgccatcaagacagaacacacgggacgggagatcgtggacctgatgtgtcatgctaccttcacaatgagactcctgagccccgtccgggtgcctaactacaatctcattatcatggatgaagcccactttaccgaccccgcttccattgccgcccgcggctatatctctacaagagttgagatgggggaggctgcgggcattttcatgaccgccacgccgcctggaagccgggatccctttccccagtccaacgctcctatcatggacgaagaaagagaaatccccgagagaagctggaactctggccacgaatgggtgacagatttcaaggggaaaaccgtctggtttgtgccttccattaaggccggaaacgacatcgccgcttgcctgcggaaaaatggcaagaaagttattcagcttagcagaaagaccttcgattctgagtacgtgaagacacgcgccaacgactgggattttgtcgtgaccacagacatcagcgagatgggggcgaatttcaaagctgaacgggtgattgatccgagacgctgtatgaagcccgtcatcctgaccgacggagaggaacgggttatcctggccggccctatgcccgtgacgcattcctctgccgctcaaagacgcgggcggattggcagaaaccctaaaaatgagaacgaccagtatatctacatgggagaacccctcgagaatgatgaggactgcgcccactggaaggaagcgaaaatgctgcttgataacattaatacaccggagggcatcattcctagcatgtttgaacccgagcgcgaaaaggtggacgccatcgatggggagtacagactgcggggagaggctcgcaaaaccttcgtcgacctcatgagacggggcgatctgcctgtgtggctggcctataaggttgctgccgaagggattaactacgctgaccgcaagtggtgttttgatggaatcaaaaataaccagatcctcgaggaaaacatggaggtggagatttggacaaaggaaggcgagcgcaagaaacttaaaccccggtggctggacgccagaatctattccgatcctctggcgctcaaggagttcaaggagttcgccgctgggcgcaaatctctgacccttaatctgattacggaaatgggccggctccccacctttatgacacagaaggccagaaacgctctggacaatctggccgtcctccataccgccgaggctggaggccgcgcgtacaaccacgcccttagcgagctgccggaaacactggagaccctcctgcttctgacactcctggctaccgtgacagggggaatcttcctgtttctcatgtccggcaaagggattggaaagatgacacttggcatgtgctgcatcatcaccgccagcattctgctgtggcacgcccaaatccagcctcattggattgctgcctctatcattctcgagttctttctgatcgttcttctgatccccgagcccgaaaaacagcggacccctcaggataatcaactcacatatgtggtcattgcgatcctgaccgtggtcgccgctacaatggccaacgagatgggcttcctggagaagacgaagaaagacctcgggcttggatccattaccacacaggaaagcgagtccaatatcctggacattgatctgagaccggcttctgcctggaccctctacgcggtggccacaacctttgttacgcccatgctgcggcacagcatcgaaaactcctctgtgaatgtgagccttaccgctattgccaaccaggctacagtcctgatgggcctcgggaagggatggcctctgtccaaaatggacatcggcgttcccctgctcgccatcgggtgttatagccaggtgaatcctattacccttacagctgccctgctgctcctggtggcgcattacgccatcattggacccggccttcaagctaaggccacccgcgaggctcagaaaagagccgccgcgggcatcatgaagaaccctacggtcgatgggattacagtgatcgacctggaaccgatcccctacgatcctaagttcgagaaacagctcggacaggttatgctgctgattctctgcgtgacccaagtccttatgatgcggacaacctgggctctgtgtgaggccctgaccctcgctacaggccccatctctacgctgtgggaagggaatcctggacgcttttggaacaccacaattgccgtgtccatggccaatatcttcagaggcagctatcttgctggggccggactgctcttttctattatgaagaacaccacatccacccggcgcggcacgggcaatatcggggagacactgggagaaaaatggaaaagcagactgaacgcgctcggcaaatctgagttccagatctacaagaaaagcgggattcaggaggtcgaccggacccttgccaaggaaggaatcaagcgcggcgagaccgatcaccatgctgtgtccagagggtctgccaaactgcggtggtttgttgaaagaaacatggtgacacccgagggaaaggtcgtggacctgggctgcggccgcgggggatggagctattactgtggcgggctcaaaaatgttcgggaagtgaagggactgaccaaaggcgggccgggacacgaggagcctattcccatgtccacatatggctggaaccttgtcagactgcaaagcggcgtggatgtgttcttcacgccccctgaaaagtgcgacaccctcctgtgtgatatcggggagtcctctcccaatcctacaattgaagctggacgcaccctgcgggttctcaaccttgtcgagaattggctgaacaataacacacagttttgcatcaaggtgctgaatccgtacatgcccagcgtgatcgagaagatggaggccctccagagacagtatggcggggcgctggtccgcaaccctctttccagaaattctacccacgagatgtactgggttagcaacgccacgggaaatattgtgtcctctgtgaacatgatcagcagaatgctgattaatcgcttcaccatgaagcataaaaaggctacatacgaacccgacgtcgatctcggctccgggacccggaacatcggaattgagagcgaaatccctaacctggacattatcggcaaaagaatcgagaagattaagcaagaacacgagatctcttggcattatgaccaggatcacccctacaaaacatgggcctatcacggctcctacgagaccaagcagacagggagcgcttcttccatggtgaatggagttgtgcgcctgctcaccaaaccgtgggacgtcgtgcctatggttacgcagatggccatgacagataccaccccctttggccaacagcgggtgttcaaggaaaaagtcgacacaagaacgcaggagcctaaggaagggaccaagaaacttatgaagattacagctgagtggctgtggaaagagctgggaaagaaaaagacaccccgcatgtgtacaagagaagagtttaccaaaaaggtgcggagcaacgccgcgctcggcgccatcttcacagatgaaaataagtggaaatctgctcgcgaggccgtggaagacgggagattttgggagctggtcgatcgggagagaaaccttcatctggaaggaaagtgcgagacctgtgtttataatatgatgggcaaacgggaaaagaaactcggcgagttcgggaaggctaagggatcccgcgccatttggtacatgtggctgggcgccagatttctggagttcgaggcgctcgggtttctgaacgaggaccactggttcagccggggaaattcccttagcggcgtggaaggggagggcctgcatcgcctcggatatatcctgagagatgtgggcaaaaaggaagggggagctatgtacgccgacgatacggccggctgggacacccggatcacacttgaggacctgaaaaacgaagagatggtcaccaatcacatgaagggggagcataaaaagctcgctgaagccatttttaagctgacataccagaacaaagtggttcgcgtgcaaagacctacaccccggggaacggtcatggatatcatttctcgcagagaccagcggggcagcggacaggtgggcacatatggactgaataccttcacaaacatggaggctcaactcatccgccagatggaaggcgaggggattttcaagtccatccagcacctgaccgccacggaggaaatcgcggttcagaattggcttgccagagtgggacgggagcgcctgtctagaatggctattagcggcgatgactgcgtcgtgaaaccgatcgatgaccggtttgcctccgctctcaccgccctgaacgatatggggaaggttagaaaagacattcaacagtgggaaccttctcgcggatggaatgattggacacaggtgcccttctgcagccaccattttcacgagcttgtcatgaaggacggccgggtgctggtcgtgccctgtagaaaccaggatgaactcatcgggcgcgcgcggatttcccaaggcgccggatggtctctgaaggagaccgcttgcctgggcaaaagctacgcccagatgtggacactcatgtatttccatagacgcgacctgcggcttgctgccaacgctatctgttccgccgttcctagccactgggtgccgacctctagaacaacctggtccattcacgcgaagcatgagtggatgacgacagaagatatgctggccgtctggaatcgcgtgtggatccaggagaacccctggatggaagacaaaacccctgtggagagctgggaagaggttccctacctcgggaagcgggaggaccagtggtgcggatctctgatcggccttacctccagagctacatgggccaaaaatattcaaaccgccatcaaccaggtgcgcagcctgattgggatcgaagagtatacagattacatgccttccatgaagcggtttagacgggaagaggaagaggctggagtcctctggtga

SEQ ID NO: 19798 - RNA, 9876 nt, synthetic construct
  misc_feature 1..9876: note = derived and/or modified CDS sequence (opt5) from DENV-2__JF357906__SS-prME
  source 1..9876: mol_type = other RNA
accgccggagtgatcgttatgctgattcccaccgctatggccttccacctcacgaccagaaatggggaacctcatatgatcgttggacggcaggaaaagggcaaaagcctgctttttaagacagaagacggggtgaatatgtgcaccctgatggcgattgatctcggagaactgtgtgaggacacaatcacctacaaatgcccgcttctgagacaaaatgaacccgaggatattgactgttggtgcaattccacatctacctgggtgacgtatggcacctgtacaaccacaggggagcacagacgggaaaagcgcagcgtggctctcgtgcctcatgttggaatgggcctggagaccagaacggaaacatggatgtcctctgagggcgcctggaaacacgtgcagcggatcgagacctggatcctgcgccatcccgggttcacaattatggccgctgtcctcgcctacaccatcggaaccacacactttcagaaggctctgattttcatccttctgacggccgtggcgcctagcatgaccatgagatgcattggcatctccaaccgggattttgttgaaggggtgtctggaggcagctgggtcgacattgtgctcgagcacgggtcctgtgtgacaaccatggccaagaataaacccacactggatttcgaacttatcaagaccgaggctaaacagcctgccacgctgcgcaagtattgcatcgaagctaaactcacaaacaccaccacagagagcagatgtccgacccaaggagagccctctctgaatgaagaacaggacaagcggtttatttgcaagcattccatggtcgatcgcggctggggcaacgggtgtggactgttcggcaaagggggaatcgttacatgcgccatgtttacgtgcaagaaaaatatggaaggcaaggtggtgcagcctgagaacctcgaatacaccattgtcatcacaccccacagcggggaggagcatgcggtgggaaatgacaccggcaaacacggcaaggaaattaaaatcacacctcagtcttccatcaccgaggccgaactgacggggtatggaaccgttacaatggagtgtagccccagaaccggccttgatttcaacgaaatggtgctgctccaaatggaggacaaggcttggctggtccaccggcagtggtttcttgatctgccgctcccttggctgcccggggccgacacacagggatctaattggattcagaaggagaccctggtgacgttcaaaaaccctcatgctaagaaacaagacgttgtggtcctcggctcccaggaaggggccatgcacacagccctgaccggcgctacagagatccagatgagctccggaaatcttctgtttaccggccatctcaagtgccgcctgagaatggataaacttcaactgaaggggatgtcttacagcatgtgtaccggaaagttcaaaattgtgaaggaaatcgcggagacacagcacggcacgattgtcatccgggtgcagtatgagggggacggatccccctgcaaaatccccttcgaaattaccgatctcgagaagagacatgttctgggccgcctgatcacagtgaaccctattgtcaccgaaaaagacagcccggtgaacatcgaggccgaacccccttttggggattcttacattatcattggcgttgagcccggacagctcaagctgaattggttcaagaaaggctccagcatcgggcaaatgtttgagacaaccatgcggggagctaagagaatggccatccttggcgacacggcctgggatttcgggtctctgggaggcgtgtttacaagcattgggaaagctctccaccaggtcttcggcgccatctacggagcggctttttccggcgtgtcttggaccatgaagattctgatcggggtgattatcacctggatcggaatgaacagccgctccacaagcctgtctgtttcccttgtcctcgtgggcgtggtcaccctgtatctgggggccgtggttcaggccgacagcggatgtgtggtctcttggaaaaataaggaactcaagtgcggctccgggattttcatcacagataacgtgcacacgtggaccgagcagtacaaatttcaacctgaaagcccctccaagctggcttctgccattcagaaagctcatgaggaaggcatctgtggcattcggagcgttacaagacttgagaatctgatgtggaagcagatcaccccggagctcaaccacatcctgtccgaaaatgaggtgaaactgacaattatgaccggcgacatcaaggggattatgcaggccggaaaacgctctcttcggcctcaacccacggaactcaagtatagctggaagacctggggcaaagcgaagatgctgtccacagagagccataaccagaccttcctgatcgatgggcctgaaacagccgagtgccccaataccaacagagcttggaactctctcgaggtcgaagactacggatttggcgtgttcacaaccaacatttggctgaaacttcgcgagaagcaggacgtcttttgtgattccaaactgatgagcgccgctatcaaggacaatcgggccgtgcacgcggatatgggctattggatcgaatctgccctcaacgacacgtggaagatggagaaggctagcttcattgaggtcaagagctgccactggcctaaatctcatacactgtggagcaatggggtgctggaatccgagatgatcattcccaagaacttcgccggaccggtgagccagcacaactacagacctggctatcatacccaaaccgctgggccctggcaccttggaaaactcgaaatggattttgacttctgtgagggcacaaccgtcgttgtgacggaagattgcgggaatcgcggaccctctctgcggacaaccacagcctccggcaagctgatcaccgagtggtgctgtagaagctgcacactccctccgctgcggtaccgcggcgaggacgggtgttggtacggaatggaaattagaccccttaaggagaaagaagagaacctggtcaattccctcgtcaccgccggccatgggcagatcgataacttttctctgggagtgctgggcatggctcttttcctcgaagagatgctgcggacgagaattgggaccaagcacgcgatcctgctcgttgccgtgagctttgtcacactgatcaccggaaatatgtccttccgcgaccttggccgggtgatggttatggtgggcgctacaatgaccgatgacattgggatgggagtcacgtatctggccctcctggccgcttttaaagtgagacctacattcgccgcgggcctgcttctgcgcaagctcacctctaaagagctgatgatggctacaatcgggattgccctcctgagccagtccaccatccccgaaaccattcttgagctgacagatgccctcgctctgggaatgatggttctgaagatcgtgagaaacatggaaaagtaccaacttgccgtcacgatcatggcgatttcttgcgtgcctaatgctgtgatcctgcagaacgcctggaaagtcagctgtaccattctcgccgctgtttccgtgagccccctgctcctgacatcttcccagcagaaggccgactggatccctcttgctctgaccattaaaggcctcaatcccacagccatctttctgaccacgctgagccggacatctaagaaacgctcctggccgcttaacgaggcgatcatggccgtggggatggtcagcattctggcttcttccctcctgaagaatgacatccctatgaccggacccctcgtggccggcggcctgcttaccgtttgctatgtgctgacagggagaagcgctgatctggaactcgagcgggccgccgacgtcaaatgggaggatcaagctgaaatttccggaagctctcctatcctgagcattaccatctccgaggacggctctatgagcattaagaacgaagaggaggaacagacacttacgatcctgatccgcaccgggctcctggtgatttccggaatcttccccgtttctattccgatcacagcggccgcttggtacctctgggaggtgaagaaacagagagccggcgtcctgtgggatgtgccttctccccctcccgtcgaaaaggccgagcttgaagacggggcttatcggattaaacagcgcggaatcctgggctactcccaaatcggcgccggggtgtataaggagggaacctttcacacaatgtggcatgttaccagaggcgcggtgctgatgcaccgggggaaacgcattgagccctcctgggctgatgtcaagaaggacctcatcagctacggaggcgggtggaaactggaaggagagtggaaggaaggcgaggaagtgcaggttcttgccctggagcctggcaaaaatccgagagccgtgcagacgaagcccgggattttcaaaaccaacacaggaaccatcggcgctgtctccctcgattttagccctgggacatctggatcccccattgtggaccggaagggcaaggtggttgggctgtacggaaatggcgtcgtgaccagaagcggcgcctatgtgtctgcgatcgctcagacagagaaatccatcgaagataaccctgagattgaagacgatatcttccgcaagaaacggctcacgattatggacctgcatcccggggccggaaagaccaaaagataccttcctgccatcgtccgcgaggctattaagcggggcctgagaacactgatcctcgccccgacccgcgtggttgctgccgaaatggaggaggcgctgcgggggcttcccattagatatcaaacccctgccatcaagacagaacacacgggacgcgagatcgtggacctgatgtgtcatgctaccttcacaatgcggctcctgagccccgtcagagtgcctaactacaatctcattatcatggatgaagcccactttaccgaccccgcttccattgccgcccggggctatatctctacacgcgttgagatgggggaggctgcgggcattttcatgaccgccacgccgcctggaagcagagatccctttccccagtccaacgctcctatcatggacgaagaacgggaaatccccgagcgcagctggaactctggccacgaatgggtgacagatttcaaagggaagaccgtctggtttgtgccttccattaaagccggaaacgacatcgccgcttgcctgagaaagaatggcaaaaaggttattcagcttagccggaagaccttcgattctgagtacgtgaaaacaagagccaacgactgggattttgtcgtgaccacagacatcagcgagatgggggcgaatttcaaggctgaacgcgtgattgatccgcggagatgtatgaaacccgtcatcctgaccgacggagaggaacgcgttatcctggccggccctatgcccgtgacgcattcctctgccgctcaacggagagggcgcattggccggaaccctaagaatgagaacgaccagtatatctacatgggagaacccctcgagaatgatgaggactgcgcccactggaaagaagcgaagatgctgcttgataacattaatacaccggagggcatcattcctagcatgtttgaacccgagagagaaaaagtggacgccatcgatggggagtaccgcctgagaggagaggctcggaagaccttcgtcgacctcatgcgcagaggcgatctgcctgtgtggctggcctataaggttgctgccgaagggattaactacacagaccggaaatggtgttttgatggaatcaagaataaccagatcctcgaggaaaacatggaggtggagatttggaccaaagaaggcgagcgcaagaaacttaagcccagatggctggacgctcggatctattccgatcctctggccctcaaggagttcaaagagttcgcggccgggagaaagtctctgacgcttaatctgattaccgaaatgggccgcctccccacatttatgacccagaaagctcggaacgccctggacaatctggctgtcctccatacagccgaggccggaggcagagcttacaaccacgcgcttagcgagctgccggaaaccctggagacactcctgcttctgaccctcctggccacggtgacagggggaatcttcctgtttctcatgtccggcaaggggattggaaaaatgacccttggcatgtgctgcatcatcaccgctagcattctgctgtggtatgcccaaatccagcctcactggattgccgcttctatcattctcgagttctttctgatcgttcttctgatccccgagcccgaaaagcagcgcacacctcaggataatcaactcacctacgtggtcattgccatcctgacagtggtcgcggccacgatggctaacgagatgggcttcctggagaagaccaaaaaggacctcgggcttggatccattacaacccaggaaagcgagtccaatatcctggacattgatctgcggccggcctctgcttggacactctatgccgtggcgaccacgtttgttacccccatgctgagacatagcatcgaaaactcctctgtgaatgtgagccttacagccattgctaaccaggccaccgtcctgatgggcctcgggaaaggatggcctctgtccaagatggacatcggcgttcccctgctcgctatcgggtgttacagccaggtgaatcctattacacttaccgccgctctgctgctcctggtggcccactacgcgatcattggacccggccttcaagccaaagctacgcgggaggcccagaagcgcgctgccgccggcatcatgaagaaccctacagtcgatgggattaccgtgatcgacctggaaccgatcccctatgatcctaaattcgagaagcagctcggacaggttatgctgctgattctctgcgtgacacaagtccttatgatgagaaccacctgggcgctgtgtgaggctctgacactcgccacgggccccatctctaccctgtgggaagggaatcctggacggttttggaacacaaccattgctgtgtccatggccaatatcttccgcggcagctaccttgccggggctggactgctcttttctattatgaaaaacacaacctccacgagacggggcacaggcaatatcggggagaccctgggagaaaagtggaaaagccgcctgaacgccctcggcaagtctgagttccagatctataaaaagagcgggattcaggaggtcgacagaacccttgcgaaggaaggaatcaaacggggcgagacagatcatcacgccgtgtcccgcgggtctgctaagctgagatggtttgttgaacggaacatggtgacccccgagggaaaagtcgtggacctgggctgcggcagagggggatggagctactattgtggcgggctcaagaatgttcgcgaagtgaaaggactgacaaagggcgggccgggacatgaggagcctattcccatgtccacgtacggctggaaccttgtccggctgcaaagcggcgtggatgtgttcttcacaccccctgaaaagtgcgacacactcctgtgtgatatcggggagtcctctcccaatcctaccattgaagccggaagaacactgcgcgttctcaaccttgtcgagaattggctgaacaataacacccagttttgcatcaaagtgctgaatccgtatatgcccagcgtgatcgaaaagatggaggctctccagcggcagtacggcggggccctggtcagaaaccctctttcccgcaattctacgcacgagatgtactgggttagcaacgcgaccggaaatattgtgtcctctgtgaacatgatcagccggatgctgattaatagattcacaatgaaacacaagaaagccacctatgaacccgacgtcgatctcggctccgggacacgcaacatcggaattgagagcgaaatccctaacctggacattatcggcaagcggatcgagaagattaaacaagaacatgagatctcttggcactacgaccaggatcatccctataagacctgggcttaccacggctcctatgagacaaaacagaccgggagcgcctcttccatggtgaatggagttgtgagactgctcacgaagccgtgggacgtcgtgcctatggttacacagatggctatgaccgataccacaccctttggccaacagcgcgtgttcaaagaaaaggtcgacacgcggacccaggagcctaaggaagggaccaagaaacttatgaaaattaccgccgagtggctgtggaaagagctgggacgcaaaaagacaccccgcatgtgtaccagagaagagtttacacggaaagtgcgcagcaacgctgccctcggcgcgatcttcaccgatgaaaataagtggaagtctgccagagaggctgtggaagacgggcggttttgggagctggtcgatagagagcggaaccttcacctggaaggaaaatgcgagacgtgtgtttacaatatgatgggcaagcgcgagaaaaagctcggcgagttcgggaaagccaagggatccagagctatttggtatatgtggctgggcgcccggtttctggagttcgaggccctcgggtttctgaacgaggaccattggttcagccgcgaaaattcccttagcggagtggagggcgaagggctgcacagactcggctacatcctgcgggatgtgggaaagaaagagggcggggcgatgtacgctgacgataccgccggatgggacacacgcatcacccttgaagacctgaagaacgaggagatggtcacaaatcatatgaaaggcgaacacaagaaactcgccgaggctatttttaagctgacctatcagaacaaggtggttagagtgcaacggcctacgccccgcgggacagtcatggatatcatttctagacgggaccagcgcggaagcggccaggtggggacctacggcctgaatacattcaccaacatggaagcccaactcatcagacagatggagggagagggcattttcaaatccatccagcatctgacggctaccgaagagatcgccgttcagaattggcttgcgcgggtggggcgcgaaagactgtctcggatggccattagcggagatgactgcgtcgtgaagccgatcgatgacagatttgcttccgccctcacagctctgaacgatatgggcaaagttcgcaaggacattcaacagtgggagccttctcgggggtggaatgattggacccaggtgcccttctgcagccaccactttcatgaacttgtcatgaaagacggaagagtgctggtcgtgccctgtcgcaaccaggatgagctcatcggccgggccagaatttcccaaggggcgggctggtctctgaaggagacagcctgcctgggaaagagctatgctcagatgtggaccctcatgtacttccaccgccgggacctgagacttgccgctaacgccatctgttccgctgttcctagccattgggtgccgacatctcgcaccacgtggtatattcacgccaaacacgaatggatgacaaccgaggatatgctggcggtctggaatcgggtgtggatccaggaaaacccctggatggaggacaagacccctgtggaatcctgggaggaggttccctacctcggcaaaagagaagaccagtggtgcgggagcctgatcggacttacatctcgcgccacctgggctaagaatattcaaacagccatcaaccaggtgcggtccctgattggcaatgaggaatatacggattacatgcctagcatgaaaagatttcggagagaggaagaggaggccggggtcctctggtga

SEQ ID NO: 19799 - RNA, 9873 nt, synthetic construct
  misc_feature 1..9873: note = derived and/or modified CDS sequence (opt5) from DENV-2__HQ705624__SS-prME
  source 1..9873: mol_type = other RNA
accgccggcgtgatcgtgatgctgattcccacagctatggccttccacctcacgaccagaaatggggagcctcatatgatcgttggacggcaggaaaagggcaaaagcctgctttttaagaccgaggacggggtgaatatgtgcaccctgatggcgattgatctcggagaactgtgtgaggacacaatcacctacaaatgcccgcttctgcgccaaaacgaacccgaggatattgactgttggtgcaattccacatctacctgggtgacgtatggcacctgtacaaccacaggggagcacagacgggaaaagcgcagcgtggctctcgtgcctcatgttggaatgggcctggagaccagaacggaaacatggatgtcctctgagggcgcctggaaacacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaggaacaggacaaacgctttatctgcaagcattccatggtggatagaggctggggcaacgggtgtggactgttcggcaaagggggaattgtcacatgcgccaaatttacgtgcaagaaaaatatggaaggcaaggttgtgcagcctgagaacctcgaatacaccatcgtgattacaccccacagcggggaggagcatgcggtcggaaatgacaccggcaaacacggcaaggaaatcaaaatcacacctcagtcttccattaccgaggccgaactgacggggtatggaaccgtgacaatggagtgtagcccccggaccggccttgatttcaacgaaatggttctgctccaaatggaggacaaggcttggctggtgcaccgccagtggtttcttgatctgccgctcccttggctgcccggggccgacacacagggatctaattggatccagaaggagaccctggtcacgttcaaaaaccctcatgctaagaaacaagacgtggttgtgctcggctcccaggaaggggccatgcacacagccctgaccggcgctacagagattcagatgagctccggaaatcttctgtttaccggccatctcaagtgcagactgcggatggataaacttcaactgaaggggatgtcttacagcatgtgtaccggaaagttcaaaatcgtcaaggaaattgcggagacacagcacggcacgatcgtgatcagagtccagtatgagggggacggatccccctgcaaagtgcccttcgaaattaccgatctcgagaagcgccatgttctgggccggctgatcacagtgaaccctattgtcaccgaaaaagacagcccggtgaacatcgaggccgaacccccttttggggattcttacattatcattggcgttgagcccggacagctcaagctgaattggttcaagaaaggctccagcatcgggcaaatgtttgagacaaccatgagaggagctaagcgcatggccatccttggcgacacggcctgggatttcgggtctctgggaggcgtgtttacaagcattgggaaagctctccaccaggtcttcggcgccatctacggagcggctttttccggcgtgtcttggaccatgaagattctgatcggggtgattatcacctggatcggaatgaacagccggtccacaagcctgtctgtttcccttgtcctcgtgggcgtggtcaccctgtatctgggggccatggtgcaggccgacagcggatgtgttgtgtcttggaaaaataaggaactcaagtgcggctccgggattttcatcacagataacgtccacacgtggaccgagcagtacaaatttcaacctgaaagcccctccaagctggcttctgccattaaaaaggctcatgaggaaggcatctgtggaattagaagcgtgacacgccttgagaatctgatgtggaaacagatcaccccggagctcaaccacatcctgtccgaaaatgaggttaagctgacaattatgaccggcgacatccgggggattatgcaggccggaaaaagatctcttcgccctcagcccacggaactcaagtatagctggaagacctggggcaaagcgaagatgctgtccacagagagccataaccaaaccttcctgatcgatgggcctgaaacagccgagtgccccaataccaaccgggcttggaactctctcgaggtggaagactacggatttggcgtcttcacaaccaacatttggctgaaacttagagacaagcaggatgtgttttgtgactccaaactgatgagcgccgctatcaaggataatcgcgccgttcacgcggacatgggctattggatcgagtctgccctcaacgatacgtggaagatggaaaaagctagcttcattgaggtcaagagctgccactggcctaaatctcatacactgtggagcaatggggtcctggagtccgaaatgatcattcccaagaacttcgccggaccggtgagccagcacaactaccggcctggctatcatacccagaccgctgggccctggcaccttggaaaactcgagatggactttgatctgtgtgaaggcacaaccgtggtcgttacggaggactgcgggaatagaggaccctctctgcggacaaccacagcctccggcaagctcatcaccgaatggtgctgtcgcagctgcacactgcctccgcttagataccggggcgaggatgggtgttggtacggaatggagattagacccctgaaggaaaaagaggaaaacctcgtcaattccctggtgaccgccggccatgggcaaatcgacaacttctctctgggagtccttggcatggctctcctgctggaggaaatgctccgcacgcggattgggaccaagcacgcgatcctgcttgtggccgttagctttgtgacactgatcaccggaaatatgtccttcagagatctcggccgcgtcatggtgatggttggcgctacaatgaccgacgatattgggatgggagtgacgtatctggccctgcttgccgcttttaaagtcagacctacattcgccgcgggcctgctcctgcggaagctcacctctaaagagctgatgatggctacaatcgggattgcccttctgagccagtccaccatccccgagaccattctcgaactgacagacgccctggctcttggaatgatggtgctgaagatcgttcgcaacatggagaagtaccagctcgccgtgacggtcatggcgatctcttgcgtgcctaatgctgtgattctgcaaaacgcctggaaagtcagctgtaccatcctcgccgctgtttccgtgagccccctgcttctgacatcttcccagcagaaggccgactggattcctctcgctctgaccatcaaaggcctgaatcccacagccatttttcttaccacgctgagcagaacatctaagaaacggtcctggccgctcaacgaagcgatcatggccgtggggatggtcagcatcctggcttcttccctcctgaagaatgatattcctatgaccggaccccttgtggccggcggcctgctgaccgtttgctatgtgctcacagggcgcagcgctgacctggagcttgaaagagccgccgatgtcaaatgggaggaccaggctgagatctccggaagctctcctattctgagcatcaccatttccgaagatggctctatgagcatcaagaacgaggaagaggagcaaacactcacgattctgatccggaccgggctcctggtgatctccggagttttccccgtgtctattccgatcacagcggccgcttggtacctttgggaagtcaagaaacagcgcgccggcgtgctgtgggacgtcccttctccccctcccgtggagaaggccgaactggaggatggggcttatagaattaaacagcggggaatcctcggctactcccagattggcgccggggtttataaggaaggaacctttcacacaatgtggcatgtgacccgcggcgcggtcctgatgcacagagggaaacggatcgagccctcctgggctgacgtgaagaaggatcttatcagctacggaggcgggtggaaactggagggagaatggaaggagggcgaagaggttcaagtgctcgccctggaacctggcaaaaatccgagagccgtccagacgaagcccgggattttcaaaaccaacacaggaaccatcggcgctgtgtccctcgactttcctgggacaagcggatctcccattgtggatcgcaagggcaaggttgtcgggctgtacggaaatggcgtggtgacccggtccggcgcctatgtcagcgcgatcgctcagacagagaaatctattgaggacaaccctgaaatcgaggatgacatcttcagaaagaaacgccttacgattatggacctgcatcccggggccggaaagaccaaacggtacctgcctgccatcgtgagagaagctattaagcgcggcctccggacactgatccttgccccgaccagagttgtggctgccgagatggaagaggcgctgcgcgggctccccattcggtatcagaccacagccatcaagacggagcacaccggaagagaaattgtcgatctgatgtgtcatgctacatttaccatgcggctcctgtcccctgtgcgcgttcccaactacaatcttatcatcatggacgaggcccacttcacagatcctgctagcattgccgccagaggctatatctccacccgggtggaaatgggggaggctgcgggcattttcatgacggccacacccccgggatctcgcgacccttttccccaaagcaacgctcccatcatggatgaggaaagagagattcctgaacggtcctggaatagcggccacgagtgggtcaccgacttcaaagggaagaccgtgtggtttgttccctctatcaaagccggaaacgatatcgccgcttgcctgagaaagaatggcaaaaaggtgattcagctgtcccgcaagacattcgacagcgaatacgtcaaaacccgggccaacgattgggactttgtggtgacaaccgatatctctgagatgggggcgaatttcaaggctgagagagtcattgaccctcgccggtgtatgaaaccggttatcctcacggacggagaagagagagtgattctggccggccccatgcctgtgacacatagctccgccgctcagcgccgggggagaatcggccgcaaccccaagaatgaaaacgatcaatatatctacatgggagagcctcttgaaaatgacgaggattgcgcccactggaaagaggcgaagatgctgctcgacaacattaatacccccgaaggcatcattccgtctatgtttgagcctgaaagagagaaagtcgatgccatcgacggggaataccggctgcgcggagaggctagaaagacattcgtggatctgatgcggcgcggcgacctccccgtttggcttgcctataaggtggctgccgaggggattaactacgctgatagaaaatggtgttttgacggaatcaagaataaccagattctggaagagaacatggaagtcgagatctggaccaaagagggcgaacggaagaaactgaagcctagatggctcgatgcccgcatctatagcgaccccctggcgcttaaggagttcaaagaatttgccgctgggcggaagtccctgacgctcaatctgattaccgagatgggcagactgcctacattcatgacccagaaagcccgcaacgctctcgataatcttgccgtgctgcatacagccgaagctggaggccgggcgtacaaccacgccctgtctgagctccccgagaccctggaaacacttctgctcctgaccctgctcgctacggttacagggggaatcttcctttttctgatgagcggcaaggggattggaaaaatgaccctgggcatgtgctgcatcattaccgcctccatcctcctgtggtatgcccagatccaaccgcactggattgctgccagcatcattcttgagttctttctgatcgtgctcctgattcctgaacccgagaagcagagaacaccccaggacaatcagctgacctacgtcgtgatcgcgatcctcacagtcgtggccgctacgatggccaacgaaatgggcttccttgagaagaccaaaaaggacctggggctgggatctattacaacccaagagtccgaaagcaatatcctcgatattgacctgcggcctgcttccgcctggacactttatgcggttgccaccacgtttgtgaccccgatgctgcgccattctatcgagaacagctccgtgaatgtctctctcacagctattgccaaccaggctaccgttctgatgggcctggggaaaggatggcccctcagcaagatggatatcggcgtgcctcttctggccattgggtgttactcccaggtgaatcccatcacactgaccgctgccctcctgcttctggtcgcgcactacgccatcattggacctggcctccaggctaaagccacgagagaagctcaaaagcgggccgccgcgggcatcatgaagaaccccacagtggacgggattaccgttatcgatctggagcctattccgtatgaccccaaattcgaaaagcagctgggacaggtgatgctccttatcctgtgcgtcacacaggtgctgatgatgcgcaccacctgggctctctgtgaggccctgacacttgctacgggccctatcagcaccctgtgggaggggaatcccggaagattttggaacacaaccattgccgtctctatggccaatatcttccggggctcctacctcgctggggccggactgctgtttagcattatgaaaaacacaaccaatacgcgcagaggcacaggcaacatcggggaaaccctcggagagaagtggaaatctcggcttaacgcgctgggcaagtccgagttccaaatttataaaaagagcgggatccaggaggtggatcgcaccctggccaaggagggaatcaaaagaggcgaaacagaccatcacgctgtttctcgggggagcgccaagctcagatggtttgtggagcgcaatatggtcacccctgaaggaaaagtggttgatctgggctgcggcagagggggatggtcctactattgtggcgggcttaagaacgtgcgggaggtcaaaggactgacaaagggcgggcccggacatgaagaacccattcctatgtctacgtacggctggaatctcgtgcgcctgcagagcggcgtggacgttttctttacaccgcccgagaagtgcgatacactgctctgtgacatcggggaatccagccctaaccccaccattgaggctggacggacacttagagtcctgaatctggtggaaaactggctcaataacaatacccaattctgcatcaaagtgctgaacccttatatgccgtccgtcattgagaagatggaagcccttcagcgcaaatacggcggggcgctggttcggaatcccctctctagaaacagcacgcacgagatgtactgggtgtccaatgccaccggaaacatcgtgtctagcgtcaatatgatctcccgcatgctgattaaccggttcacaatgaagcacaaaaaggctacctatgagcctgatgtggacctgggctctgggacaagaaacatcggaattgaaagcgagatccccaatctcgacattatcggcaagcgcattgaaaagatcaagcaggagcatgaaacctcctggcactacgatcaggaccatccttataaaacatgggcctaccacggcagctatgagaccaagcaaacggggtctgcttccagcatggttaacggagtggtccggcttctgacaaaaccctgggatgtggttccgatggtgacccagatggccatgaccgacacaacgccttttggccagcagagagtcttcaaggagaaggtggatacccgcacacaagaacccaaagaggggaccaagaaactgatgaagatcacagctgaatggctctggaaagagctgggaaagaaaaagacccctagaatgtgtacacgggaggaatttacccgcaaggtgagatctaatgccgcgcttggcgccattttcacggacgagaacaaatggaagtccgctcgggaagccgtcgaggatgggagattttgggaactggttgaccgggagcgcaatctccacctggagggaaaatgcgaaacctgtgtgtacaacatgatgggcaagagagagaaaaagctgggcgagttcgggaaggctaaaggaagccgggccatctggtatatgtggctcggcgcccgctttctggagttcgaagcgcttgggtttctgaatgaggatcattggttctctagaggaaactccctcagcggcgtggagggggaaggcctgcaccggcttggatacattctgcgcgacgtcggcaagaaagaagggggagctatgtacgccgatgacacagccggctgggacaccagaatcacactcgaagatctgaagaatgaggaaatggtgaccaaccatatgaaaggggagcacaagaagctggctgaggccatttttaaactcacgtatcagaataaggttgtgcgggtccagcgccccacacctagaggaaccgtgatggacatcatctcccggcgcgatcagagaggcagcgggcaagttggcacatacggactgaacaccttcacgaatatggaagctcagcttattcggcagatggagggcgaagggatctttaaatctattcaacatctgaccgccacagaggagatcgcggtgcagaactggctcgcccgcgtcggaagagaacggctgagcagaatggctatttccggcgacgattgcgtggttaagcccatcgacgatcgcttcgcctctgctcttaccgccctgaatgacatggggaaagtgcggaaggatatccagcagtgggagccgagcagaggatggaacgactggacacaagtccctttctgctcccaccactttcatgaactcgtgatgaaggatggccgcgtcctggtggttccctgtcggaaccaggacgagctgattgggagagcgcgcatctctcagggcgccggatggagcctcaaagaaaccgcttgcctgggcaagtcctatgcccagatgtggacacttatgtacttccaccggagagatctgcgcctcgctgccaatgctatttgttctgccgtgcccagccattgggtccctacctcccggacgacatggagcatccacgcgaaacacgagtggatgaccaccgaggacatgctggccgtgtggaacagagtgtggattcaagaaaatccgtggatggaggacaagacacccgttgaatcttgggaggaagtgccttatcttgggaaacgcgaggatcagtggtgcggatccctgatcggcctcaccagccgggctacatgggccaagaacattcagacggccatcaatcaggtcagatctctgatcgggaacgaggaatacaccgactatatgccctccatgaagcggtttagacgcgaggaagaggaagctggagtgctgtggtga

SEQ ID NO: 19800 - RNA, 9876 nt, synthetic construct
  misc_feature 1..9876: note = derived and/or modified CDS sequence (opt5) from DENV-2__HQ705625__SS-prME
  source 1..9876: mol_type = other RNA
acagccggcgtgatcgtcatgctgattcccacagctatggccttccacctcacgacacggaatggggaacctcatatgatcgttggacggcaggaaaagggcaaaagcctgctttttaagacagaagacggggtgaatatgtgcaccctgatggcgattgatctcggagaactgtgtgaggacacaatcacctacaaatgcccgcttctgcgccaaaatgaacccgaggatattgactgttggtgcaattccacatctacctgggtgacgtatggcacctgtacaaccacaggggagcacagacgggaaaagcgcagcgtcgctctcgtgcctcatgttggaatgggcctggagaccagaacggaaacatggatgtcctctgagggcgcctggaaacacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatgaaaaccgaggctaagcagcctgccacgctgagaaaatattgcatcgaagctaagctcacaaacaccaccacagagagccggtgtccgacccaaggagagccctctctgaatgaagaacaggacaaacgctttatttgcaagcattccatggtggatagaggctggggcaacgggtgtggactgttcggcaaaggagggatcgtcacatgcgccatgtttacgtgcaaaaagaatatggaaggcaaagttgtgcagcctgagaacctcgaatacaccattgtgatcacaccccacagcggggaggagcatgcggtcggaaatgacaccggcaagcacggcaaagaaattaagatcacacctcagtcttccatcaccgaggccgaactgacggggtatggaaccgtgacaatggagtgtagcccccggaccggccttgatttcaacgaaatggttctgctccaaatggaggacaaggcttggctggtgcaccgccagtggtttcttgatctgccgctcccttggctgcccggggccgacacacagggatctaattggattcagaaggagaccctggtcacgttcaagaaccctcatgctaaaaagcaagacgtggttgtgctcggctcccaggaaggggccatgcacacagccctgaccggcgctacagagatccagatgagctccggaaatcttctgtttaccggccatctcaaatgcagactgcggatggataaacttcaactgaaagggatgtcttacagcatgtgtaccggaaagttcaagattgtcaaagaaatcgcggagacacagcacggcacgattgtgatcagagtccagtatgagggggacggatccccctgcaagatccccttcgaaattaccgatctcgagaaacgccatgtgctgggccggctgatcacagttaaccctattgtgaccgaaaaggacagcccggtcaacatcgaggccgaacccccttttggggattcttacattatcattggcgtggagcccggacagctcaaactgaattggttcaagaagggctccagcatcgggcaaatgtttgagacaaccatgagaggagctaaacgcatggccatccttggcgacacggcctgggatttcgggtctctgggaggcgtttttacaagcattgggaaggctctccaccaggtgttcggcgccatctacggagcggctttttccggcgtctcttggaccatgaaaattctgatcggggtgattatcacctggatcggaatgaacagccggtccacaagcctgtctgtgtcccttgttctcgtcggcgtggtgaccctgtatctgggggccgtcgtgcaggccgacagcggatgtgttgtgtcttggaagaataaagaactcaagtgcggctccgggattttcatcacagataacgtccacacgtggaccgagcagtacaagtttcaacctgaaagcccctccaaactggcttctgccattcagaaggctcatgaggaaggcatctgtggaattagaagcgtgacacgccttgagaatctgatgtggaaacagatcaccccggagctcaaccacatcctgtccgaaaatgaggttaagctgacaattatgaccggcgacatcaaagggattatgcaggccggaaagcggtctcttagacctcaacccacggaactcaaatatagctggaagacctggggcaaggcgaaaatgctgtccacagagagccataaccagaccttcctgatcgatgggcctgaaacagccgagtgccccaataccaaccgcgcttggaactctctcgaggtggaagactacggatttggcgtcttcacaaccaacatttggctgaaacttcgggagaaacaggacgtgttttgtgattccaagctgatgagcgccgctatcaaagacaatagagccgttcacgcggatatgggctattggatcgaatctgccctcaacgacacgtggaagatggagaaggcttccttcattgaggtgaaaagctgccactggcctaagtctcatacactgtggagcaatggggtcctggaatccgagatgatcattcccaaaaacttcgccggaccggtgagccagcacaactaccgccctggctatcatacccaaaccgctgggccctggcaccttggaaagctcgaaatggattttgacttctgtgagggcacaaccgtggtcgttacggaagattgcgggaatcggggaccctctctgagaacaaccacagcctccggcaaactgatcaccgagtggtgctgtcggagctgcacactccctccgctgcgctacagaggcgaggacgggtgttggtacggaatggaaattcggccccttaaggagaaggaagagaacctggtgaatagcctcgtgaccgccggccatgggcagatcgataacttttctctgggagtcctgggcatggctcttttcctcgaagagatgctgagaacgcgcattgggaccaaacacgcgatcctgctcgtggccgttagctttgtgacactgatcaccggaaatatgtccttccgggaccttggcagagtcatggtgatggttggcgctacaatgaccgatgacattgggatgggagtgacgtatctggccctcctggccgcttttaaggtccgccctacattcgccgcgggcctgcttctgagaaaactcacctctaaggagctgatgatggctacaatcgggattgccctcctgagccagtccaccatccccgaaaccattcttgagctgacagatgccctcgctctgggaatgatggtgctgaaaatcgttcggaacatggaaaagtaccaacttgccgtgacgatcatggcgatttcttgcgtccctaatgctgtgatcctgcagaacgcctggaaggtgagctgtaccattctcgccgctgtctccgttagccccctgctcctgacatcttcccagcagaaagccgactggatccctcttgctctgaccattaagggcctcaatcccacagccatctttctgaccacgctgagccgcacatctaaaaagagatcctggccgcttaacgaggcgatcatggccgtggggatggtgagcattctggcttcttccctcctgaaaaatgacatccctatgaccggacccctcgtcgccggcggcctgcttaccgtgtgctatgttctgacagggcggagcgctgatctggaactcgagcgcgccgccgacgtgaagtgggaggatcaagctgaaatttccggaagctctcctatcctgagcattaccatctccgaggacggctctatgagcattaaaaacgaagaggaggaacagacacttacgatcctgatcagaaccgggctcctggtcatttccggagtgttccccgtttctatcccgattacagcggccgcttggtacctctgggaggtgaagaagcagcgggccggcgtcctgtgggatgtgccttctccccctcccgtcgaaaaagccgagcttgaagacggggcttatcgcatcaagcagagagggattctgggctactcccaaatcggcgccggggtgtataaagagggaacctttcacacaatgtggcatgttacccggggcgcggtgctgatgcaccgcgggaagagaatcgagccctcctgggctgatgtcaaaaaggacctcattagctacggaggcgggtggaagctggaaggagagtggaaagaaggcgaggaagtgcaggttcttgccctggagcctggcaagaatccgcgggccgtgcagacgaaacccgggatcttcaagaccaacacaggaaccattggcgctgtctccctcgattttagccctgggacatctggatcccccatcgtggacagaaaaggcaaggtggttgggctgtacggaaatggcgtcgtgacccgcagcggcgcctatgtgtctgcgattgctcagacagagaagtccatcgaagataaccctgagatcgaagacgatattttccggaaaaagagactcacgatcatggacctgcatcccggggccggaaaaaccaagcgctaccttcctgccattgtccgggaggctatcaaaagaggcctgcgcacactgattctcgccccgacccgggtggttgctgccgaaatggaggaggcgctgagagggcttcccatccgctatcaaacccctgccattaagacagaacacacgggacgggagatcgtggacctgatgtgtcatgctaccttcacaatgagactcctgagccccgtccgggtgcctaactacaatctcatcattatggatgaagcccactttaccgaccccgcttccatcgccgcccgcggctatatttctacaagagttgagatgggggaggctgcgggcatcttcatgaccgccacgccgcctggaagccgggatccctttccccagtccaacgctcctattatggacgaagaaagagaaatccccgagagaagctggaactctggccacgaatgggtgacagatttcaaggggaaaaccgtctggtttgtgccttccatcaaggccggaaacgacattgccgcttgcctgcggaaaaatggcaagaaagttatccagcttagcagaaagaccttcgattctgagtacgtgaagacacgcgccaacgactgggattttgtcgtgaccacagacattagcgagatgggggcgaatttcaaagctgaacgggtgatcgatccgagacgctgtatgaagcccgtcattctgaccgacggagaggaacgggttatcctggccggccctatgcccgtgacgcattcctctgccgctcaaagacgcgggcggatcggcagaaaccctaaaaatgagaacgaccagtatatttacatgggagaacccctcgagaatgatgaggactgcgcccactggaaggaagcgaaaatgctgcttgataacatcaatacaccggagggcattatccctagcatgtttgaacccgagcgcgaaaaggtggacgccattgatggggagtacagactgcggggagaggctcgcaaaaccttcgtcgacctcatgagacggggcgatctgcctgtgtggctggcctataaggttgctgccgaagggatcaactacgctgaccgcaagtggtgttttgatggaaccaagaataaccagattctcgaggaaaacatggaggtggagatctggaccaaggaaggcgagcgcaagaaacttaaaccccggtggctggacgccagaatctattccgatcctctggcgctcaaggagttcaaggagttcgccgctgggcgcaaatctctgacgcttaatctgattaccgaaatgggccggctccccacatttatgacccagaaggccagaaacgctctggacaatctggccgtcctccatacagccgaggctggaggccgcgcgtacaaccacgcccttagcgagctgccggaaaccctggagacactcctgcttctgaccctcctggctacggtgacagggggaatcttcctgtttctcatgtccggcaaagggattggaaagatgacccttggcatgtgctgcatcattaccgccagcatcctgctgtggtatgcccaaatccagcctcactggattgctgcctctatcattctcgagttctttctgatcgttcttctgattcccgagcccgaaaaacagcggacacctcaggataatcaactcacctacgtggtcatcgcgatcctgacagtggtcgccgctacgatggccaacgagatgggcttcctggagaagaccaagaaagacctcgggcttggatccattacaacccaggaaagcgagtccaatatcctggacattgatctgagaccggcttctgcctggacactctatgcggtggccaccacgtttgttacccccatgctgcggcatagcatcgaaaactcctctgtgaatgtgagccttacagctattgccaaccaggctaccgtcctgatgggcctcgggaagggatggcctctgtccaaaatggacatcggcgttcccctgctcgccattgggtgttacagccaggtgaatcctatcacacttaccgctgccctgctgctcctggtggcgcactacgccatcattggacccggccttcaagctaaggccacgcgcgaggctcagaaaagagccgccgcgggcatcatgaagaaccctacagtcgatgggattaccgtgatcgacctggaaccgattccctatgatcctaagttcgagaaacagctcggacaggttatgctgctgatcctctgcgtgacacaagtccttatgatgcggaccacctgggctctgtgtgaggccctgacactcgctacgggccccatctctaccctgtgggaagggaatcctggacgcttttggaacacaaccattgccgtgtccatggccaatatcttcagaggcagctaccttgctggggccggactgctcttttctattatgaagaacacaacctccacgcggcgcggcacaggcaatatcggggagaccctgggagaaaaatggaaaagcagactgaacgcgctcggcaaatctgagttccagatttataagaaaagcgggatccaggaggtcgaccggacccttgccaaggaaggaatcaagcgcggcgagacagatcatcacgctgtgtccagagggtctgccaaactgcggtggtttgttgaaagaaacatggtgacccccgagggaaaggtcgtggacctgggctgcggccgcgggggatggagctactattgtggcgggctcaaaaatgttcgggaagtgaagggactgacaaaaggcgggccgggacatgaggagcctattcccatgtccacgtacggctggaaccttgtcagactgcaaagcggcgtggatgtgttcttcacaccccctgaaaagtgcgacaccctcctgtgtgatatcggggagtcctctcccaatcctaccattgaagctggacgcacactgcgggttctcaaccttgtcgagaattggctgaacaataacacccagttttgcatcaaggtgctgaatccgtatatgcccagcgtgattgagaagatggaggccctccagagacagtacggcggggcgctggtccgcaaccctctttccagaaattctacgcacgagatgtactgggttagcaacgccaccggaaatatcgtgtcctctgtgaacatgatcagcagaatgctgattaatcgcttcacaatgaagcacaaaaaggctacctatgaacccgacgtcgatctcggctccgggacacggaacatcggaattgagagcgaaatccctaacctggacattatcggcaaaagaattgagaagatcaagcaagaacatgagatctcttggcactacgaccaggatcatccctataaaacctgggcctaccacggctcctatgagacaaagcagaccgggagcgcttcttccatggtgaatggagttgtgcgcctgctcacgaaaccgtgggacgtcgtgcctatggttacacagatggccatgaccgataccacaccctttggccaacagcgggtgttcaaggaaaaagtcgacacgagaacccaggagcctaaggaagggacaaagaaacttatgaagattaccgctgagtggctgtggaaagagctgggaaagaaaaagacaccccgcatgtgtaccagagaagagtttaccaagaaggtgcggagcaacgccgcgctcggcgccatcttcaccgatgaaaataagtggaaatctgctcgcgaggccgtggaagacgggagattttgggagctggtcgatcgggagagaaaccttcacctggaaggaaagtgcgagacgtgtgtttacaatatgatgggcaaacgggaaaagaaactcggcgagttcgggaaggctaagggatcccgcgccatttggtatatgtggctgggcgccagatttctggagttcgaggcgctcgggtttctgaacgaggaccattggttcagccggggaaattcccttagcggcgtggaaggggagggcctgcaccgcctcggatacatcctgagagatgtgggcaaaaaggaagggggagctatgtacgccgacgataccgccggctgggacacacggattacccttgaggacctgaaaaacgaagagatggtcacaaatcatatgaagggggagcacaaaaagctcgctgaagccatctttaagctgacctatcagaacaaagtggttcgcgtgcaaagacctacgccccggggaacagtcatggatatcatttctcgcagagaccagcggggcagcggacaggtgggcacctacggactgaatacattcaccaacatggaggctcaactcatccgccagatggaaggcgaggggattttcaagtccatccagcatctgacggccaccgaggaaattgcggttcagaattggcttgccagagtgggacgggagcgcctgtctagaatggctatcagcggcgatgactgcgtcgtgaaaccgatcgatgaccggtttgcctccgctctcacagccctgaacgatatggggaaggttagaaaagacattcaacagtgggaaccttctcgcggatggaatgattggacccaggtgcccttctgcagccaccactttcatgagcttgtcatgaaggacggccgggtgctggtcgtgccctgtagaaaccaggatgaactcatcgggcgcgcgcggatttcccaaggcgccggatggtctctgaaggagacagcttgcctgggcaaaagctatgcccagatgtggaccctcatgtacttccacagacgcgacctgcggcttgctgccaacgctatctgttccgccgttcctagccattgggtgccgacatctagaaccacgtggtccattcacgcgaagcacgagtggatgacaaccgaagatatgctggccgtctggaatcgcgtgtggatccaggagaacccctggatggaagacaaaacccctgtggagagctgggaagaggttccctatctcgggaagcgggaggaccagtggtgcggatctctgattggccttacatccagagctacctgggccaaaaatatccaaacagccatcaaccaggtgcgcagcctgattgggaatgaagagtacacggattatatgccttccatgaagcggtttagacgggaagaggaagaggctggagtcctctggtga

SEQ ID NO: 19801 - RNA, 9876 nt, synthetic construct
  misc_feature 1..9876: note = derived and/or modified CDS sequence (opt5) from DENV-2__JF730052__SS-prME
  source 1..9876: mol_type = other RNA
accgccggcgtgatcgtcatgctgattcccacagctatggccttccacctcacgacccggaatggggaacctcatatgatcgttggacggcaggaaaagggcaagagcctgctttttaagacagaagacggggtgaatatgtgcaccctgatggcgattgatctcggagaactgtgtgaggacacaatcacctacaagtgcccgcttctgcgccaaaatgaacccgaggatattgactgttggtgcaattccacatctacctgggtgacgtatggcacctgtacaaccacaggggagcacagacgggaaaagcgcagcgtcgctctcgtgcctcatgttggaatgggcctggagaccagaacggaaacatggatgtcctctgagggcgcctggaaacacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatgaaaaccgaggctaagcagcctgccacgctgagaaaatattgcatcgaagctaagctcacaaacaccaccacagagagccggtgtccgacccaaggagagccctctctgaatgaagaacaggacaaacgctttatttgcaagcattccatggtggatagaggctggggcaacgggtgtggactgttcggcaaaggcgggatcgtcacatgcgccatgtttacgtgcaaaaagaatatggaagggaaagttgtgcagcctgagaacctcgaatacaccattgtgatcacaccccacagcggggaggagcatgcggtcggaaatgacaccggcaagcacggcaaagaaattaagatcacacctcagtcttccatcaccgaggccgaactgacggggtatggaaccgtgacaatggagtgtagcccccggaccggccttgatttcaacgaaatggttctgctccaaatggaggacaaggcttggctggtgcaccgccagtggtttcttgatctgccgctcccttggctgcccggggccgacacacagggatctaattggattcagaaggagaccctggtcacgttcaagaaccctcatgctaaaaagcaagacgtggttgtgctcggctcccaggaaggggccatgcacacagccctgaccggcgctacagagatccagatgagctccggaaatcttctgtttaccggccatctcaaatgcagactgcggatggataaacttcaactgaaagggatgtcttacagcatgtgtaccggaaagttcaagattgtcaaagaaatcgcggagacacagcacggcacgattgtgatcagagtccagtatgagggggacggatccccctgcaagatccccttcgaaattaccgatctcgagaaacgccatgtgctgggccggctgatcacagttaaccctattgtgaccgaaaaggacagcccggtcaacatcgaggccgaacccccttttggggattcttacattatcattggcgtggagcccggacagctcaaactgaattggttcaagaagggctccagcatcgggcaaatgtttgagacaaccatgagaggagctaaacgcatggccatccttggcgacacggcctgggatttcgggtctctgggaggcgtttttacaagcattgggaaggctctccaccaggtgttcggcgccatctacggagcggctttttccggcgtctcttggaccatgaaaattctgatcggggtgattatcacctggatcggaatgaacagccggtccacaagcctgtctgtgtcccttgttctcgtcggcgtggtgaccctgtatctgggggccgtcgtgcaggccgacagcggatgtgttgtgtcttggaagaataaagaactcaagtgcggctccgggattttcatcacagataacgtccacacgtggaccgagcagtacaagtttcaacctgaaagcccctccaaactggcttctgccattcagaaggctcatgaggaaggcatctgtggaattagaagcgtgacacgccttgagaatctgatgtggaaacagatcaccccggagctcaaccacatcctgtccgaaaatgaggttaagctgacaattatgaccggcgacatcaaagggattatgcaggccggaaagcggtctcttagacctcaacccacggaactcaaatatagctggaagacctggggcaaggcgaaaatgctgtccacagagagccataaccagaccttcctgatcgatgggcctgaaacagccgagtgccccaataccaaccgcgcttggaactctctcgaggtggaagactacggatttggcgtcttcacaaccaacatttggctgaaacttcgggagaaacaggacgtgttttgtgattccaagctgatgagcgccgctatcaaagacaatagagccgttcacgcggatatgggctattggatcgaatctgccctcaacgacacgtggaagatggagaaggcttccttcattgaggtgaaaagctgccactggcctaagtctcatacactgtggagcaatggggtcctggaatccgagatgatcattcccaaaaacttcgccggaccggtgagccagcacaactaccgccctggctatcatacccaaaccgctgggccctggcaccttggaaagctcgaaatggattttgacttctgtgagggcacaaccgtggtcgttacggaagattgcgggaatcggggaccctctctgagaacaaccacagcctccggcaaactgatcaccgagtggtgctgtcggagctgcacactccctccgctgcgctacagaggcgaggacgggtgttggtacggaatggaaattcggccccttaaggagaaggaagagaacctggtgaatagcctcgtgaccgccggccatgggcagatcgataacttttctctgggagtcctgggcatggctcttttcctcgaagagatgctgagaacgcgcattgggaccaaacacgcgatcctgctcgtggccgttagctttgtgacactgaccacaggaaatatgtccttccgggaccttggcagagtcatggtgatggttggcgctaccatgacggatgacatcgggatgggagtgacatatctggccctcctggccgcttttaaggtccgccctaccttcgccgcgggcctgcttctgagaaaactcacatctaaggagctgatgatggctaccattgggatcgccctcctgagccagtccaccattcccgaaacaatccttgagctgacggatgccctcgctctgggaatgatggtgctgaaaattgttcggaacatggaaaagtaccaacttgccgtgaccatcatggcgatctcttgcgtccctaatgctgtgattctgcagaacgcctggaaggtgagctgtacaatcctcgccgctgtctccgttagccccctgctcctgacctcttcccagcagaaagccgactggattcctcttgctctgacaatcaagggcctcaatcccaccgccatttttctgacgacactgagccgcacctctaaaaagagatcctggccgcttaacgaggcgatcatggccgtggggatggtgagcatcctggcttcttccctcctgaaaaatgacattcctatgaccggacccctcgtcgccggcggcctgcttacagtgtgctatgttctgaccgggcggagcgctgatctggaactcgagcgcgccgccgacgtgaagtgggaggatcaagctgaaatctccggaagctctcctattctgagcatcacaatttccgaggacggctctatgagcatcaaaaacgaagaggaggaacagacgcttaccattctgatcagaacagggctcctggtcatctccggagtgttccccgtttctattccgatcaccgcggccgcttggtacctctgggaggtgaagaagcagcgggccggcgtcctgtgggatgtgccttctccccctcccgtcgaaaaagccgagcttgaagacggggcttatcgcattaagcagagaggaatcctgggctactcccaaattggcgccggggtgtataaagagggaacatttcacaccatgtggcatgttacgcggggcgcggtgctgatgcaccgcgggaagagaatcgagccctcctgggctgatgtcaaaaaggacctcatcagctacggaggcgggtggaagctggaaggagagtggaaagaaggcgaggaagtgcaggttcttgccctggagcctggcaagaatccgcgggccgtgcagaccaaacccgggattttcaagacaaacaccggaacaatcggcgctgtctccctcgattttagccctgggacctctggatcccccattgtggacagaaaaggcaaggtggttgggctgtacggaaatggcgtcgtgacacgcagcggcgcctatgtgtctgcgatcgctcagacggagaagtccattgaagataaccctgagatcgaagacgatatcttccggaaaaagagactcaccattatggacctgcatcccggggccggaaaaacaaagcgctaccttcctgccatcgtccgggaggctattaaaagaggcctgcgcaccctgatcctcgccccgacccgggtggttgctgccgaaatggaggaggcgctgagagggcttcccattcgctatcaaacccctgccatcaagacggaacacaccggacgggagattgtggacctgatgtgtcatgctacattcaccatgagactcctgagccccgtccgggtgcctaactacaatctcatcatcatggatgaagcccactttacagaccccgcttccattgccgcccgcggctatatctctaccagagttgagatgggggaggctgcgggcattttcatgacggccacaccgcctggaagccgggatccctttccccagtccaacgctcctatcatggacgaagaaagagaaattcccgagagaagctggaactctggccacgaatgggtgaccgatttcaaggggaaaaccgtctggtttgtgccttccatcaaggccggaaacgacatcgccgcttgcctgcggaaaaatggcaagaaagttattcagcttagcagaaagacattcgattctgagtacgtgaagacccgcgccaacgactgggattttgtcgtgacaaccgacatcagcgagatgggggcgaatttcaaagctgaacgggtgattgatccgagacgctgtatgaagcccgtcatcctgacggacggagaggaacgggttattctggccggccctatgcccgtgacacattcctctgccgctcaaagacgcgggcggatcggcagaaaccctaaaaatgagaacgaccagtatatctacatgggagaacccctcgagaatgatgaggactgcgcccactggaaggaagcgaaaatgctgcttgataacattaataccccggagggcatcattcctagcatgtttgaacccgagcgcgaaaaggtggacgccatcgatggggagtacagactgcggggagaggctcgcaaaacattcgtcgacctcatgagacggggcgatctgcctgtgtggctggcctataaggttgctgccgaagggattaactacgctgaccgcaagtggtgttttgatggaaccaaaaataaccagatcctcgaggaaaacatggaggtggagatttggacgaaggaaggcgagcgcaagaaacttaaaccccggtggctggacgccagaatctattccgatcctctggcgctcaaggagttcaaggagttcgccgctgggcgcaaatctctgacccttaatctgatcacagaaatgggccggctccccacctttatgacacagaaggccagaaacgctctggacaatctggccgtcctccataccgccgaggctggaggccgcgcgtacaaccacgcccttagcgagctgccggaaacactggagaccctcctgcttctgacgctcctggctacagtgaccgggggaattttcctgtttctcatgtccggcaaagggatcggaaagatgacccttggcatgtgctgcattatcacagccagcattctgctgtggtatgcccaaatccagcctcactggatcgctgcctctattatcctcgagttctttctgattgttcttctgatccccgagcccgaaaaacagcggacccctcaggataatcaactcacatacgtggtcattgcgatcctgacggtggtcgccgctaccatggccaacgagatgggcttcctggagaagacaaagaaagacctcgggcttggatccatcaccacacaggaaagcgagtccaatattctggacatcgatctgagaccggcttctgcctggaccctctatgcggtggccacgacctttgttacacccatgctgcggcatagcattgaaaactcctctgtgaatgtgagccttaccgctatcgccaaccaggctacagtcctgatgggcctcgggaagggatggcctctgtccaaaatggacattggcgttcccctgctcgccatcgggtgttacagccaggtgaatcctattacccttacggctgccctgctgctcctggtggcgcactacgccatcatcggacccggccttcaagctaaggccacacgcgaggctcagaaaagagccgccgcgggcattatgaagaaccctaccgtcgatgggatcacagtgattgacctggaaccgatcccctatgatcctaagttcgagaaacagctcggacaggttatgctgctgattctctgcgtgacccaagtccttatgatgcggaccacatgggctctgtgtgaggccctgacgctcgctaccggccccatctctacactgtgggaagggaatcctggacgcttttggaacaccacaatcgccgtgtccatggccaatattttcagaggcagctaccttgctggggccggactgctcttttctatcatgaagaacaccacgtccacacggcgcggcaccggcaatattggggagaccctgggagaaaaatggaaaagcagactgaacgcgctcggcaaatctgagttccagatctataagaaaagcgggattcaggaggtcgaccggacacttgccaaggaaggaatcaagcgcggcgagaccgatcatcacgctgtgtccagagggtctgccaaactgcggtggtttgttgaaagaaacatggtgacacccgagggaaaggtcgtggacctgggctgcggccgcgggggatggagctactattgtggcgggctcaaaaatgttcgggaagtgaagggactgacgaaaggcgggccgggacatgaggagcctatccccatgtccacctacggctggaaccttgtcagactgcaaagcggcgtggatgtgttcttcacaccccctgaaaagtgcgacaccctcctgtgtgatattggggagtcctctcccaatcctacaatcgaagctggacgcaccctgcgggttctcaaccttgtcgagaattggctgaacaataacacgcagttttgcattaaggtgctgaatccgtatatgcccagcgtgatcgagaagatggaggccctccagagacagtacggcggggcgctggtccgcaaccctctttccagaaattctacccacgagatgtactgggttagcaacgccacaggaaatattgtgtcctctgtgaacatgatcagcagaatgctgatcaatcgcttcaccatgaagcacaaaaaggctacatatgaacccgacgtcgatctcggctccgggacccggaacattggaatcgagagcgaaattcctaacctggacatcattggcaaaagaatcgagaagattaagcaagaacatgagatctcttggcactacgaccaggatcatccctataaaacatgggcctaccacggctcctatgagaccaagcagacggggagcgcttcttccatggtgaatggagttgtgcgcctgctcacaaaaccgtgggacgtcgtgcctatggttacccagatggccatgaccgatacaacgccctttggccaacagcgggtgttcaaggaaaaagtcgacaccagaacacaggagcctaaggaagggaccaagaaacttatgaagatcacagctgagtggctgtggaaagagctgggaaagaaaaagacaccccgcatgtgtacaagagaagagtttaccaaaaaggtgcggagcaacgccgcgctcggcgccattttcacggatgaaaataagtggaaatctgctcgcgaggccgtggaagacgggagattttgggagctggtcgatcgggagagaaaccttcacctggaaggaaagtgcgagacctgtgtttacaatatgatgggcaaacgggaaaagaaactcggcgagttcgggaaggctaagggatcccgcgccatctggtatatgtggctgggcgccagatttctggagttcgaggcgctcgggtttctgaacgaggaccattggttcagccggggaaattcccttagcggcgtggaaggggagggcctgcaccgcctcggatacattctgagagatgtgggcaaaaaggaagggggagctatgtacgccgacgatacagccggctgggacacccggatcacacttgaggacctgaaaaacgaagagatggtcaccaatcatatgaagggggagcacaaaaagctcgctgaagccatttttaagctgacgtatcagaacaaagtggttcgcgtgcaaagacctacaccccggggaaccgtcatggatatcatctctcgcagagaccagcggggcagcggacaggtgggcacatacggactgaataccttcacgaacatggaggctcaactcattcgccagatggaaggcgaggggatcttcaagtccattcagcatctgaccgccacagaggaaatcgcggttcagaattggcttgccagagtgggacgggagcgcctgtctagaatggctattagcggcgatgactgcgtcgtgaaaccgatcgatgaccggtttgcctccgctctcaccgccctgaacgatatggggaaggttagaaaagacatccaacagtgggaaccttctcgcggatggaatgattggacacaggtgcccttctgcagccaccactttcatgagcttgtcatgaaggacggccgggtgctggtcgtgccctgtagaaaccaggatgaactcattgggcgcgcgcggatctcccaaggcgccggatggtctctgaaggagaccgcttgcctgggcaaaagctatgcccagatgtggacactcatgtacttccacagacgcgacctgcggcttgctgccaacgctatttgttccgccgttcctagccattgggtgccgacctctagaacgacatggtccatccacgcgaagcacgagtggatgaccaccgaagatatgctggccgtctggaatcgcgtgtggattcaggagaacccctggatggaagacaaaacacctgtggagagctgggaagaggttccctatctcgggaagcgggaggaccagtggtgcggatctctgatcggccttacctccagagctacatgggccaaaaatattcaaacggccatcaaccaggtgcgcagcctgatcgggaatgaagagtacaccgattatatgccttccatgaagcggtttagacgggaagaggaagaggctggagtcctctggtga

SEQ ID NO: 19802 - RNA, 9876 nt, synthetic construct
  misc_feature 1..9876: note = derived and/or modified CDS sequence (opt5) from DENV-2__EU482748__SS-prME
  source 1..9876: mol_type = other RNA
accgccggagtgatcgtcatgctgattcccacggctatggccttccacctcacgacccggaatggggagcctcatatgatcgttggacggcaggaaaagggcaagagcctgctttttaagacagaggacggggtgaatatgtgcaccctgatggcgattgatctcggagaactgtgtgaggaaacaatcacctacaagtgcccgcttctgcgccaaaatgagcccgaggacattgattgttggtgcaatagcacatctacctgggtgacgtatggcacctgtacaaccacaggggaacacagacgggagaagcgcagcgtcgctctcgtgcctcatgttggaatgggcctggaaaccagaacggagacatggatgtcctctgagggcgcctggaaacacgtgcagcggatcgaaacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgactttgtggagggggtttctggaggcagctgggtggatatcgtcctcgaacacgggtcctgtgtgacaaccatggccaagaataagcccacactggacttcgagcttatcaaaaccgaagctaagcagcctgccacgctgagaaaatattgcattgaggctaagctcacaaacaccaccacagagagccggtgtccgacccaaggagaaccctctctgaatgaggaacaggataaacgctttatctgcaagcattccatggtggacagaggctggggcaacgggtgtggactgttcggcaaagggggaattgtcacatgcgccatgtttacgtgcaaaaagaatatggagggcaaagttgtgcagcctgaaaacctcgagtacaccatcgtgattacaccccacagcggggaggaacatgcggtcggaaatgataccggcaagcacggcaaagagatcaagatcacacctcagtcttccattaccgaagccgagctgacggggtatggaaccgtgacaatggaatgtagcccccggaccggccttgacttcaacgagatggttctgctccaaatggaggataaggcttggctggtgcaccgccagtggtttcttgacctgccgctcccttggctgcccggggccgatacacagggatctaattggatccagaaggaaaccctggtcacgttcaagaaccctcatgctaaaaagcaagacgtggttgtgctcggctcccaggagggggccatgcacacagccctgaccggcgctacagaaattcagatgagctccggaaatcttctgtttaccggccatctcaaatgcagactgcggatggacaaacttcaactgaaagggatgtcttacagcatgtgtaccggaaagttcaagatcgtcaaagagattgcggagacacagcacggcacgatcgtgatcagagtccagtatgaaggggatggatccccctgcaagattcccttcgagatcaccgacctcgaaaaacgccatgtgctgggccggctgattacagttaaccctatcgtgaccgagaaggatagcccggtcaacattgaagccgagcccccttttggggactcttacatcattatcggcgtggagcccggacagctcaaactgaattggttcaagaagggctccagcatcgggcaaatgtttgaaacaaccatgagaggagctaaacgcatggccattcttggcgatacggcctgggacttcgggtctctgggaggcgtttttacaagcatcgggaaggctctccaccaggtgttcggcgccatttacggagcggctttttccggcgtctcttggaccatgaaaatcctgattggggtgatcatcacctggattggaatgaacagccggtccacaagcctgtctgtgtcccttgttctcgtcggcgtggtgaccctgtatctgggggccatggtccaggccgatagcggatgtgtggtttcttggaagaataaagagctcaagtgcggctccgggatcttcattacagacaacgtgcacacgtggaccgaacagtacaagtttcaacctgagagcccctccaaactggcttctgccatccagaaggctcatgaagagggcatttgtggaatcagaagcgtcacacgccttgagaatctgatgtggaaacagatcaccccggaactcaaccacattctgtccgagaatgaagtgaagctgacaatcatgaccggcgatattaaagggatcatgcaggccggaaagcggtctcttagacctcaacccacggagctcaaatatagctggaagacctggggcaaggcgaaaatgctgtccacagaaagccataaccagaccttcctgattgacgggcctgagacagccgagtgccccaataccaaccgcgcttggaactctctcgaagttgaggattacggatttggcgtgttcacaaccaacatctggctgaaacttcgggaaaaacaggacgtcttttgtgactccaagctgatgagcgccgctatcaaagataatagagccgtgcacgcggacatgggctattggattgagtctgccctcaacgatacgtggaagatggagaaggcttccttcatcgaagttaaaagctgccactggcctaagtctcatacactgtggagcaatggggtgctggagtccgaaatgattatccccaaaaacttcgccggaccggtcagccagcacaactaccgccctggctatcatacccaaaccgctgggccctggcaccttggaaagctcgagatggactttgatctgtgtgaaggcacaaccgtggtggtcacggaggactgcgggaatcggggaccctctctgagaacaaccacagcctccggcaaactcattaccgagtggtgctgtcggagctgcacactgcctccgcttcgctacagaggcgaagatgggtgttggtacggaatggagatccggcccctgaaggaaaaggaggaaaacctcgttaattccctggtgaccgccggccatgggcagattgacaacttctctctgggagtgcttggcatggctctctttctggaggagatgctgagaacgcgcatcgggaccaaacacgcgatcctcctggtcgccgtgagcttcgttacacttattaccggaaatatgtcctttcgggatctgggcagagtgatggtcatggtgggcgctacaatgaccgacgatatcgggatgggagttacgtatctcgccctgctggccgctttcaaggtgcgccctacatttgccgcgggccttctgctcagaaaactgacctctaaggaactcatgatggctacaattgggatcgccctgcttagccagtccaccattcccgagaccatcctggaactcacagacgccctggctctgggaatgatggtccttaaaatcgtgcggaacatggagaagtaccaactggccgttacgattatggcgatctcttgcgtgcctaatgctgtcattctccagaacgcctggaaggtgagctgtaccatcctggccgctgtgtccgtcagccccctcctgcttacatcttcccagcagaaagccgattggattcctctggctctcaccatcaagggcctgaatcccacagccatcttcctgaccacgcttagccgcacatctaaaaagagatcctggccgctgaacgaagcgattatggccgttgggatggtgagcatcctcgcttcttccctgctcaaaaatgacattcctatgaccggacccctggtggccggcggccttctgaccgtctgctatgtgctgacagggcggagcgctgacctcgagctggagcgcgccgccgatgttaagtgggaagaccaagctgagatctccggaagctctcctattcttagcatcaccatttccgaagatggctctatgagcatcaaaaacgaggaggaagaacagacactgacgatcctcattagaaccgggctgctcgtgatctccggagtctttcccgtgtctattccgatcacagcggccgcttggtacctgtgggaagttaagaagcagcgggccggcgtgctttgggacgtcccttctccccctcccgtggagaaagccgaactggaggatggggcttatcgcattaagcagagaggaatcctgggctactcccaaatcggcgccggggtctataaagagggaaccttccacacaatgtggcatgtgacccggggcgcggttctcatgcaccgcgggaagagaattgaaccctcctgggctgacgtgaaaaaggatctgatcagctacggaggcgggtggaaacttgagggagaatggaaagagggcgaagaggtccaggtgctggccctcgagcctggcaagaatccgcgggccgttcagacgaaacccgggatttttaagaccaacacaggaaccatcggcgctgtgtccctggacttcagccctgggacatctggatcccccattgtcgatagaaaaggcaaggtggtggggctctacggaaatggcgttgtcacccgcagcggcgcctatgtgtctgcgatcgctcagacagaaaagtccatcgaggacaaccctgaaattgaggatgacatctttcggaaaaagagactgacgattatggatcttcatcccggggccggaaaaaccaagcgctacctgcctgccatcgtgcgggaagctattaaaagaggcctgcgcacactcatcctggccccgacccgggtcgtggctgccgagatggaggaagcgcttagagggctgcccattcgctatcaaacccctgccatcaagacagagcacacgggacgggaaatcgttgacctcatgtgtcatgctaccttcacaatgagactgctcagccccgtgcgggtccctaactacaatctgattatcatggacgaggcccacttcaccgatcccgcttccattgccgcccgcggctatatctctacaagagtggagatgggggaagctgcgggcatttttatgaccgccacgccgcctggaagccgggaccccttcccccagtccaacgctcctatcatggatgaggaacgcgagatccccgaaagaagctggaactctggccacgagtgggttacagactttaaggggaaaaccgtgtggttcgtcccttccattaaggccggaaacgatatcgccgcttgccttcggaaaaatggcaagaaagtgattcagctgagcagaaagacctttgactctgagtacgttaagacacgcgccaacgattgggacttcgtggtcaccacagatatcagcgaaatgggggcgaattttaaagctgagcgggtgattgacccgagacgctgtatgaagcccgtgatcctgaccgatggagaagaacgggtcatcctcgccggccctatgcccgttacgcattcctctgccgctcaaagacgcgggcggattggcagaaaccctaaaaatgaaaacgaccagtatatctacatgggagagcccctggagaatgacgaagattgcgcccactggaaggaggcgaaaatgcttctggacaacattaatacaccggaaggcatcattcctagcatgttcgagcccgaacgcgagaaggtggatgccatcgacggggagtacagactccggggagaagctcgcaaaacctttgtggatctgatgagacggggcgacctgcctgtctggctcgcctataaggtggctgccgaggggattaactacgctgatcgcaagtggtgtttcgacggaatcaaaaataaccagatccttgaagagaacatggaggttgaaatttggacaaaggagggcgaacgcaagaagctgaaaccccggtggctggatgccagaatctattccgaccctctcgcgctgaaggagtttaaggagttcgccgctgggcgcaaatctcttaccctgaatctcattacggagatgggccggctgcccaccttcatgacacagaaggccagaaacgctctggataatctcgccgtgcttcataccgccgaggctggaggccgcgcgtacaaccacgccctgagcgaactgccggagacactcgaaaccctgcttctgctcacactgctggctaccgtcacagggggaatctttctcttccttatgtccggcaaagggattggaaagatgacactgggcatgtgctgcatcatcaccgccagcattctgctctggtatgcccaaatccagcctcactggattgctgcctctatcattctggagtttttccttatcgtgctgctcatccccgaacccgagaaacagcggacccctcaggacaatcaactgacatacgttgtgattgcgatcctgaccgtcgtggccgctacaatggccaacgagatgggctttctcgaaaagacgaagaaagatcttgggctgggatccattaccacacaggagagcgaatccaatatcctggacattgacctcagaccggcttctgcctggaccctgtatgcggtcgccacaaccttcgtgacgcccatgcttcggcatagcatcgagaactcctctgttaatgtgagcctgaccgctattgccaaccaggctacagtgctcatgggcctggggaagggatggcctctgtccaaaatggatatcggcgtccccctccttgccatcgggtgttacagccaggttaatcctattaccctgacagctgccctgctcctgcttgtggcgcactacgccatcattggacccggcctgcaagctaaggccacccgcgaagctcagaaaagagccgccgcgggcatcatgaagaaccctacggtggacgggattacagtcatcgatctcgagccgatcccctatgaccctaagtttgagaaacagctgggacaggtgatgctgctcattctttgcgttacccaagtgctgatgatgcggacaacctgggctctgtgtgaagccctcaccctggctacaggccccatctctacgctttgggaggggaatcctggacgcttctggaacaccacaattgccgtctccatggccaatatctttagaggcagctacctggctggggccggactcctgttctctattatgaagaacaccacatccacccggcgcggcacgggcaatatcggggaaacactgggagagaaatggaaaagcagactcaacgcgcttggcaaatctgagtttcagatctataagaaaagcgggattcaggaagtggatcggaccctggccaaggagggaatcaagcgcggcgaaaccgaccatcacgctgtctccagagggtctgccaaactgcggtggttcgtggagagaaacatggttacacccgaaggaaaggtggtcgatctcggctgcggccgcgggggatggagctactattgtggcgggctgaaaaatgtgcgggaggttaagggacttaccaaaggcgggccgggacatgaggaacctattcccatgtccacatacggctggaacctggtgagactccaaagcggcgtcgacgtgtttttcacgccccctgagaagtgcgataccctgctgtgtgacatcggggaatcctctcccaatcctacaattgaggctggacgcaccctccgggtgcttaacctggttgaaaattggctgaacaataacacacagttctgcatcaaggtcctcaatccgtatatgcccagcgtgatcgagaaaatggaggccctgcagagaaagtacggcggggcgcttgtgcgcaaccctctgtccagaaattctacccacgaaatgtactgggtcagcaacgccacgggaaatattgtttcctctgtgaacatgatcagcagaatgctcattaatcgctttaccatgaaacacaagaaaacaacctatgagcccgatgtggacctgggctccgggacacggaacatcggaattgaaagcgagatccctaacctggatattatcggcaagagaatcgaaaagattaaacaggagcatgagacctcttggcactacgaccaagaccatccctataagacatgggcttaccacggctcctatgaaaccaaacagacggggagcgcctcttccatggtcaatggagtggttcgcctccttacaaagccgtgggatgtggtccctatggtgacccagatggctatgaccgacacaacgcccttcggccagcaacgggtttttaaagagaaggtggataccagaacacaggaacctaaggaggggaccaaaaagctgatgaaaatcacagccgagtggctgtggaaggaactcggcaagaagaaaacccccagaatgtgtacaagagaggagttcacccggaaggtccgcagcaacgctgccctgggcgcgatttttacggacgagaataagtggaaatctgccagagaagctgtggaggatgggcggttctgggagcttgtggacagagaacggaacctgcacctcgagggaaagtgcgaaacctgtgtctacaatatgatgggcaaacgcgagaagaaactgggcgaatttgggaaggccaagggatccagagctatctggtatatgtggctgggcgcccggttcctcgagtttgaggccctggggttccttaacgaagatcattggtttagccgcggaaattccctgagcggcgttgagggggaaggcctccacagactgggatacattcttcgggacgtgtctaaaaaggagggcggggcgatgtacgctgatgacacagccggatgggatacccgcatcacactggaagacctcaaaaacgaggagatggtgaccaatcatatgaagggcgaacacaaaaagctggccgaggctatcttcaagctgacgtatcagaacaaagtcgtgagagttcagcggcctacaccccgcgggaccgtgatggacattatcagcagacgggatcaacgcggatccggccaggtcgggacatacggcctcaatacctttacgaacatggaagcccagctgattagacaaatggagggagagggcatcttcaagtctattcagcatcttaccgctacagaagagatcgtggttcagaattggctggcccgggtggggcgcgaaagactcagccggatggcgatctccggagacgattgcgtcgtgaaaccgattgacgatagattcgcctctgctctgaccgcccttaacgacatgggcaaggttcgcaaagatatccagcaatgggagcctagccgggggtggaatgactggacacaggtgcccttttgctcccaccacttccatgaactggtcatgaaggatggaagagtgctcgtcgtgccctgtcgcaaccaggacgagctgattggccgggctagaatctctcagggggccggctggagcctgaaggagaccgcgtgcctcggaaaatcctatgcccaaatgtggacactgatgtactttcaccgccgggatcttagactggctgccaacgctatttgtagcgccgttccttctcattgggtgccgacctcccgcacgacatggagcatccacgctaagcacgaatggatgaccaccgaggacatgctcgccgtctggaatcgggtgtggattcaggaaaacccctggatggaggataaaacacctgtggaatcttgggaggaggttccctatctgggcaagagagaagaccagtggtgcgggtcccttatcggactgaccagccgcgcgacatgggccaaaaatatccagacggctattaaccaagtgcggtccctcatcggcaatgaggaatacaccgactatatgccttctatgaagagattccggagagaggaagaggaggccggggtcctgtggtga

SEQ ID NO: 19803 - RNA, 9876 nt, synthetic construct
  misc_feature 1..9876: note = derived and/or modified CDS sequence (opt5) from DENV-2__EU482749__SS-prME
  source 1..9876: mol_type = other RNA
accgccggcgtgatcgtcatgctgattcccaccgctatggccttccacctcacgacccggaatggggagcctcatatgatcgttggacggcaggaaaagggcaagtccctgctttttaagaccgaggacggggtgaatatgtgcaccctgatggcgattgatctcggagaactgtgtgaggacaccatcacctacaaatgcccgcttctgcgccaaaacgaacccgaggatattgactgttggtgcaattccacatctacctgggtgacgtatggcacctgtacaaccacaggggagcacagacgggaaaagcgcagcgtcgctctcgtgcctcatgttggaatgggcctggagaccagaacggaaacatggatgtcctctgagggcgcctggaaacacgtgcagaccatcgagacatggatcctgcggcatcccgggttcaccattatggccgctatcctcgcctacaccattggaacaacgcactttcagcgcgctctgatcttcattcttctgaccgccgtcgcgcctagcatgacaatgagatgcatcggcatttccaaccgggattttgtggaaggggtttctggaggcagctgggtggacatcgtcctcgagcacgggtcctgtgtgaccacaatggccaagaataagcccaccctggatttcgaacttatcaaaacggaggctaagcagcctgccacactgcgcaaatattgcattgaagctaagctcaccaacaccacaaccgagagcagatgtccgacacaaggagagccctctctgtccgaagaacaggacaaacggtttatctgcaagcatagcatggtggatcgcggctggggcaatgggtgtggactgttcggcaaagggggaattgtcacgtgcgccatgtttacctgcaaaaagaacatggaaggcaaagttgtgcagcctgagaatctcgaatacacaatcgtgattacaccccactctggggaggagcatgcggtcggaaacgacacaggcaagcacggcaaagaaatcaagatcacccctcagtccagcattacggaggccgaactgaccgggtatggaacagtgaccatggagtgttctcccagaacaggccttgatttcaatgaaatggttctgctccaaatggaggacaaggcttggctggtgcaccggcagtggtttcttgatctgccgctcccttggctgcccggggccgacacccagggatccaactggatccagaaggagacgctggtcacattcaagaatcctcatgctaaaaagcaagacgtggttgtgctcggcagccaggaaggggccatgcacaccgccctgacaggcgctaccgagattcagatgtcctctggaaaccttctgtttaccggccatctcaaatgccgcctgagaatggataaacttcaactgaaagggatgagctactccatgtgtacaggaaagttcaagatcgtcaaagaaattgcggagacgcagcacggcaccatcgtgatccgggtccagtatgagggggacggaagcccctgcaagattcccttcgaaatcacagatctcgagaaaagacatgtgctgggccgcctgattaccgttaatcctatcgtgacagaaaaggactctccggtcaacattgaggccgaacccccttttggggattcctacatcattatcggcgtggagcccggacagctcaaactgaactggttcaagaagggcagctctatcgggcaaatgtttgagaccacgatgcggggagctaaaagaatggccattcttggcgacacagcctgggatttcgggagcctgggaggcgtttttacctccatcgggaaggctctccaccaggtgttcggcgccatttacggagcggctttttctggcgtcagctggaccatgaaaatcctgattggggtgatcatcacatggattggaatgaactcccgcagcacctctctgtccgtgagccttgttctcgtcggcgtggtgacactgtatctgggggccatggtccaggccgactctggatgtgtggtttcctggaagaacaaagaactcaagtgcggcagcgggatcttcattacggataatgtgcacacctggacagagcagtacaagtttcaacctgaatccccctctaaactggctagcgccatccagaaggctcatgaggaaggcatttgtggaatccggtccgtcaccagacttgagaacctgatgtggaaacagatcacaccggagctcaatcacattctgtctgaaaacgaggtgaagctgaccatcatgacgggcgacattcgcgggatcatgcaggccggaaaacggagccttagacctcaacccaccgaactcaagtattcctggaaaacatggggcaaggcgaagatgctgagcaccgagtctcataatcagacattcctgattgatgggcctgaaaccgccgagtgccccaacacaaatcgcgcttggaactccctcgaggttgaagactacggatttggcgtgttcaccacgaatatctggctgaaacttcgggagaagcaggacgtcttttgtgatagcaaactgatgtctgccgctatcaaggacaacagagccgtgcacgcggatatgggctattggattgaatccgccctcaatgacacatggaaaatggagaaggctagcttcatcgaggttaagtcttgccactggcctaaaagccataccctgtggtccaacggggtgctggaaagcgagatgattatccccaagaatttcgccggaccggtctctcagcacaactaccgccctggctatcatacccaaacagctgggccctggcaccttggaaaactcgaaatggattttgacctgtgtgagggcaccacggtggtggtcacagaagattgcgggaaccggggaccctccctgagaaccacaaccgccagcggcaagctcattacagagtggtgctgtcggtcctgcaccctgcctccgcttcgctacagaggcgaggacgggtgttggtacggaatggaaatccggcccctgaaagagaaggaagagaatctcgttaactctctggtgacggccggccatgggcagattgataatttcagcctgggagtgcttggcatggctctctttctggaagagatgctgagaacccgcatcgggacaaagcacgcgatcctcctggtcgccgtgtccttcgttacccttattacaggaaacatgtcttttcgggacctgggcagagtgatggtcatggtgggcgctaccatgacggatgacatcgggatgggagttacatatctcgccctgctggccgctttcaaagtgcgccctacctttgccgcgggccttctgctcagaaagctgacaagcaaagagctcatgatggctaccattgggatcgccctgctttcccagtctaccattcccgaaacaatcctggagctcacggatgccctggctctgggaatgatggtccttaagatcgtgcggaatatggaaaaataccaactggccgttaccattatggcgatcagctgcgtgcctaacgctgtcattctccagaatgcctggaaggtgtcctgtacaatcctggccgctgtgagcgtctctcccctcctgcttacctccagccagcagaaggccgactggattcctctggctctcacaatcaaaggcctgaaccccaccgccatcttcctgacgacactttctcgcacctccaagaaaagaagctggccgctgaatgaggcgattatggccgttgggatggtgtctatcctcgcttccagcctgctcaagaacgacattcctatgaccggacccctggtggccggcggccttctgacagtctgctatgtgctgaccgggcggtccgctgatctcgaactggagcgcgccgccgacgttaaatgggaggatcaagctgaaatcagcggatctagccctattctttccatcacaatttctgaggacggcagcatgtccatcaagaatgaagaggaggaacagacgctgaccatcctcattagaacagggctgctcgtgatctctggagtctttcccgtgagcattccgatcaccgcggccgcttggtacctgtgggaggttaaaaagcagcgggccggcgtgctttgggatgtcccttctccccctcccgtggaaaaggccgagctggaagacggggcttatcgcattaaacagagaggaatcctgggctacagccaaatcggcgccggggtctataaggagggaacattccacaccatgtggcatgtgacgcggggcgcggttctcatgcaccgcgggaaaagaattgagcccagctgggctgatgtgaagaaagacctgatctcctacggaggcgggtggaaacttgaaggagagtggaaggaaggcgaggaagtccaggtgctggccctcgagcctggcaaaaacccgcgggccgttcagaccaagcccgggatttttaaaacaaataccggaacaatcggcgctgtgagcctggatttctctcctgggacctccggaagccccattgtcgacagaaagggcaaagtggtggggctctacggaaacggcgttgtcacacgctctggcgcctatgtgtccgcgatcgctcagacggaaaagagcatcgaagataatcctgagattgaagacgatatctttcggaagaaaagactgaccattatggaccttcatcccggggccggaaagacaaaacgctacctgcctgccatcgtgcgggaggctattaagagaggcctgcgcaccctcatcctggccccgacccgggtcgtggctgccgaaatggaggaggcgcttagagggctgcccattcgctatcaaacaacggccatcaaaaccgaacacacaggacgggagatcgttgacctcatgtgtcatgctaccttcacaatgagactgctctcccctgtgcgggtccccaactacaacctgattatcatggatgaagcccacttcaccgaccctgcttctattgccgcccgcggctatatcagcacgagagtggagatgggggaggctgcgggcatttttatgacagccacacctcccggatcccgggatcccttcccccagagcaatgctcccatcatggacgaggagcgcgaaatccctgagagatcttggaactccggccacgaatgggttaccgattttaaggggaagacagtgtggttcgtccccagcattaaagccggaaatgacatcgccgcttgccttcggaagaacggcaaaaaggtgattcagctgtctagaaaaacctttgatagcgagtacgttaagacacgcgccaatgactgggatttcgtggtcaccacggacatctccgagatgggggcgaactttaaggctgaacgggtgattgatcctagacgctgtatgaaaccggtgatcctgacagacggagaggaacgggtcatcctcgccggccccatgcctgttacccattctagcgccgctcaaagacgcgggcggattggcagaaatcccaagaacgagaatgaccagtatatctacatgggagaacctctggagaacgatgaggactgcgcccactggaaagaagcgaagatgcttctggataatattaacacacccgagggcatcattccgtccatgttcgaacctgagcgcgaaaaagtggacgccatcgatggggagtacagactccggggagaggctcgcaagacctttgtggacctgatgagacggggcgatctgcccgtctggctcgcctataaagtggctgccgaagggattaattacgctgaccgcaagtggtgtttcgatggaatcaagaacaatcagatccttgaggaaaacatggaggttgagatttggacgaaagaaggcgagagaaagaaactgaagcctcggtggctggacgccagaatctattctgatcccctcgcgctgaaagaatttaaggagttcgccgctgggcgcaagagccttaccctgaacctcattacagaaatgggccggctgcctaccttcatgacacagaaagccagaaatgctctggacaacctcgccgtgcttcataccgccgaggctggaggccgcgcgtacaatcacgccctgtccgagctgcccgaaacactcgagaccctgcttctgctcacgctgctggctacagtcaccgggggaatctttctcttccttatgagcggcaaggggattggaaaaatgaccctgggcatgtgctgcatcatcacagcctctattctgctctggtatgcccaaatccagccgcactggattgctgcctccatcattctggaatttttccttatcgtgctgctcatccctgagcccgaaaagcagcggacaccccaggataaccaactgacatacgttgtgattgcgatcctgacggtcgtggccgctaccatggccaatgagatgggctttctcgagaaaacaaagaaggaccttgggctgggaagcattaccacacaggaatccgagtctaacatcctggacattgatctcagacctgctagcgcctggaccctgtatgcggtcgccacgaccttcgtgacaccgatgcttcggcattccatcgaaaattctagcgttaacgtgtccctgaccgctattgccaatcaggctacagtgctcatgggcctggggaaaggatggcccctgagcaagatggacatcggcgtccctctccttgccatcgggtgttactctcaggttaaccccattaccctgacggctgccctgctcctgcttgtggcgcactacgccatcattggacctggcctgcaagctaaagccacacgcgaggctcagaagagagccgccgcgggcatcatgaaaaatcccaccgtggatgggattacagtcatcgacctcgaacctatcccgtatgatcccaagtttgagaagcagctgggacaggtgatgctgctcattctttgcgttacccaagtgctgatgatgcggaccacatgggctctgtgtgaggccctcacgctggctaccggccctatctccacactttgggaagggaaccccggacgcttctggaataccacaattgccgtcagcatggccaacatctttagaggctcttacctggctggggccggactcctgttctccattatgaaaaataccacgaacacacggcgcggcaccggcaatatcggggagaccctgggagaaaagtggaaaagcagactcaacgcgcttggcaagtctgagtttcagatctataaaaagagcgggattcaggaggtggaccggacactggccaaagaaggaatcaagcgcggcgagaccgatcatcacgctgtctccagagggtctgccaagctgcggtggttcgtggaaagaaacatggttacacctgagggaaaagtggtcgacctcggctgcggccgcgggggatggagctactattgtggcgggctgaagaatgtgcgggaagttaaaggacttacgaagggcgggcccggacatgaggagccgattcctatgtccacctacggctggaacctggtgagactccaaagcggcgtcgatgtgtttttcacaccgcccgaaaaatgcgacaccctgctgtgtgatatcggggagtcctctcctaatcccacaattgaagctggacgcaccctccgggtgcttaacctggttgagaattggctgaacaataacacgcagttctgcatcaaggtcctcaatccttatatgccgagcgtgatcgaaaagatggaggccctgcagagaaaatacggcggggcgcttgtgcgcaaccccctgtccagaaattctacccacgagatgtactgggtcagcaacgccacaggaaatattgtttcctctgtgaacatgatcagcagaatgctcattaatcgctttaccatgaagcacaaaaaggctacatatgaacctgacgtggatctgggctccgggacccggaacatcggaattgagagcgaaatccccaacctggacattatcggcaaaagaatcgagaagattaagcaggaacatgagacatcttggcactacgaccaagatcatccttataaaacctgggcctaccacggctcctatgagacgaagcagacagggagcgcttcttccatggtcaatggagtggttcgcctccttaccaaaccctgggacgtggtcccgatggtgacccagatggccatgacagatacgacccctttcggccagcaacgggtttttaaggaaaaagtggacacaagaacccaggagcccaaggaagggacaaagaaactgatgaagatcaccgctgagtggctgtggaaagagctcggaaagaaaaagacacctcgcatgtgtaccagagaagagttcacgcggaaagtccgcagcaacgccgcgctgggcgccatttttaccgatgaaaataagtggaagtctgctagagaggccgtggaagacgggcggttctgggagcttgtggatagagagcggaacctgcacctcgaaggaaaatgcgagacatgtgtctacaatatgatgggcaagcgcgagaagaagctgggcgagtttgggaaagctaagggatccagagccatctggtatatgtggctgggcgcccggttcctcgaatttgaggcgctggggttccttaacgaggaccattggtttagccgcggaaattccctgagcggcgttgaaggggagggcctccacagactgggatacattcttcgggatgtgggcaagaaagaagggggagctatgtacgccgacgataccgccggctgggacacacgcatcaccctggaggacctcaagaacgaagagatggtgacgaatcatatgaaaggggagcacaagaaactggctgaagccatcttcaagctgacatatcagaacaaggtcgtgagagttcagcggcccacccctcgcggaacagtgatggatattatctctagacgggaccaacgcggcagcgggcaggtcggcacctacggactcaatacgtttaccaacatggaggctcagctgattagacaaatggaaggcgaggggatcttcaaatccattcagcatcttacagccaccgaggaaatcgcggtgcagaattggctggcccgggttggacgcgagagactctctcggatggctatcagcggcgatgactgcgtggtcaagcccattgatgacagattcgcctccgctctgacagcccttaacgatatggggaaaatccgcaaggacattcagcaatgggaaccgtctcggggatggaatgattggacccaggtgcctttttgcagccaccacttccatgagctggttatgaaagacggcagagtgctcgtcgtgccctgtcgcaaccaggatgaactgatcgggcgggcgagaatttcccagggcgccggatggtctctgaaggagacagcttgcctcggcaagagctatgcccaaatgtggaccctgatgtactttcaccgccgggaccttagactggctgccaacgctatctgttccgccgtccccagccattgggtgcctacgtctcgcacaacctggtccattcacgcgaaacacgagtggatgaccacagaagatatgctcgccgtttggaatcgggtgtggatccaggagaacccgtggatggaagacaagacccccgtcgagagctgggaagaggtgccttatctggggaaaagagaggaccagtggtgcggatctcttatcggcctgacatcccgcgctacgtgggccaagaatattcagaccgccatcaaccaagtgcggagcctcattgggaatgaagagtacacagattatatgccctccatgaaaagattccggagagaagaggaagaggctggagttctgtggtga

SEQ ID NO: 19804 - RNA, 9876 nt, synthetic construct
  misc_feature 1..9876: note = derived and/or modified CDS sequence (opt5) from DENV-2__EU482751__SS-prME
  source 1..9876: mol_type = other RNA
accgccggcgtgatcgtcatgctgattcccaccgctatggccttccacctcacgacccggaatggggaacctcatatgatcgttggacggcaggaaaagggcaagagcctgctttttaagaccgaagacggggtgaatatgtgcaccctgatggcgattgatctcggagaactgtgtgaagacacgatcacctacaaatgcccgcttctgcgccaaaatgaacccgaggatattgactgttggtgcaattccacatctacctgggtgacgtatggcacctgtacaaccacaggggagcacagacgggaaaagcgcagcgtcgctctcgtgcctcatgttggaatgggcctggagaccagaacggaaacatggatgtcctctgagggcgcctggaaacacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaagaacaggacaaacgctttatctgcaagcattccatggtggatagaggctggggcaacgggtgtggactgttcggcaaaggcgggattgtcacatgcgccatgtttacgtgcaaaaagaatatggaagggaaagttgtgcagcctgagaacctcgaatacaccatcgtgattacaccccacagcggggaggagcatgcggtcggaaatgacaccggcaagcacggcaaagaaatcaagatcacacctcagtcttccattaccgaggccgaactgacggggtatggaaccgtgacaatggagtgtagcccccggaccggccttgatttcaacgaaatggttctgctccaaatggaggacaaggcttggctggtgcaccgccagtggtttcttgatctgccgctcccttggctgcccggggccgacacacagggatctaattggatccagaaggagaccctggtcacgttcaagaaccctcatgctaaaaagcaagacgtggttgtgctcggctcccaggaaggggccatgcacacagccctgaccggcgctacagagattcagatgagctccggaaatcttctgtttaccggccatctcaaatgcagactgcggatggataaacttcaactgaaagggatgtcttacagcatgtgtaccggaaagttcaagatcgtcaaagaaattgcggagacacagcacggcacgatcgtgatcagagtccagtatgagggggacggatccccctgcaagattcccttcgaaatcaccgatctcgagaaacgccatgtgctgggccggctgattacagttaaccctatcgtgaccgaaaaggacagcccggtcaacattgaggccgaacccccttttggggattcttacatcattatcggcgtggagcccggacagctcaaactgaattggttcaagaagggctccagcatcgggcaaatgtttgagacaaccatgagaggagctaaacgcatggccattcttggcgacacggcctgggatttcgggtctctgggaggcgtttttacaagcatcgggaaggctctccaccaggtgttcggcgccatttacggagcggctttttccggcgtctcttggaccatgaaaatcctgattggggtgatcatcacctggattggaatgaacagccggtccacaagcctgtctgtgtcccttgttctcgtcggcgtggtgaccctgtatctgggggccgtcgtgcaggccgacagcggatgtgttgtgtcttggaagaataaagaactcaagtgcggctccgggatcttcattacagataacgtccacacgtggaccgagcagtacaagtttcaacctgaaagcccctccaaactggcttctgccatccagaaggctcatgaggaaggcatttgtggaatcagaagcgtgacacgccttgagaatctgatgtggaaacagatcaccccggagctcaaccacattctgtccgaaaatgaggttaagctgacaatcatgaccggcgacattaaagggatcatgcaggccggaaagcggtctcttagacctcaacccacggaactcaaatatagctggaagacctggggcaaggcgaaaatgctgtccacagagagccataaccagaccttcctgattgatgggcctgaaacagccgagtgccccaataccaaccgcgcttggaactctctcgaggtggaagactacggatttggcgtcttcacaaccaacatctggctgaaacttcgggagaaacaggacgtgttttgtgattccaagctgatgagcgccgctatcaaagacaatagagccgttcacgcggatatgggctattggattgaatctgccctcaacgacacgtggaagatggagaaggcttccttcatcgaggtgaaaagctgccactggcctaagtctcatacactgtggagcaatggggtcctggaatccgagatgattatccccaaaaacttcgccggaccggtgagccagcacaactaccgccctggctatcatacccaaaccgctgggccctggcaccttggaaagctcgaaatggattttgacttctgtgagggcacaaccgtggtcgttacggaagattgcgggaatcggggaccctctctgagaacaaccacagcctccggcaaactgattaccgagtggtgctgtcggagctgcacactccctccgctgcgctacagaggcgaggacgggtgttggtacggaatggaaatccggccccttaaggagaaggaagagaacctggtgaatagcctcgtgaccgccggccatgggcagattgataacttttctctgggagtcctgggcatggctcttttcctcgaagagatgctgagaacgcgcatcgggaccaaacacgcgatcctgctcgtggccgttagctttgtgacactgattaccggaaatatgtccttccgggaccttggcagagtcatggtgatggttggcgctacaatgaccgatgacatcgggatgggagtgacgtatctggccctcctggccgcttttaaggtccgccctacattcgccgcgggcctgcttctgagaaaactcacctctaaggagctgatgatggctacaattgggatcgccctcctgagccagtccaccattcccgaaaccatccttgagctgacagatgccctcgctctgggaatgatggtgctgaaaatcgttcggaacatggaaaagtaccaacttgccgtgacgattatggcgatctcttgcgtccctaatgctgtgattctgcagaacgcctggaaggtgagctgtaccatcctcgccgctgtctccgttagccccctgctcctgacatcttcccagcagaaagccgactggattcctcttgctctgaccatcaagggcctcaatcccacagccatctttctgaccacgctgagccgcacatctaaaaagagatcctggccgcttaacgaggcgattatggccgtggggatggtgagcatcctggcttcttccctcctgaaaaatgacattcctatgaccggacccctcgtcgccggcggcctgcttaccgtgtgctatgttctgacagggcggagcgctgatctggaactcgagcgcgccgccgacgtgaagtgggaggatcaagctgaaatctccggaagctctcctattctgagcatcaccatttccgaggacggctctatgagcatcaaaaacgaagaggaggaacagacacttacgatcctgattagaaccgggctcctggtcatctccggagtgttccccgtttctattccgatcacagcggccgcttggtacctctgggaggtgaagaagcagcgggccggcgtcctgtgggatgtgccttctccccctcccgtcgaaaaagccgagcttgaagacggggcttatcgcattaagcagagaggaatcctgggctactcccaaatcggcgccggggtgtataaagagggaacctttcacacaatgtggcatgttacccggggcgcggtgctgatgcaccgcgggaagagaattgagccctcctgggctgatgtcaaaaaggacctcatcagctacggaggcgggtggaagctggaaggagagtggaaagaaggcgaggaagtgcaggttcttgccctggagcctggcaagaatccgcgggccgtgcagacgaaacccgggattttcaagaccaacacaggaaccatcggcgctgtctccctcgattttagccctgggacatctggatcccccattgtggacagaaaaggcaaggtggttgggctgtacggaaatggcgtcgtgacccgcagcggcgcctatgtgtctgcgatcgctcagacagagaagtccatcgaagataaccctgagattgaagacgatatcttccggaaaaagagactcacgattatggacctgcatcccggggccggaaaaaccaagcgctaccttcctgccatcgtccgggaggctattaaaagaggcctgcgcacactgatcctcgccccgacccgggtggttgctgccgaaatggaggaggcgctgagagggcttcccattcgctatcaaacccctgccatcaagacagaacacacgggacgggagatcgtggacctgatgtgtcatgctaccttcacaatgagactcctgagccccgtccgggtgcctaactacaatctcattatcatggatgaagcccactttaccgaccccgcttccattgccgcccgcggctatatctctacaagagttgagatgggggaggctgcgggcattttcatgaccgccacgccgcctggaagccgggatccctttccccagtccaacgctcctatcatggacgaagaaagagaaatccccgagagaagctggaactctggccacgaatgggtgacagatttcaaggggaaaaccgtctggtttgtgccttccattaaggccggaaacgacatcgccgcttgcctgcggaaaaatggcaagaaagttattcagcttagcagaaagaccttcgattctgagtacgtgaagacacgcgccaacgactgggattttgtcgtgaccacagacatcagcgagatgggggcgaatttcaaagctgaacgggtgattgatccgagacgctgtatgaagcccgtcatcctgaccgacggagaggaacgggttatcctggccggccctatgcccgtgacgcattcctctgccgctcaaagacgcgggcggattggcagaaaccctaaaaatgagaacgaccagtatatctacatgggagaacccctcgagaatgatgaggactgcgcccactggaaggaagcgaaaatgctgcttgataacattaatacaccggagggcatcattcctagcatgtttgaacccgagcgcgaaaaggtggacgccatcgatggggagtacagactgcggggagaggctcgcaaaaccttcgtcgacctcatgagacggggcgatctgcctgtgtggctggcctataaggttgctgccgaagggattaactacgctgaccgcaagtggtgttttgatggaatcaaaaataaccagatcctcgaggaaaacatggaggtggagatttggacaaaggaaggcgagcgcaagaaacttaaaccccggtggctggacgccagaatctattccgatcctctggcgctcaaggagttcaaggagttcgccgctgggcgcaaatctctgacccttaatctgattacggaaatgggccggctccccacctttatgacacagaaggccagaaacgctctggacaatctggccgtcctccataccgccgaggctggaggccgcgcgtacaaccacgcccttagcgagctgccggaaacactggagaccctcctgcttctgacactcctggctaccgtgacagggggaatcttcctgtttctcatgtccggcaaagggattggaaagatgacacttggcatgtgctgcatcatcaccgccagcattctgctgtggtatgcccaaatccagcctcactggattgctgcctctatcattctcgagttctttctgatcgttcttctgatccccgagcccgaaaaacagcggacccctcaggataatcaactcacatacgtggtcattgcgatcctgaccgtggtcgccgctacaatggccaacgagatgggcttcctggagaagacgaagaaagacctcgggcttggatccattaccacacaggaaagcgagtccaatatcctggacattgatctgagaccggcttctgcctggaccctctatgcggtggccacaacctttgttacgcccatgctgcggcatagcatcgaaaactcctctgtgaatgtgagccttaccgctattgccaaccaggctacagtcctgatgggcctcgggaagggatggcctctgtccaaaatggacatcggcgttcccctgctcgccatcgggtgttacagccaggtgaatcctattacccttacagctgccctgctgctcctggtggcgcactacgccatcattggacccggccttcaagctaaggccacccgcgaggctcagaaaagagccgccgcgggcatcatgaagaaccctacggtcgatgggattacagtgatcgacctggaaccgatcccctatgatcctaagttcgagaaacagctcggacaggttatgctgctgattctctgcgtgacccaagtccttatgatgcggacaacctgggctctgtgtgaggccctgaccctcgctacaggccccatctctacgctgtgggaagggaatcctggacgcttttggaacaccacaattgccgtgtccatggccaatatcttcagaggcagctaccttgctggggccggactgctcttttctattatgaagaacaccacatccacccggcgcggcacgggcaatatcggggagacactgggagaaaaatggaaaagcagactgaacgcgctcggcaaatctgagttccagatctataagaaaagcgggattcaggaggtcgaccggacccttgccaaggaaggaatcaagcgcggcgagaccgatcatcacgctgtgtccagagggtctgccaaactgcggtggtttgttgaaagaaacatggtgacacccgagggaaaggtcgtggacctgggctgcggccgcgggggatggagctactattgtggcgggctcaaaaatgttcgggaagtgaagggactgaccaaaggcgggccgggacatgaggagcctattcccatgtccacatacggctggaaccttgtcagactgcaaagcggcgtggatgtgttcttcacgccccctgaaaagtgcgacaccctcctgtgtgatatcggggagtcctctcccaatcctacaattgaagctggacgcaccctgcgggttctcaaccttgtcgagaattggctgaacaataacacacagttttgcatcaaggtgctgaatccgtatatgcccagcgtgatcgagaagatggaggccctccagagacagtacggcggggcgctggtccgcaaccctctttccagaaattctacccacgagatgtactgggttagcaacgccacgggaaatattgtgtcctctgtgaacatgatcagcagaatgctgattaatcgcttcaccatgaagcacaaaaaggctacatatgaacccgacgtcgatctcggctccgggacccggaacatcggaattgagagcgaaatccctaacctggacattatcggcaaaagaatcgagaagattaagcaagaacatgagatctcttggcactacgaccaggatcatccctataaaacatgggcctaccacggctcctatgagaccaagcagacagggagcgcttcttccatggtgaatggagttgtgcgcctgctcaccaaaccgtgggacgtcgtgcctatggttacgcagatggccatgacagataccaccccctttggccaacagcgggtgttcaaggaaaaagtcgacacaagaacgcaggagcctaaggaagggaccaagaaacttatgaagattacagctgagtggctgtggaaagagctgggaaagaaaaagacaccccgcatgtgtacaagagaagagtttacccggaaagtgcgcagcaacgccgcgctcggcgccatcttcacagatgaaaataagtggaagtctgctagagaggccgtggaagacgggcggttttgggagctggtcgatagagagcggaaccttcacctggaaggaaaatgcgagacctgtgtttacaatatgatgggcaagcgcgagaagaagctcggcgagttcgggaaagctaagggatccagagccatttggtatatgtggctgggcgcccggtttctggagttcgaggcgctcgggtttctgaacgaggaccattggttcagccgcggaaattcccttagcggcgtggaaggggagggcctgcacagactcggatacatcctgcgggatgtgggcaagaaagaagggggagctatgtacgccgacgatacggccggctgggacacccgcatcacacttgaggacctgaagaacgaagagatggtcaccaatcatatgaaaggggagcacaagaaactcgctgaagccatttttaagctgacatatcagaacaaggtggttagagtgcaacggcctacaccccgcggaacggtcatggatatcatttctagacgggaccagcgcggcagcggacaggtgggcacatacggactgaataccttcacaaacatggaggctcaactcatcagacagatggaaggcgaggggattttcaaatccatccagcatctgaccgccacggaggaaatcgcggttcagaattggcttgcccgggtgggacgcgagagactgtctcggatggctattagcggcgatgactgcgtcgtgaagccgatcgatgacagatttgcctccgctctcaccgccctgaacgatatggggaaagttcgcaaggacattcaacagtgggaaccttctcggggatggaatgattggacacaggtgcccttctgcagccaccactttcatgagcttgtcatgaaagacggcagagtgctggtcgtgccctgtcgcaaccaggatgaactcatcgggcgggcgagaatttcccaaggcgccggatggtctctgaaggagaccgcttgcctgggcaagagctatgcccagatgtggacactcatgtacttccaccgccgggacctgagacttgctgccaacgctatctgttccgccgttcctagccattgggtgccgacctctcgcacaacctggtccattcacgcgaaacacgagtggatgacgacagaagatatgctggccgtctggaatcgggtgtggatccaggagaacccctggatggaagacaagacccctgtggagagctgggaagaggttccctatctcgggaaaagagaggaccagtggtgcggatctctgatcggccttacctcccgcgctacatgggccaagaatattcaagccgctatcaaccaggtgcggagcctgattgggaatgaagagtacaccgattatatgccttccatgaaaagatttcggagagaagaggaagaggccggagtcctctggtga

SEQ ID NO: 19805 - RNA, 9876 nt, synthetic construct
  misc_feature 1..9876: note = derived and/or modified CDS sequence (opt5) from DENV-2__GQ868604__SS-prME
  source 1..9876: mol_type = other RNA
acagccggcgtgatcgtcatgctgattcccacagctatggccttccacctcacgaccagaaacggggagcctcatatgatcgttggacggcaggaaaagggcaaaagcctgctttttaagacagaggacggggtgaatatgtgcaccctgatggcgattgatctcggagaactgtgtgaggacacaatcacctacaaatgcccgcttctgagacaaaacgaacccgaggatattgactgttggtgcaattccacatctacctgggtgacgtatggcacctgtacaaccacaggggagcacagacgggaaaagagaagcgtcgctctcgtgcctcatgttggaatgggcctggagaccagaacggaaacatggatgtcctctgagggcgcctggaaacacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaagaacaggacaaacgctttatctgcaagcattccatggtggatagaggctggggcaacgggtgtggactgttcggcaaaggcgggattgtcacatgcgccatgtttacgtgcaaaaagaatatggaagggaaagttgtgcagcctgagaacctcgaatacaccatcgtgattacaccccacagcggggaggagcatgcggtcggaaatgacaccggcaagcacggcaaagaaatcaagatcacacctcagtcttccattaccgaggccgaactgacggggtatggaaccgtgacaatggagtgtagcccccggaccggccttgatttcaacgaaatggttctgctccaaatggaggacaaggcttggctggtgcaccgccagtggtttcttgatctgccgctcccttggctgcccggggccgacacacagggatctaattggatccagaaggagaccctggtcacgttcaagaaccctcatgctaaaaagcaagacgtggttgtgctcggctcccaggaaggggccatgcacacagccctgaccggcgctacagagattcagatgagctccggaaatcttctgtttaccggccatctcaaatgcagactgcggatggataaacttcaactgaaagggatgtcttacagcatgtgtaccggaaagttcaagatcgtcaaagaaattgcggagacacagcacggcacgatcgtgatcagagtccagtatgagggggacggatccccctgcaagattcccttcgaaatcaccgatctcgagaaacgccatgtgctgggccggctgattacagttaaccctatcgtgaccgaaaaggacagcccggtcaacattgaggccgaacccccttttggggattcttacatcattatcggcgtggagcccggacagctcaaactgaattggttcaagaagggctccagcatcgggcaaatgtttgagacaaccatgagaggagctaaacgcatggccattcttggcgacacggcctgggatttcgggtctctgggaggcgtttttacaagcatcgggaaggctctccaccaggtgttcggcgccatttacggagcggctttttccggcgtctcttggaccatgaaaatcctgattggggtgatcatcacctggattggaatgaacagccggtccacaagcctgtctgtgtcccttgttctcgtcggcgtggtgaccctgtatctgggggccgtcgtgcaggccgacagcggatgtgttgtgtcttggaagaataaagaactcaagtgcggctccgggatcttcattacagataacgtccacacgtggaccgagcagtacaagtttcaacctgaaagcccctccaaactggcttctgccatccagaaggctcatgaggaaggcatttgtggaatcagaagcgtgacacgccttgagaatctgatgtggaaacagatcaccccggagctcaaccacattctgtccgaaaatgaggttaagctgacaatcatgaccggcgacattaaagggatcatgcaggccggaaagcggtctcttagacctcaacccacggaactcaaatatagctggaagacctggggcaaggcgaaaatgctgtccacagagagccataaccagaccttcctgattgatgggcctgaaacagccgagtgccccaataccaaccgcgcttggaactctctcgaggtggaagactacggatttggcgtcttcacaaccaacatctggctgaaacttcgggagaaacaggacgtgttttgtgattccaagctgatgagcgccgctatcaaagacaatagagccgttcacgcggatatgggctattggattgaatctgccctcaacgacacgtggaagatggagaaggcttccttcatcgaggtgaaaagctgccactggcctaagtctcatacactgtggagcaatggggtcctggaatccgagatgattatccccaaaaacttcgccggaccggtgagccagcacaactaccgccctggctatcatacccaaaccgctgggccctggcaccttggaaagctcgaaatggattttgacctgtgtgagggcacaaccgtggtcgttacggaagattgcgggaatcggggaccctctctgagaacaaccacagcctccggcaaactcattaccgagtggtgctgtcggagctgcacactgcctccgcttcgctacagaggcgaggacgggtgttggtacggaatggaaatccggcccctgaaggagaaggaagagaacctcgtgaatagcctggtgaccgccggcagagggcagattgataacttctctctgggagtccttggcatggctctctttctggaagagatgctgcgcacgcggatcgggaccaaacatgcgatcctcctggtggccgttagcttcgtgacacttattaccggaaatatgtcctttagagacctgggccgcgtcatggtgatggttggcgctacaatgaccgatgacatcgggatgggagtgacgtatctcgccctgctggccgctttcaaggtcagacctacatttgccgcgggccttctgctccggaaactgacctctaaggagctcatgatggctacaattgggatcgccctgcttagccagtccaccattcccgaaaacatcctggagctcaccgatgccctggctctgggaatgatggtgcttaaaatcgttcgcaatatggaaaagtaccaactggccgtgacaattatggcgatctcttgcgtccctaacgctgtgattctccagaatgcctggaaggtgagctgtacgatcctggccgctgtctccgttagccccctcctgcttacctcttcccagcagaaagccgactggattcctctggctctcacaatcaagggcctgaaccccaccgccatcttcctgacaacccttagcagaacgtctaaaaagcggtcctggccgctgaatgaggcgattatggccgtggggatggtgagcatcctcgcttcttccctgctcaaaaacgacattcctatgacaggacccctggtcgccggcggccttctgaccgtgtgctatgttctgaccgggcgcagcgctgatctcgaactggagagagccgccgacgtgaagtgggaggatcaagctgaaatctccggaagctctcctattcttagcatcacaatttccgaggacggctctatgagcatcaaaaatgaagaggaggaacagaccctgacaatcctcattcggacggggctgctcgtcatctccggagtgtttcccgtttctattccgatcaccgcggccgcttggtacctgtgggaggtgaagaagcagcgcgccggcgtcctttgggatgtgccttctccccctcccgtcgaaaaagccgagctggaagacggggcttatagaattaagcagcggggaatcctgggctactcccaaatcggcgccggggtgtataaagagggaacattccacaccatgtggcacgttacacgcggcgcggtgctcatgcatagagggaagcggattgagccctcctgggctgatgtcaaaaaggacctgatcagctacggaggcgggtggaaacttgaaggagagtggaaagaaggcgaggaagtgcaggttctggccctcgagcctggcaagaacccgagagccgtgcagaccaaacccgggatttttaagacgaataccggaacaatcggcgctgtctccctggatttcagccctgggacctctggatcccccattgtggaccgcaaaggcaaggtggttgggctctacggaaacggcgtcgtgacacggagcggcgcctatgtgtctgcgatcgctcagaccgagaagtccatcgaagataaccctgagattgaagacgatatctttcgcaagaagcgcctgacaattatggaccttcaccccggggccggaaaaacgaagcggtacctgcctgccatcgtcagagaggctattaaacgcggcctgcggaccctcatcctggccccgacaagagtggttgctgccgaaatggaggaggcgcttcgcgggctgcccattcggtatcaaacccctgccatcaagaccgaacatacaggaagagagatcgtggacctcatgtgtcacgctacgttcaccatgcggctgctcagccccgtccgcgtgcctaattacaacctgattatcatggatgaagcccatttcacagaccccgcttccattgccgccagaggctatatctctacccgggttgagatgggggaggctgcgggcatttttatgacagccaccccgcctggaagccgcgatcccttcccccagtccaatgctcctatcatggacgaagagagagaaatccccgagcggagctggaactctggccacgaatgggtgacggattttaaggggaaaacagtctggttcgtgccttccattaaggccggaaatgacatcgccgcttgccttcgcaagaatggcaagaaagttattcagctgagccgcaagacctttgattctgagtacgtgaagacccgggccaatgactgggatttcgtcgtgacaaccgacatcagcgagatgggggcgaactttaaagctgaaagagtgattgatccgcgccggtgtatgaagcccgtcatcctgacagacggagaggaaagagttatcctcgccggccctatgcccgtgacccactcctctgccgctcaacgccgggggagaattggccgcaatcctaaaaacgagaatgaccagtatatctacatgggagaacccctggagaacgatgaggactgcgcccattggaaggaagcgaaaatgcttctggataatattaacacgccggagggcatcattcctagcatgttcgaacccgagagagaaaaggtggacgccatcgatggggagtaccggctccgcggagaggctagaaaaacatttgtcgacctgatgcggcgcggcgatctgcctgtgtggctcgcctataaggttgctgccgaagggattaattacgctgacagaaagtggtgtttcgatggaatcaaaaacaaccagatccttgaggaaaatatggaggtggagatttggaccaaggaaggcgagcggaaaaagctgaaacccagatggctggacgcccgcatctattccgatcctctcgcgctgaaggaatttaaggagttcgccgctgggcggaaatctcttacactgaacctcattaccgaaatgggcagactgcccacgttcatgacccagaaggcccgcaatgctctggacaacctcgccgtccttcacacagccgaggctggaggccgggcgtacaatcatgccctgagcgagctgccggaaaccctcgagacactgcttctgctcaccctgctggctacagtgaccgggggaatctttctcttccttatgtccggcaaagggattggaaagatgacgctgggcatgtgctgcatcatcacagccagcattctgctctggtatgcccaaatccagcctcactggattgctgcctctatcattctggaatttttccttatcgttctgctcatccccgagcccgaaaaacagagaacccctcaggataaccaactgacctacgtggtcattgcgatcctgacagtggtcgccgctaccatggccaatgagatgggctttctcgagaagacaaagaaagaccttgggctgggatccattacgacccaggaaagcgagtccaacatcctggacattgatctccggccggcttctgcctggacactgtatgcggtggccaccacattcgttacccccatgcttcgccacagcatcgaaaattcctctgtgaacgtgagcctgacggctattgccaatcaggctaccgtcctcatgggcctggggaagggatggcctctgtccaaaatggacatcggcgttcccctccttgccatcgggtgttacagccaggtgaaccctattacactgaccgctgccctgctcctgcttgtggcgcattacgccatcattggacccggcctgcaagctaaggccacaagagaggctcagaaacgggccgccgcgggcatcatgaagaatcctaccgtcgatgggattacggtgatcgacctcgaaccgatcccctatgatcctaagtttgagaaacagctgggacaggttatgctgctcattctttgcgtgacacaagtcctgatgatgcgcaccacatgggctctgtgtgaggccctcaccctggctaccggccccatctctacactttgggaagggaaccctggaagattctggaatacgaccattgccgtgtccatggccaacatctttcggggcagctacctggctggggccggactcctgttctctattatgaagaatacaacctccacacgcagaggcaccggcaacatcggggagacgctgggagaaaaatggaaaagccggctcaacgcgcttggcaaatctgagtttcagatctataagaaaagcgggattcaggaggtcgaccgcacactggccaaggaaggaatcaagagaggcgagaccgatcaccatgctgtgtcccgggggtctgccaaactgagatggttcgttgaacgcaatatggtgacccccgagggaaaggtcgtggacctcggctgcggcagagggggatggagctactattgtggcgggctgaaaaacgttcgggaagtgaagggacttacaaaaggcgggccgggacacgaggagcctattcccatgtccacctacggctggaatctggtccgcctccaaagcggcgtggatgtgtttttcacaccccctgaaaagtgcgacacgctgctgtgtgatatcggggagtcctctcccaaccctaccattgaagctggacggacactcagagttcttaatctggtcgagaactggctgaataacaatacccagttctgcatcaaggtgctcaacccgtatatgcccagcgtgatcgagaagatggaggccctgcagcgccagtacggcggggcgcttgtccggaatcctctgtccagaaactctacacatgagatgtactgggttagcaatgccaccggaaacattgtgtcctctgtgaatatgatcagccgcatgctcattaaccggtttacgatgaagcacaaaaaggctacctatgaacccgacgtcgatctgggctccgggacaagaaacatcggaattgagagcgaaatccctaatctggacattatcggcaaacgcatcgagaagattaagcaagaacacgagatctcttggcattacgaccaggatcacccctataaaacctgggcctaccatggctcctatgagacaaagcagaccgggagcgcttcttccatggtgaacggagttgtgcggctccttacaaaaccgtgggacgtcgtgcctatggttacccagatggccatgacggatacaacccccttcggccaacagagagtgtttaaggaaaaagtcgacacccgcacacaggagcctaaggaagggacgaagaaactgatgaagattaccgctgagtggctgtggaaagagctcggaaagaaaaagacacccagaatgtgtacccgggaagagttcaccaagaaggtgcgcagcaatgccgcgctgggcgccatctttaccgatgaaaacaagtggaaatctgctagagaggccgtggaagacgggcggttctgggagcttgtcgatagagagcggaatctgcacctcgaaggaaagtgcgagacatgtgtttacaacatgatgggcaaacgcgaaaagaaactgggcgagtttgggaaggctaagggatccagagccatttggtatatgtggctgggcgcccggttcctcgaatttgaggcgctggggttccttaatgaggaccactggtttagccgcggaaactccctgagcggcgtggaaggggagggcctccatagactgggatacatccttcgggatgtgggcaaaaaggaagggggagctatgtacgccgacgataccgccggctgggacacgcgcatcaccctggaggacctcaaaaatgaagagatggtcacaaaccacatgaagggggagcataaaaagctggctgaagccattttcaagctgacctatcagaataaagtggttagagtgcaacggcctacaccccgcggaaccgtcatggatatcatttctagacgggaccagcgcggcagcggacaggtgggcacgtacggactcaacacatttaccaatatggaggctcaactgatcagacagatggaaggcgaggggattttcaagtccatccagcaccttacagccaccgaggaaatcgcggttcagaactggctggcccgggtgggacgcgagagactctctcggatggctattagcggcgatgactgcgtcgtgaaaccgatcgatgacagattcgcctccgctctgacggcccttaatgatatggggaaggttcgcaaagacattcaacagtgggaaccttctcggggatggaacgattggacccaggtgcccttttgcagccatcacttccacgagctggtcatgaaggacggcagagtgctcgtcgtgccctgtcgcaaccaggatgaactgatcgggcgggcgagaatttcccaaggcgccggatggtctctgaaggagacagcttgcctcggcaaaagctatgcccagatgtggaccctgatgtactttcatcgccgggaccttagactggctgccaatgctatctgttccgccgttcctagccactgggtgccgacatctcgcaccacatggtccattcatgcgaagcacgagtggatgaccacggaagatatgctcgccgtctggaaccgggtgtggatccaggagaatccctggatggaagacaaaacacctgtggagagctgggaagaggttccctatctggggaagagagaggaccagtggtgcggatctcttatcggcctgacctcccgcgctacctgggccaaaaacattcaaacagccatcaatcaggtgcggagcctcattgggaacgaagagtacaccgattatatgccttccatgaagagattccggagagaagaggaagaggctggagtcctgtggtga

SEQ ID NO: 19806 - RNA, 9876 nt, synthetic construct
  misc_feature 1..9876: note = derived and/or modified CDS sequence (opt5) from DENV-2__EU482752__SS-prME
  source 1..9876: mol_type = other RNA
accgccggcgtgatcgtcatgctgattcccaccgctatggccttccacctcacgaccagaaatggggaacctcatatgatcgttggacggcaggaaaagggcaagagcctgctttttaagacggaggacggggtgaatatgtgcaccctgatggcgattgatctcggagaactgtgtgaggacacaatcacctacaagtgcccccttctgcgccaaaacgaacccgaggatattgactgttggtgcaatagcacatctacctgggtgacgtatggcacctgtacaaccacaggggagcacagacgggaaaagcgcagcgtcgctctcgtgcctcatgttggaatgggcctggagaccagaacggaaacatggatgtcctctgagggcgcctggaaacacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaggaacaggacaaacgctttatctgcaagcattccatggtggatagaggctggggcaacgggtgtggactgttcggcaaagggggaattgtcacatgcgccatgtttacgtgcaaaaagaatatggaaggcaaagttgtgcagcctgagaacctcgaatacaccatcgtgattacaccccacagcggggaggagcatgcggtcggaaatgacaccggcaagcacggcaaagaaatcaagatcacacctcagtcttccattaccgaggccgaactgacggggtatggaaccgtgacaatggagtgtagcccccggaccggccttgatttcaacgaaatggttctgctccaaatggaggacaaggcttggctggtgcaccgccagtggtttcttgatctgccgctcccttggctgcccggggccgacacacagggatctaattggatccagaaggagaccctggtcacgttcaagaaccctcatgctaaaaagcaagacgtggttgtgctcggctcccaggaaggggccatgcacacagccctgaccggcgctacagagattcagatgagctccggaaatcttctgtttaccggccatctcaaatgcagactgcggatggataaacttcaactgaaagggatgtcttacagcatgtgtaccggaaagttcaagatcgtcaaagaaattgcggagacacagcacggcacgatcgtgatcagagtccagtatgagggggacggatccccctgcaagattcccttcgaaatcaccgatctcgagaaacgccatgtgctgggccggctgattacagttaaccctatcgtgaccgaaaaggacagcccggtcaacattgaggccgaacccccttttggggattcttacatcattatcggcgtggagcccggacagctcaaactgaattggttcaagaagggctccagcatcgggcaaatgtttgagacaaccatgagaggagctaaacgcatggccattcttggcgacacggcctgggatttcgggtctctgggaggcgtttttacaagcatcgggaaggctctccaccaggtgttcggcgccatttacggagcggctttttccggcgtctcttggaccatgaaaatcctgattggggtgatcatcacctggattggaatgaacagccggtccacaagcctgtctgtgtcccttgttctcgtcggcgtggtgaccctgtatctgggggccatggtccaggccgacagcggatgtgtggtttcttggaagaataaagaactcaagtgcggctccgggatcttcattacagataacgtgcacacgtggaccgagcagtacaagtttcaacctgaaagcccctccaaactggcttctgccatccagaaggctcatgaggaaggcatttgtggaatcagaagcgtcacacgccttgagaatctgatgtggaaacagatcaccccggagctcaaccacattctgtccgaaaatgaggtgaagctgacaatcatgaccggcgacattcgggggatcatgcaggccggaaaaagatctcttcgccctcaacccacggaactcaagtatagctggaaaacctggggcaaggcgaagatgctgtccacagagagccataaccagaccttcctgattgatgggcctgaaacagccgagtgccccaataccaaccgggcttggaactctctcgaggttgaagactacggatttggcgtgttcacaaccaacatctggctgaaacttagagagaagcaggacgtcttttgtgattccaaactgatgagcgccgctatcaaggacaatcgcgccgtgcacgcggatatgggctattggattgaatctgccctcaacgacacgtggaaaatggagaaggcttccttcatcgaggttaagagctgccactggcctaaatctcatacactgtggagcaatggggtgctggaatccgagatgattatccccaagaacttcgccggaccggtcagccagcacaactaccggcctggctatcatacccaaaccgctgggccctggcaccttggaaaactcgaaatggattttgacctgtgtgagggcacaaccgtggtggtcacggaagattgcgggaatagaggaccctctctgcggacaaccacagcctccggcaagctcattaccgagtggtgctgtcgcagctgcacactgcctccgcttagataccggggcgaggacgggtgttggtacggaatggaaatcagacccctgaaagagaaggaagagaacctcgttaattccctggtgaccgccggccatgggcagattgataacttctctctgggagtgcttggcatggctctctttctggaagagatgctgcgcacgcggatcgggaccaagcacgcgatcctcctggtcgccgtgagcttcgttacacttattaccggaaatatgtcctttagagacctgggccgcgtgatggtcatggtgggcgctacaatgaccgatgacatcgggatgggagttacgtatctcgccctgctggccgctttcaaagtgagacctacatttgccgcgggccttctgctccggaagctgacctctaaagagctcatgatggctacaattgggatcgccctgcttagccagtccaccattcccgaaaacatcctggagctcaccgatgccctggctctgggaatgatggtccttaagatcgtgcgcaatatggaaaaataccaactggccgttacaattatggcgatctcttgcgtgcctaacgctgtcattctccagaatgcctggaaggtgagctgtacgatcctggccgctgtgtccgtcagccccctcctgcttacctcttcccagcagaaggccgactggattcctctggctctcacaatcaaaggcctgaaccccaccgccatcttcctgacaacccttagcagaacgtctaagaaacggtcctggccgctgaatgaggcgattatggccgttgggatggtgagcatcctcgcttcttccctgctcaagaacgacattcctatgacaggacccctggtggccggcggccttctgaccgtctgctatgtgctgaccgggcgcagcgctgatctcgaactggagagagccgccgacgttaaatgggaggatcaagctgaaatctccggaagctctcctattcttagcatcacaatttccgaggacggctctatgagcatcaagaatgaagaggaggaacagaccctgacaatcctcattcggacggggctgctcgtgatctccggagtctttcccgtgtctattccgatcaccgcggccgcttggtacctgtgggaggttaaaaagcagcgcgccggcgtgctttgggatgtcccttctccccctcccgtggaaaaggccgagctggaagacggggcttatagaattaaacagcggggaatcctgggctactcccaaatcggcgccggggtctataaggagggaacattccacaccatgtggcatgtgacacgcggcgcggttctcatgcacagagggaaacggattgagccctcctgggctgatgtgaagaaagacctgatcagctacggaggcgggtggaaacttgaaggagagtggaaggaaggcgaggaagtccaggtgctggccctcgagcctggcaaaaacccgagagccgttcagaccaagcccgggatttttaaaacgaataccggaacaatcggcgctgtgtccctggatttcagccctgggacctctggatcccccattgtcgaccgcaagggcaaagtggtggggctctacggaaacggcgttgtcacacggagcggcgcctatgtgtctgcgatcgctcagaccgagaagtccatcgaagataaccctgagattgaagacgatatctttagaaagaaacgcctgacaattatggaccttcatcccggggccggaaagacgaaacggtacctgcctgccatcgtgagagaggctattaagcgcggcctgcggaccctcatcctggccccgacaagagtcgtggctgccgaaatggaggaggcgcttcgcgggctgcccattcggtatcaaaccaccgccatcaaaacagaacacacgggaagagagatcgttgacctcatgtgtcatgctaccttcacaatgcggctgctcagccctgtgcgcgtccccaattacaacctgattatcatggatgaagcccacttcaccgaccctgcttccattgccgccagaggctatatctctacacgggtggagatgggggaggctgcgggcatttttatgaccgccacgcccccgggaagccgcgatcctttcccccagtccaatgctcccatcatggacgaagagagagaaatccctgagcggagctggaactctggccacgaatgggttacagattttaaggggaagaccgtgtggttcgtcccctccattaaagccggaaatgacatcgccgcttgccttagaaagaacggcaaaaaggtgattcagctgagccgcaaaacctttgattctgagtacgttaagacacgggccaatgactgggatttcgtggtcaccacagacatcagcgagatgggggcgaactttaaggctgaaagagtgattgatcctcgccggtgtatgaaaccggtgatcctgaccgacggagaggaaagagtcatcctcgccggccccatgcctgttacgcattcctctgccgctcaacgccgggggagaattggccgcaatcccaagaacgagaatgaccagtatatctacatgggagaacctctggagaacgatgaggactgcgcccactggaaagaagcgaagatgcttctggataatattaacacacccgagggcatcattccgagcatgttcgaacctgagagagaaaaagtggacgccatcgatggggagtaccggctccgcggagaggctagaaagacctttgtggacctgatgcggcgcggcgatctgcccgtctggctcgcctataaagtggctgccgaagggattaattacgctgacagaaagtggtgtttcgatggaatcaagaacaaccagatccttgaggaaaatatggaggttgagatttggacaaaagaaggcgagcggaagaaactgaagcctagatggctggacgcccgcatctattccgatcccctcgcgctgaaagaatttaaggagttcgccgctgggcggaagtctcttaccctgaacctcattacggaaatgggcagactgcctaccttcatgacacagaaagcccgcaatgctctggacaacctcgccgtgcttcataccgccgaggctggaggccgggcgtacaatcacgccctgagcgagctgcccgaaacactcgagaccctgcttctgctcacactgctggctaccgtcacagggggaatctttctcttccttatgtccggcaaggggattggaaaaatgacactgggcatgtgctgcatcatcaccgccagcattctgctctggtatgcccaaatccagccgcactggattgctgcctctatcattctggaatttttccttatcgtgctgctcatccctgagcccgaaaagcagagaacaccccaggataaccaactgacatacgttgtgattgcgatcctgaccgtcgtggccgctacaatggccaatgagatgggctttctcgagaaaacgaagaaggaccttgggctgggatccattaccacacaggaaagcgagtccaacatcctggacattgatctccggcctgcttctgcctggaccctgtatgcggtcgccacaaccttcgtgacgccgatgcttcgccatagcatcgaaaattcctctgttaacgtgagcctgaccgctattgccaatcaggctacagtgctcatgggcctggggaaaggatggcccctgtccaagatggacatcggcgtccctctccttgccatcgggtgttacagccaggttaaccccattaccctgacagctgccctgctcctgcttgtggcgcactacgccatcattggacctggcctgcaagctaaagccaccagagaggctcagaagcgggccgccgcgggcatcatgaaaaatcccacggtggatgggattacagtcatcgacctcgaacctatcccgtatgatcccaagtttgagaagcagctgggacaggtgatgctgctcattctttgcgttacccaagtgctgatgatgcgcacaacctgggctctgtgtgaggccctcaccctggctacaggccctatctctacgctttgggaagggaaccccggaagattctggaataccacaattgccgtctccatggccaacatctttcggggcagctacctggctggggccggactcctgttctctattatgaaaaataccacaaacacccgcagaggcacgggcaacatcggggagacactgggagaaaagtggaaatcccggctcaatgcgcttggcaagagcgagtttcagatctataaaaagtctgggattcaggaggtggaccgcaccctggccaaagaaggaatcaagagaggcgagaccgatcatcacgctgtcagccgggggtccgccaagctgagatggttcgtggaacgcaacatggttacacctgagggaaaagtggtcgacctcggctgcggcagagggggatggtcttactattgtggcgggctgaagaatgtgcgggaagttaaaggacttaccaagggcgggcccggacatgaggagccgattcctatgagcacatacggctggaacctggtgcgcctccaatccggcgtcgatgtgtttttcacgccgcccgaaaaatgcgacaccctgctgtgtgatatcggggagagctcccctaatcccacaattgaagctggacggaccctcagagtgcttaacctggttgagaattggctgaacaataacacacagttctgcatcaaggtcctcaatccttatatgccgtctgtgatcgaaaagatggaggccctgcagcgcaaatacggcggggcgcttgtgcggaaccccctgagcagaaattccacccacgagatgtactgggtctctaacgccacgggaaatattgttagctccgtgaacatgatctctcgcatgctcattaaccggtttaccatgaagcacaaaaaggctacatatgaacctgacgtggatctgggcagcgggaccagaaatatcggaattgagtccgaaatccccaacctggacattatcggcaaacgcatcgagaagattaagcaggaacatgagacaagctggcactacgaccaagatcatccttataaaacctgggcctaccacggctcttatgagacaaagcagaccgggtccgctagctctatggtcaatggagtggttcggctccttacgaaaccctgggacgtggtcccgatggtgacacagatggccatgaccgataccacacctttcggccagcaaagagtttttaaggaaaaagtggacacgcgcacccaggagcccaaggaagggacaaagaaactgatgaagatcaccgctgagtggctgtggaaagagctcggaaagaaaaagacacctagaatgtgtacccgggaagagttcacacgcaaagtcagatccaacgccgcgctgggcgccatttttaccgatgaaaataagtggaaaagcgctcgggaggccgtggaagacgggagattctgggagcttgtggatcgggagcgcaacctgcacctcgaaggaaaatgcgagacgtgtgtctacaatatgatgggcaagagagagaagaagctgggcgagtttgggaaagctaagggatctcgggccatctggtatatgtggctgggcgcccgcttcctcgaatttgaggcgctggggttccttaacgaggaccattggttttccagaggaaatagcctgtccggcgttgaaggggagggcctccaccggctgggatacattcttcgcgatgtgggcaagaaagaagggggagctatgtacgccgacgataccgccggctgggacacaagaatcaccctggaggacctcaagaacgaagagatggtgacaaatcatatgaaaggggagcacaagaaactggctgaagccatcttcaagctgacctatcagaacaaggtcgtgcgggttcagcgccccacgcctagaggaacagtgatggatattatcagccggcgcgaccaaagaggctctgggcaggtcggcacctacggactcaatacatttaccaacatggaggctcagctgattcggcaaatggaaggcgaggggatcttcaaaagcattcagcatcttacggccaccgaggaaatcgcggtgcagaattggctggcccgcgttggaagagagcggctctccagaatggctatctctggcgatgactgcgtggtcaagcccattgatgaccgcttcgccagcgctctgacagcccttaacgatatggggaaagtgcggaaggacatccagcaatgggaaccgtccagaggatggaacgattggacccaggttcctttttgctctcaccacttccatgagctggtgatgaaagacggccgcgtcctcgtggtcccctgtcggaatcaggatgaactgattgggagagcgcgcatcagccagggcgccggatggtccctgaaggagacagcttgcctcggcaagtcttatgcccaaatgtggaccctgatgtactttcaccggagagaccttcgcctggctgccaacgctatttgtagcgccgtgccctcccattgggttcctacaagccggaccacgtggtctatccacgcgaaacacgagtggatgacaaccgaagatatgctcgccgtgtggaatagagtctggattcaggagaacccgtggatggaagacaagacccccgtggagtcctgggaagaggtgccttatctggggaaacgcgaggaccagtggtgcggaagccttatcggcctgacatctcgggctacctgggccaagaatatccagacagccattaaccaagttagatccctcatcgggaatgaagagtacacggattatatgcccagcatgaaacggttcagacgcgaagaggaagaggctggagtgctgtggtga

SEQ ID NO: 19807 - RNA, 9876 nt, synthetic construct
  misc_feature 1..9876: note = derived and/or modified CDS sequence (opt5) from DENV-2__EU482753__SS-prME
  source 1..9876: mol_type = other RNA
accgccggcgtgatcgtcatgctgattcccacagctatggccttccacctcacgaccagaaatggggaacctcatatgatcgttggacggcaggaaaagggcaagagcctgctttttaagaccgaggacggggtgaatatgtgcaccctgatggcgattgatctcggagaactgtgtgaggacacaatcacctacaagtgcccccttctgcgccaaaatgaacccgaggatattgactgttggtgcaatagcacatctacctgggtgacgtatggcacctgtacaaccacaggggagcacagacgggaaaagcgcagcgtcgctctcgtgcctcatgttggaatgggcctggagaccagaacggaaacatggatgtcctctgagggcgcctggaaacacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaggaacaggacaaacgctttatctgcaagcattccatggtggatagaggctggggcaacgggtgtggactgttcggcaaagggggaattgtcacatgcgccatgtttacgtgcaaaaagaatatggaaggcaaagttgtgcagcctgagaacctcgaatacaccatcgtgattacaccccacagcggggaggagcatgcggtcggaaatgacaccggcaagcacggcaaagaaatcaagatcacacctcagtcttccattaccgaggccgaactgacggggtatggaaccgtgacaatggagtgtagcccccggaccggccttgatttcaacgaaatggttctgctccaaatggaggacaaggcttggctggtgcaccgccagtggtttcttgatctgccgctcccttggctgcccggggccgacacacagggatctaattggatccagaaggagaccctggtcacgttcaagaaccctcatgctaaaaagcaagacgtggttgtgctcggctcccaggaaggggccatgcacacagccctgaccggcgctacagagattcagatgagctccggaaatcttctgtttaccggccatctcaaatgcagactgcggatggataaacttcaactgaaagggatgtcttacagcatgtgtaccggaaagttcaagatcgtcaaagaaattgcggagacacagcacggcacgatcgtgatcagagtccagtatgagggggacggatccccctgcaagattcccttcgaaatcaccgatctcgagaaacgccatgtgctgggccggctgattacagttaaccctatcgtgaccgaaaaggacagcccggtcaacattgaggccgaacccccttttggggattcttacatcattatcggcgtggagcccggacagctcaaactgaattggttcaagaagggctccagcatcgggcaaatgtttgagacaaccatgagaggagctaaacgcatggccattcttggcgacacggcctgggatttcgggtctctgggaggcgtttttacaagcatcgggaaggctctccaccaggtgttcggcgccatttacggagcggctttttccggcgtctcttggaccatgaaaatcctgattggggtgatcatcacctggattggaatgaacagccggtccacaagcctgtctgtgtcccttgttctcgtcggcgtggtgaccctgtatctgggggccatggtccaggccgacagcggatgtgtggtttcttggaagaataaagaactcaagtgcggctccgggatcttcattacagataacgtgcacacgtggaccgagcagtacaagtttcaacctgaaagcccctccaaactggcttctgccatccagaaggctcatgaggaaggcatttgtggaatcagaagcgtcacacgccttgagaatctgatgtggaaacagatcaccccggagctcaaccacattctgtccgaaaatgaggtgaagctgacaatcatgaccggcgacattcgggggatcatgcaggccggaaaaagatctcttcgccctcaacccacggaactcaagtatagctggaaaacctggggcaaggcgaagatgctgtccacagagagccataaccagaccttcctgattgatgggcctgaaacagccgagtgccccaataccaaccgggcttggaactctctcgaggttgaagactacggatttggcgtgttcacaaccaacatctggctgaaacttagagagaagcaggacgtcttttgtgattccaaactgatgagcgccgctatcaaggacaatcgcgccgtgcacgcggatatgggctattggattgaatctgccctcaacgacacgtggaaaatggagaaggcttccttcatcgaggttaagagctgccactggcctaaatctcatacactgtggagcaatggggtgctggaatccgagatgattatccccaagaacttcgccggaccggtcagccagcacaactaccggcctggctatcatacccaaaccgctgggccctggcaccttggaaaactcgaaatggattttgacctgtgtgagggcacaaccgtggtggtcacggaagattgcgggaatagaggaccctctctgcggacaaccacagcctccggcaagctcattaccgagtggtgctgtcgcagctgcacactgcctccgcttagataccggggcgaggacgggtgttggtacggaatggaaatcagacccctgaaagagaaggaagagaacctcgttaattccctggtgaccgccggccatgggcagattgataacttctctctgggagtgcttggcatggctctctttctggaagagatgctgcgcacgcggatcgggaccaagcacgcgatcctcctggtcgccgtgagcttcgttacacttattaccggaaatatgtcctttagagacctgggccgcgtgatggtcatggtgggcgctacaatgaccgatgacatcgggatgggagttacgtatctcgccctgctggccgctttcaaagtgagacctacatttgccgcgggccttctgctccggaagctgacctctaaagagctcatgatggctacaattgggatcgccctgcttagccagtccaccattcccgaaaccatcctggagctcacagatgccctggctctgggaatgatggtccttaagatcgtgcgcaacatggaaaaataccaactggccgttacgattatggcgatctcttgcgtgcctaatgctgtcattctccagaacgcctggaaggtgagctgtaccatcctggccgctgtgtccgtcagccccctcctgcttacatcttcccagcagaaggccgactggattcctctggctctcaccatcaaaggcctgaatcccacagccatcttcctgaccacgcttagcagaacatctaagaaacggtcctggccgctgaacgaggcgattatggccgttgggatggtgagcatcctcgcttcttccctgctcaagaatgacattcctatgaccggacccctggtggccggcggccttctgaccgtctgctatgtgctgacagggcgcagcgctgatctcgaactggagagagccgccgacgttaaatgggaggatcaagctgaaatctccggaagctctcctattcttagcatcaccatttccgaggacggctctatgagcatcaagaacgaagaggaggaacagacactgacgatcctcattcggaccgggctgctcgtgatctccggagtctttcccgtgtctattccgatcacagcggccgcttggtacctgtgggaggttaaaaagcagcgcgccggcgtgctttgggatgtcccttctccccctcccgtggaaaaggccgagctggaagacggggcttatagaattaaacagcggggaatcctgggctactcccaaatcggcgccggggtctataaggagggaaccttccacacaatgtggcatgtgacccgcggcgcggttctcatgcacagagggaaacggattgagccctcctgggctgatgtgaagaaagacctgatcagctacggaggcgggtggaaacttgaaggagagtggaaggaaggcgaggaagtccaggtgctggccctcgagcctggcaaaaatccgagagccgttcagacgaagcccgggatttttaaaaccaacacaggaaccatcggcgctgtgtccctggatttcagccctgggacatctggatcccccattgtcgaccgcaagggcaaagtggtggggctctacggaaatggcgttgtcacccggagcggcgcctatgtgtctgcgatcgctcagacagagaagtccatcgaagataaccctgagattgaagacgatatctttagaaagaaacgcctgacgattatggaccttcatcccggggccggaaagaccaaacggtacctgcctgccatcgtgagagaggctattaagcgcggcctgcggacactcatcctggccccgaccagagtcgtggctgccgaaatggaggaggcgcttcgcgggctgcccattcggtatcaaaccacagccatcaaaacggaacacaccggaagagagatcgttgacctcatgtgtcatgctacattcaccatgcggctgctcagccctgtgcgcgtccccaactacaatctgattatcatggatgaagcccacttcacagaccctgcttccattgccgccagaggctatatctctacccgggtggagatgggggaggctgcgggcatttttatgacggccacacccccgggaagccgcgatcctttcccccagtccaacgctcccatcatggacgaagagagagaaatccctgagcggagctggaactctggccacgaatgggttaccgattttaaggggaagaccgtgtggttcgtcccctccattaaagccggaaacgacatcgccgcttgccttagaaagaatggcaaaaaggtgattcagctgagccgcaaaacatttgattctgagtacgttaagacccgggccaacgactgggatttcgtggtcacaaccgacatcagcgagatgggggcgaattttaaggctgaaagagtgattgatcctcgccggtgtatgaaaccggtgatcctgacggacggagaggaaagagtcatcctcgccggccccatgcctgttacacattcctctgccgctcaacgccgggggagaattggccgcaaccccaagaatgagaacgaccagtatatctacatgggagaacctctggagaatgatgaggactgcgcccactggaaagaagcgaagatgcttctggataacattaatacccccgagggcatcattccgagcatgttcgaacctgagagagaaaaagtggacgccatcgatggggagtaccggctccgcggagaggctagaaagacatttgtggacctgatgcggcgcggcgatctgcccgtctggctcgcctataaagtggctgccgaagggattaactacgctgacagaaagtggtgtttcgatggaatcaagaataaccagatccttgaggaaaacatggaggttgagatttggaccaaagaaggcgagcggaagaaactgaagcctagatggctggacgcccgcatctattccgatcccctcgcgctgaaagaatttaaggagttcgccgctgggcggaagtctcttacgctgaatctcattaccgaaatgggcagactgcctacattcatgacccagaaagcccgcaacgctctggacaatctcgccgtgcttcatacagccgaggctggaggccgggcgtacaaccacgccctgagcgagctgcccgaaaccctcgagacactgcttctgctcaccctgctggctacggtcacagggggaatctttctcttccttatgtccggcaaggggattggaaaaatgaccctgggcatgtgctgcatcatcaccgccagcattctgctctggtatgcccaaatccagccgcactggattgctgcctctatcattctggaatttttccttatcgtgctgctcatccctgagcccgaaaagcagagaacaccccaggataatcaactgacctacgttgtgattgcgatcctgacagtcgtggccgctacgatggccaacgagatgggctttctcgagaaaaccaagaaggaccttgggctgggatccattacaacccaggaaagcgagtccaatatcctggacattgatctccggcctgcttctgcctggacactgtatgcggtcgccaccacgttcgtgaccccgatgcttcgccatagcatcgaaaactcctctgttaatgtgagcctgacagctattgccaaccaggctaccgtgctcatgggcctggggaaaggatggcccctgtccaagatggacatcggcgtccctctccttgccatcgggtgttacagccaggttaatcccattacactgaccgctgccctgctcctgcttgtggcgcactacgccatcattggacctggcctgcaagctaaagccacgagagaggctcagaagcgggccgccgcgggcatcatgaaaaaccccacagtggatgggattaccgtcatcgacctcgaacctatcccgtatgatcccaagtttgagaagcagctgggacaggtgatgctgctcattctttgcgttacacaagtgctgatgatgcgcaccacctgggctctgtgtgaggccctcacactggctacgggccctatctctaccctttgggaagggaatcccggaagattctggaacacaaccattgccgtctccatggccaatatctttcggggcagctacctggctggggccggactcctgttctctattatgaaaaacacaaccaatacgcgcagaggcacaggcaacatcggggagaccctgggagaaaagtggaaatcccggctcaacgcgcttggcaagagcgagtttcagatctataaaaagtctgggattcaggaggtggaccgcaccctggccaaagaaggaatcaagagaggcgagacagatcatcacgctgtcagccgggggtccgccaagctgagatggttcgtggaacgcaatatggttacccctgagggaaaagtggtcgacctcggctgcggcagagggggatggtcttactattgtggcgggctgaagaacgtgcgggaagttaaaggacttacaaagggcgggcccggacatgaggagccgattcctatgagcacgtacggctggaatctggtgcgcctccaatccggcgtcgatgtgtttttcacaccgcccgaaaaatgcgacacactgctgtgtgatatcggggagagctcccctaaccccaccattgaagctggacggacactcagagtgcttaatctggttgagaactggctgaataacaatacccagttctgcatcaaggtcctcaacccttatatgccgtctgtgatcgaaaagatggaggccctgcagcgcaaatacggcggggcgcttgtgcggaatcccctgagcagaaactccacgcacgagatgtactgggtctctaatgccaccggaaacattgttagctccgtgaatatgatctctcgcatgctcattaaccggtttacaatgaagcacaaaaaggctacctatgaacctgacgtggatctgggcagcgggacaagaaacatcggaattgagtccgaaatccccaatctggacattatcggcaaacgcatcgagaagattaagcaggaacatgagaccagctggcactacgaccaagatcatccttataaaacatgggcctaccacggctcttatgagaccaagcagacggggtccgctagctctatggtcaacggagtggttcggctccttacaaaaccctgggacgtggtcccgatggtgacccagatggccatgaccgatacaacgcctttcggccagcaaagagtttttaaggaaaaagtggacacccgcacacaggagcccaaggaagggaccaagaaactgatgaagatcacagctgagtggctgtggaaagagctcggaaagaaaaagacccctagaatgtgtacacgggaagagttcacccgcaaagtcagatccaatgccgcgctgggcgccatttttacggatgaaaacaagtggaaaagcgctcgggaggccgtggaagacgggagattctgggagcttgtggatcgggagcgcaatctgcacctcgaaggaaaatgcgagacctgtgtctacaacatgatgggcaagagagagaagaagctgggcgagtttgggaaagctaagggatctcgggccatctggtatatgtggctgggcgcccgcttcctcgaatttgaggcgctggggttccttaatgaggaccattggttttccagaggaaacagcctgtccggcgttgaaggggagggcctccaccggctgggatacattcttcgcgatgtgggcaagaaagaagggggagctatgtacgccgacgatacagccggctgggacaccagaatcacactggaggacctcaagaatgaagagatggtgaccaaccatatgaaaggggagcacaagaaactggctgaagccatcttcaagctgacgtatcagaataaggtcgtgcgggttcagcgccccacacctagaggaaccgtgatggatattatcagccggcgcgaccaaagaggctctgggcaggtcggcacatacggactcaacacctttacgaatatggaggctcagctgattcggcaaatggaaggcgaggggatcttcaaaagcattcagcatcttaccgccacagaggaaatcgcggtgcagaactggctggcccgcgttggaagagagcggctctccagaatggctatctctggcgatgactgcgtggtcaagcccattgatgaccgcttcgccagcgctctgaccgcccttaatgatatggggaaagtgcggaaggacatccagcaatgggaaccgtccagaggatggaacgattggacacaggttcctttttgctctcaccacttccatgagctggtgatgaaagacggccgcgtcctcgtggtcccctgtcggaaccaggatgaactgattgggagagcgcgcatcagccagggcgccggatggtccctgaaggagaccgcttgcctcggcaagtcttatgcccaaatgtggacactgatgtactttcaccggagagaccttcgcctggctgccaatgctatttgtagcgccgtgccctcccattgggttcctaccagccggacgacatggtctatccacgcgaaacacgagtggatgaccaccgaagatatgctcgccgtgtggaacagagtctggattcaggagaatccgtggatggaagacaagacacccgtggagtcctgggaagaggtgccttatctggggaaacgcgaggaccagtggtgcggaagcatgatcggccttacctctcgggctacatgggccaagaacatccagacggccattaatcaagttagatccctgatcgggaacgaagagtacaccgattatatgcccagcatgaaacggttcagacgcgaagaggaagaggctggagtgctctggtga

SEQ ID NO: 19808 - RNA, 9876 nt, synthetic construct
  misc_feature 1..9876: note = derived and/or modified CDS sequence (opt5) from DENV-2__EU482680__SS-prME
  source 1..9876: mol_type = other RNA
accgccggagtgatcgtgatgctgattcccaccgctatggccttccacctcacgaccagaaatggggagcctcatatgatcgttggacggcaggaaaagggcaaaagcctgctttttaagaccgaggacggggtgaatatgtgcaccctgatggcgattgatctcggagaactgtgtgaggacacaatcacctacaaatgcccgcttctgcgccaaaatgaacccgaggatattgactgttggtgcaatagcacatctacctgggtgacgtatggcacctgtacaaccacaggggagcacagacgggaaaagcgcagcgtcgctctcgtgcctcatgttggaatgggcctggagaccagaacggaaacatggatgtcctctgagggcgcctggaaacacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaggaacaggacaaacgctttatctgcaagcattccatggtggatagaggctggggcaacgggtgtggactgttcggcaaaggcgggattgtcacatgcgccatgtttacgtgcaaaaagaatatggaagggaaaatcgttcagcctgagaacctcgaatacaccattgtgatcacaccccacagcggggaggagcatgcggtgggaaatgacaccggcaagcacggcaaagaaatcaagattacacctcagtcttccatcaccgaggccgaactgacggggtatggaaccgtcacaatggagtgtagcccccggaccggccttgatttcaacgaaatggtgctgctccaaatggaggacaaggcttggctggttcaccgccagtggtttcttgatctgccgctcccttggctgcccggggccgacacacagggatctaattggattcagaaggagaccctggtgacgttcaagaaccctcatgctaaaaagcaagacgtcgtggttctcggctcccaggaaggggccatgcacacagccctgaccggcgctacagagatccagatgagctccggaaatcttctgtttaccggccatctcaaatgcagactgcggatggataaacttcaactgaaagggatgtcttacagcatgtgtaccggaaagttcaagattgtgaaagaaatcgcggagacacagcacggcacgatcgtcattagagtgcagtatgagggggacggatccccctgcaagatccccttcgaaattaccgatctcgagaaacgccatgtcctgggccggctgatcacagtgaaccctattgttaccgaaaaggacagcccggtgaacatcgaggccgaacccccttttggggattcttacattatcatcggcgtcgagcccggacagctcaaactgaattggttcaagaagggctccagcattgggcaaatgtttgagacaaccatgagaggagctaaacgcatggccatccttggcgacacggcctgggatttcgggtctctgggaggcgtgtttacaagcattgggaaggctctccaccaggttttcggcgccatctacggagcggctttttccggcgtgtcttggaccatgaaaattctgatcggggtcatcattacctggatcggaatgaacagccggtccacaagcctgtctgtgtcccttgtgctcgttggcgtcgtgaccctgtatctgggggccatggtgcaggccgacagcggatgtgtcgtgtcttggaagaataaagaactcaagtgcggctccgggattttcatcacagataacgttcacacgtggaccgagcagtacaagtttcaacctgaaagcccctccaaactggcttctgccattcagaaggctcatgaggaaggcatctgtggaatcagaagcgtgacacgccttgagaatctgatgtggaaacagattaccccggagctcaaccacatcctgtccgaaaatgaggtcaagctgacaattatgaccggcgacatccgggggattatgcaggccggaaaaagatctcttcgccctcaacccacggaactcaagtatagctggaaaacctggggcaaggcgaagatgctgtccacagagagccataaccagaccttcctgatcgatgggcctgaaacagccgagtgccccaataccaaccgggcttggaactctctcgaggtggaagactacggatttggcgttttcacaaccaacatctggctgaaacttagagagaagcaggacgtgttttgtgattccaaactgatgagcgccgctattaaggacaatcgcgccgtccacgcggatatgggctattggatcgaatctgccctcaacgacacgtggaaaatggagaaggcttccttcattgaggtcaagagctgccactggcctaaatctcatacactgtggagcaatggggttctggaatccgagatgatcattcccaagaacttcgccggaccggtgagccagcacaactaccggcctggctatcatacccaaaccgctgggccctggcaccttggaaaactcgaaatggattttgacctgtgtgagggcacaaccgtcgtggtgacggaagattgcgggaatagaggaccctctctgcggacaaccacagcctccggcaagctcatcaccgagtggtgctgtcgcagctgcacactgcctccgcttagataccggggcgaggacgggtgttggtacggaatggaaattagacccctgaaagagaaggaagagaacctcgtcaattccctggttaccgccggccatgggcagatcgataacttctctctgggagtgcttggcatggctctctttctggaagagatgctgcgcacgcggatcgggaccaagcacgcgattctcctggtggccgtcagcttcgtgacacttatcaccggaaatatgtcctttagagacctgggccgcgttatggtgatggtcggcgctacaatgaccgatgacattgggacgggagtgacatatctcgccctgctggccgctttcaaagttagacctacctttgccgcgggccttctgctccggaagctgacatctaaagagctcatgatggctaccatcgggattgccctgcttagccagtccaccatccccgaaacaatcctggagctcacggatgccctggctctgggaatgatggtgcttaagattgtccgcaacatggaaaaataccaactggccgtgaccatcatggcgatttcttgcgttcctaatgctgtgatcctccagaacgcctggaaggtcagctgtacaattctggccgctgtgtccgtgagccccctcctgcttacctcttcccagcagaaggccgactggatccctctggctctcacaatcaaaggcctgaatcccaccgccattttcctgacgacacttagcagaacctctaagaaacggtcctggccgctgaacgaggcgatcatggccgtcgggatggttagcattctcgcttcttccctgctcaagaatgacatccctatgaccggacccctggtggccggcggccttctgacagtgtgctatgtcctgaccgggcgcagcgctgatctcgaactggagagagccgccgacgtgaaatgggaggatcaagctgaaatttccggaagctctcctatccttagcattacaatctccgaggacggctctatgagcatcaagaacgaagaggaggaacagacgctgaccattctcatccggacagggctgctcgttatttccggagtgtttcccgtctctatcccgattaccgcggccgcttggtacctgtgggaggtgaaaaagcagcgcgccggcgttctttgggatgtgccttctccccctcccgtcgaaaaggccgagctggaagacggggcttatagaatcaaacagcggggaatcctgggctactcccaaattggcgccggggtgtataaggagggaacattccacaccatgtggcatgtcacgcgcggcgcggtgctcatgcacagagggaaacggatcgagccctcctgggctgatgttaagaaagacctgattagctacggaggcgggtggaaacttgaaggagagtggaaggaaggcgaggaagtgcaggtcctggccctcgagcctggcaaaaatccgagagccgtgcagaccaagcccgggatctttaaaacaaacaccggaacaattggcgctgtttccctggatttcagccctgggacctctggatcccccatcgtggaccgcaagggcaaagtcgtggggctctacggaaatggcgtggttacacggagcggcgcctatgtctctgcgatcgctcagacggagaagtccattgaagataaccctgagatcgaagacgatatttttagaaagaaacgcctgaccatcatggaccttcatcccggggccggaaagacaaaacggtacctgcctgccattgtgagagaggctatcaagcgcggcctgcggaccctcattctggccccgaccagagtggtcgctgccgaaatggaggaggcgcttcgcgggctgcccatccggtatcaaacaacggccatcaaaaccgaacacacaggaagagagattgtggacctcatgtgtcatgctaccttcacaatgcggctgctcagccctgttcgcgtgcccaactacaatctgatcattatggatgaagcccacttcaccgaccctgcttccatcgccgccagaggctatatttctacgcgggtcgagatgggggaggctgcgggcatctttatgacagccacacctcccggaagccgcgatcccttcccccagtccaacgctcccatcatggacgaagagagagaaattcctgagcggagctggaactctggccacgaatgggtgaccgattttaaggggaagacagtttggttcgtgccctccatcaaagccggaaacgacattgccgcttgccttagaaagaatggcaaaaaggtcatccagctgagccgcaaaacctttgattctgagtacgtgaagacacgggccaacgactgggatttcgttgtgaccacggacattagcgagatgggggcgaattttaaggctgaaagagtcatcgatcctcgccggtgtatgaaaccggtgatcctgacagacggagaggaaagagtgattctcgccggccccatgcctgtcacccattcctctgccgctcaacgccgggggagaatcggccgcaaccccaagaatgagaacgaccagtatatttacatgggagaacctctggagaatgatgaggactgcgcccactggaaagaagcgaagatgcttctggataacatcaatacacccgagggcattatcccgagcatgttcgaacctgagagagaaaaagttgacgccattgatggggagtaccggctccgcggagaggctagaaagacctttgtggacctgatgcggcgcggcgatctgcccgtgtggctcgcctataaagtcgctgccgaagggatcaactacgctgacagaaagtggtgtttcgatggaatcaagaataaccagattcttgaggaaaacatggaggtggagatctggacgaaagaaggcgagcggaagaaactgaagcctagatggctggacgcccgcatttattccgatcccctcgcgctgaaagaatttaaggagttcgccgctgggcggaagtctcttaccctgaatctcatcacagaaatgggcagactgcctaccttcatgacacagaaagcccgcaacgctctggacaatctcgccgttcttcataccgccgaggctggaggccgggcgtacaaccacgccctgagcgagctgcccgaaacactcgagaccctgcttctgctcacgctgctggctacagtgaccgggggaatttttctcttccttatgtccggcaaggggatcggaaaaatgaccctgggcatgtgctgcatcattacagccagcatcctgctctggtatgcccaaattcagccgcactggatcgctgcctctattatcctggaatttttccttatcgtcctgctcattcctgagcccgaaaagcagagaacaccccaggataatcaactgacatacgtggttatcgcgattctgacggtggtcgccgctaccatggccaacgagatgggctttctcgagaaaacaaagaaggaccttgggctgggatccatcaccacacaggaaagcgagtccaatattctggacatcgatctccggcctgcttctgcctggaccctgtatgcggtggccacgaccttcgtcacaccgatgcttcgccatagcattgaaaactcctctgtgaatgttagcctgaccgctatcgccaaccaggctacagtgctcatgggcctggggaaaggatggcccctgtccaagatggacatcggcgtgcctctccttgccattgggtgttacagccaggtcaatcccatcaccctgacggctgccctgctcctgcttgttgcgcactacgccattatcggacctggcctgcaagctaaagccacaagagaggctcagaagcgggccgccgcgggcattatgaaaaaccccaccgtggatgggatcacagtgatcgacctcgaacctattccgtatgatcccaagtttgagaagcagctgggacaggtcatgctgctcatcctttgcgtgacccaagttctgatgatgcgcaccacatgggctctgtgtgaggccctcacgctggctaccggccctatttctacactttgggaagggaatcccggaagattctggaacaccacaatcgccgtgtccatggccaatatttttcggggcagctacctggctggggccggactcctgttctctatcatgaaaaacaccacgaatacacgcagaggcaccggcaacatcggggagaccctgggagaaaagtggaaatcccggctcaacgcgcttggcaagagcgagtttcagatttataaaaagtctgggatccaggaggtcgaccgcacactggccaaagaaggaattaagagaggcgagaccgatcatcacgctgtgagccgggggtccgccaagctgagatggttcgtcgaacgcaatatggtgacacctgagggaaaagttgtggacctcggctgcggcagagggggatggtcttactattgtggcgggctgaagaacgtccgggaagtgaaaggacttacgaagggcgggcccggacatgaggagccgatccctatgagcacctacggctggaatctggttcgcctccaatccggcgtggatgtctttttcacaccgcccgaaaaatgcgacaccctgctgtgtgatattggggagagctcccctaaccccacaatcgaagctggacggaccctcagagtgcttaatctggtggagaactggctgaataacaatacgcagttctgcatcaaggttctcaacccttatatgccgtctgtcattgaaaagatggaggccctgcagcgcaaatacggcggggcgcttgtgcggaatcccctgagcagaaactccacccacgagatgtactgggtgtctaatgccacaggaaacatcgtcagctccgttaatatgatttctcgcatgctcatcaaccggtttaccatgaagcacaaaaaggctacatatgaacctgacgtggatctgggcagcgggaccagaaacattggaatcgagtccgaaaaacccaatctggacattatcggcaagcgcatcgagaagattaaacaggaacatgagacaagctggcactacgaccaagatcatccttataagacctgggcctaccacggctcttatgagacgaaacagacagggtccgctagctctatggtgaacggagtcgtgcggctccttaccaagccctgggacgttgtgccgatggtcacccagatggccatgacagatacgacccctttcggccagcaaagagtgtttaaagaaaaggttgacacacgcacccaggagcccaaggaagggaccaagaagctgatgaaaatcaccgctgagtggctgtggaaggagctcggcaagaagaaaacacctagaatgtgtacccgggaagagttcacgcgcaaggtgagatccaatgccgcgctgggcgccatttttaccgatgaaaacaagtggaaaagcgctcgggaggccgtcgaagacgggagattctgggagcttgtggatcgggagcgcaatctgcacctcgaaggaaagtgcgagacatgtgtgtacaacatgatgggcaaaagagaaaagaaactgggcgagtttgggaaggctaagggatctcgggccatctggtatatgtggctgggcgcccgcttcctcgaatttgaggcgctggggttccttaatgaggaccattggttttccagaggaaacagcctgtccggcgtcgaaggggagggcctccaccggctgggatacattcttcgcgatgttggcaaaaaggaagggggagctatgtacgccgacgataccgccggctgggacacaagaatcaccctggaggacctcaaaaatgaagagatggtgacgaaccatatgaagggggagcacaaaaagctggctgaagccatcttcaagctgacatatcagaataaagtggtccgggtgcagcgccccacccctagaggaacagttatggatattatcagccggcgcgaccaaagaggctctggacaggtgggcacctacggactcaacacgtttaccaatatggaggctcagctgattcggcaaatggaaggcgaggggatcttcaagagcattcagcatcttacagccaccgaggaaatcgcggtccagaactggctggcccgcgtgggaagagagcggctctccagaatggctatctctggcgatgactgcgttgtgaaacccattgatgaccgcttcgccagcgctctgacagcccttaatgatatggggaaggtccggaaagacatccagcaatgggaaccgtccagaggatggaacgattggacccaggtgcctttttgctctcaccacttccatgagctggttatgaaggacggccgcgtgctcgtcgtgccctgtcggaaccaggatgaactgattgggagagcgcgcatcagccagggcgccggatggtccctgaaggagacagcttgcctcggcaaatcttatgcccaaatgtggaccctgatgtactttcaccggagagaccttcgcctggctgccaatgctatttgtagcgccgtcccctcccattgggtgcctacgagccggacaacctggtctatccacgcgaagcacgagtggatgaccacagaagatatgctcgccgtttggaacagagtgtggattcaggagaatccgtggatggaagacaaaacccccgtcgagtcctgggaagaggtgccttatctggggaagcgcgaggaccagtggtgcggaagccttatcggcctgacatctcgggctacgtgggccaaaaacatccagaccgccattaatcaagtgagatccctcatcgggaacgaagagtacacagattatatgcccagcatgaagcggttcagacgcgaagaggaagaggctggagttctgtggtga

SEQ ID NO: 19809 - RNA, 9876 nt, synthetic construct
  misc_feature 1..9876: note = derived and/or modified CDS sequence (opt5) from DENV-2__EU482754__SS-prME
  source 1..9876: mol_type = other RNA
accgccggcgtgatcgtgatgctgattcccacagctatggccttccacctcacgaccagaaatggggaacctcatatgatcgttggacggcaggaaaagggcaagagcctgctttttaagaccgaggacggggtgaatatgtgcaccctgatggcgatggatctcggagaactgtgtgaggacacaattacctacaagtgcccccttctgcgccaaaatgaacccgaggatatcgactgttggtgcaatagcacatctacctgggtgacgtatggcacctgtacaaccacaggggagcacagacgggaaaagcgcagcgtcgctctcgtgcctcatgttggaatgggcctggagaccagaacggaaacatggatgtcctctgagggcgcctggaaacacgtgcagcggattgagacctggatcctgcgccatcccgggttcacaatcatggccgctattctcgcctacaccatcggaaccacacactttcagagagctctgattttcatccttctgacggccgtcgcgcctagcatgaccatgcggtgcattggcatctccaaccgcgattttgtggaaggggtttctggaggcagctgggtggacattgtcctcgagcacgggtcctgtgtgacaaccatggccaagaataagcccacactggatttcgaacttatcaaaaccgaggctaagcagcctgccacgctgagaaaatattgcatcgaagctaagctcacaaacaccaccacagagagccggtgtccgacccaaggagagccctctctgaatgaggaacaggacaaacgctttatttgcaagcattccatggtggatagaggctggggcaacgggtgtggactgttcggcaaaggcgggatcgtcacatgcgccatgtttacgtgcaaaaagaatatggaagggaaagttgtgcagcctgagaacctcgaatacaccattgtgatcacaccccacagcggggaggagcatgcggtcggaaatgacaccggcaagcacggcaaagaaattaagatcacacctcagtcttccatcaccgaggccgaactgacggggtatggaaccgtgacaatggagtgtagcccccggaccggccttgatttcaacgaaatggttctgctccaaatggaggacaaggcttggctggtgcaccgccagtggtttcttgatctgccgctcccttggctgcccggggccgacacacagggatctaattggattcagaaggagaccctggtcacgttcaagaaccctcatgctaaaaagcaagacgtggttgtgctcggctcccaggaaggggccatgcacacagccctgaccggcgctacagagatccagatgagctccggaaatcttctgtttaccggccatctcaaatgcagactgcggatggataaacttcaactgaaagggatgtcttacagcatgtgtaccggaaagttcaagattgtcaaagaaatcgcggagacacagcacggcacgattgtgatcagagtccagtatgagggggacggatccccctgcaagatccccttcgaaattaccgatctcgagaaacgccatgtgctgggccggctgatcacagttaaccctattgtgaccgaaaaggacagcccggtcaacatcgaggccgaacccccttttggggattcttacattatcattggcgtggagcccggacagctcaaactgaattggttcaagaagggctccagcatcgggcaaatgtttgagacaaccatgagaggagctaaacgcatggccatccttggcgacacggcctgggatttcgggtctctgggaggcgtttttacaagcattgggaaggctctccaccaggtgttcggcgccatctacggagcggctttttccggcgtctcttggaccatgaaaattctgatcggggtgattatcacctggatcggaatgaacagccggtccacaagcctgtctgtgtcccttgttctcgtcggcgtggtgaccctgtatctgggggccatggtccaggccgacagcggatgtgtggtttcttggaagaataaagaactcaagtgcggctccgggattttcatcacagataacattcacacgtggaccgagcagtacaagtttcaacctgaaagcccctccaaactggcttctgccatccagaaggctcatgaggaaggcatttgtggaatcagaagcgtgacacgccttgagaatctgatgtggaaacagatcaccccggagctcaaccacattctgtccgaaaatgaggtcaagctgacaatcatgaccggcgacattcgggggatcatgcaggccggaaaaagatctcttcgccctcaacccacggaactcaagtatagctggaaaacctggggcaaggcgaagatgctgtccacagagagccataaccagaccttcctgattgatgggcctgaaacagccgagtgccccaataccaaccgggcttggaactctctcgaggtggaagactacggatttggcgttttcacaaccaacatctggctgaaacttagagagaagcaggacgtgttttgtgattccaaactgatgagcgccgctatcaaggacaatcgcgccgtccacgcggatatgggctattggattgaatctgccctcaacgacacgtggaaaatggagaaggcttccttcatcgaggtcaagagctgccactggcctaaatctcatacactgtggagcaatggggttctggaatccgagatgattatccccaagaacttcgccggaccggtgagccagcacaactaccggcctggctatcatacccaaaccgctgggccctggcaccttggaaaactcgaaatggattttgacctgtgtgagggcacaaccgtcgtggtgacggaagattgcgggaatagaggaccctctctgcggacaaccacagcctccggcaagctcattaccgagtggtgctgtcgcagctgcacactgcctccgcttagataccggggcgaggacgggtgttggtacggaatggaaatcagacccctgaaagagaaggaagagaacctcgtcaattccctggttaccgccggccatgggcagattgataacttctctctgggagtgcttggcatggctctctttctggaagagatgctgcgcacgcggatcgggaccaagcacgcgatcctcctggtggccgtcagcttcgtgacacttattaccggaaatatgtcctttagagacctgggccgcgttatggtgatggtcggcgctacaatgaccgatgacatcgggatgggagtgacgtatctcgccctgctggccgctttcaaagttagacctacatttgccgcgggccttctgctccggaagctgacctctaaagagctcatgatggctacaattgggatcgccctgcttagccagtccaccattcccgaaaccatcctggagctcacagatgccctggctctgggaatgatggtgcttaagatcgtccgcaacatggaaaaataccaactggccgtgacgattatggcgatctcttgcgttcctaatgctgtgattctccagaacgcctggaaggtcagctgtaccatcctggccgctgtgtccgtgagccccctcctgcttacatcttcccagcagaaggccgactggattcctctggctctcaccatcaaaggcctgaatcccacagccatcttcctgaccacgcttagcagaacatctaagaaacggtcctggccgctgaacgaggcgattatggccgtcgggatggttagcatcctcgcttcttccctgctcaagaatgacattcctatgaccggacccctggtggccggcggccttctgaccgtgtgctatgtcctgacagggcgcagcgctgatctcgaactggagagagccgccgacgtgaaatgggaggatcaagctgaaatctccggaagctctcctattcttagcatcaccatttccgaggacggctctatgagcatcaagaacgaagaggaggaacagacactgacgatcctcattcggaccgggctgctcgttatctccggagtgtttcccgtctctattccgatcacagcggccgcttggtacctgtgggaggtgaaaaagcagcgcgccggcgttctttgggatgtgccttctccccctcccgtcgaaaaggccgagctggaagacggggcttatagaattaaacagcggggaatcctgggctactcccaaatcggcgccggggtgtataaggagggaaccttccacacaatgtggcatgtcacccgcggcgcggtgctcatgcacagagggaaacggattgagccctcctgggctgatgttaagaaagacctgatcagctacggaggcgggtggaaacttgaaggagagtggaaggaaggcgaggaagtgcaggtcctggccctcgagcctggcaaaaatccgagagccgtgcagacgaagcccgggatttttaaaaccaacacaggaaccatcggcgctgtttccctggatttcagccctgggacatctggatcccccattgtggaccgcaagggcaaagtcgtggggctctacggaaatggcgtggttacccggagcggcgcctatgtctctgcgatcgctcagacagagaagtccatcgaagataaccctgagattgaagacgatatctttagaaagaaacgcctgacgattatggaccttcatcccggggccggaaagaccaaacggtacctgcctgccatcgtgagagaggctattaagcgcggcctgcggacactcatcctggccccgaccagagtggtcgctgccgaaatggaggaggcgcttcgcgggctgcccattcggtatcaaaccacagccatcaaaacggaacacaccggaagagagatcgtggacctcatgtgtcatgctacattcaccatgcggctgctcagccctgttcgcgtgcccaactacaatctgattatcatggatgaagcccacttcacagaccctgcttccattgccgccagaggctatatctctacccgggtcgagatgggggaggctgcgggcatttttatgacggccacacccccgggaagccgcgatcctttcccccagtccaacgctcccatcatggacgaagagagagaaatccctgagcggagctggaactctggccacgaatgggtgaccgattttaaggggaagaccgtttggttcgtgccctccattaaagccggaaacgacatcgccgcttgccttagaaagaatggcaaaaaggtcattcagctgagccgcaaaacatttgattctgagtacgtgaagacccgggccaacgactgggatttcgttgtgacaaccgacatcagcgagatgggggcgaattttaaggctgaaagagtcattgatcctcgccggtgtatgaaaccggtgatcctgacggacggagaggaaagagtgatcctcgccggccccatgcctgtcacacattcctctgccgctcaacgccgggggagaattggccgcaaccccaagaatgagaacgaccagtatatctacatgggagaacctctggagaatgatgaggactgcgcccactggaaagaagcgaagatgcttctggataacattaatacccccgagggcatcattccgagcatgttcgaacctgagagagaaaaagttgacgccatcgatggggagtaccggctccgcggagaggctagaaagacatttgtggacctgatgcggcgcggcgatctgcccgtgtggctcgcctataaagtcgctgccgaagggattaactacgctgacagaaagtggtgtttcgatggaatcaagaataaccagatccttgaggaaaacatggaggtggagatttggaccaaagaaggcgagcggaagaaactgaagcctagatggctggacgcccgcatctattccgatcccctcgcgctgaaagaatttaaggagttcgccgctgggcggaagtctcttacgctgaatctcattaccgaaatgggcagactgcctacattcatgacccagaaagcccgcaacgctctggacaatctcgccgttcttcatacagccgaggctggaggccgggcgtacaaccacgccctgagcgagctgcccgaaaccctcgagacactgcttctgctcaccctgctggctacggtgacagggggaatctttctcttccttatgtccggcaaggggattggaaaaatgaccctgggcatgtgctgcatcatcaccgccagcattctgctctggtatgcccaaatccagccgcactggattgctgcctctatcattctggaatttttccttatcgtcctgctcatccctgagcccgaaaagcagagaacaccccaggataatcaactgacctacgtggttattgcgatcctgacagtggtcgccgctacgatggccaacgagatgggctttctcgagaaaaccaagaaggaccttgggctgggatccattacaacccaggaaagcgagtccaatatcctggacattgatctccggcctgcttctgcctggacactgtatgcggtggccaccacgttcgtcaccccgatgcttcgccatagcatcgaaaactcctctgtgaatgttagcctgacagctattgccaaccaggctaccgtgctcatgggcctggggaaaggatggcccctgtccaagatggacatcggcgtgcctctccttgccatcgggtgttacagccaggtcaatcccattacactgaccgctgccctgctcctgcttgttgcgcactacgccatcattggacctggcctgcaagctaaagccacgagagaggctcagaagcgggccgccgcgggcatcatgaaaaaccccacagtggatgggattaccgtgatcgacctcgaacctatcccgtatgatcccaagtttgagaagcagctgggacaggtcatgctgctcattctttgcgtgacacaagttctgatgatgcgcaccacctgggctctgtgtgaggccctcacactggctacgggccctatctctaccctttgggaagggaatcccggaagattctggaacacaaccattgccgtgtccatggccaatatctttcggggcagctacctggctggggccggactcctgttctctattatgaaaaacacaaccaatacgcgcagaggcacaggcaacatcggggagaccctgggagaaaagtggaaatcccggctcaacgcgcttggcaagagcgagtttcagatctataaaaagtctgggattcaggaggtcgaccgcaccctggccaaagaaggaatcaagagaggcgagacagatcatcacgctgtgagccgggggtccgccaagctgagatggttcgtcgaacgcaatatggtgacccctgagggaaaagttgtggacctcggctgcggcagagggggatggtcttactattgtggcgggctgaagaacgtccgggaagtgaaaggacttacaaagggcgggcccggacatgaggagccgattcctatgagcacgtacggctggaatctggttcgcctccaatccggcgtggatgtctttttcacaccgcccgaaaaatgcgacacactgctgtgtgatatcggggagagctcccctaaccccaccattgaagctggacggacactcagagtgcttaatctggtggagaactggctgaataacaatacccagttctgcatcaaggttctcaacccttatatgccgtctgtcatcgaaaagatggaggccctgcagcgcaaatacggcggggcgcttgtgcggaatcccctgagcagaaactccacgcacgagatgtactgggtgtctaatgccaccggaaacattgtcagctccgttaatatgatctctcgcatgctcattaaccggtttacaatgaagcacaaaaaggctacctatgaacctgacgtggatctgggcagcgggacaagaaacatcggaattgagtccgaaatccccaatctggacattatcggcaaacgcatcgagaagattaagcaggaacatgagaccagctggcactacgaccaagatcatccttataaaacatgggcctaccacggctcttatgagaccaagcagacggggtccgctagctctatggtgaacggagtcgtgcggctccttacaaaaccctgggacgttgtgccgatggtcacccagatggccatgaccgatacaacgcctttcggccagcaaagagtgtttaaggaaaaagttgacacccgcacacaggagcccaaggaagggaccaagaaactgatgaagatcacagctgagtggctgtggaaagagctcggaaagaaaaagacccctagaatgtgtacacgggaagagttcacccgcaaagtgagatccaatgccgcgctgggcgccatttttacggatgaaaacaagtggaaaagcgctcgggaggccgtcgaagacgggagattctgggagcttgtggatcgggagcgcaatctgcacctcgaaggaaaatgcgagacctgtgtgtacaacatgatgggcaagagagagaagaagctgggcgagtttgggaaagctaagggatctcgggccatctggtatatgtggctgggcgcccgcttcctcgaatttgaggcgctggggttccttaatgaggaccattggttttccagaggaaacagcctgtccggcgtcgaaggggagggcctccaccggctgggatacattcttcgcgatgttggcaagaaagaagggggagctatgtacgccgacgatacagccggctgggacaccagaatcacactggaggacctcaagaatgaagagatggtgaccaaccatatgaaaggggagcacaagaaactggctgaagccatcttcaagctgacgtatcagaataaggtggtccgggtgcagcgccccacacctagaggaaccgttatggatattatcagccggcgcgaccaaagaggctctggacaggtgggcacatacggactcaacacctttacgaatatggaggctcagctgattcggcaaatggaaggcgaggggatcttcaaaagcattcagcatcttaccgccacagaggaaatcgcggtccagaactggctggcccgcgtgggaagagagcggctctccagaatggctatctctggcgatgactgcgttgtgaagcccattgatgaccgcttcgccagcgctctgaccgcccttaatgatatggggaaagtccggaaggacatccagcaatgggaaccgtccagaggatggaacgattggacacaggtgcctttttgctctcaccacttccatgagctggttatgaaagacggccgcgtgctcgtcgtgccctgtcggaaccaggatgaactgattgggagagcgcgcatcagccagggcgccggatggtccctgaaggagaccgcttgcctcggcaagtcttatgcccaaatgtggacactgatgtactttcaccggagagaccttcgcctggctgccaatgctatttgtagcgccgtcccctcccattgggtgcctaccagccggacgacatggtctatccacgcgaaacacgagtggatgaccaccgaagatatgctcgccgtttggaacagagtgtggattcaggagaatccgtggatggaagacaagacacccgtcgagtcctgggaagaggtgccttatctggggaaacgcgaggaccagtggtgcggaagccttatcggcctgacctctcgggctacatgggccaagaacatccagacggccattaatcaagtgagatccctcatcgggaacgaagagtacaccgattatatgcccagcatgaaacggttcagacgcgaagaggaagaggctggagttctgtggtga

SEQ ID NO: 19810 - RNA, 9876 nt, synthetic construct
  misc_feature 1..9876: note = derived and/or modified CDS sequence (opt5) from DENV-2__FJ478455__SS-prME
  source 1..9876: mol_type = other RNA
accgccggcgtgatcgttatgctgattcccaccgctatggccttccacctcacgacccggaatggggaacctcatatgatcgttggacggcaggaaaagggcaagagcctgctttttaagaccgaagacggggtgaatatgtgcaccctgatggcgattgatctcggagaactgtgtgaagacacgatcacctacaaatgcccgcttctgcgccaaaatgaacccgaggatattgactgttggtgcaattccacatctacctgggtgacgtatggcacctgtacaaccacaggggagcacagacgggaaaagcgcagcgtcgctctcgtgcctcatgttggaatgggcctggagaccagaacggaaacatggatgtcctctgagggcgcctggaaacacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaagaacaggacaaacgctttatctgcaagcattccatggtggatagaggctggggcaacgggtgtggactgttcggcaaagggggaattgtcacatgcgccatgtttacgtgcaaaaagaatatggaaggcaaagttgtgcagcctgagaacctcgaatacaccatcgtgattacaccccacagcggggaggagcatgcggtcggaaatgacaccggcaagcacggcaaagaaatcaagatcacacctcagtcttccattaccgaggccgaactgacggggtatggaaccgtgacaatggagtgtagcccccggaccggccttgatttcaacgaaatggttctgctccaaatggaggacaaggcttggctggtgcaccgccagtggtttcttgatctgccgctcccttggctgcccggggccgacacacagggatctaattggatccagaaggagaccctggtcacgttcaagaaccctcatgctaaaaagcaagacgtggttgtgctcggctcccaggaaggggccatgcacacagccctgaccggcgctacagagattcagatgagctccggaaatcttctgtttaccggccatctcaaatgcagactgcggatggataaacttcaactgaaagggatgtcttacagcatgtgtaccggaaagttcaagatcgtcaaagaaattgcggagacacagcacggcacgatcgtgatcagagtccagtatgagggggacggatccccctgcaagattcccttcgaaatcaccgatctcgagaaacgccatgtgctgggccggctgattacagttaaccctatcgtgaccgaaaaggacagcccggtcaacattgaggccgaacccccttttggggattcttacatcattatcggcgtggagcccggacagctcaaactgaattggttcaagaagggctccagcatcgggcaaatgtttgagacaaccatgagaggagctaaacgcatggccattcttggcgacacggcctgggatttcgggtctctgggaggcgtttttacaagcatcgggaaggctctccaccaggtgttcggcgccatttacggagcggctttttccggcgtctcttggaccatgaaaatcctgattggggtgatcatcacctggattggaatgaacagccggtccacaagcctgtctgtgtcccttgttctcgtcggcgtggtgaccctgtatctgggggccgtcgtgcaggccgacagcggatgtgttgtgtcttggaagaataaagaactcaagtgcggctccgggatcttcattacagataacgtccacacgtggaccgagcagtacaagtttcaacctgaaagcccctccaaactggcttctgccatccagaaggctcatgaggaaggcatttgtggaatcagaagcgtgacacgccttgagaatctgatgtggaaacagatcaccccggagctcaaccacattctgtccgaaaatgaggttaagctgacaatcatgaccggcgacattaaagggatcatgcaggccggaaagcggtctcttagacctcaacccacggaactcaaatatagctggaagacctggggcaaggcgaaaatgctgtccacagagagccataaccagaccttcctgattgatgggcctgaaacagtggagtgccccaataccaaccgcgcctggaactctctcgaggtcgaagactacggatttggcgtgttcacaaccaacatctggctgaaacttcgggagaaacaggacgtcttttgtgattccaagctgatgagcgctgccatcaaagacaatagagctgtgcacgccgatatgggctattggattgaatctgcgctcaacgacacgtggaagatggagaaggcctccttcatcgaggtcaaaagctgccactggcctaagtctcatacactgtggagcaatggggtgctggaatccgagatgattatccccaaaaacttcgctggaccggtgagccagcacaactaccgccctggctatcatacccaaaccgccgggccctggcaccttggaaagctcgaaatggattttgacttctgtgagggcacaaccgtcgttgtgacggaagattgcgggaatcggggaccctctctgagaacaaccacagcttccggcaaactgattaccgagtggtgctgtcggagctgcacactccctccgctgcgctacagaggcgaggacgggtgttggtacggaatggaaatccggccccttaaggagaaggaagagaacctggtgaatagcctcgtcaccgccggccatgggcagattgataacttttctctgggagtgctgggcatggcccttttcctcgaagagatgctgagaacgcgcatcgggaccaaacacgctatcctgctcgttgcggtgagctttgtcacactgattaccggaaatatgtccttccgggaccttggcagagtgatggttatggtgggcgccacaatgaccgatgacatcgggatgggagtcacgtatctggctctcctggccgcctttaaggtgcgccctacattcgctgccggcctgcttctgagaaaactcacctctaaggagctgatgatggcgacaattgggatcgctctcctgagccagtccaccattcccgaaaccatccttgagctgacagatgccctcgccctgggaatgatggttctgaaaatcgtgcggaacatggaaaagtaccaacttgctgtcacgattatggccatctcttgcgtgcctaatgcggtgattctgcagaacgcttggaaggtcagctgtaccatcctcgccgccgtttccgtgagccccctgctcctgacatcttcccagcagaaagctgactggattcctcttgccctgaccatcaagggcctcaatcccacagctatctttctgaccacgctgagccgcacatctaaaaagagatcctggccgcttaacgaggccattatggcggtggggatggtcagcatcctggcctcttccctcctgaaaaatgacattcctatgaccggacccctcgtggctggcggcctgcttaccgtttgctatgtgctgacagggcggagcgccgatctggaactcgagcgcgctgccgacgtcaagtgggaggatcaagccgaaatctccggaagctctcctattctgagcatcaccatttccgaggacggctctatgagcatcaaaaacgaagaggaggaacagacacttacgatcctgattagaaccgggctcctggtgatctccggagttttccccgtgtctattccgatcacagctgcggcctggtacctctgggaggtcaagaagcagcgggctggcgtgctgtgggatgtcccttctccccctcccgtggaaaaagccgagcttgaagacggggcctatcgcattaagcagagaggaatcctgggctactcccaaatcggcgctggggtttataaagagggaacctttcacacaatgtggcatgtgacccggggcgccgtcctgatgcaccgcgggaagagaattgagccctcctgggcggatgtgaaaaaggacctcatcagctacggaggcgggtggaagctggaaggagagtggaaagaaggcgaggaagttcaggtgcttgctctggagcctggcaagaatccgcgggccgtccagacgaaacccgggattttcaagaccaacacaggaaccatcggcgccgtgtccctcgattttagccctgggacatctggatcccccattgtggacagaaaaggcaaggttgtcgggctgtacggaaatggcgtggtgacccgcagcggcgcttatgtctctgccatcgcgcagacagagaagtccatcgaagataaccctgagattgaagacgatatcttccggaaaaagagactcacgattatggacctgcatcccggggctggaaaaaccaagcgctaccttcctgccatcgtgcgggaggccattaaaagaggcctgcgcacactgatcctcgctccgacccgggttgtggccgctgaaatggaggaggccctgagagggcttcccattcgctatcaaacccctgcgatcaagacagaacacacgggacgggagatcgtcgacctgatgtgtcatgccaccttcacaatgagactcctgagccccgtgcgggttcctaactacaatctcattatcatggatgaagctcactttaccgaccccgcctccattgctgcccgcggctatatctctacaagagtggagatgggggaggccgctggcattttcatgaccgcgacgccgcctggaagccgggatccctttccccagtccaacgcccctatcatggacgaagaaagagaaatccccgagagaagctggaactctggccacgaatgggtcacagatttcaaggggaaaaccgtgtggtttgttccttccattaaggctggaaacgacatcgccgcctgcctgcggaaaaatggcaagaaagtgattcagcttagcagaaagaccttcgattctgagtacgtcaagacacgcgctaacgactgggattttgtggtgaccacagacatcagcgagatgggggccaatttcaaagcggaacgggtcattgatccgagacgctgtatgaagcccgttatcctgaccgacggagaggaacgggtgatcctggctggccctatgcccgtgacgcattcctctgccgcccaaagacgcgggcggattggcagaaaccctaaaaatgagaacgaccagtatatctacatgggagaacccctcgagaatgatgaggactgcgctcactggaaggaagccaaaatgctgcttgataacattaatacaccggagggcatcattcctagcatgtttgaacccgagcgcgaaaaggtcgacgcgatcgatggggagtacagactgcggggagaggcccgcaaaaccttcgtggacctcatgagacggggcgatctgcctgtttggctggcttataaggtggccgctgaagggattaactacgccgaccgcaagtggtgttttgatggaatcaaaaataaccagatcctcgaggaaaacatggaggtcgagatttggacaaaggaaggcgagcgcaagaaacttaaaccccggtggctggacgctagaatctattccgatcctctggccctcaaggagttcaaggagttcgcggccgggcgcaaatctctgacccttaatctgattacggaaatgggccggctccccacctttatgacacagaaggctagaaacgccctggacaatctggctgtgctccataccgccgaggccggaggccgcgcttacaaccacgcgcttagcgagctgccggaaacactggagaccctcctgcttctgacactcctggccaccgttacagggggaatcttcctgtttctcatgtccggcaaagggattggaaagatgacacttggcatgtgctgcatcatcaccgctagcattctgctgtggtatgcccaaatccagcctcactggattgccgcttctatcattctcgagttctttctgatcgtgcttctgatccccgagcccgaaaaacagcggacccctcaggataatcaactcacatacgtcgtgattgccatcctgaccgtcgtggcggccacaatggctaacgagatgggcttcctggagaagacgaagaaagacctcgggcttggatccattaccacacaggaaagcgagtccaatatcctggacattgatctgagaccggcctctgcttggaccctctatgccgttgcgacaacctttgtgacgcccatgctgcggcatagcatcgaaaactcctctgtgaatgtcagccttaccgccattgctaaccaggccacagttctgatgggcctcgggaagggatggcctctgtccaaaatggacatcggcgtgcccctgctcgctatcgggtgttacagccaggtgaatcctattacccttacagccgctctgctgctcctggtcgcccactacgcgatcattggacccggccttcaagccaaggctacccgcgaggcccagaaaagagctgccgccggcatcatgaagaaccctacggtggatgggattacagttatcgacctggaaccgatcccctatgatcctaagttcgagaaacagctcggacaggtgatgctgctgattctctgcgtcacccaagtgcttatgatgcggacaacctgggcgctgtgtgaggctctgaccctcgccacaggccccatctctacgctgtgggaagggaatcctggacgcttttggaacaccacaattgctgtctccatggccaatatcttcagaggcagctaccttgccggggctggactgctcttttctattatgaagaacaccacatccacccggcgcggcacgggcaatatcggggagacactgggagaaaaatggaaaagcagactgaacgccctcggcaaatctgagttccagatctataagaaaagcgggattcaggaggtggaccggacccttgcgaaggaaggaatcaagcgcggcgagaccgatcatcacgccgtttccagagggtctgctaaactgcggtggtttgtggaaagaaacatggtcacacccgagggaaaggtggttgacctgggctgcggccgcgggggatggagctactattgtggcgggctcaaaaatgtgcgggaagtcaagggactgaccaaaggcgggccgggacatgaggagcctattcccatgtccacatacggctggaaccttgtgagactgcaaagcggcgtggatgttttcttcacgccccctgaaaagtgcgacaccctcctgtgtgatatcggggagtcctctcccaatcctacaattgaagccggacgcaccctgcgggtcctcaaccttgtggagaattggctgaacaataacacacagttttgcatcaaggtgctgaatccgtatatgcccagcgtcatcgagaagatggaggctctccagagacagtacggcggggccctggttcgcaaccctctttccagaaattctacccacgagatgtactgggtgagcaacgcgacgggaaatattgtgtcctctgtcaacatgatcagcagaatgctgattaatcgcttcaccatgaagcacaaaaaggccacatatgaacccgacgtggatctcggctccgggacccggaacatcggaattgagagcgaaatccctaacctggacattatcggcaaaagaatcgagaagattaagcaagaacatgagatctcttggcactacgaccaggatcatccctataaaacatgggcttaccacggctcctatgagaccaagcagacagggagcgcctcttccatggttaatggagtggtccgcctgctcaccaaaccgtgggacgtggttcctatggtgacgcagatggctatgacagataccaccccctttggccaacagcgggtcttcaaggaaaaagtggacacaagaacgcaggagcctaaggaagggaccaagaaacttatgaagattacagccgagtggctgtggaaagagctgggaaagaaaaagacaccccgcatgtgtacaagagaagagtttacccggaaagtgcgcagcaacgctgccctcggcgcgatcttcacagatgaaaataagtggaagtctgccagagaggctgtcgaagacgggcggttttgggagctggttgatagagagcggaaccttcacctggaaggaaaatgcgagacctgtgtgtacaatatgatgggcaagcgcgagaagaagctcggcgagttcgggaaagccaagggatccagagctatttggtatatgtggctgggcgcccggtttctggagttcgaggccctcgggtttctgaacgaggaccattggttcagccgcggaaattcccttagcggcgtggaaggggagggcctgcacagactcggatacatcctgcgggatgtcggcaagaaagaagggggagcgatgtacgctgacgatacggccggctgggacacccgcatcacacttgaggacctgaagaacgaagagatggtgaccaatcatatgaaaggggagcacaagaaactcgccgaagctatttttaagctgacatatcagaacaaggttgtgagagtccaacggcctacaccccgcggaacggtgatggatatcatttctagacgggaccagcgcggcagcgggcaggttggcacatacggactgaataccttcacaaacatggaggcccaactcatcagacagatggaaggcgaggggattttcaaatccatccagcatctgaccgctacggaggaaatcgccgtgcagaattggcttgcgcgggtcggacgcgagagactgtctcggatggccattagcggcgatgactgcgtggttaagccgatcgatgacagatttgcttccgccctcaccgctctgaacgatatggggaaagtgcgcaaggacattcaacagtgggaaccttctcggggatggaatgattggacacaggtccccttctgcagccaccactttcatgagcttgtgatgaaagacggcagagtcctggtggttccctgtcgcaaccaggatgaactcatcgggcgggccagaatttcccaaggcgcgggatggtctctgaaggagaccgcctgcctgggcaagagctatgctcagatgtggacactcatgtacttccaccgccgggacctgagacttgccgctaacgccatctgttccgctgtgcctagccattgggtcccgacctctcgcacaacctggtccattcacgccaaacacgagtggatgacgacagaagatatgctggcggtgtggaatcgggtgtggatccaggagaacccctggatggaagacaagacccctgttgagagctgggaagaggtgccctatctcgggaaaagagaggaccagtggtgcggatctctgatcggccttacctcccgcgccacatgggctaagaatattcaagccgccatcaaccaggtccggagcctgattgggaatgaagagtacaccgattatatgccttccatgaaaagatttcggagagaagaggaagaggctggagtgctctggtga

SEQ ID NO: 19811 - RNA, 9876 nt, synthetic construct
  misc_feature 1..9876: note = derived and/or modified CDS sequence (opt5) from DENV-2__EU482756__SS-prME
  source 1..9876: mol_type = other RNA
accgccggcgtgatcgtcatgctgattcccacagctatggccttccacctcacgaccagaaatggggaacctcatatgatcgttggacggcaggaaaagggcaagagcctgctttttaagaccgaggacggggtgaatatgtgcaccctgatggcgattgatctcggagaactgtgtgaggacacaatcacctacaagtgcccccttctgcgccaaaatgaacccgaggatattgactgttggtgcaatagcacatctacctgggtgacgtatggcacctgtacaaccacaggggagcacagacgggaaaagcgcagcgtcgctctcgtgcctcatgttggaatgggcctggagaccagaacggaaacatggatgtcctctgagggcgcctggaaacacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaggaacaggacaaacgctttatctgcaagcattccatggtggatagaggctggggcaacgggtgtggactgttcggcaaagggggaattgtcacatgcgccatgtttacgtgcaaaaagaatatggaaggcaaagttgtgcagcctgagaacctcgaatacaccatcgtgattacaccccacagcggggaggagcatgcggtcggaaatgacaccggcaagcacggcaaagaaatcaagatcacacctcagtcttccattaccgaggccgaactgacggggtatggaaccgtgacaatggagtgtagcccccggaccggccttgatttcaacgaaatggttctgctccaaatggaggacaaggcttggctggtgcaccgccagtggtttcttgatctgccgctcccttggctgcccggggccgacacacagggatctaattggatccagaaggagaccctggtcacgttcaagaaccctcatgctaaaaagcaagacgtggttgtgctcggctcccaggaaggggccatgcacacagccctgaccggcgctacagagattcagatgagctccggaaatcttctgtttaccggccatctcaaatgcagactgcggatggataaacttcaactgaaagggatgtcttacagcatgtgtaccggaaagttcaagatcgtcaaagaaattgcggagacacagcacggcacgatcgtgatcagagtccagtatgagggggacggatccccctgcaagattcccttcgaaatcaccgatctcgagaaacgccatgtgctgggccggctgattacagttaaccctatcgtgaccgaaaaggacagcccggtcaacattgaggccgaacccccttttggggattcttacatcattatcggcgtggagcccggacagctcaaactgaattggttcaagaagggctccagcatcgggcaaatgtttgagacaaccatgagaggagctaaacgcatggccattcttggcgacacggcctgggatttcgggtctctgggaggcgtttttacaagcatcgggaaggctctccaccaggtgttcggcgccatttacggagcggctttttccggcgtctcttggaccatgaaaatcctgattggggtgatcatcacctggattggaatgaacagccggtccacaagcctgtctgtgtcccttgttctcgtcggcgtggtgaccctgtatctgggggccatggtccaggccgacagcggatgtgtggtttcttggaagaataaagaactcaagtgcggctccgggatcttcattacagataacgtgcacacgtggaccgagcagtacaagtttcaacctgaaagcccctccaaactggcttctgccatccagaaggctcatgaggaaggcatttgtggaatcagaagcgtcacacgccttgagaatctgatgtggaaacagatcaccccggagctcaaccacattctgtccgaaaatgaggtgaagctgacaatcatgaccggcgacattcgggggatcatgcaggccggaaaaagatctcttcgccctcaacccacggaactcaagtatagctggaaaacctggggcaaggcgaagatgctgtccacagagagccataaccagaccttcctgattgatgggcctgaaacagccgagtgccccaataccaaccgggcttggaactctctcgaggttgaagactacggatttggcgtgttcacaaccaacatctggctgaaacttagagagaagcaggacgtcttttgtgattccaaactgatgagcgccgctatcaaggacaatcgcgccgtgcacgcggatatgggctattggattgaatctgccctcaacgacacgtggaaaatggagaaggcttccttcatcgaggttaagagctgccactggcctaaatctcatacactgtggagcaatggggtgctggaatccgagatgattatccccaagaacttcgccggaccggtcagccagcacaactaccggcctggctatcatacccaaaccgctgggccctggcaccttggaaaactcgaaatggattttgacctgtgtgagggcacaaccgtggtggtcacggaagattgcgggaatagaggaccctctctgcggacaaccacagcctccggcaagctcattaccgagtggtgctgtcgcagctgcacactgcctccgcttagataccggggcgaggacgggtgttggtacggaatggaaatcagacccctgaaagagaaggaagagaacctcgttaattccctggtgaccgccggccatgggcagattgataacttctctctgggagtgcttggcatggctctctttctggaagagatgctgcgcacgcggatcgggaccaagtatgcgatcctcctggtcgccgtgagcttcgttacacttattaccggaaatatgtcctttagagacctgggccgcgtgatggtcatggtgggcgctacaatgaccgatgacatcgggatgggagttacgtacctcgccctgctggccgctttcaaagtgagacctacatttgccgcgggccttctgctccggaagctgacctctaaagagctcatgatggctacaattgggatcgccctgcttagccagtccaccattcccgaaaccatcctggagctcacagatgccctggctctgggaatgatggtccttaagatcgtgcgcaacatggaaaaatatcaactggccgttacgattatggcgatctcttgcgtgcctaatgctgtcattctccagaacgcctggaaggtgagctgtaccatcctggccgctgtgtccgtcagccccctcctgcttacatcttcccagcagaaggccgactggattcctctggctctcaccatcaaaggcctgaatcccacagccatcttcctgaccacgcttagcagaacatctaagaaacggtcctggccgctgaacgaggcgattatggccgttgggatggtgagcatcctcgcttcttccctgctcaagaatgacattcctatgaccggacccctggtggccggcggccttctgaccgtctgctacgtgctgacagggcgcagcgctgatctcgaactggagagagccgccgacgttaaatgggaggatcaagctgaaatctccggaagctctcctattcttagcatcaccatttccgaggacggctctatgagcatcaagaacgaagaggaggaacagacactgacgatcctcattcggaccgggctgctcgtgatctccggagtctttcccgtgtctattccgatcacagcggccgcttggtatctgtgggaggttaaaaagcagcgcgccggcgtgctttgggatgtcccttctccccctcccgtggaaaaggccgagctggaagacggggcttacagaattaaacagcggggaatcctgggctattcccaaatcggcgccggggtctacaaggagggaaccttccacacaatgtggcacgtgacccgcggcgcggttctcatgcatagagggaaacggattgagccctcctgggctgatgtgaagaaagacctgatcagctacggaggcgggtggaaacttgaaggagagtggaaggaaggcgaggaagtccaggtgctggccctcgagcctggcaaaaatccgagagccgttcagacgaagcccgggatttttaaaaccaacacaggaaccatcggcgctgtgtccctggatttcagccctgggacatctggatcccccattgtcgaccgcaagggcaaagtggtggggctctatggaaatggcgttgtcacccggagcggcgcctacgtgtctgcgatcgctcagacagagaagtccatcgaagataaccctgagattgaagacgatatctttagaaagaaacgcctgacgattatggaccttcaccccggggccggaaagaccaaacggtatctgcctgccatcgtgagagaggctattaagcgcggcctgcggacactcatcctggccccgaccagagtcgtggctgccgaaatggaggaggcgcttcgcgggctgcccattcggtaccaaaccacagccatcaaaacggaacataccggaagagagatcgttgacctcatgtgtcacgctacattcaccatgcggctgctcagccctgtgcgcgtccccaactataatctgattatcatggatgaagcccatttcacagaccctgcttccattgccgccagaggctacatctctacccgggtggagatgggggaggctgcgggcatttttatgacggccacacccccgggaagccgcgatcctttcccccagtccaacgctcccatcatggacgaagagagagaaatccctgagcggagctggaactctggccacgaatgggttaccgattttaaggggaagaccgtgtggttcgtcccctccattaaagccggaaacgacatcgccgcttgccttagaaagaatggcaaaaaggtgattcagctgagccgcaaaacatttgattctgagtatgttaagacccgggccaacgactgggatttcgtggtcacaaccgacatcagcgagatgggggcgaattttaaggctgaaagagtgattgatcctcgccggtgtatgaaaccggtgatcctgacggacggagaggaaagagtcatcctcgccggccccatgcctgttacacactcctctgccgctcaacgccgggggagaattggccgcaaccccaagaatgagaacgaccagtacatctacatgggagaacctctggagaatgatgaggactgcgcccattggaaagaagcgaagatgcttctggataacattaatacccccgagggcatcattccgagcatgttcgaacctgagagagaaaaagtggacgccatcgatggggagtatcggctccgcggagaggctagaaagacatttgtggacctgatgcggcgcggcgatctgcccgtctggctcgcctacaaagtggctgccgaagggattaactatgctgacagaaagtggtgtttcgatggaatcaagaataaccagatccttgaggaaaacatggaggttgagatttggaccaaagaaggcgagcggaagaaactgaagcctagatggctggacgcccgcatctactccgatcccctcgcgctgaaagaatttaaggagttcgccgctgggcggaagtctcttacgctgaatctcattaccgaaatgggcagactgcctacattcatgacccagaaagcccgcaacgctctggacaatctcgccgtgcttcacacagccgaggctggaggccgggcgtataaccatgccctgagcgagctgcccgaaaccctcgagacactgcttctgctcaccctgctggctacggtcacagggggaatctttctcttccttatgtccggcaaggggattggaaaaatgaccctgggcatgtgctgcatcatcaccgccagcattctgctctggtacgcccaaatccagccgcactggattgctgcctctatcattctggaatttttccttatcgtgctgctcatccctgagcccgaaaagcagagaacaccccaggataatcaactgacctatgttgtgattgcgatcctgacagtcgtggccgctacgatggccaacgagatgggctttctcgagaaaaccaagaaggaccttgggctgggatccattacaacccaggaaagcgagtccaatatcctggacattgatctccggcctgcttctgcctggacactgtacgcggtcgccaccacgttcgtgaccccgatgcttcgccacagcatcgaaaactcctctgttaatgtgagcctgacagctattgccaaccaggctaccgtgctcatgggcctggggaaaggatggcccctgtccaagatggacatcggcgtccctctccttgccatcgggtgttacagccaggttaatcccattacactgaccgctgccctgctcctgcttgtggcgcattatgccatcattggacctggcctgcaagctaaagccacgagagaggctcagaagcgggccgccgcgggcatcatgaaaaaccccacagtggatgggattaccgtcatcgacctcgaacctatcccgtacgatcccaagtttgagaagcagctgggacaggtgatgctgctcattctttgcgttacacaagtgctgatgatgcgcaccacctgggctctgtgtgaggccctcacactggctacgggccctatctctaccctttgggaagggaatcccggaagattctggaacacaaccattgccgtctccatggccaatatctttcggggcagctatctggctggggccggactcctgttctctattatgaaaaacacaaccaatacgcgcagaggcacaggcaacatcggggagaccctgggagaaaagtggaaatcccggctcaacgcgcttggcaagagcgagtttcagatctacaaaaagtctgggattcaggaggtggaccgcaccctggccaaagaaggaatcaagagaggcgagacagatcaccatgctgtcagccgggggtccgccaagctgagatggttcgtggaacgcaatatggttacccctgagggaaaagtggtcgacctcggctgcggcagagggggatggtcttattactgtggcgggctgaagaacgtgcgggaagttaaaggacttacaaagggcgggcccggacacgaggagccgattcctatgagcacgtatggctggaatctggtgcgcctccaatccggcgtcgatgtgtttttcacaccgcccgaaaaatgcgacacactgctgtgtgatatcggggagagctcccctaaccccaccattgaagctggacggacactcagagtgcttaatctggttgagaactggctgaataacaatacccagttctgcatcaaggtcctcaacccttacatgccgtctgtgatcgaaaagatggaggccctgcagcgcaaatacggcggggcgcttgtgcggaatcccctgagcagaaactccacgcatgagatgtattgggtctctaatgccaccggaaacattgttagctccgtgaatatgatctctcgcatgctcattaaccggtttacaatgaagcacaaaaaggctacctacgaacctgacgtggatctgggcagcgggacaagaaacatcggaattgagtccgaaatccccaatctggacattatcggcaaacgcatcgagaagattaagcaggaacacgagaccagctggcattatgaccaagatcacccttacaaaacatgggcctatcatggctcttacgagaccaagcagacggggtccgctagctctatggtcaacggagtggttcggctccttacaaaaccctgggacgtggtcccgatggtgacccagatggccatgaccgatacaacgcctttcggccagcaaagagtttttaaggaaaaagtggacacccgcacacaggagcccaaggaagggaccaagaaactgatgaagatcacagctgagtggctgtggaaagagctcggaaagaaaaagacccctagaatgtgtacacgggaagagttcacccgcaaagtcagatccaatgccgcgctgggcgccatttttacggatgaaaacaagtggaaaagcgctcgggaggccgtggaagacgggagattctgggagcttgtggatcgggagcgcaatctgcacctcgaaggaaaatgcgagacctgtgtctataacatgatgggcaagagagagaagaagctgggcgagtttgggaaagctaagggatctcgggccatctggtacatgtggctgggcgcccgcttcctcgaatttgaggcgctggggttccttaatgaggaccactggttttccagaggaaacagcctgtccggcgttgaaggggagggcctccatcggctgggatacattcttcgcgatgtgggcaagaaagaagggggagctatgtatgccgacgatacagccggctgggacaccagaatcacactggaggacctcaagaatgaagagatggtgaccaaccacatgaaaggggagcataagaaactggctgaagccatcttcaagctgacgtaccagaataaggtcgtgcgggttcagcgccccacacctagaggaaccgtgatggatattatcagccggcgcgaccaaagaggctctgggcaggtcggcacatatggactcaacacctttacgaatatggaggctcagctgattcggcaaatggaaggcgaggggatcttcaaaagcattcagcaccttaccgccacagaggaaatcgcggtgcagaactggctggcccgcgttggaagagagcggctctccagaatggctatctctggcgatgactgcgtggtcaagcccattgatgaccgcttcgccagcgctctgaccgcccttaatgatatggggaaagtgcggaaggacatccagcaatgggaaccgtccagaggatggaacgattggacacaggttcctttttgctctcatcacttccacgagctggtgatgaaagacggccgcgtcctcgtggtcccctgtcggaaccaggatgaactgattgggagagcgcgcatcagccagggcgccggatggtccctgaaggagaccgcttgcctcggcaagtcttacgcccaaatgtggacactgatgtattttcatcggagagaccttcgcctggctgccaatgctatttgtagcgccgtgccctcccactgggttcctaccagccggacgacatggtctatccatgcgaaacacgagtggatgaccaccgaagatatgctcgccgtgtggaacagagtctggattcaggagaatccgtggatggaagacaagacacccgtggagtcctgggaagaggtgccttacctggggaaacgcgaggaccagtggtgcggaagccttatcggcctgacctctcgggctacatgggccaagaacatccagacggccattaatcaagttagatccctcatcgggaacgaagagtataccgattacatgcccagcatgaaacggttcagacgcgaagaggaagaggctggagtgctgtggtga

SEQ ID NO: 19812 - RNA, 9876 nt, synthetic construct
  misc_feature 1..9876: note = derived and/or modified CDS sequence (opt5) from DENV-2__EU482757__SS-prME
  source 1..9876: mol_type = other RNA
acagccggagtgatcgtcatgctgattcccacggctatggccttccacctcacgacccggaatggggagcctcatatgatcgttggacggcaggaaaagggcaaaagcctgctttttaagacagaggacggggtgaatatgtgcaccctgatggcgattgatctcggagaactgtgtgaggacacaatcacctacaaatgcccgcttctgcgccaaaatgaacccgaggatattgactgttggtgcaatagcacatctacctgggtgacgtatggcacctgtacaaccacaggggagcacagacgggaaaagcgcagcgtcgctctcgtgcctcatgttggaatgggcctggagaccagaacggaaacatggatgtcctctgagggcgcctggaaacacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaagaacaggacaaacgctttatctgcaagcattccatggtggatagaggctggggcaacgggtgtggactgttcggcaaagggggaattgtcacatgcgccatgtttacgtgcaaaaagaatatggaaggcaaagttgtgcagcctgagaacctcgaatacaccatcgtgattacaccccacagcggggaggagcatgcggtcggaaatgacaccggcaagcacggcaaagaaatcaagatcacacctcagtcttccattaccgaggccgaactgacggggtatggaaccgtgacaatggagtgtagcccccggaccggccttgatttcaacgaaatggttctgctccaaatggaggacaaggcttggctggtgcaccgccagtggtttcttgatctgccgctcccttggctgcccggggccgacacacagggatctaattggatccagaaggagaccctggtcacgttcaagaaccctcatgctaaaaagcaagacgtggttgtgctcggctcccaggaaggggccatgcacacagccctgaccggcgctacagagattcagatgagctccggaaatcttctgtttaccggccatctcaaatgcagactgcggatggataaacttcaactgaaagggatgtcttacagcatgtgtaccggaaagttcaagatcgtcaaagaaattgcggagacacagcacggcacgatcgtgatcagagtccagtatgagggggacggatccccctgcaagattcccttcgaaatcaccgatctcgagaaacgccatgtgctgggccggctgattacagttaaccctatcgtgaccgaaaaggacagcccggtcaacattgaggccgaacccccttttggggattcttacatcattatcggcgtggagcccggacagctcaaactgaattggttcaagaagggctccagcatcgggcaaatgtttgagacaaccatgagaggagctaaacgcatggccattcttggcgacacggcctgggatttcgggtctctgggaggcgtttttacaagcatcgggaaggctctccaccaggtgttcggcgccatttacggagcggctttttccggcgtctcttggaccatgaaaatcctgattggggtgatcatcacctggattggaatgaacagccggtccacaagcctgtctgtgtcccttgttctcgtcggcgtggtgaccctgtatctgggggccatggtccaggccgacagcggatgtgtggtttcttggaagaataaagaactcaagtgcggctccgggatcttcattacagataacgtgcacacgtggaccgagcagtacaagtttcaacctgaaagcccctccaaactggcttctgccatccagaaggctcatgaggaaggcatttgtggaatcagaagcgtcacacgccttgagaatctgatgtggaaacagatcaccccggagctcaaccacattctgtccgaaaatgaggtgaagctgacaatcatgaccggcgacattaaagggatcatgcaggccggaaagcggtctcttagacctcaacccacggaactcaaatatagctggaagacctggggcaaggcgaaaatgctgtccacagagagccataaccagaccttcctgattgatgggcctgaaacagccgagtgccccaataccaaccgcgcttggaactctctcgaggttgaagactacggatttggcgtgttcacaaccaacatctggctgaaacttcgggagaaacaggacgtcttttgtgattccaagctgatgagcgccgctatcaaagacaatagagccgtgcacgcggatatgggctattggattgaatctgccctcaacgacacgtggaagatggagaaggcttccttcatcgaggttaaaagctgccactggcctaagtctcatacactgtggagcaatggggtgctggaatccgagatgattatccccaaaaacttcgccggaccggtcagccagcacaactaccgccctggctatcatacccaaaccgctgggccctggcaccttggaaagctcgaaatggattttgacctgtgtgagggcacaaccgtggtggtcacggaagattgcgggaatcggggaccctctctgagaacaaccacagcctccggcaaactcattaccgagtggtgctgtcggagctgcacactgcctccgcttcgctacagaggcgaggacgggtgttggtacggaatggaaatccggcccctgaaggagaaggaagagaacctcgttaattccctggtgaccgccggccatgggcagattgataacttctctctgggagtgcttggcatggctctctttctggaagagatgctgagaacgcgcatcgggaccaaacacgcgatcctcctggtcgccgtgagcttcgttacacttattaccggaaatatgtcctttcgggacctgggcagagtgatggtcatggtgggcgctacaatgaccgatgacatcgggatgggagttacgtatctcgccctgctggccgctttcaaggtgcgccctacatttgccgcgggccttctgctcagaaaactgacctctaaggagctcatgatggctacaattgggatcgccctgcttagccagtccaccattcccgaaaccatcctggagctcacagatgccctggctctgggaatgatggtccttaaaatcgtgcggaacatggaaaagtaccaactggccgttacgattatggcgatctcttgcgtgcctaatgctgtcattctccagaacgcctggaaggtgagctgtaccatcctggccgctgtgtccgtcagccccctcctgcttacatcttcccagcagaaagccgactggattcctctggctctcaccatcaagggcctgaatcccacagccatcttcctgaccacgcttagccgcacatctaaaaagagatcctggccgctgaacgaggcgattatggccgttgggatggtgagcatcctcgcttcttccctgctcaaaaatgacattcctatgaccggacccctggtggccggcggccttctgaccgtctgctatgtgctgacagggcggagcgctgatctcgaactggagcgcgccgccgacgttaagtgggaggatcaagctgaaatctccggaagctctcctattcttagcatcaccatttccgaggacggctctatgagcatcaaaaacgaagaggaggaacagacactgacgatcctcattagaaccgggctgctcgtgatctccggagtctttcccgtgtctattccgatcacagcggccgcttggtacctgtgggaggttaagaagcagcgggccggcgtgctttgggatgtcccttctccccctcccgtggaaaaagccgagctggaagacggggcttatcgcattaagcagagaggaatcctgggctactcccaaatcggcgccggggtctataaagagggaaccttccacacaatgtggcatgtgacccggggcgcggttctcatgcaccgcgggaagagaattgagccctcctgggctgatgtgaaaaaggacctgatcagctacggaggcgggtggaaacttgaaggagagtggaaagaaggcgaggaagtccaggtgctggccctcgagcctggcaagaatccgcgggccgttcagacgaaacccgggatttttaagaccaacacaggaaccatcggcgctgtgtccctggatttcagccctgggacatctggatcccccattgtcgacagaaaaggcaaggtggtggggctctacggaaatggcgttgtcacccgcagcggcgcctatgtgtctgcgatcgctcagacagagaagtccatcgaagataaccctgagattgaagacgatatctttcggaaaaagagactgacgattatggaccttcatcccggggccggaaaaaccaagcgctacctgcctgccatcgtgcgggaggctattaaaagaggcctgcgcacactcatcctggccccgacccgggtcgtggctgccgaaatggaggaggcgcttagagggctgcccattcgctatcaaacccctgccatcaagacagaacacacgggacgggagatcgttgacctcatgtgtcatgctaccttcacaatgagactgctcagccccgtgcgggtccctaactacaatctgattatcatggatgaagcccacttcaccgaccccgcttccattgccgcccgcggctatatctctacaagagtggagatgggggaggctgcgggcatttttatgaccgccacgccgcctggaagccgggatcccttcccccagtccaacgctcctatcatggacgaagagagagaaatccccgagagaagctggaactctggccacgaatgggttacagattttaaggggaaaaccgtgtggttcgtcccttccattaaggccggaaacgacatcgccgcttgccttcggaaaaatggcaagaaagtgattcagctgagcagaaagacctttgattctgagtacgttaagacacgcgccaacgactgggatttcgtggtcaccacagacatcagcgagatgggggcgaattttaaagctgaacgggtgattgatccgagacgctgtatgaagcccgtgatcctgaccgacggagaggaacgggtcatcctcgccggccctatgcccgttacgcattcctctgccgctcaaagacgcgggcggattggcagaaaccctaaaaatgagaacgaccagtatatctacatgggagaacccctggagaatgatgaggactgcgcccactggaaggaagcgaaaatgcttctggataacattaatacaccggagggcatcattcctagcatgttcgaacccgagcgcgaaaaggtggacgccatcgatggggagtacagactccggggagaggctcgcaaaacctttgtggacctgatgagacggggcgatctgcctgtctggctcgcctataaggtggctgccgaagggattaactacgctgaccgcaagtggtgtttcgatggaatcaaaaataaccagatccttgaggaaaacatggaggttgagatttggacaaaggaaggcgagcgcaagaagctgaaaccccggtggctggacgccagaatctattccgatcctctcgcgctgaaggaatttaaggagttcgccgctgggcgcaaatctcttaccctgaatctcattacggaaatgggccggctgcccaccttcatgacacagaaggccagaaacgctctggacaatctcgccgtgcttcataccgccgaggctggaggccgcgcgtacaaccacgccctgagcgagctgccggaaacactcgagaccctgcttctgctcacactgctggctaccgtcacagggggaatctttctcttccttatgtccggcaaagggattggaaagatgacactgggcatgtgctgcatcatcaccgccagcattctgctctggtatgcccaaatccagcctcactggattgctgcctctatcattctggaatttttccttatcgtgctgctcatccccgagcccgaaaaacagcggacccctcaggataatcaactgacatacgttgtgattgcgatcctgaccgtcgtggccgctacaatggccaacgagatgggctttctcgagaagacgaagaaagaccttgggctgggatccattaccacacaggaaagcgagtccaatatcctggacattgatctcagaccggcttctgcctggaccctgtatgcggtcgccacaaccttcgtgacgcccatgcttcggcatagcatcgaaaactcctctgttaatgtgagcctgaccgctattgccaaccaggctacagtgctcatgggcctggggaagggatggcctctgtccaaaatggacatcggcgtccccctccttgccatcgggtgttacagccaggttaatcctattaccctgacagctgccctgctcctgcttgtggcgcactacgccatcattggacccggcctgcaagctaaggccacccgcgaggctcagaaaagagccgccgcgggcatcatgaagaaccctacggtggatgggattacagtcatcgacctcgaaccgatcccctatgatcctaagtttgagaaacagctgggacaggtgatgctgctcattctttgcgttacccaagtgctgatgatgcggacaacctgggctctgtgtgaggccctcaccctggctacaggccccatctctacgctttgggaagggaatcctggacgcttctggaacaccacaattgccgtctccatggccaatatctttagaggcagctacctggctggggccggactcctgttctctattatgaagaacaccacatccacccggcgcggcacgggcaatatcggggagacactgggagaaaaatggaaaagcagactcaacgcgcttggcaaatctgagtttcagatctataagaaaagcgggattcaggaggtggaccggaccctggccaaggaaggaatcaagcgcggcgagaccgatcatcacgctgtctccagagggtctgccaaactgcggtggttcgtggaaagaaacatggttacacccgagggaaaggtggtcgacctcggctgcggccgcgggggatggagctactattgtggcgggctgaaaaatgtgcgggaagttaagggacttaccaaaggcgggccgggacatgaggagcctattcccatgtccacatacggctggaacctggtgagactccaaagcggcgtcgatgtgtttttcacgccccctgaaaagtgcgacaccctgctgtgtgatatcggggagtcctctcccaatcctacaattgaagctggacgcaccctccgggtgcttaacctggttgagaattggctgaacaataacacacagttctgcatcaaggtcctcaatccgtatatgcccagcgtgatcgagaagatggaggccctgcagagaaagtacggcggggcgcttgtgcgcaaccctctgtccagaaattctacccacgagatgtactgggtcagcaacgccacgggaaatattgtttcctctgtgaacatgatcagcagaatgctcattaatcgctttaccatgaaacacaagaaagctacatatgaacccgacgtggatctgggctccgggacccggaacatcggaattgagagcgaaatccctaacctggacattatcggcaagagaatcgagaagattaaacaggaacatgagacatcttggcactacgaccaagatcatccctataagacctgggcctaccacggctcctatgagacaaaacagaccgggagcgcttcttccatggtcaatggagtggttcgcctccttacgaagccgtgggacgtggtccctatggtgacacagatggccatgaccgataccacacccttcggccagcaacgggtttttaaagaaaaggtggacacgagaacccaggagcctaaggaagggaccaagaagctgatgaaaatcaccgctgagtggctgtggaaggagctcggcaagaagaaaacaccccgcatgtgtaccagagaagagttcacacggaaggtccgcagcaacgccgcgctgggcgccatttttaccgatgaaaataagtggaaatctgctagagaggccgtggaagacgggcggttctgggagcttgtggatagagagcggaacctgcacctcgaaggaaagtgcgagacgtgtgtctacaatatgatgggcaaacgcgaaaagaaactgggcgagtttgggaaggctaagggatccagagccatctggtatatgtggctgggcgcccggttcctcgaatttgaggcgctggggttccttaacgaggaccattggtttagccgcggaaattccctgagcggcgttgaaggggagggcctccacagactgggatacattcttcgggatgtgtctaaaaaggaaggcggggctatgtacgccgacgataccgccggatgggacacacgcatcaccctggaggacctcaaaaacgaagagatggtgacaaatcatatgaagggcgagcacaaaaagctggctgaagccatcttcaagctgacctatcagaacaaagtcgtgagagttcagcggcctacgccccgcgggacagtgatggatattatcagcagacgggaccaacgcggatccggccaggtcgggacctacggcctcaatacatttaccaacatggaggctcagctgattagacaaatggaaggagagggcatcttcaagtctattcagcatcttacggccaccgaggaaatcgtggttcagaattggctggcgcgggtggggcgcgagagactcagccggatggccatctccggagatgactgcgtcgtgaaaccgattgatgacagattcgcttctgccctgacagctcttaacgatatgggcaaggttcgcaaagacatccagcaatgggaacctagccgggggtggaatgattggacccaggtgcccttttgctcccaccacttccatgagctggtcatgaaggacggaagagtgctcgtcgtgccctgtcgcaaccaggatgaactgattggccgggccagaatctctcagggggcgggctggagcctgaaggagacagcctgcctcggaaaatcctatgctcaaatgtggaccctgatgtactttcaccgccgggaccttagactggccgctaacgccatttgtagcgctgttccttctcattgggtgccgacatcccgcaccacgtggagcatccacgccaagcacgagtggatgacaaccgaagatatgctcgcggtctggaatcgggtgtggattcaggagaacccctggatggaagacaaaacccctgtggagtcttgggaagaggttccctatctgggcaagagagaggaccagtggtgcgggtcccttatcggactgacaagccgcgccacctgggctaaaaatatccagacagccattaaccaagtgcggtccctcatcggcaatgaagagtacacggattatatgccttctatgaagagattccggagagaagaggaagaggccggggtcctgtggtga

SEQ ID NO: 19813 - RNA, 9876 nt, synthetic construct
  misc_feature 1..9876: note = derived and/or modified CDS sequence (opt5) from DENV-2__FJ906956__SS-prME
  source 1..9876: mol_type = other RNA
accgccggcgtgatcgtcatgctgattcccacagctatggccttccacctcacgacccggaatggggagcctcatatgatcgttggaaagcaggaaaagggcaagagcctgctttttaagacagaggacggggtgaatatgtgcaccctgatggcgattgatctcggagaactgtgtgaggacacaatcacctacaagtgcccgcttctgcggcaaaatgaacccgaggatattgactgttggtgcaattccacatctacctgggtgacgtatggcacctgtacaaccacaggggagcaccgcagagaaaagcggagcgtcgctctcgtgcctcatgttggaatgggcctggagacccgcacggaaacatggatgtcctctgagggcgcctggaagcacgtgcagagaatcgagacctggatcctgcggcatcccgggttcacaattatggccgctatcctcgcctacaccattggaaccacacactttcagcgcgctctgatcttcattcttctgacggccgtcgcgcctagcatgaccatgagatgcatcggcatttccaaccgggattttgtggaaggggtttctggaggcagctgggtggacatcgtcctcgagcacgggtcctgtgtgacaaccatggccaagaataagcccacactggatttcgaacttatcaagaccgaggctaaacagcctgccacgctgcgcaagtattgcattgaagctaaactcacaaacaccaccacagagagcagatgtccgacccaaggagagccctctctgaatgaagaacaggacaagcggtttatctgcaagcattccatggtggatcgcggctggggcaacgggtgtggactgttcggcaaagggggaattgtcacatgcgccatgtttacgtgcaagaaaaatatggaaggcaaggttgtgcagcctgagaacctcgaatacaccatcgtgattacaccccacagcggggaggagcatgcggtcggaaatgacaccggcaaacacggcaaggaaatcaaaatcacacctcagtcttccattaccgaggccgaactgacggggtatggaaccgtgacaatggagtgtagccccagaaccggccttgatttcaacgaaatggttctgctccaaatggaggacaaggcttggctggtgcaccggcagtggtttcttgatctgccgctcccttggctgcccggggccgacacacagggatctaattggatccagaaggagaccctggtcacgttcaaaaaccctcatgctaagaaacaagacgtggttgtgctcggctcccaggaaggggccatgcacacagccctgaccggcgctacagagattcagatgagctccggaaatcttctgtttaccggccatctcaagtgccgcctgagaatggataaacttcaactgaaggggatgtcttacagcatgtgtaccggaaagttcaaaatcgtcaaggaaattgcggagacacagcacggcacgatcgtgatccgggtccagtatgagggggacggatccccctgcaaaattcccttcgaaatcaccgatctcgagaagagacatgtgctgggccgcctgattacagttaaccctatcgtgaccgggaaagacagcccggtcaacattgaagccgagcccccttttggcgattcttacatcattatcggagtggaacccggccagctcaagctgaattggttcaagaaagggtccagcatcggacaaatgtttgagacaaccatgcggggcgctaagagaatggccattcttggggacacggcctgggatttcggatctctgggcggggtttttacaagcatcggcaaagctctccaccaggtgttcggagccatttacggcgcggctttttccggggtctcttggaccatgaagatcctgattggagtgatcatcacctggattggcatgaacagccgctccacaagcctgtctgtgtcccttgttctcgtcggggtggtgaccctgtatctgggagccatggtccaggccgacagcggctgtgtggtttcttggaaaaataaggagctcaagtgcgggtccggcatcttcattacagataacgtgcacacgtggaccgaacagtacaaatttcaacctgagagcccctccaagctggcttctgccatccagaaagctcatgaagagggaatttgtggcatccggagcgtcacaagacttgaaaatctgatgtggaagcagatcaccccggagctcaaccacattctgtccgagaatgaagtgaaactgacaatcatgaccggggacattcgcggaatcatgcaggccggcaagcggtctcttagacctcaacccacggagctcaaatatagctggaagacctgggggaaggcgaaaatgctgtccacagaaagccataaccagaccttcctgattgatggacctgagacagccgaatgccccaataccaaccgcgcttggaactctctcgaggttgaggactacggctttggcgtgttcacaaccaacatctggctgaaacttcgggaaaaacaggacgtcttttgtgattccaagctgatgagcgccgctatcaaagacaatagagccgtgcacgcggatatggggtattggattgagtctgccctcaacgacacgtggaagatggaaaaggcttccttcatcgaggttaaaagctgccactggcctaagtctcatacactgtggagcaatggagtgctggagtccgaaatggtcattcccaaaaacttcgccggcccggtgagccagcacaactaccgccctgggtatcatacccaaaccgctggaccctggcaccttggcaagctcgagatggattttgacctgtgtgaagggacaaccgtggtcgttacggaggattgcggaaatcggggcccctctctgagaacaaccacagcctccggcaaactcatcaccgaatggtgctgtcggagctgcacactgcctccgcttcgctacagaggggaggacggatgttggtacggcatggagattcggcccctgaaggaaaaggaggaaaacctcgtgaatagcctggtgaccgccgggcatggacagatcgataacttctctctgggcgtccttgggatggctctctttctggaggaaatgctgagaacgcgcattggaaccaaacacgcgatcctcctggtggccgttagcttcgtgacacttatcaccggcaatatgtcctttcgggacctgggcagagtcatggtgatggttggggctacaatgaccgatgacattggaatgggcgtgacgtatctcgccctgctggccgctttcaaggtccgccctacatttgccgcggggcttctgctcagaaaactgacctctaaggagctcatgatggctacaatcggaattgccctgcttagccagtccaccatccccgagaccattctggaactcacagatgccctggctctgggcatgatggtgcttaaaatcgttcggaacatggagaagtaccaactggccgtgacgatcatggcgatttcttgcgtccctaatgctgtgatcctccagaacgcctggaaggtgagctgtaccattctggccgctgtctccgttagccccctcctgcttacatcttcccagcagaaagccgactggatccctctggctctcaccattaaggggctgaatcccacagccatcttcctgaccacgcttagccgcacatctaaaaagagatcctggccgctgaacgaagcgatcatggccgtgggaatggtgagcattctcgcttcttccctgctcaaaaatgacatccctatgaccggccccctggtcgccggcgggcttctgaccgtgtgctatgttctgacaggacggagcgctgatctcgagctggaacgcgccgccgacgtgaagtgggaggatcaagctgagatttccggcagctctcctatccttagcattaccatctccgaagacgggtctatgagcattaaaaacgaggaagaggagcagacactgacgatcctcatcagaaccggactgctcgtcatttccggcgtgtttcccgtttctatcccgattacagcggccgcttggtacctgtgggaagtgaagaagcagcgggccggggtcctttgggatgtgccttctccccctcccgtcgagaaagccgaactggaggacggagcttatcgcatcaagcagagaggcattctgggctactcccaaatcggggccggagtgtataaagaaggcaccttccacacaatgtggcatgttaccagaggggcggtgctcatgcaccgcggaaagagaatcgagccctcctgggctgatgtcaaaaaggacctgattagctacggcgggggatggaaacttgagggcgaatggaaagagggcgaagaggtgcaggttctggccctcgaacctgggaagaatccgcgggccgtgcagacgaaacccggaatctttaagaccaacacaggcaccattggggctgtctccctggatttcagccctggaacatctggctcccccatcgtggacagaaaagggaaggtggttggactctacggcaatggcgtcgtgacccgcagcggggcctatgtgtctgcgattgctcagacagagaagtccatcgaggataaccctgaaatcgaggacgatatttttcggaaaaagagactgacgatcatggaccttcatcccggagccggcaaaaccaagcgctacctgcctgccattgtccgggaagctatcaaaagagggctgcgcacactcattctggccccgacccgggtggttgctgccgagatggaagaggcgcttagaggactgcccatccgctatcaaaccacagccattaagacggagcacaccggccgggaaatcgtggacctcatgtgtcatgctacattcaccatgagactgctcagccctgtccgggtgcccaactacaatctgatcattatggatgaggcccacttcacagaccctgcttccatcgccgcccgcgggtatatttctaccagagttgaaatgggcgaggctgcgggaatctttatgacggccacacccccgggcagccgggatcctttcccccagtccaacgctcccattatggacgaggaacgcgagatccctgaaagaagctggaactctgggcacgagtgggtgaccgattttaagggaaaaaccgtctggttcgtgccctccatcaaggccggcaacgacattgccgcttgccttcggaaaaatgggaagagagttatccagctgagccgcaaaacatttgattctgaatacgtgaagacccgggccaacgactgggatttcgtcgtgacaaccgacattagcgagatgggagcgaattttaaggctgagagagtgatcgatcctcgccggtgtatgaaaccggtcattctgacggacggcgaagagagagttatcctcgccgggcccatgcctgtgacacattcctctgccgctcaacgccggggcagaatcggacgcaaccccaagaatgaaaacgaccagtatatttacatgggcgagcctctggaaaatgatgaggactgcgcccactggaaagaggcgaagatgcttctggataacatcaatacccccgaagggattatcccgagcatgttcgagcctgaaagagagaaagtggacgccattgatggagaataccggctccgcggcgaggctagaaagacatttgtcgacctgatgcggcgcggggatctgcccgtgtggctcgcctataaagttgctgccgagggaatcaactacgctgacagaaagtggtgtttcgatggcattaagaataaccagatccttgaagagaacatggaagtggagatctggaccaaagagggggaacggaagaaactgaagcctagatggctggacgcccgcatttattccgatcccctcgcgctgaaagagtttaaggagttcgccgctggccggaagtctcttacgctgaatctcatcaccgagatgggaagactgcctacattcatgacccagaaagcccgcaacgctctggacaatctcgccgtccttcatacagccgaagctggcgggcgggcgtacaaccacgccctgagcgagctgcccgagaccctcgaaacactgcttctgctcaccctgctggctacggtgacaggaggcatttttctcttccttatgtccgggaagggaatcggcaaaatgaccctgggcatgtgctgcattatcaccgccagcatcctgctctggtatgcccaaattcagccgcactggatcgctgcctctattatcctggagtttttccttattgttctgctcatccctgaacccgagaagcagagaacaccccaggataatcaactgacctacgtggtcatcgcgattctgacagtggtcgccgctacgatggccaacgaaatggggtttctcgagaaaaccaagaaggaccttggactgggctccatcacaacccaggagagcgaatccaatattctggacatcgatctccggcctgcttctgcctggacactgtatgcggtggccaccacgttcgttaccccgatgcttcgccatagcattgagaactcctctgtgaatgtgagcctgacagctatcgccaaccaggctaccgtcctcatggggctgggaaaaggctggcccctgtccaagatggacattggggttcctctccttgccatcggatgttacagccaggtgaatcccatcacactgaccgctgccctgctcctgcttgtggcgcactacgccattatcggccctggcctgcaagctaaagccacgagagaagctcagaagcgggccgccgcggggattatgaaaaaccccacagtcgatggaatcaccgtgattgacctcgagcctatcccgtatgatcccaagtttgaaaagcagctgggccaggttatgctgctcatcctttgcgtgacacaagtcctgatgatgcgcaccacctgggctctgtgtgaggccctcacactggctacggggcctatttctaccctttgggagggaaatcccggcagattctggaacacaaccatcgccgtgtccatggccaatatttttcgggggagctacctggctggagccggcctcctgttctctatcatgaaaaacacaaccaatacgcgcagaggcacagggaacattggagaaaccctgggcgagaagtggaaatcccggctcaacgcgcttggaaagagcgaatttcagatctataaaaagtctggaatccaggaggtcgaccgcaccctggccaaagagggcattaagagaggggaaacagatcatcacgctgtgagccggggatccgccaagctgagatggttcgttgagcgcaatatggtgacccctgaaggcaaagtcgtggacctcggctgcgggcggggaggctggtcttactattgtgggggactgaagaacgttagagaggtgaaaggccttacaaaaggcgggcccgggcatgaagaaccgatccctatgagcacgtacggctggaatctggtccgcctccaatccggggtggatgtgtttttcacccctcccgagaaatgcgacacactgctgtgtgatattggagaaagctcccccaaccccaccatcgaggctggccggacactcagagttcttaatctggtcgaaaactggctgaataacaatacccagttctgcattaaggtgctcaacccttatatgccgtctgtgatcgagaagatggaagccctgcagcgcaaatacgggggagcgcttgtccggaatcccctgagcagaaactccacgcacgagatgtactgggtttctaatgccaccggcaacatcgtgagctccgtgaatatgatttctcgcatgctcatcaaccggtttacaatgaagcacaaaaaggctacctatgagcctgacgtcgatctggggagcggaacaagaaacattggcatcgaatccgagattcccaatctggacatcattggcaaacgcatcgaaaagatcaagcaggagcatgaaaccagctggcactacgaccaagatcatccttataaaacatgggcctaccacgggtcttatgagaccaagcagacgggatccgctagctctatggtgaacggcgttgtgcggctccttacaaaaccctgggacgtcgtgccgatggttacccagatggccatgaccgatacaacgcctttcgggcagcaaagagtgtttaaggagaaagtcgacacccgcacacaggaacccaaggagggaaccaagaaactgatgaagattacagctgaatggctgtggaaagagctcggcaagaaaaagacccctagaatgtgtacacgggaggagttcacccgcaaagtgagatccaatgccgcgctgggggccatctttacggatgagaacaagtggaaaagcgctcgggaagccgtggaggacggaagattctgggaacttgtcgatcgggagcgcaatctgcacctcgagggcaaatgcgaaacctgtgtttacaacatgatgggcaagagagagaaaaagctgggggaatttggaaaagctaagggctctcgggccatttggtatatgtggctgggggcccgcttcctcgagtttgaagcgctgggattccttaatgaggaccattggttttccagaggcaacagcctgtccggggtggagggcgaaggactccaccggctgggctacatccttcgcgatgtggggaagaaagagggaggcgctatgtacgccgacgatacagccgggtgggacaccagaattacactggaagacctcaagaatgaggaaatggtcaccaaccatatgaaaggagagcacaagaaactggctgaggccatcttcaagctgacgtatcagaataaggtggttcgggtgcagcgccccacacctagaggcaccgtcatggatatcattagccggcgcgaccaaagagggtctggccaggtgggaacatacggcctcaacacctttacgaatatggaagctcagctgatccggcaaatggagggggaaggaattttcaaaagcatccagcatcttaccgccacagaggagattgcggttcagaactggctggcccgcgtgggcagagaacggctctccagaatggctatctctggggatgactgcgtcgtgaagcccatcgatgaccgcttcgccagcgctctgaccgcccttaatgatatgggaaaagttcggaaggacattcagcaatgggagccgtccagaggctggaacgattggacacaggtgcctttttgctctcaccacttccatgaactggtcatgaaagacgggcgcgtgctcgtcgtgccctgtcggaaccaggatgagctgatcggcagagcgcgcattagccagggagccggctggtccctgaaggaaaccgcttgcctcgggaagtcttatgcccaaatgtggacactgatgtactttcaccggagagaccttcgcctggctgccaatgctatctgtagcgccgttccctcccattgggtgcctaccagccggacgacatggtctattcacgcgaaccacgagtggatgaccaccgaggatatgctcgccgtctggaatagagtgtggatccaggaaaacccgtggatggaggacaaaacacccgtggaatcctgggaggaagttccttatctgggaaagcgcgaggaccagtggtgcggcagccttattgggctgacctctcgggctacatgggccaaaaatatccagacggccatcaaccaagtgagatccctcattggaaatgaggaatacaccgattatatgcccagcatgaagcggttcagacgcgaggaagaggaagctggcgtcctgtggtga

SEQ ID NO: 19814 - RNA, 9876 nt, synthetic construct
  misc_feature 1..9876: note = derived and/or modified CDS sequence (opt5) from DENV-2__EU482759__SS-prME
  source 1..9876: mol_type = other RNA
accgccggagtgatcgtcatgctgattcccacagctatggccttccacctcacgaccagaaatggggagcctcatatgatcgttggacggcaggaaaagggcaagagcctgctttttaagaccgaggacggggtgaatatgtgcaccctgatggcgattgatctcggagaactgtgtgaggacacaatcacctacaagtgcccgcttctgcgccaaaatgaacccgaggatattgactgttggtgcaatagcacatctacctgggtgacgtatggcacctgtacaaccacaggggagcacagacgggaaaagcgcagcgtcgctctcgtgcctcatgttggaatgggcctggagaccagaacggaaacatggatgtcctctgagggcgcctggaagcacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaagaccgaggctaagcagcctgccacgctgagaaaatattgcattgaagctaagctcacaaacaccaccacagagagccggtgtccgacccaaggagagccctctctgaatgaagaacaggacaaacgctttatctgcaagcattccatggtggatagaggctggggcaacgggtgtggactgttcggcaaaggcgggattgtcacatgcgccatgtttacgtgcaaaaagaatatggaagggaaagttgtgcagcctgagaacctcgaatacaccatcgtgattacaccccacagcggggaggagcatgcggtcggaaatgacaccggcaagcacggcaaagaaatcaagatcacacctcagtcttccattaccgaggccgaactgacggggtatggaaccgtgacaatggagtgtagcccccggaccggccttgatttcaacgaaatggttctgctccaaatggaggacaaggcttggctggtgcaccgccagtggtttcttgatctgccgctcccttggctgcccggggccgacacacagggatctaattggatccagaaggagaccctggtcacgttcaagaaccctcatgctaaaaagcaagacgtggttgtgctcggctcccaggaaggggccatgcacacagccctgaccggcgctacagagattcagatgagctccggaaatcttctgtttaccggccatctcaaatgcagactgcggatggataaacttcaactgaaagggatgtcttacagcatgtgtaccggaaagttcaagatcgtcaaagaaattgcggagacacagcacggcacgatcgtgatcagagtccagtatgagggggacggatccccctgcaagattcccttcgaaatcaccgatctcgagaaacgccatgtgctgggccggctgattacagttaaccctatcgtgaccgaaaaggacagcccggtcaacattgaggccgaacccccttttggggattcttacatcattatcggcgtggagcccggacagctcaaactgaattggttcaagaagggctccagcatcgggcaaatgtttgagacaaccatgagaggagctaaacgcatggccattcttggcgacacggcctgggatttcgggtctctgggaggcgtttttacaagcatcgggaaggctctccaccaggtgttcggcgccatttacggagcggctttttccggcgtctcttggaccatgaaaatcctgattggggtgatcatcacctggattggaatgaacagccggtccacaagcctgtctgtgtcccttgttctcgtcggcgtggtgaccctgtatctgggggccatggtccaggccgacagcggatgtgtggtttcttggaagaataaagaactcaagtgcggctccgggatcttcattacagataacgtgcacacgtggaccgagcagtacaagtttcaacctgaaagcccctccaaactggcttctgccatccagaaggctcatgaggaaggcatttgtggaatcagaagcgtcacacgccttgagaatctgatgtggaaacagatcaccccggagctcaaccacattctgtccgaaaatgaggtgaagctgacaatcatgaccggcgacattcgggggatcatgcaggccggaaaaagatctcttcgccctcaacccacggaactcaagtatagctggaaaacctggggcaaggcgaagatgctgtccacagagagccataaccagaccttcctgattgatgggcctgaaacagccgagtgccccaataccaaccgggcttggaactctctcgaggttgaagactacggatttggcgtgttcacaaccaacatctggctgaaacttagagagaagcaggacgtcttttgtgattccaaactgatgagcgccgctatcaaggacaatcgcgccgtgcacgcggatatgggctattggattgaatctgccctcaacgacacgtggaaaatggagaaggcttccttcatcgaggttaagagctgccactggcctaaatctcatacactgtggagcaatggggtgctggaatccgagatgattatccccaagaacttcgccggaccggtcagccagcacaactaccggcctggctatcatacccaaaccgctgggccctggcaccttggaaaactcgaaatggattttgacctgtgtgagggcacaaccgtggtggtcacggaagattgcgggaatagaggaccctctctgcggacaaccacagcctccggcaagctcattaccgagtggtgctgtcgcagctgcacactgcctccgcttagataccggggcgaggacgggtgttggtacggaatggaaatcagacccctgaaagagaaggaagagaacctcgttaattccctggtgaccgccggccatgggcagattgataacttctctctgggagtgcttggcatggctctctttctggaagagatgctgcgcacgcggatcgggaccaagcacgcgatcctcctggtcgccgtgagcttcgttacacttattaccggaaatatgtcctttagagacctgggccgcgtgatggtcatggtgggcgctacaatgaccgatgacatcgggatgggagttacgtatctcgccctgctggccgctttcaaagtgagacctacatttgccgcgggccttctgctccggaagctgacctctaaagagctcatgatggctacaattgggatcgccctgcttagccagtccaccattcccgaaaccatcctggagctcacagatgccctggctctgggaatgatggtccttaagatcgtgcgcaacatggaaaaataccaactggccgttacgattatggcgatctcttgcgtgcctaatgctgtcattctccagaacgcctggaaggtgagctgtaccatcctggccgctgtgtccgtcagccccctcctgcttacatcttcccagcagaaggccgactggattcctctggctctcaccatcaaaggcctgaatcccacagccatcttcctgaccacgcttagcagaacatctaagaaacggtcctggccgctgaacgaggcgattatggccgttgggatggtgagcatcctcgcttcttccctgctcaagaatgacattcctatgaccggacccctggtggccggcggccttctgaccgtctgctatgtgctgacagggcgcagcgctgatctcgaactggagagagccgccgacgttaaatgggaggatcaagctgaaatctccggaagctctcctattcttagcatcaccatttccgaggacggctctatgagcatcaagaacgaagaggaggaacagacactgacgatcctcattcggaccgggctgctcgtgatctccggagtctttcccgtgtctattccgatcacagcggccgcttggtacctgtgggaggttaaaaagcagcgcgccggcgtgctttgggatgtcccttctccccctcccgtggaaaaggccgagctggaagacggggcttatagaattaaacagcggggaatcctgggctactcccaaatcggcgccggggtctataaggagggaaccttccacacaatgtggcatgtgacccgcggcgcggttctcatgcacagagggaaacggattgagccctcctgggctgatgtgaagaaagacctgatcagctacggaggcgggtggaaacttgaaggagagtggaaggaaggcgaggaagtccaggtgctggccctcgagcctggcaaaaatccgagagccgttcagacgaagcccgggatttttaaaaccaacacaggaaccatcggcgctgtgtccctggatttcagccctgggacatctggatcccccattgtcgaccgcaagggcaaagtggtggggctctacggaaatggcgttgtcacccggagcggcgcctatgtgtctgcgatcgctcagacagagaagtccatcgaagataaccctgagattgaagacgatatctttagaaagaaacgcctgacgattatggaccttcatcccggggccggaaagaccaaacggtacctgcctgccatcgtgagaggcgctattaagcgcgggctgcggacactcatcctggccccgaccagagtcgtggctgccgagatggaagaggcgcttcgcggactgcccattcggtatcaaaccacagccatcaaaacggagcacaccggcagagaaatcgttgacctcatgtgtcatgctacattcaccatgcggctgctcagccctgtgcgcgtccccaactacaatctgattatcatggatgaggcccacttcacagaccctgcttccattgccgccagagggtatatctctacccgggtggaaatgggcgaggctgcgggaatttttatgacggccacacccccgggcagccgcgatcctttcccccagtccaacgctcccatcatggacgaggaaagagagatccctgaacggagctggaactctgggcacgagtgggttaccgattttaagggaaagaccgtgtggttcgtcccctccattaaagccggcaacgacatcgccgcttgccttagaaagaatgggaaaaaggtgattcagctgagccgcaaaacatttgattctgaatacgttaagacccgggccaacgactgggatttcgtggtcacaaccgacatcagcgagatgggagcgaattttaaggctgagagagtgattgatcctcgccggtgtatgaaaccggtgatcctgacggacggcgaagagagagtcatcctcgccgggcccatgcctgttacacattcctctgccgctcaacgccggggcagaattggacgcaaccccaagaatgaaaacgaccagtatatctacatgggcgagcctctggaaaatgatgaggactgcgcccactggaaagaggcgaagatgcttctggataacattaatacccccgaagggatcattccgagcatgttcgagcctgaaagagagaaagtggacgccatcgatggagaataccggctccgcggcgaggctagaaagacatttgtggacctgatgcggcgcggggatctgcccgtctggctcgcctataaagtggctgccgagggaattaactacgctgacagaaagtggtgtttcgatggcatcaagaataaccagatccttgaagagaacatggaagttgagatttggaccaaagagggggaacggaagaaactgaagcctagatggctggacgcccgcatctattccgatcccctcgcgctgaaagagtttaaggagttcgccgctggccggaagtctcttacgctgaatctcattaccgagatgggaagactgcctacattcatgacccagaaagcccgcaacgctctggacaatctcgccgtgcttcatacagccgaagctggcgggcgggcgtacaaccacgccctgagcgagctgcccgagaccctcgaaacactgcttctgctcaccctgctggctacggtcacaggaggcatctttctcttccttatgtccgggaagggaattggcaaaatgaccctgggcatgtgctgcatcatcaccgccagcattctgctctggtatgcccaaatccagccgcactggattgctgcctctatcattctggagtttttccttatcgtgctgctcatccctgaacccgagaagcagagaacaccccaggataatcaactgacctacgttgtgattgcgatcctgacagtcgtggccgctacgatggccaacgaaatggggtttctcgagaaaaccaagaaggaccttggactgggctccattacaacccaggagagcgaatccaatatcctggacattgatctccggcctgcttctgcctggacactgtatgcggtcgccaccacgttcgtgaccccgatgcttcgccatagcatcgagaactcctctgttaatgtgagcctgacagctattgccaaccaggctaccgtgctcatggggctgggaaaaggctggcccctgtccaagatggacatcggggtccctctccttgccatcggatgttacagccaggttaatcccattacactgaccgctgccctgctcctgcttgtggcgcactacgccatcattggccctggcctgcaagctaaagccacgagagaagctcagaagcgggccgccgcggggatcatgaaaaaccccacagtggatggaattaccgtcatcgacctcgagcctatcccgtatgatcccaagtttgaaaagcagctgggccaggtgatgctgctcattctttgcgttacacaagtgctgatgatgcgcaccacctgggctctgtgtgaggccctcacactggctacggggcctatctctaccctttgggagggaaatcccggcagattctggaacacaaccattgccgtctccatggccaatatctttcgggggagctacctggctggagccggcctcctgttctctattatgaaaaacacaaccaatacgcgcagaggcacagggaacatcggagaaaccctgggcgagaagtggaaatcccggctcaacgcgcttggaaagagcgaatttcagatctataaaaagtctggcattcaggaggtggaccgcaccctggccaaagagggcatcaagagaggggaaacagatcatcacgctgtcagccggggatccgccaagctgagatggttcgtggagcgcaatatggttacccctgaaggcaaagtggtcgacctcggctgcgggcggggaggctggtcttactattgtgggggactgaagaacgtgagagaggttaaaggccttacaaaagggggacccggccatgaagaacccattcctatgagcacgtacggctggaatctggtgcgcctccaatccggggtcgatgtgtttttcacaccgcccgagaaatgcgacacactgctgtgtgatatcggagaaagctcccctaaccccaccattgaggctggccggacactcagagtgcttaatctggttgaaaactggctgaataacaatacccagttctgcatcaaggtcctcaacccttatatgccgtctgtgatcgagaagatggaagccctgcagcgcaaatacgggggagcgcttgtgcggaatcccctgagcagaaactccacgcacgagatgtactgggtctctaatgccaccggcaacattgttagctccgtgaatatgatctctcgcatgctcattaaccggtttacaatgaagcacaaaaaggctacctatgagcctgacgtggatctggggagcggaacaagaaacatcggcattgaatccgagatccccaatctggacattatcggcaaacgcatcgaaaagattaagcaggagcatgaaaccagctggcactacgaccaagatcatccttataaaacatgggcctaccacgggtcttatgagaccaagcagacgggatccgctagctctatggtcaacggcgtggttcggctccttacaaaaccctgggacgtggtcccgatggtgacccagatggccatgaccgatacaacgcctttcgggcagcaaagagtttttaaggagaaagtggacacccgcacacaggaacccaaggagggaaccaagaaactgatgaagatcacagctgaatggctgtggaaagagctcggcaagaaaaagacccctagaatgtgtacacgggaggagttcacccgcaaagtcagatccaatgccgcgctgggggccatttttacggatgagaacaagtggaaaagcgctcgggaagccgtggaggacggaagattctgggaacttgtggatcgggagcgcaatctgcacctcgagggcaaatgcgaaacctgtgtctacaacatgatgggcaagagagagaaaaagctgggggaatttggaaaagctaagggctctcgggccatctggtatatgtggctgggggcccgcttcctcgagtttgaagcgctgggattccttaatgaggaccattggttttccagaggcaacagcctgtccggggttgagggcgaaggactccaccggctgggctacattcttcgcgatgtggggaagaaagagggaggcgctatgtacgccgacgatacagccgggtgggacaccagaatcacactggaagacctcaagaatgaggaaatggtgaccaaccatatgaaaggagagcacaagaaactggctgaggccatcttcaagctgacgtatcagaataaggtcgtgcgggttcagcgccccacacctagaggcaccgtgatggatattatcagccggcgcgaccaaagagggtctggccaggtcggaacatacggcctcaacacctttacgaatatggaagctcagctgattcggcaaatggagggggaaggaatcttcaaaagcattcagcatcttaccgccacagaggagatcgcggtgcagaactggctggcccgcgttggcagagaacggctctccagaatggctatctctggggatgactgcgtggtcaagcccattgatgaccgcttcgccagcgctctgaccgcccttaatgatatgggaaaagtgcggaaggacatccagcaatgggagccgtccagaggctggaacgattggacacaggttcctttttgctctcaccacttccatgaactggtgatgaaagacgggcgcgtcctcgtggtcccctgtcggaaccaggatgagctgattggcagagcgcgcatcagccagggagccggctggtccctgaaggaaaccgcttgcctcgggaagtcttatgcccaaatgtggacactgatgtactttcaccggagagaccttcgcctggctgccaatgctatttgtagcgccgtgccctcccattgggttcctaccagccggacgacatggtctatccacgcgaaacacgagtggatgaccaccgaggatatgctcgccgtgtggaacagagtctggattcaggaaaatccgtggatggaggacaagacacccgtggaatcctgggaggaagtgccttatctgggaaaacgcgaggaccagtggtgcggcagccttatcgggctgacctctcgggctacatgggccaagaacatccagacggccattaatcaagttagatccctcatcggaaacgaggaatacaccgattatatgcccagcatgaaacggttcagacgcgaggaagaggaagctggcgtgctgtggtga

SEQ ID NO: 19815 - RNA, 9876 nt, synthetic construct
  misc_feature 1..9876: note = derived and/or modified CDS sequence (opt5) from DENV-2__EU482760__SS-prME
  source 1..9876: mol_type = other RNA
accgccggcgtcatcgtcatgctgattcccaccgctatggccttccacctcacgaccagaaatggggaacctcatatgatcgttggacggcaggaaaagggcaagagcctgctttttaagaccgaggacggggtgaatatgtgcaccctgatggcgattgatctcggagaactgtgtgaggacacgatcacctacaagtgcccccttctgcgccaaaatgaacccgaggatattgactgttggtgcaatagcacatctacctgggtgacgtatggcacctgtgctacaaccggggagcacagacgggaaaagcgcagcgtcgccctcgtgcctcatgttggaatgggcctggagacaagaaccgaaacgtggatgtcctctgagggcgcctggaagcacgtgcagcggatcgagacatggatcctgcgccatcccgggttcaccattatggctgccatcctcgcttacacaattggaaccacccactttcagagagccctgatcttcattcttctgacagcggtcgcccctagcatgacgatgcggtgcatcggcatttccaaccgcgattttgtggaaggggtttctggaggcagctgggtggacatcgtcctcgagcacgggtcctgtgtgaccacaatggctaagaataagcccaccctggatttcgaacttatcaaaacagaggccaagcagcctgctaccctgagaaaatattgcattgaagccaagctcacgaacacaaccaccgagagccggtgtccgacacaaggagagccctctctgaatgaggaacaggacaaacgctttatctgcaagcattccatggtggatagaggctggggcaacgggtgtggactgttcggcaaagggggaattgtgacctgcgcgatgtttacatgcaaaaagaatatggaaggcaaagttgtgcagcctgagaacctcgaatacacgatcgtgattacaccccacagcggggaggagcatgccgtcggaaatgacacaggcaagcacggcaaagaaatcaagatcacccctcagtcttccattacagaggctgaactgaccgggtatggaacggtgaccatggagtgtagcccccggacaggccttgatttcaacgaaatggttctgctccaaatggaggacaaagcctggctggtgcaccgccagtggtttcttgatctgccgctcccttggctgcccggggctgacacccagggatctaattggatccagaaggagacactggtcaccttcaagaaccctcatgccaaaaagcaagacgtggttgtgctcggctcccaggaaggggccatgcacacggctctgacaggcgcgaccgagattcagatgagctccggaaatcttctgtttacaggccatctcaaatgcagactgcggatggataaacttcaactgaaagggatgtcttacagcatgtgtaccggaaagttcaagatcgtcaaagaaattgccgagacccagcacggcacaatcgtgatcagagtccagtatgagggggacggatccccctgcaagattcccttcgaaatcacggatctcgagaaacgccatgtgctgggccggctgattaccgttaaccctatcgtgacagaaaaggacagcccggtcaacattgaggctgaacccccttttggggattcttacatcattatcggcgtggagcccggacagctcaaactgaattggttcaagaagggctccagcatcgggcaaatgtttgagaccacaatgagaggagccaaacgcatggccattcttggcgacaccgcttgggatttcgggtctctgggaggcgtttttacgagcatcgggaaggccctccaccaggtgttcggcgcgatttacggagctgccttttccggcgtctcttggacaatgaaaatcctgattggggtgatcatcacctggattggaatgaacagccggtccaccagcctgtctgtgtcccttgttctcgtcggcgtggtgacactgtatctgggggccatggtccaggctgacagcggatgtgtggtttcttggaagaataaagaactcaagtgcggctccgggatcttcattaccgataacgtgcacacatggacggagcagtacaagtttcaacctgaaagcccctccaaactggcctctgctatccagaaggcccatgaggaaggcatttgtggaatcagaagcgtcacccgccttgagaatctgatgtggaaacagatcacaccggagctcaaccacattctgtccgaaaatgaggtgaagctgaccatcatgacaggcgacattcgggggatcatgcaggcgggaaaaagatctcttcgccctcaacccaccgaactcaagtatagctggaaaacgtggggcaaggccaagatgctgtccaccgagagccataaccagacattcctgattgatgggcctgaaaccgctgagtgccccaatacaaaccgggcctggaactctctcgaggttgaagactacggatttggcgtgttcaccacaaacatctggctgaaacttagagagaagcaggacgtcttttgtgattccaaactgatgagcgctgccatcaaggacaatcgcgcggtgcacgccgatatgggctattggattgaatctgctctcaacgacacctggaaaatggagaaggcctccttcatcgaggttaagagctgccactggcctaaatctcatacgctgtggagcaatggggtgctggaatccgagatgattatccccaagaacttcgctggaccggtcagccagcacaactaccggcctggctatcatacacaaaccgccgggccctggcaccttggaaaactcgaaatggattttgacctgtgtgagggcaccacagtggtggtcaccgaagattgcgggaatagaggaccctctctgcggacgacaaccgcctccggcaagctcattacagagtggtgctgtcgcagctgcaccctgcctccgcttagataccggggcgaggacgggtgttggtacggaatggaaatcagacccctgaaagagaaggaagagaacctcgttaattccctggtgacagctggccatgggcagattgataacttctctctgggagtgcttggcatggcgctctttctggaagagatgctgcgcacccggatcgggacgaagcacgccatcctcctggtcgctgtgagcttcgttacccttattacaggaaatatgtcctttagagacctgggccgcgtgatggtcatggtgggcgccaccatgacagatgacatcgggatgggagttacctatctcgccctgctggctgccttcaaagtgagacctacgtttgcggctggccttctgctccggaagctgacatctaaagagctcatgatggccaccattgggatcgccctgcttagccagtccacaattcccgaaaccatcctggagctcaccgatgctctggccctgggaatgatggtccttaagatcgtgcgcaacatggaaaaataccaactggcggttacaattatggctatctcttgcgtgcctaatgccgtcattctccagaacgcctggaaggtgagctgtacgatcctggctgccgtgtccgtcagccccctcctgcttacctcttcccagcagaaggctgactggattcctctggccctcacaatcaaaggcctgaatcccaccgcgatcttcctgacaacccttagcagaacgtctaagaaacggtcctggccgctgaacgaggccattatggctgttgggatggtgagcatcctcgcctcttccctgctcaagaatgacattcctatgacaggacccctggtggctggcggccttctgaccgtctgctatgtgctgaccgggcgcagcgccgatctcgaactggagagagccgctgacgttaaatgggaggatcaagcggaaatctccggaagctctcctattcttagcatcacaatttccgaggacggctctatgagcatcaagaacgaagaggaggaacagaccctgacaatcctcattcggacggggctgctcgtgatctccggagtctttcccgtgtctattccgatcaccgccgctgcctggtacctgtgggaggttaaaaagcagcgcgccggcgtgctttgggatgtcccttctccccctcccgtggaaaaggctgagctggaagacggggcctatagaattaaacagcggggaatcctgggctactcccaaatcggcgcgggggtctataaggagggaacattccacaccatgtggcatgtgacacgcggcgctgttctcatgcacagagggaaacggattgagccctcctgggccgatgtgaagaaagacctgatcagctacggaggcgggtggaaacttgaaggagagtggaaggaaggcgaggaagtccaggtgctggccctcgagcctggcaaaaatccgagagctgttcagaccaagcccgggatttttaaaacgaacaccggaacaatcggcgccgtgtccctggatttcagccctgggacctctggatcccccattgtcgaccgcaagggcaaagtggtggggctctacggaaatggcgttgtcacacggagcggcgcgtatgtgtctgctatcgcccagaccgagaagtccatcgaagataaccctgagattgaagacgatatctttagaaagaaacgcctgacaattatggaccttcatcccggggccggaaagacgaaacggtacctgcctgctatcgtgagagaggccattaagcgcggcctgcggaccctcatcctggctccgacaagagtcgtggccgcggaaatggaggaggcccttcgcgggctgcccattcggtatcaaaccaccgctatcaaaacagaacacacgggaagagagatcgttgacctcatgtgtcatgccaccttcacaatgcggctgctcagccctgtgcgcgtccccaactacaatctgattatcatggatgaagctcacttcaccgaccctgcctccattgccgctagaggctatatctctacacgggtggagatgggggaggcggccggcatttttatgaccgctacgcccccgggaagccgcgatcctttcccccagtccaacgcccccatcatggacgaagagagagaaatccctgagcggagctggaactctggccacgaatgggttacagattttaaggggaagaccgtgtggttcgtcccctccattaaagccggaaacgacatcgctgcctgccttagaaagaatggcaaaaaggtgattcagctgagccgcaaaacctttgattctgagtacgttaagacacgggcgaacgactgggatttcgtggtcaccacagacatcagcgagatgggggctaattttaaggccgaaagagtgattgatcctcgccggtgtatgaaaccggtgatcctgaccgacggagaggaaagagtcatcctcgccggccccatgcctgttacgcattcctctgctgcccaacgccgggggagaattggccgcaaccccaagaatgagaacgaccagtatatctacatgggagaacctctggagaatgatgaggactgcgcgcactggaaagaagccaagatgcttctggataacattaatacacccgagggcatcattccgagcatgttcgaacctgagagagaaaaagtggacgctatcgatggggagtaccggctccgcggagaggccagaaagacctttgtggacctgatgcggcgcggcgatctgcccgtctggctcgcttataaagtggccgctgaagggattaactacgccgacagaaagtggtgtttcgatggaatcaagaataaccagatccttgaggaaaacatggaggttgagatttggacaaaagaaggcgagcggaagaaactgaagcctagatggctggacgcgcgcatctattccgatcccctcgccctgaaagaatttaaggagttcgctgccgggcggaagtctcttaccctgaatctcattacggaaatgggcagactgcctaccttcatgacacagaaagctcgcaacgccctggacaatctcgccgtgcttcataccgctgaggcgggaggccgggcctacaaccacgctctgagcgagctgcccgaaacactcgagaccctgcttctgctcacactgctggccaccgtcacagggggaatctttctcttccttatgtccggcaaggggattggaaaaatgacactgggcatgtgctgcatcatcaccgccagcattctgctctggtatgctcaaatccagccgcactggattgccgcgtctatcattctggaatttttccttatcgtgctgctcatccctgagcccgaaaagcagagaacaccccaggataatcaactgacatacgttgtgattgccatcctgaccgtcgtggctgccacaatggctaacgagatgggctttctcgagaaaacgaagaaggaccttgggctgggatccattaccacacaggaaagcgagtccaatatcctggacattgatctccggcctgcctctgcgtggaccctgtatgccgtcgctacaaccttcgtgacgccgatgcttcgccatagcatcgaaaactcctctgttaatgtgagcctgaccgccattgctaaccaggccacagtgctcatgggcctggggaaaggatggcccctgtccaagatggacatcggcgtccctctccttgctatcgggtgttacagccaggttaatcccattaccctgacagccgcgctgctcctgcttgtggcccactacgctatcattggacctggcctgcaagccaaagctaccagagaggcccagaagcgggccgcggctggcatcatgaaaaaccccacggtggatgggattacagtcatcgacctcgaacctatcccgtatgatcccaagtttgagaagcagctgggacaggtgatgctgctcattctttgcgttacccaagtgctgatgatgcgcacaacctgggccctgtgtgaggctctcaccctggccacaggccctatctctacgctttgggaagggaatcccggaagattctggaacaccacaattgccgtctccatggctaatatctttcggggcagctacctggccggggcgggactcctgttctctattatgaaaaacaccacaaatacccgcagaggcacgggcaacatcggggagacactgggagaaaagtggaaatcccggctcaacgcccttggcaagagcgagtttcagatctataaaaagtctgggattcaggaggtggaccgcaccctggctaaagaaggaatcaagagaggcgagaccgatcatcacgccgtcagccgggggtccgctaagctgagatggttcgtggaacgcaatatggttacacctgagggaaaagtggtcgacctcggctgcggcagagggggatggtcttactattgtggcgggctgaagaacgtgcgggaagttaaaggacttaccaagggcgggcccggacatgaggagccgattcctatgagcacatacggctggaatctggtgcgcctccaatccggcgtcgatgtgtttttcacgccgcccgaaaaatgcgacaccctgctgtgtgatatcggggagagctcccctaaccccacaattgaagccggacggaccctcagagtgcttaatctggttgagaactggctgaataacaatacacagttctgcatcaaggtcctcaacccttatatgccgtctgtgatcgaaaagatggaggcgctgcagcgcaaatacggcggggcccttgtgcggaatcccctgagcagaaactccacccacgagatgtactgggtctctaatgctacgggaaacattgttagctccgtgaatatgatctctcgcatgctcattaaccggtttaccatgaagcacaaaaaggccacatatgaacctgacgtggatctgggcagcgggaccagaaacatcggaattgagtccgaaatccccaatctggacattatcggcaaacgcatcgagaagattaagcaggaacatgagacaagctggcactacgaccaagatcatccttataaaacctgggcttaccacggctcttatgagacaaagcagaccgggtccgccagctctatggtcaacggagtggttcggctccttacgaaaccctgggacgtggtcccgatggtgacacagatggctatgaccgataccacacctttcggccagcaaagagtttttaaggaaaaagtggacacgcgcacccaggagcccaaggaagggacaaagaaactgatgaagatcaccgccgagtggctgtggaaagagctcggaaagaaaaagacacctagaatgtgtacccgggaagagttcacacgcaaagtcagatccaatgcggccctgggcgctatttttaccgatgaaaacaagtggaaaagcgcccgggaggctgtggaagacgggagattctgggagcttgtggatcgggagcgcaatctgcacctcgaaggaaaatgcgagacgtgtgtctacaacatgatgggcaagagagagaagaagctgggcgagtttgggaaagccaagggatctcgggccatctggtatatgtggctgggcgcgcgcttcctcgaatttgaggctctggggttccttaatgaggaccattggttttccagaggaaacagcctgtccggcgttgaaggggagggcctccaccggctgggatacattcttcgcgatgtgggcaagaaagaagggggagccatgtacgccgacgataccgctggctgggacacaagaatcaccctggaggacctcaagaatgaagagatggtgacaaaccatatgaaaggggagcacaagaaactggccgaagctatcttcaagctgacctatcagaataaggtcgtgcgggttcagcgccccacgcctagaggaacagtgatggatattatcagccggcgcgaccaaagaggctctgggcaggtcggcacctacggactcaacacatttaccaatatggaggcccagctgattcggcaaatggaaggcgaggggatcttcaaaagcattcagcatcttacggcgaccgaggaaatcgccgtgcagaactggctggctcgcgttggaagagagcggctctccagaatggccatctctggcgatgactgcgtggtcaagcccattgatgaccgcttcgctagcgccctgacagcgcttaatgatatggggaaaatccggaaggacattcagcaatgggaaccgtccagaggatggaacgattggacccaggtgcctttttgctctcaccacttccatgagctggttatgaaagacggccgcgtgctcgtcgtgccctgtcggaaccaggatgaactgatcgggagagcccgcattagccagggcgctggatggtccctgaaggagacagcctgcctcggcaagtcttatgctcaaatgtggaccctgatgtactttcaccggagagaccttcgcctggccgctaatgccatctgtagcgcggtcccctcccattgggtgcctacaagccggaccacgtggtctattcacgccaaacacgagtggatgacaaccgaagatatgctcgctgtttggaacagagtgtggatccaggagaatccgtggatggaagacaagacccccgtcgagtcctgggaagaggtgccttatctggggaaacgcgaggaccagtggtgcggaagccttatcggcctgacatctcgggccacctgggccaagaacattcagacagctatcaatcaagtgagatccctcattgggaacgaagagtacacggattatatgcccagcatgaaacggttcagacgcgaagaggaagaggccggagttctgtggtga

SEQ ID NO: 19816 - RNA, 9876 nt, synthetic construct
  misc_feature 1..9876: note = derived and/or modified CDS sequence (opt5) from DENV-2__EU482762__SS-prME
  source 1..9876: mol_type = other RNA
accgccggcgtgatcgtcatgctgattcccacagctatggccttccacctcacgaccagaaatggggaacctcatatgatcgttggacggcaggaaaagggcaagagcctgctttttaagaccgaggacggggtgaatatgtgcaccctgatggcgattgatctcggagaactgtgtgaggacacaatcacctacaagtgcccccttctgcgccaaaatgaacccgaggatattgactgttggtgcaatagcacatctacctgggtgacgtatggcacctgtacaaccacaggggagcacagacgggaaaagcgcagcgtcgctctcgtgcctcatgttggaatgggcctggagaccagaacggaaacatggatgtcctctgagggcgcctggaaacacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaggaacaggacaaacgctttatctgcaagcattccatggtggatagaggctggggcaacgggtgtggactgttcggcaaagggggaattgtcacatgcgccatgtttacgtgcaaaaagaatatggaaggcaaagttgtgcagcctgagaacctcgaatacaccatcgtgattacaccccacagcggggaggagcatgcggtcggaaatgacaccggcaagcacggcaaagaaatcaagatcacacctcagtcttccattaccgaggccgaactgacggggtatggaaccgtgacaatggagtgtagcccccggaccggccttgatttcaacgaaatggttctgctccaaatggaggacaaggcttggctggtgcaccgccagtggtttcttgatctgccgctcccttggctgcccggggccgacacacagggatctaattggatccagaaggagaccctggtcacgttcaagaaccctcatgctaaaaagcaagacgtggttgtgctcggctcccaggaaggggccatgcacacagccctgaccggcgctacagagattcagatgagctccggaaatcttctgtttaccggccatctcaaatgcagactgcggatggataaacttcaactgaaagggatgtcttacagcatgtgtaccggaaagttcaagatcgtcaaagaaattgcggagacacagcacggcacgatcgtgatcagagtccagtatgagggggacggatccccctgcaagattcccttcgaaatcaccgatctcgagaaacgccatgtgctgggccggctgattacagttaaccctatcgtgaccgaaaaggacagcccggtcaacattgaggccgaacccccttttggggattcttacatcattatcggcgtggagcccggacagctcaaactgaattggttcaagaagggctccagcatcgggcaaatgtttgagacaaccatgagaggagctaaacgcatggccattcttggcgacacggcctgggatttcgggtctctgggaggcgtttttacaagcatcgggaaggctctccaccaggtgttcggcgccatttacggagcggctttttccggcgtctcttggaccatgaaaatcctgattggggtgatcatcacctggattggaatgaacagccggtccacaagcctgtctgtgtcccttgttctcgtcggcgtggtgaccctgtatctgggggccatggtccaggccgacagcggatgtgtggtttcttggaagaataaagaactcaagtgcggctccgggatcttcattacagataacgtgcacacgtggaccgagcagtacaagtttcaacctgaaagcccctccaaactggcttctgccatccagaaggctcatgaggaaggcatttgtggaatcagaagcgtcacacgccttgagaatctgatgtggaaacagatcaccccggagctcaaccacattctgtccgaaaatgaggtgaagctgacaatcatgaccggcgacattcgggggatcatgcaggccggaaaaagatctcttcgccctcaacccacggaactcaagtatagctggaaaacctggggcaaggcgaagatgctgtccacagagagccataaccagaccttcctgattgatgggcctgaaacagccgagtgccccaataccaaccgggcttggaactctctcgaggttgaagactacggatttggcgtgttcacaaccaacatctggctgaaacttagagagaagcaggacgtcttttgtgattccaaactgatgagcgccgctatcaaggacaatcgcgccgtgcacgcggatatgggctattggattgaatctgccctcaacgacacgtggaaaatggagaaggcttccttcatcgaggttaagagctgctactggcctaaatctcacacactgtggagcaatggggtgctggaatccgagatgattatccccaagaacttcgccggaccggtcagccagcataactatcggcctggctaccacacccaaaccgctgggccctggcatcttggaaaactcgaaatggattttgacctgtgtgagggcacaaccgtggtggtcacggaagattgcgggaatagaggaccctctctgcggacaaccacagcctccggcaagctcattaccgagtggtgctgtcgcagctgcacactgcctccgcttagataccggggcgaggacgggtgttggtatggaatggaaatcagacccctgaaagagaaggaagagaacctcgttaattccctggtgaccgccggccacgggcagattgataacttctctctgggagtgcttggcatggctctctttctggaagagatgctgcgcacgcggatcgggaccaagcatgcgatcctcctggtcgccgtgagcttcgttacacttattaccggaaatatgtcctttagagacctgggccgcgtgatggtcatggtgggcgctacaatgaccgatgacatcgggatgggagttacgtacctcgccctgctggccgctttcaaagtgagacctacatttgccgcgggccttctgctccggaagctgacctctaaagagctcatgatggctacaattgggatcgccctgcttagccagtccaccattcccgaaaccatcctggagctcacagatgccctggctctgggaatgatggtccttaagatcgtgcgcaacatggaaaaatatcaactggccgttacgattatggcgatctcttgcgtgcctaatgctgtcattctccagaacgcctggaaggtgagctgtaccatcctggccgctgtgtccgtcagccccctcctgcttacatcttcccagcagaaggccgactggattcctctggctctcaccatcaaaggcctgaatcccacagccatcttcctgaccacgcttagcagaacatctaagaaacggtcctggccgctgaacgaggcgattatggccgttgggatggtgagcatcctcgcttcttccctgctcaagaatgacattcctatgaccggacccctggtggccggcggccttctgaccgtctgctacgtgctgacagggcgcagcgctgatctcgaactggagagagccgccgacgttaaatgggaggatcaagctgaaatctccggaagctctcctattcttagcatcaccatttccgaggacggctctatgagcatcaagaacgaagaggaggaacagacactgacgatcctcattcggaccgggctgctcgtgatctccggagtctttcccgtgtctattccgatcacagcggccgcttggtatctgtgggaggttaaaaagcagcgcgccggcgtgctttgggatgtcccttctccccctcccgtggaaaaggccgagctggaagacggggcttacagaattaaacagcggggaatcctgggctattcccaaatcggcgccggggtctacaaggagggaaccttccacacaatgtggcacgtgacccgcggcgcggttctcatgcatagagggaaacggattgagccctcctgggctgatgtgaagaaagacctgatcagctacggaggcgggtggaaacttgaaggagagtggaaggaaggcgaggaagtccaggtgctggccctcgagcctggcaaaaatccgagagccgttcagacgaagcccgggatttttaaaaccaacacaggaaccatcggcgctgtgtccctggatttcagccctgggacatctggatcccccattgtcgaccgcaagggcaaagtggtggggctctatggaaatggcgttgtcacccggagcggcgcctacgtgtctgcgatcgctcagacagagaagtccatcgaagataaccctgagattgaagacgatatctttagaaagaaacgcctgacgattatggaccttcaccccggggccggaaagaccaaacggtatctgcctgccatcgtgagagaggctattaagcgcggcctgcggacactcatcctggccccgaccagagtcgtggctgccgaaatggaggaggcgcttcgcgggctgcccattcggtaccaaaccacagccatcaaaacggaacataccggaagagagatcgttgacctcatgtgtcacgctacattcaccatgcggctgctcagccctgtgcgcgtccccaactataatctgattatcatggatgaagcccatttcacagaccctgcttccattgccgccagaggctacatctctacccgggtggagatgggggaggctgcgggcatttttatgacggccacacccccgggaagccgcgatcctttcccccagtccaacgctcccatcatggacgaagagagagaaatccctgagcggagctggaactctggccacgaatgggttaccgattttaaggggaagaccgtgtggttcgtcccctccattaaagccggaaacgacatcgccgcttgccttagaaagaatggcaaaaaggtgattcagctgagccgcaaaacatttgattctgagtatgttaagacccgggccaacgactgggatttcgtggtcacaaccgacatcagcgagatgggggcgaattttaaggctgaaagagtgattgatcctcgccggtgtatgaaaccggtgatcctgacggacggagaggaaagagtcatcctcgccggccccatgcctgttacacactcctctgccgctcaacgccgggggagaattggccgcaaccccaagaatgagaacgaccagtacatctacatgggagaacctctggagaatgatgaggactgcgcccattggaaagaagcgaagatgcttctggataacattaatacccccgagggcatcattccgagcatgttcgaacctgagagagaaaaagtggacgccatcgatggggagtatcggctccgcggagaggctagaaagacatttgtggacctgatgcggcgcggcgatctgcccgtctggctcgcctacaaagtggctgccgaagggattaactatgctgacagaaagtggtgtttcgatggaatcaagaataaccagatccttgaggaaaacatggaggttgagatttggaccaaagaaggcgagcggaagaaactgaagcctagatggctggacgcccgcatctactccgatcccctcgcgctgaaagaatttaaggagttcgccgctgggcggaagtctcttacgctgaatctcattaccgaaatgggcagactgcctacattcatgacccagaaagcccgcaacgctctggacaatctcgccgtgcttcacacagccgaggctggaggccgggcgtataaccatgccctgagcgagctgcccgaaaccctcgagacactgcttctgctcaccctgctggctacggtcacagggggaatctttctcttccttatgtccggcaaggggattggaaaaatgaccctgggcatgtgctgcatcatcaccgccagcattctgctctggtacgcccaaatccagccgcactggattgctgcctctatcattctggaatttttccttatcgtgctgctcatccctgagcccgaaaagcagagaacaccccaggataatcaactgacctatgttgtgattgcgatcctgacagtcgtggccgctacgatggccaacgagatgggctttctcgagaaaaccaagaaggaccttgggctgggatccattacaacccaggaaagcgagtccaatatcctggacattgatctccggcctgcttctgcctggacactgtacgcggtcgccaccacgttcgtgaccccgatgcttcgccacagcatcgaaaactcctctgttaatgtgagcctgacagctattgccaaccaggctaccgtgctcatgggcctggggaaaggatggcccctgtccaagatggacatcggcgtccctctccttgccatcgggtgttacagccaggttaatcccattacactgaccgctgccctgctcctgcttgtggcgcattatgccatcattggacctggcctgcaagctaaagccacgagagaggctcagaagcgggccgccgcgggcatcatgaaaaaccccacagtggatgggattaccgtcatcgacctcgaacctatcccgtacgatcccaagtttgagaagcagctgggacaggtgatgctgctcattctttgcgttacacaagtgctgatgatgcgcaccacctgggctctgtgtgaggccctcacactggctacgggccctatctctaccctttgggaagggaatcccggaagattctggaacacaaccattgccgtctccatggccaatatctttcggggcagctatctggctggggccggactcctgttctctattatgaaaaacacaaccaatacgcgcagaggcacaggcaacatcggggagaccctgggagaaaagtggaaatcccggctcaacgcgcttggcaagagcgagtttcagatctacaaaaagtctgggattcaggaggtggaccgcaccctggccaaagaaggaatcaagagaggcgagacagatcaccatgctgtcagccgggggtccgccaagctgagatggttcgtggaacgcaatatggttacccctgagggaaaagtggtcgacctcggctgcggcagagggggatggtcttattactgtggcgggctgaagaacgtgcgggaagttaaaggacttacaaagggcgggcccggacacgaggagccgattcctatgagcacgtatggctggaatctggtgcgcctccaatccggcgtcgatgtgtttttcacaccgcccgaaaaatgcgacacactgctgtgtgatatcggggagagctcccctaaccccaccattgaagctggacggacactcagagtgcttaatctggttgagaactggctgaataacaatacccagttctgcatcaaggtcctcaacccttacatgccgtctgtgatcgaaaagatggaggccctgcagcgcaaatacggcggggcgcttgtgcggaatcccctgagcagaaactccacgcatgagatgtattgggtctctaatgccaccggaaacattgttagctccgtgaatatgatctctcgcatgctcattaaccggtttacaatgaagcacaaaaaggctacctacgaacctgacgtggatctgggcagcgggacaagaaacatcggaattgagtccgaaatccccaatctggacattatcggcaaacgcatcgagaagattaagcaggaacacgagaccagctggcattatgaccaagatcacccttacaaaacatgggcctatcatggctcttacgagaccaagcagacggggtccgctagctctatggtcaacggagtggttcggctccttacaaaaccctgggacgtggtcccgatggtgacccagatggccatgaccgatacaacgcctttcggccagcaaagagtttttaaggaaaaagtggacacccgcacacaggagcccaaggaagggaccaagaaactgatgaagatcacagctgagtggctgtggaaagagctcggaaagaaaaagacccctagaatgtgtacacgggaagagttcacccgcaaagtcagatccaatgccgcgctgggcgccatttttacggatgaaaacaagtggaaaagcgctcgggaggccgtggaagacgggagattctgggagcttgtggatcgggagcgcaatctgcacctcgaaggaaaatgcgagacctgtgtctataacatgatgggcaagagagagaagaagctgggcgagtttgggaaagctaagggatctcgggccatctggtacatgtggctgggcgcccgcttcctcgaatttgaggcgctggggttccttaatgaggaccactggttttccagaggaaacagcctgtccggcgttgaaggggagggcctccatcggctgggatacattcttcgcgatgtgggcaagaaagaagggggagctatgtatgccgacgatacagccggctgggacaccagaatcacactggaggacctcaagaatgaagagatggtgaccaaccacatgaaaggggagcataagaaactggctgaagccatcttcaagctgacgtaccagaataaggtcgtgcgggttcagcgccccacacctagaggaaccgtgatggatattatcagccggcgcgaccaaagaggctctgggcaggtcggcacatatggactcaacacctttacgaatatggaggctcagctgattcggcaaatggaaggcgaggggatcttcaaaagcattcagcaccttaccgccacagaggaaatcgcggtgcagaactggctggcccgcgttggaagagagcggctctccagaatggctatctctggcgatgactgcgtggtcaagcccattgatgaccgcttcgccagcgctctgaccgcccttaatgatatggggaaagtgcggaaggacatccagcaatgggaaccgtccagaggatggaacgattggacacaggttcctttttgctctcatcacttccacgagctggtgatgaaagacggccgcgtcctcgtggtcccctgtcggaaccaggatgaactgattgggagagcgcgcatcagccagggcgccggatggtccctgaaggagaccgcttgcctcggcaagtcttacgcccaaatgtggacactgatgtattttcatcggagagaccttcgcctggctgccaatgctatttgtagcgccgtgccctcccactgggttcctaccagccggacgacatggtctatccatgcgaaacacgagtggatgaccaccgaagatatgctcgccgtgtggaacagagtctggattcaggagaatccgtggatggaagacaagacacccgtggagtcctgggaagaggtgccttacctggggaaacgcgaggaccagtggtgcggaagccttatcggcctgacctctcgggctacatgggccaagaacatccagacggccattaatcaagttagatccctcatcgggaacgaagagtataccgattacatgcccagcatgaaacggttcagacgcgaagaggaagaggctggagtgctgtggtga

SEQ ID NO: 19817 - RNA, 9876 nt, synthetic construct
  misc_feature 1..9876: note = derived and/or modified CDS sequence (opt5) from DENV-2__EU482763__SS-prME
  source 1..9876: mol_type = other RNA
accgccggcgtgatcgtcatgctgattcccaccgctatggccttccacctcacgaccagaaatggggaacctcatatgatcgttggacggcaggaaaagggcaagagcctgctttttaagacagaggacggggtgaatatgtgcaccctgatggcgatggatctcggagaactgtgtgaggacacaattacctacaagtgcccccttctgcgccaaaatgaacccgaggatatcgactgttggtgcaatagcacatctacctgggtgacgtatggcacctgtacaaccacaggggagcacagacgggaaaagcgcagcgtcgctctcgtgcctcatgttggaatgggcctggagaccagaacggaaacatggatgtcctctgagggcgcctggaaacacgtgcagcggattgagacctggatcctgcgccatcccgggttcacaatcatggccgctattctcgcctacaccatcggaaccacacactttcagagagctctgattttcatccttctgacggccgtcgcgcctagcatgaccatgcggtgcattggcatctccaaccgcgattttgtggaaggggtttctggaggcagctgggtggacattgtcctcgagcacgggtcctgtgtgacaaccatggccaagaataagcccacactggatttcgaacttatcaaaaccgaggctaagcagcctgccacgctgagaaaatattgcatcgaagctaagctcacaaacaccaccacagagagccggtgtccgacccaaggagagccctctctgaatgaggaacaggacaaacgctttatttgcaagcattccatggtggatagaggctggggcaacgggtgtggactgttcggcaaagggggaatcgtcacatgcgccatgtttacgtgcaaaaagaatatggaaggcaaagttgtgcagcctgagaacctcgaatacaccattgtgatcacaccccacagcggggaggagcatgcggtcggaaatgacaccggcaagcacggcaaagaaattaagatcacacctcagtcttccatcaccgaggccgaactgacggggtatggaaccgtgacaatggagtgtagcccccggaccggccttgatttcaacgaaatggttctgctccaaatggaggacaaggcttggctggtgcaccgccagtggtttcttgatctgccgctcccttggctgcccggggccgacacacagggatctaattggattcagaaggagaccctggtcacgttcaagaaccctcatgctaaaaagcaagacgtggttgtgctcggctcccaggaaggggccatgcacacagccctgaccggcgctacagagatccagatgagctccggaaatcttctgtttaccggccatctcaaatgcagactgcggatggataaacttcaactgaaagggatgtcttacagcatgtgtaccggaaagttcaagattgtcaaagaaatcgcggagacacagcacggcacgattgtgatcagagtccagtatgagggggacggatccccctgcaagatccccttcgaaattaccgatctcgagaaacgccatgtgctgggccggctgatcacagttaaccctattgtgaccgaaaaggacagcccggtcaacatcgaggccgaacccccttttggggattcttacattatcattggcgtggagcccggacagctcaaactgaattggttcaagaagggctccagcatcgggcaaatgtttgagacaaccatgagaggagctaaacgcatggccatccttggcgacacggcctgggatttcgggtctctgggaggcgtttttacaagcattgggaaggctctccaccaggtgttcggcgccatctacggagcggctttttccggcgtctcttggaccatgaaaattctgatcggggtgattatcacctggatcggaatgaacagccggtccacaagcctgtctgtgtcccttgttctcgtcggcgtggtgaccctgtatctgggggccatggtccaggccgacagcggatgtgtggtttcttggaagaataaagaactcaagtgcggctccgggattttcatcacagataacgtgcacacgtggaccgagcagtacaagtttcaacctgaaagcccctccaaactggcttctgccattcagaaggctcatgaggaaggcatctgtggaattagaagcgtcacacgccttgagaatctgatgtggaaacagatcaccccggagctcaaccacatcctgtccgaaaatgaggtgaagctgacaattatgaccggcgacatccgggggattatgcaggccggaaaaagatctcttcgccctcaacccacggaactcaagtatagctggaaaacctggggcaaggcgaagatgctgtccacagagagccataaccagaccttcctgatcgatgggcctgaaacagccgagtgccccaataccaaccgggcttggaactctctcgaggttgaagactacggatttggcgtgttcacaaccaacatttggctgaaacttagagagaagcaggacgtcttttgtgattccaaactgatgagcgccgctatcaaggacaatcgcgccgtgcacgcggatatgggctattggatcgaatctgccctcaacgacacgtggaaaatggagaaggcttccttcattgaggttaagagctgccactggcctaaatctcatacactgtggagcaatggggtgctggaatccgagatgatcattcccaagaacttcgccggaccggtcagccagcacaactaccggcctggctatcatacccaaaccgctgggccctggcaccttggaaaactcgaaatggattttgacctgtgtgagggcacaaccgtggtggtcacggaagattgcgggaatagaggaccctctctgcggacaaccacagcctccggcaagctcatcaccgagtggtgctgtcgcagctgcacactgcctccgcttagataccggggcgaggacgggtgttggtacggaatggaaattagacccctgaaagagaaggaagagaacctcgttaattccctggtgaccgccggccatgggcagatcgataacttctctctgggagtgcttggcatggctctctttctggaagagatgctgcgcacgcggattgggaccaagcacgcgatcctcctggtcgccgtgagcttcgttacacttatcaccggaaatatgtcctttagagacctgggccgcgtgatggtcatggtgggcgctacaatgaccgatgacattgggatgggagttacgtatctcgccctgctggccgctttcaaagtgagacctacatttgccgcgggccttctgctccggaagctgacctctaaagagctcatgatggctacaatcgggattgccctgcttagccagtccaccatccccgaaaccattctggagctcacagatgccctggctctgggaatgatggtccttaagatcgtgcgcaacatggaaaaataccaactggccgttacgatcatggcgatttcttgcgtgcctaatgctgtcatcctccagaacgcctggaaggtgagctgtaccattctggccgctgtgtccgtcagccccctcctgcttacatcttcccagcagaaggccgactggatccctctggctctcaccattaaaggcctgaatcccacagccatcttcctgaccacgcttagcagaacatctaagaaacggtcctggccgctgaacgaggcgatcatggccgttgggatggtgagcattctcgcttcttccctgctcaagaatgacatccctatgaccggacccctggtggccggcggccttctgaccgtctgctatgtgctgacagggcgcagcgctgatctcgaactggagagagccgccgacgttaaatgggaggatcaagctgaaatttccggaagctctcctatccttagcattaccatctccgaggacggctctatgagcattaagaacgaagaggaggaacagacactgacgatcctcatccggaccgggctgctcgtgatttccggagtctttcccgtgtctatcccgattacagcggccgcttggtacctgtgggaggttaaaaagcagcgcgccggcgtgctttgggatgtcccttctccccctcccgtggaaaaggccgagctggaagacggggcttatagaatcaaacagcgggggattctgggctactcccaaatcggcgccggggtctataaggagggaaccttccacacaatgtggcatgtgacccgcggcgcggttctcatgcacagagggaaacggatcgagccctcctgggctgatgtgaagaaagacctgattagctacggaggcgggtggaaacttgaaggagagtggaaggaaggcgaggaagtccaggtgctggccctcgagcctggcaaaaatccgagagccgttcagacgaagcccgggatctttaaaaccaacacaggaaccattggcgctgtgtccctggatttcagccctgggacatctggatcccccatcgtcgaccgcaagggcaaagtggtggggctctacggaaatggcgttgtcacccggagcggcgcctatgtgtctgcgattgctcagacagagaagtccatcgaagataaccctgagatcgaagacgatatttttagaaagaaacgcctgacgatcatggaccttcatcccggggccggaaagaccaaacggtacctgcctgccattgtgagagaggctatcaagcgcggcctgcggacactcattctggccccgaccagagtcgtggctgccgaaatggaggaggcgcttcgcgggctgcccatccggtatcaaaccacagccattaaaacggaacacaccggaagagagatcgttgacctcatgtgtcatgctacattcaccatgcggctgctcagccctgtgcgcgtccccaactacaatctgatcattatggatgaagcccacttcacagaccctgcttccatcgccgccagaggctatatttctacccgggtggagatgggggaggctgcgggcatctttatgacggccacacccccgggaagccgcgatcctttcccccagtccaacgctcccattatggacgaagagagagaaatccctgagcggagctggaactctggccacgaatgggttaccgattttaaggggaagaccgtgtggttcgtcccctccatcaaagccggaaacgacattgccgcttgccttagaaagaatggcaaaaaggtgatccagctgagccgcaaaacatttgattctgagtacgttaagacccgggccaacgactgggatttcgtggtcacaaccgacattagcgagatgggggcgaattttaaggctgaaagagtgatcgatcctcgccggtgtatgaaaccggtgattctgacggacggagaggaaagagtcatcctcgccggccccatgcctgttacacattcctctgccgctcaacgccgggggagaatcggccgcaaccccaagaatgagaacgaccagtatatttacatgggagaacctctggagaatgatgaggactgcgcccactggaaagaagcgaagatgcttctggataacatcaatacccccgagggcattatcccgagcatgttcgaacctgagagagaaaaagtggacgccattgatggggagtaccggctccgcggagaggctagaaagacatttgtggacctgatgcggcgcggcgatctgcccgtctggctcgcctataaagtggctgccgaagggatcaactacaccgacagaaagtggtgtttcgatggaattaagaataaccagatccttgaggaaaacatggaggttgagatctggacgaaagaaggcgagcggaagaaactgaagcctagatggctggacgctcgcatttattccgatcccctcgccctgaaagaatttaaggagttcgcggccgggcggaagtctcttaccctgaatctcatcacagaaatgggcagactgcctaccttcatgacacagaaagctcgcaacgccctggacaatctcgctgtgcttcataccgccgaggccggaggccgggcttacaaccacgcgctgagcgagctgcccgaaacactcgagaccctgcttctgctcacgctgctggccacagtcaccgggggaatttttctcttccttatgtccggcaaggggatcggaaaaatgaccctgggcatgtgctgcattatcacagctagcatcctgctctggtatgcccaaattcagccgcactggatcgccgcttctattatcctggaatttttccttattgtgctgctcatccctgagcccgaaaagcagagaacaccccaggataatcaactgacatacgttgtgatcgccattctgacggtcgtggcggccaccatggctaacgagatgggctttctcgagaaaacaaagaaggaccttgggctgggatccatcaccacacaggaaagcgagtccaatattctggacatcgatctccggcctgcctctgcttggaccctgtatgccgtcgcgacgaccttcgtgacaccgatgcttcgccatagcattgaaaactcctctgttaatgtgagcctgaccgccatcgctaaccaggccacagtgctcatgggcctggggaaaggatggcccctgtccaagatggacattggcgtccctctccttgctatcgggtgttacagccaggttaatcccatcaccctgacggccgctctgctcctgcttgtggcccactacgcgattatcggacctggcctgcaagccaaagctacaagagaggcccagaagcgggctgccgccggcattatgaaaaaccccaccgtggatgggatcacagtcattgacctcgaacctatcccgtatgatcccaagtttgagaagcagctgggacaggtgatgctgctcatcctttgcgttacccaagtgctgatgatgcgcaccacatgggcgctgtgtgaggctctcacgctggccaccggccctatttctacactttgggaagggaatcccggaagattctggaacaccacaatcgctgtctccatggccaatatttttcggggcagctacctggccggggctggactcctgttctctatcatgaaaaacaccacgaatacacgcagaggcaccggcaacattggggagaccctgggagaaaagtggaaatcccggctcaacgcccttggcaagagcgagtttcagatctataaaaagtctgggatccaggaggtggaccgcacactggcgaaagaaggaattaagagaggcgagaccgatcatcacgccgtcagccgggggtccgctaagctgagatggttcgtggaacgcaatatggttacacctgagggaaaagtggtcgacctcggctgcggccggggaggatggtcttactattgtggcgggctgaagaacgtgagagaagttaaaggacttacgaagggcgggcccggacatgaggagccgatccctatgagcacctacggctggaatctggtgcgcctccaatccggcgtcgatgtgtttttcacaccgcccgaaaaatgcgacaccctgctgtgtgatattggggagagctcccctaaccccacaatcgaagccggacggaccctcagagtgcttaatctggttgagaactggctgaataacaatacgcagttctgcattaaggtcctcaacccttatatgccgtctgtgatcgaaaagatggaggctctgcagcgcaaatacggcggggcccttgtgcggaatcccctgagcagaaactccacccacgagatgtactgggtctctaatgcgacaggaaacatcgttagctccgtgaatatgatttctcgcatgctcatcaaccggtttaccatgaagcacaaaaaggccacatatgaacctgacgtggatctgggcagcgggaccagaaacattggaatcgagtccgaaattcccaatctggacatcattggcaaacgcatcgagaagatcaagcaggaacatgagacaagctggcactacgaccaagatcatccttataaaacctgggcttaccacggctcttatgagacgaagcagacagggtccgccagctctatggtcaacggagtggttcggctccttaccaaaccctgggacgtggtcccgatggtgacccagatggctatgacagatacgacccctttcggccagcaaagagtttttaaggaaaaagtggacacacgcacccaggagcccaaggaagggacaaagaaactgatgaagattaccgccgagtggctgtggaaagagctcggaaagaaaaagacacctagaatgtgtacccgggaagagttcacgcgcaaagtcagatccaatgctgccctgggcgcgatctttaccgatgaaaacaagtggaaaagcgcccgggaggctgtggaagacgggagattctgggagcttgtggatcgggagcgcaatctgcacctcgaaggaaaatgcgagacatgtgtctacaacatgatgggcaagagagagaagaagctgggcgagtttgggaaagccaagggatctcgggctatttggtatatgtggctgggcgcccgcttcctcgaatttgaggccctggggttccttaatgaggaccattggttttccagaggaaacagcctgtccggcgttgaaggggagggcctccaccggctgggatacatccttcgcgatgtgggcaagaaagaagggggagcgatgtacgctgacgataccgccggctgggacacaagaattaccctggaggacctcaagaatgaagagatggtgacgaaccatatgaaaggggagcacaagaaactggccgaagctatcttcaagctgacatatcagaataaggtcgtgcgggttcagcgccccacccctagaggaacagtgatggatatcattagccggcgcgaccaaagaggctctgggcaggtcggcacctacggactcaacacgtttaccaatatggaggcccagctgatccggcaaatggaaggcgaggggattttcaaaagcatccagcatcttacagctaccgaggaaattgccgtgcagaactggctggcgcgcgttggaagagagcggctctccagaatggccatctctggcgatgactgcgtggtcaagcccatcgatgaccgcttcgctagcgccctgacagctcttaatgatatggggaaagtgcggaaggacattcagcaatgggaaccgtccagaggatggaacgattggacccaggttcctttttgctctcaccacttccatgagctggtgatgaaagacggccgcgtcctcgtggtcccctgtcggaaccaggatgaactgatcgggagagcccgcattagccagggcgcgggatggtccctgaaggagacagcctgcctcggcaagtcttatgctcaaatgtggaccctgatgtactttcaccggagagaccttcgcctggccgctaatgccatctgtagcgctgtgccctcccattgggttcctacgagccggacaacctggtctattcacgccaaacacgagtggatgaccacagaagatatgctcgcggtgtggaacagagtctggatccaggagaatccgtggatggaagacaagacccccgtggagtcctgggaagaggtgccttatctggggaaacgcgaggaccagtggtgcggaagccttattggcctgacatctcgggccacgtgggctaagaacatccagaccgccatcaatcaagttagatccctcattgggaacgaagagtacacagattatatgcccagcatgaaacggttcagacgcgaagaggaagaggccggagtgctgtggtga

SEQ ID NO: 19818 - RNA, 9876 nt, synthetic construct
  misc_feature 1..9876: note = derived and/or modified CDS sequence (opt5) from DENV-2__EU482444__SS-prME
  source 1..9876: mol_type = other RNA
accgccggcgtgatcgtcatgctgattcccacagctatggccttccacctcacgaccagaaatggggagcctcatatgatcgttggacggcaggaaaagggcaagagcctgctttttaagacagaggacggggtgaatatgtgcaccctgatggcgatggatctcggagaactgtgtgaggacacaattacctacaagtgcccccttctgcgccaaaatgaacccgaggatatcgactgttggtgcaatagcacatctacctgggtgacgtatggcacctgtacaaccacaggggagcacagacgggaaaagcgcagcgtcgctctcgtgcctcatgttggaatgggcctggagaccagaacggaaacatggatgtcctctgagggcgcctggaaacacgtgcagcggattgagacctggatcctgcgccatcccgggttcacaatcatggccgctattctcgcctacaccatcggaaccacacactttcagagagctctgattttcatccttctgacggccgtcgcgcctagcatgaccatgcggtgcattggcatctccaaccgcgattttgtggaaggggtttctggaggcagctgggtggacattgtcctcgagcacgggtcctgtgtgacaaccatggccaagaataagcccacactggatttcgaacttatcaaaaccgaggctaagcagcctgccacgctgagaaaatattgcatcgaagctaagctcacaaacaccaccacagagagccggtgtccgacccaaggagagccctctctgaatgaggaacaggacaaacgctttatttgcaagcattccatggtggatagaggctggggcaacgggtgtggactgttcggcaaaggagggatcgtcacatgcgccatgtttacgtgcaaaaagaatatggaaggcaaagttgtgcagcctgagaacctcgaatacaccattgtgatcacaccccacagcggggaggagcatgcggtcggaaatgacaccggcaagcacggcaaagaaattaagatcacacctcagtcttccatcaccgaggccgaactgacggggtatggaaccgtgacaatggagtgtagcccccggaccggccttgatttcaacgaaatggttctgctccaaatggaggacaaggcttggctggtgcaccgccagtggtttcttgatctgccgctcccttggctgcccggggccgacacacagggatctaattggattcagaaggagaccctggtcacgttcaagaaccctcatgctaaaaagcaagacgtggttgtgctcggctcccaggaaggggccatgcacacagccctgaccggcgctacagagatccagatgagctccggaaatcttctgtttaccggccatctcaaatgcagactgcggatggataaacttcaactgaaagggatgtcttacagcatgtgtaccggaaagttcaagattgtcaaagaaatcgcggagacacagcacggcacgattgtgatcagagtccagtatgagggggacggatccccctgcaagatccccttcgaaattaccgatctcgagaaacgccatgtgctgggccggctgatcacagttaaccctattgtgaccgaaaaggacagcccggtcaacatcgaggccgaacccccttttggggattcttacattatcattggcgtggagcccggacagctcaaactgaattggttcaagaagggctccagcatcgggcaaatgtttgagacaaccatgagaggagctaaacgcatggccatccttggcgacacggcctgggatttcgggtctctgggaggcgtttttacaagcattgggaaggctctccaccaggtgttcggcgccatctacggagcggctttttccggcgtctcttggaccatgaaaattctgatcggggtgattatcacctggatcggaatgaacagccggtccacaagcctgtctgtgtcccttgttctcgtcggcgtggtgaccctgtatctgggggccatggtccaggccgacagcggatgtgtggtttcttggaagaataaagaactcaagtgcggctccgggattttcatcacagataacgtgcacacgtggaccgagcagtacaagtttcaacctgaaagcccctccaaactggcttctgccattcagaaggctcatgaggaaggcatctgtggaattagaagcgtcacacgccttgagaatctgatgtggaaacagatcaccccggagctcaaccacatcctgtccgaaaatgaggtgaagctgacaattatgaccggcgacatccgggggattatgcaggccggaaaaagatctcttcgccctcaacccacggaactcaagtatagctggaaaacctggggcaaggcgaagatgctgtccacagagagccataaccagaccttcctgatcgatgggcctgaaacagccgagtgccccaataccaaccgggcttggaactctctcgaggttgaagactacggatttggcgtgttcacaaccaacatttggctgaaacttagagagaagcaggacgtcttttgtgattccaaactgatgagcgccgctatcaaggacaatcgcgccgtgcacgcggatatgggctattggatcgaatctgccctcaacgacacgtggaaaatggagaaggcttccttcattgaggttaagagctgccactggcctaaatctcatacactgtggagcaatggggtgctggaatccgagatgatcattcccaagaacttcgccggaccggtcagccagcacaactaccggcctggctatcatacccaaaccgctgggccctggcaccttggaaaactcgaaatggattttgacctgtgtgagggcacaaccgtggtggtcacggaagattgcgggaatagaggaccctctctgcggacaaccacagcctccggcaagctcatcaccgagtggtgctgtcgcagctgcacactgcctccgcttagataccggggcgaggacgggtgttggtacggaatggaaattagacccctgaaagagaaggaagagaacctcgttaattccctggtgaccgccggccatgggcagatcgataacttctctctgggagtgcttggcatggctctctttctggaagagatgctgcgcacgcggattgggaccaagcacgcgatcctcctggtcgccgtgagcttcgttacacttatcaccggaaatatgtcctttagagacctgggccgcgtgatggtcatggtgggcgctacaatgaccgatgacattgggatgggagttacgtatctcgccctgctggccgctttcaaagtgagacctacatttgccgcgggccttctgctccggaagctgacctctaaagagctcatgatggctacaatcgggattgccctgcttagccagtccaccatccccgaaaccattctggagctcacagatgccctggctctgggaatgatggtccttaagatcgtgcgcaacatggaaaaataccaactggccgttacgatcatggcgatttcttgcgtgcctaatgctgtcatcctccagaacgcctggaaggtgagctgtaccattctggccgctgtgtccgtcagccccctcctgcttacatcttcccagcagaaggccgactggatccctctggctctcaccattaaaggcctgaatcccacagccatcttcctgaccacgcttagcagaacatctaagaaacggtcctggccgctgaacgaggcgatcatggccgttgggatggtgagcattctcgcttcttccctgctcaagaatgacatccctatgaccggacccctggtggccggcggccttctgaccgtctgctatgtgctgacagggcgcagcgctgatctcgaactggagagagccgccgacgttaaatgggaggatcaagctgaaatttccggaagctctcctatccttagcattaccatctccgaggacggctctatgagcattaagaacgaagaggaggaacagacactgacgatcctcatccggaccgggctgctcgtgatttccggagtctttcccgtgtctatcccgattacagcggccgcttggtacctgtgggaggttaaaaagcagcgcgccggcgtgctttgggatgtcccttctccccctcccgtggaaaaggccgagctggaagacggggcttatagaatcaaacagcgggggattctgggctactcccaaatcggcgccggggtctataaggagggaaccttccacacaatgtggcatgtgacccgcggcgcggttctcatgcacagagggaaacggatcgagccctcctgggctgatgtgaagaaagacctgattagctacggaggcgggtggaaacttgaaggagagtggaaggaaggcgaggaagtccaggtgctggccctcgagcctggcaaaaatccgagagccgttcagacgaagcccgggatctttaaaaccaacacaggaaccattggcgctgtgtccctggatttcagccctgggacatctggatcccccatcgtcgaccgcaagggcaaagtggtggggctctacggaaatggcgttgtcacccggagcggcgcctatgtgtctgcgattgctcagacagagaagtccatcgaagataaccctgagatcgaagacgatatttttagaaagaaacgcctgacgatcatggaccttcatcccggggccggaaagaccaaacggtacctgcctgccattgtgagagaggctatcaagcgcggcctgcggacactcattctggccccgaccagagtcgtggctgccgaaatggaggaggcgcttcgcgggctgcccatccggtatcaaaccacagccattaaaacggaacacaccggaagagagatcgttgacctcatgtgtcatgctacattcaccatgcggctgctcagccctgtgcgcgtccccaactacaatctgatcattatggatgaagcccacttcacagaccctgcttccatcgccgccagaggctatatttctacccgggtggagatgggggaggctgcgggcatctttatgacggccacacccccgggaagccgcgatcctttcccccagtccaacgctcccattatggacgaagagagagaaatccctgagcggagctggaactctggccacgaatgggttaccgattttaaggggaagaccgtgtggttcgtcccctccatcaaagccggaaacgacattgccgcttgccttagaaagaatggcaaaaaggtgatccagctgagccgcaaaacatttgattctgagtacgttaagacccgggccaacgactgggatttcgtggtcacaaccgacattagcgagatgggggcgaattttaaggctgaaagagtgatcgatcctcgccggtgtatgaaaccggtgattctgacggacggagaggaaagagtcatcctcgccggccccatgcctgttacacattcctctgccgctcaacgccgggggagaatcggccgcaaccccaagaatgagaacgaccagtatatttacatgggagaacctctggagaatgatgaggactgcgcccactggaaagaagcgaagatgcttctggataacatcaatacccccgagggcattatcccgagcatgttcgaacctgagagagaaaaagtggacgccattgatggggagtaccggctccgcggagaggctagaaagacatttgtggacctgatgcggcgcggcgatctgcccgtctggctcgcctataaagtggctgccgaagggatcaactacgctgacagaaagtggtgtttcgatggaattaagaataaccagatccttgaggaaaacatggaggttgagatctggaccaaagaaggcgagcggaagaaactgaagcctagatggctggacgcccgcatttattccgatcccctcgcgctgaaagaatttaaggagttcgccgctgggcggaagtctcttacgctgaatctcatcaccgaaatgggcagactgcctacattcatgacccagaaagcccgcaacgctctggacaatctcgccgtgcttcatacagccgaggctggaggccgggcgtacaaccacgccctgagcgagctgcccgaaaccctcgagacactgcttctgctcaccctgctggctacggtcacagggggaatttttctcttccttatgtccggcaaggggatcggaaaaatgaccctgggcatgtgctgcattatcaccgccagcatcctgctctggtatgcccaaattcagccgcactggatcgctgcctctattatcctggaatttttccttattgtgctgctcatccctgagcccgaaaagcagagaacaccccaggataatcaactgacctacgttgtgatcgcgattctgacagtcgtggccgctacgatggccaacgagatgggctttctcgagaaaaccaagaaggaccttgggctgggatccatcacaattcaggaaagcgagtccaatatcctggacattgatctccggcctgcttctgcctggaccctgtatgcggtcgccacaaccttcgtgacgccgatgcttcgccatagcatcgaaaactcctctgttaatgtgagcctgaccgctattgccaaccaggctacagtgctcatgggcctggggaaaggatggcccctgtccaagatggacatcggcgtccctctccttgccatcgggtgttacagccaggttaatcccattaccctgacagctgccctgctcctgcttgtggcgcactacgccatcattggacctggcctgcaagctaaagccaccagagaggctcagaagcgggccgccgcgggcatcatgaaaaaccccacggtggatgggattacagtcatcgacctcgaacctatcccgtatgatcccaagtttgagaagcagctgggacaggtgatgctgctcattctttgcgttacccaagtgctgatgatgcgcacaacctgggctctgtgtgaggccctcaccctggctacaggccctatctctacgctttgggaagggaatcccggaagattctggaacaccacaattgccgtctccatggccaatatctttcggggcagctacctggctggggccggactcctgttctctattatgaaaaacaccacaaatacccgcagaggcacgggcaacatcggggagacactgggagaaaagtggaaatcccggctcaacgcgcttggcaagagcgagtttcagatctataaaaagtctgggattcaggaggtggaccgcaccctggccaaagaaggaatcaagagaggcgagaccgatcatcacgctgtcagccgggggtccgccaagctgagatggttcgtggaacgcaatatggttacacctgagggaaaagtggtcgacctcggctgcggcagagggggatggtcttactattgtggcgggctgaagaacgtgcgggaagttaaaggacttaccaagggcgggcccggacatgaggagccgattcctatgagcacatacggctggaatctggtgcgcctccaatccggcgtcgatgtgtttttcacgccgcccgaaaaatgcgacaccctgctgtgtgatatcggggagagctcccctaaccccacaattgaagctggacggaccctcagagtgcttaatctggttgagaactggctgaataacaatacacagttctgcatcaaggtcctcaacccttatatgccgtctgtgatcgaaaagatggaggccctgcagcgcaaatacggcggggcgcttgtgcggaatcccctgagcagaaactccacccacgagatgtactgggtctctaatgccacgggaaacattgttagctccgtgaatatgatctctcgcatgctcattaaccggtttaccatgaagcacaaaaaggctacatatgaacctgacgtggatctgggcagcgggaccagaaacatcggaattgagtccgaaatccccaatctggacattatcggcaaacgcatcgagaagattaagcaggaacatgagacaagctggcactacgaccaagatcatccttataaaacctgggcctaccacggctcttatgagacaaagcagaccgggtccgctagctctatggtcaacggagtggttcggctccttacgaaaccctgggacgtggtcccgatggtgacacagatggccatgaccgataccacacctttcggccagcaaagagtttttaaggaaaaagtggacacgcgcacccaggagcccaaggaagggacaaagaaactgatgaagatcaccgctgagtggctgtggaaagagctcggaaagaaaaagacacctagaatgtgtacccgggaagagttcacacgcaaagtcagatccaatgccgcgctgggcgccatttttaccgatgaaaacaagtggaaaagcgctcgggaggccgtggaagacgggagattctgggagcttgtggatcgggagcgcaatctgcacctcgaaggaaaatgcgagacgtgtgtctacaacatgatgggcaagagagagaagaagctgggcgagtttgggaaagctaagggatctcgggccatctggtatatgtggctgggcgcccgcttcctcgaatttgaggcgctggggttccttaatgaggaccattggttttccagaggaaacagcctgtccggcgttgaaggggagggcctccaccggctgggatacattcttcgcgatgtgggcaagaaagaagggggagtgatgtacgctgacgataccgccggctgggacacaagaatcaccctggaggacctcaagaatgaagaactggtcacaaaccatatgaaaggggagcacaagaaactggccgaagctatcttcaagctcacctatcagaataaggtggttcgggtgcagcgccccacgcctagaggaacagtcatggatattatcagccggcgcgaccaaagaggctctggacaggtgggcacctacggactgaacacatttaccaatatggaggcccagcttattcggcaaatggaaggcgaggggatcttcaaaagcattcagcatctgacggctaccgaggaaatcgccgttcagaactggctcgcgcgcgtgggaagagagcggctgtccagaatggccatctctggcgatgactgcgtcgtgaagcccattgatgaccgcttcgctagcgcccttacagctctgaatgatatggggaaagttcggaaggacatccagcaatgggaaccgtccagaggatggaacgattggacccaggtgcctttttgctctcaccacttccatgagctcgtcatgaaagacggccgcgtgctggtcgtgccctgtcggaaccaggatgaactgattgggagagcccgcatcagccagggcgcgggatggtccctcaaggagacagcctgcctgggcaagtcttatgctcaaatgtggacccttatgtactttcaccggagagacctgcgcctcgccgctaatgccatttgtagcgctgttccctcccattgggtgcctacaagccggaccacgtggtctatccacgccaaacacgagtggatgacaaccgaagatatgctggcggtctggaacagagtgtggattcaggagaatccgtggatggaagacaagacccccgtggagtcctgggaagaggttccttatcttgggaaacgcgaggaccagtggtgcggaagcctgatcggcctcacatctcgggccacctgggctaagaacatccagacagccattaatcaagtgagatccctgatcgggaacgaagagtacacggattatatgcccagcatgaaacggttcagacgcgaagaggaagaggccggagtcctgtggtga

SEQ ID NO: 19819 - RNA, 9876 nt, synthetic construct
  misc_feature 1..9876: note = derived and/or modified CDS sequence (opt5) from DENV-2__EU482684__SS-prME
  source 1..9876: mol_type = other RNA
acagccggcgtgatcgtcatgctgattcccacagctatggccttccacctcacgacccggaatggggaacctcatatgatcgttggacggcaggaaaagggcaagagcctgctttttaagacagaagacggggtgaatatgtgcaccctgatggcgattgatctcggagaactgtgtgaggacacaatcacctacaagtgcccgcttctgcgccaaaatgaacccgaggatattgactgttggtgcaattccacatctacctgggtgacgtatggcacctgtacaaccacaggggagcacagacgggaaaagcgcagcgtcgctctcgtgcctcatgttggaatgggcctggagaccagaacggaaacatggatgtcctctgagggcgcctggaaacacgtgcagcggatcgagacctggatcctgcgccatcccgggttcacaattatggccaccatcctcgcttacaccattggaacaacgcactttcagagagccctgatcttcattcttctgaccgctgtcgcccctagcatgacaatgcggtgcatcggcatttccaaccgcgattttgtggaaggggtttctggaggcagctgggtggacatcgtcctcgagcacgggtcctgtgtgaccacaatggcgaagaataagcccaccctggatttcgaacttatcaaaacggaggccaagcagcctgctacactgagaaaatattgcattgaagccaagctcaccaacaccacaaccgagagccggtgtccgacacaaggagagccctctctgaatgaagaacaggacaaacgctttatctgcaagcattccatggtggatagaggctggggcaacgggtgtggactgttcggcaaaggcgggattgtcacgtgcgctatgtttacctgcaaaaagaatatggaagggaaagttgtgcagcctgagaacctcgaatacacaatcgtgattacaccccacagcggggaggagcatgccgtcggaaatgacacaggcaagcacggcaaagaaatcaagatcacccctcagtcttccattacggaggcggaactgaccgggtatggaacagtgaccatggagtgtagcccccggacaggccttgatttcaacgaaatggttctgctccaaatggaggacaaagcctggctggtgcaccgccagtggtttcttgatctgccgctcccttggctgcccggggctgacacccagggatctaattggatccagaaggagacgctggtcacattcaagaaccctcatgccaaaaagcaagacgtggttgtgctcggctcccaggaaggggctatgcacaccgccctgacaggcgccaccgagattcagatgagctccggaaatcttctgtttaccggccatctcaaatgcagactgcggatggataaacttcaactgaaagggatgtcttacagcatgtgtacaggaaagttcaagatcgtcaaagaaattgctgagacgcagcacggcaccatcgtgatcagagtccagtatgagggggacggatccccctgcaagattcccttcgaaatcacagatctcgagaaacgccatgtgctgggccggctgattaccgttaaccctatcgtgacagaaaaggacagcccggtcaacattgaggcggaacccccttttggggattcttacatcattatcggcgtggagcccggacagctcaaactgaattggttcaagaagggctccagcatcgggcaaatgtttgagaccacgatgagaggagccaaacgcatggctattcttggcgacacagcctgggatttcgggtctctgggaggcgtttttaccagcatcgggaaggccctccaccaggtgttcggcgctatttacggagccgcgttttccggcgtctcttggaccatgaaaatcctgattggggtgatcatcacatggattggaatgaacagccggtccaccagcctgtctgtgtcccttgttctcgtcggcgtggtgacactgtatctgggggctgtcgtgcaggccgacagcggatgtgttgtgtcttggaagaataaagaactcaagtgcggctccgggatcttcattacggataacgtccacacctggacagagcagtacaagtttcaacctgaaagcccctccaaactggcctctgctatccagaaggcccatgaggaaggcatttgtggaatcagaagcgtgacccgccttgagaatctgatgtggaaacagatcacaccggagctcaaccacattctgtccgaaaatgaggttaagctgaccatcatgacgggcgacattaaagggatcatgcaggctggaaagcggtctcttagacctcaacccaccgaactcaaatatagctggaagacatggggcaaggccaaaatgctgtccaccgagagccataaccagacattcctgattgatgggcctgaaaccgcggagtgccccaatacaaaccgcgcctggaactctctcgaggtggaagactacggatttggcgtcttcaccacgaacatctggctgaaacttcgggagaaacaggacgtgttttgtgattccaagctgatgagcgctgccatcaaagacaatagagctgttcacgccgatatgggctattggattgaatctgcgctcaacgacacatggaagatggagaaggcctccttcatcgaggtgaaaagctgccactggcctaagtctcataccctgtggagcaatggggtcctggaatccgagatgattatccccaaaaacttcgctggaccggtgagccagcacaactaccgccctggctatcatacccaaacagccgggccctggcaccttggaaagctcgaaatggattttgacttctgtgagggcaccacggtggtcgttacagaagattgcgggaatcggggaccctctctgagaaccacaaccgcttccggcaaactgattacagagtggtgctgtcggagctgcaccctccctccgctgcgctacagaggcgaggacgggtgttggtacggaatggaaatccggccccttaaggagaaggaagagaacctggtgaatagcctcgtgacggccggccatgggcagattgataacttttctctgggagtcctgggcatggcccttttcctcgaagagatgctgagaacccgcatcgggacaaaacacgctatcctgctcgtggcggttagctttgtgaccctgattacaggaaatatgtccttccgggaccttggcagagtcatggtgatggttggcgccaccatgacggatgacatcgggatgggagtgacatatctggctctcctggccgcctttaaggtccgccctaccttcgctgccggcctgcttctgagaaaactcacatctaaggagctgatgatggcgaccattgggatcgctctcctgagccagtccaccattcccgaaacaatccttgagctgacggatgccctcgccctgggaatgatggtgctgaaaatcgttcggaacatggaaaagtaccaacttgctgtgaccattatggccatctcttgcgtccctaatgcggtgattctgcagaacgcttggaaggtgagctgtacaatcctcgccgccgtctccgttagccccctgctcctgacctcttcccagcagaaagctgactggattcctcttgccctgacaatcaagggcctcaatcccaccgctatctttctgacgacactgagccgcacctctaaaaagagatcctggccgcttaacgaggccattatggcggtggggatggtgagcatcctggcctcttccctcctgaaaaatgacattcctatgaccggacccctcgtcgctggcggcctgcttacagtgtgctatgttctgaccgggcggagcgccgatctggaactcgagcgcgctgccgacgtgaagtgggaggatcaagccgaaatctccggaagctctcctattctgagcatcacaatttccgaggacggctctatgagcatcaaaaacgaagaggaggaacagacgcttaccatcctgattagaacagggctcctggtcatctccggagtgttccccgtttctattccgatcaccgctgcggcctggtacctctgggaggtgaagaagcagcgggctggcgtcctgtgggatgtgccttctccccctcccgtcgaaaaagccgagcttgaagacggggcctatcgcattaagcagagaggaatcctgggctactcccaaatcggcgctggggtgtataaagagggaacatttcacaccatgtggcatgttacgcggggcgccgtgctgatgcaccgcgggaagagaattgagccctcctgggcggatgtcaaaaaggacctcatcagctacggaggcgggtggaagctggaaggagagtggaaagaaggcgaggaagtgcaggttcttgctctggagcctggcaagaatccgcgggccgtgcagaccaaacccgggattttcaagacaaacaccggaacaatcggcgccgtctccctcgattttagccctgggacctctggatcccccattgtggacagaaaaggcaaggtggttgggctgtacggaaatggcgtcgtgacacgcagcggcgcttatgtgtctgccatcgcgcagacggagaagtccatcgaagataaccctgagattgaagacgatatcttccggaaaaagagactcaccattatggacctgcatcccggggctggaaaaacaaagcgctaccttcctgccatcgtccgggaggccattaaaagaggcctgcgcaccctgatcctcgctccgacccgggtggttgccgctgaaatggaggaggccctgagagggcttcccattcgctatcaaacccctgcgatcaagacggaacacaccggacgggagatcgtggacctgatgtgtcatgccacattcaccatgagactcctgagccccgtccgggtgcctaactacaatctcattatcatggatgaagctcactttacagaccccgcctccattgctgcccgcggctatatctctaccagagttgagatgggggaggccgctggcattttcatgacggcgacaccgcctggaagccgggatccctttccccagtccaacgcccctatcatggacgaagaaagagaaatccccgagagaagctggaactctggccacgaatgggtgaccgatttcaaggggaaaaccgtctggtttgtgccttccattaaggctggaaacgacatcgccgcctgcctgcggaaaaatggcaagaaagttattcagcttagcagaaagacattcgattctgagtacgtgaagacccgcgctaacgactgggattttgtcgtgacaaccgacatcagcgagatgggggccaatttcaaagcggaacgggtgattgatccgagacgctgtatgaagcccgtcatcctgacggacggagaggaacgggttatcctggctggccctatgcccgtgacacattcctctgccgcccaaagacgcgggcggattggcagaaaccctaaaaatgagaacgaccagtatatctacatgggagaacccctcgagaatgatgaggactgcgctcactggaaggaagccaaaatgctgcttgataacattaataccccggagggcatcattcctagcatgtttgaacccgagcgcgaaaaggtggacgcgatcgatggggagtacagactgcggggagaggcccgcaaaacattcgtcgacctcatgagacggggcgatctgcctgtgtggctggcttataaggttgccgctgaagggattaactacgccgaccgcaagtggtgttttgatggaatcaaaaataaccagatcctcgaggaaaacatggaggtggagatttggaccaaggaaggcgagcgcaagaaacttaaaccccggtggctggacgctagaatctattccgatcctctggccctcaaggagttcaaggagttcgcggccgggcgcaaatctctgacgcttaatctgattaccgaaatgggccggctccccacatttatgacccagaaggctagaaacgccctggacaatctggctgtcctccatacagccgaggccggaggccgcgcttacaaccacgcgcttagcgagctgccggaaaccctggagacactcctgcttctgaccctcctggccacggtgacagggggaatcttcctgtttctcatgtccggcaaagggattggaaagatgacccttggcatgtgctgcatcatcaccgctagcattctgctgtggtatgcccaaatccagcctcactggattgccgcttctatcattctcgagttctttctgatcgttcttctgatccccgagcccgaaaaacagcggacacctcaggataatcaactcacctacgtggtcattgccatcctgacagtggtcgcggccacgatggctaacgagatgggcttcctggagaagaccaagaaagacctcgggcttggatccattacaacccaggaaagcgagtccaatatcctggacattgatctgagaccggcctctgcttggacactctatgccgtggcgaccacgtttgttacccccatgctgcggcatagcatcgaaaactcctctgtgaatgtgagccttacagccattgctaaccaggccaccgtcctgatgggcctcgggaagggatggcctctgtccaaaatggacatcggcgttcccctgctcgctatcgggtgttacagccaggtgaatcctattacacttaccgccgctctgctgctcctggtggcccactacgcgatcattggacccggccttcaagccaaggctacgcgcgaggcccagaaaagagctgccgccggcatcatgaagaaccctacagtcgatgggattaccgtgatcgacctggaaccgatcccctatgatcctaagttcgagaaacagctcggacaggttatgctgctgattctctgcgtgacacaagtccttatgatgcggaccacctgggcgctgtgtgaggctctgacactcgccacgggccccatctctaccctgtgggaagggaatcctggacgcttttggaacacaaccattgctgtgtccatggccaatatcttcagaggcagctaccttgccggggctggactgctcttttctattatgaagaacacaacctccacgcggcgcggcacaggcaatatcggggagaccctgggagaaaaatggaaaagcagactgaacgccctcggcaaatctgagttccagatctataagaaaagcgggattcaggaggtcgaccggacccttgcgaaggaaggaatcaagcgcggcgagacagatcatcacgccgtgtccagagggtctgctaaactgcggtggtttgttgaaagaaacatggtgacccccgagggaaaggtcgtggacctgggctgcggccgcgggggatggagctactattgtggcgggctcaaaaatgttcgggaagtgaagggactgacaaaaggcgggccgggacatgaggagcctattcccatgtccacgtacggctggaaccttgtcagactgcaaagcggcgtggatgtgttcttcacaccccctgaaaagtgcgacaccctcctgtgtgatatcggggagtcctctcccaatcctaccattgaagccggacgcacactgcgggttctcaaccttgtcgagaattggctgaacaataacacccagttttgcatcaaggtgctgaatccgtatatgcccagcgtgatcgagaagatggaggctctccagagacagtacggcggggccctggtccgcaaccctctttccagaaattctacgcacgagatgtactgggttagcaacgcgaccggaaatattgtgtcctctgtgaacatgatcagcagaatgctgattaatcgcttcacaatgaagcacaaaaaggccacctatgaacccgacgtcgatctcggctccgggacacggaacatcggaattgagagcgaaatccctaacctggacattatcggcaaaagaatcgagaagattaagcaagaacatgagatctcttggcactacgaccaggatcatccctataaaacctgggcttaccacggctcctatgagacaaagcagaccgggagcgcctcttccatggtgaatggagttgtgcgcctgctcacgaaaccgtgggacgtcgtgcctatggttacacagatggctatgaccgataccacaccctttggccaacagcgggtgttcaaggaaaaagtcgacacgagaacccaggagcctaaggaagggacaaagaaacttatgaagattaccgccgagtggctgtggaaagagctgggaaagaaaaagacaccccgcatgtgtaccagagaagagtttaccaagaaggtgcggagcaacgctgccctcggcgcgatcttcaccgatgaaaataagtggaaatctgcccgcgaggctgtggaagacgggagattttgggagctggtcgatcgggagagaaaccttcacctggaaggaaagtgcgagacgtgtgtttacaatatgatgggcaaacgggaaaagaaactcggcgagttcgggaaggccaagggatcccgcgctatttggtatatgtggctgggcgccagatttctggagttcgaggccctcgggtttctgaacgaggaccattggttcagccggggaaattcccttagcggcgtggaaggggagggcctgcaccgcctcggatacatcctgagagatgtgggcaaaaaggaagggggagcgatgtacgctgacgataccgccggctgggacacacggatcacccttgaggacctgaaaaacgaagagatggtcacaaatcatatgaagggggagcacaaaaagctcgccgaagctatttttaagctgacctatcagaacaaagtggttcgcgtgcaaagacctacgccccggggaacagtcatggatatcatttctcgcagagaccagcggggcagcggacaggtgggcacctacggactgaatacattcaccaacatggaggcccaactcatccgccagatggaaggcgaggggattttcaagtccatccagcatctgacggctaccgaggaaatcgccgttcagaattggcttgcgagagtgggacgggagcgcctgtctagaatggccattagcggcgatgactgcgtcgtgaaaccgatcgatgaccggtttgcttccgccctcacagctctgaacgatatggggaaggttagaaaagacattcaacagtgggaaccttctcgcggatggaatgattggacccaggtgcccttctgcagccaccactttcatgagcttgtcatgaaggacggccgggtgctggtcgtgccctgtagaaaccaggatgaactcatcgggcgcgcccggatttcccaaggcgcgggatggtctctgaaggagacagcctgcctgggcaaaagctatgctcagatgtggaccctcatgtacttccacagacgcgacctgcggcttgccgctaacgccatctgttccgctgttcctagccattgggtgccgacatctagaaccacgtggtccattcacgccaagcacgagtggatgacaaccgaagatatgctggcggtctggaatcgcgtgtggatccaggagaacccctggatggaagacaaaacccctgtggagagctgggaagaggttccctatctcgggaagcgggaggaccagtggtgcggatctctgatcggccttacatccagagccacctgggctaaaaatattcaaacagccatcaaccaggtgcgcagcctgattgggaatgaagagtacacggattatatgccttccatgaagcggtttagacgggaagaggaagaggccggagtcctctggtga

SEQ ID NO: 19820 - RNA, 9876 nt, synthetic construct
  misc_feature 1..9876: note = derived and/or modified CDS sequence (opt5) from DENV-2__EU482685__SS-prME
  source 1..9876: mol_type = other RNA
accgccggcgtgatcgtcatgctgattcccaccgctatggccttccacctcacgaccagaaatggggagcctcatatgatcgttggacggcaggaaaagggcaagagcctgctttttaagaccgaggacggggtgaatatgtgcaccctgatggcgattgatctcggagaactgtgtgaggacacgatcacctacaagtgcccgcttctgcgccaaaacgaacccgaggatattgactgttggtgcaattccacatctacctgggtgacgtatggcacctgtacaaccacaggggagcacagacgggaaaagcgcagcgtcgctctcgtgcctcatgttggaatgggcctggagaccagaacggaaacatggatgtcctctgagggcgcctggaagcacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaggaacaggacaaacgctttatctgcaagcattccatggtggatagaggctggggcaacgggtgtggactgttcggcaaagggggaattgtcacatgcgccatgtttacgtgcaaaaagaatatggaaggcaaagttgtgcagcctgagaacctcgaatacaccatcgtgattacaccccacagcggggaggagcatgcggtcggaaatgacaccggcaagcacggcaaagaaatcaagatcacacctcagtcttccattaccgaggccgaactgacggggtatggaaccgtgacaatggagtgtagcccccggaccggccttgatttcaacgaaatggttctgctccaaatggaggacaaggcttggctggtgcaccgccagtggtttcttgatctgccgctcccttggctgcccggggccgacacacagggatctaattggatccagaaggagaccctggtcacgttcaagaaccctcatgctaaaaagcaagacgtggttgtgctcggctcccaggaaggggccatgcacacagccctgaccggcgctacagagattcagatgagctccggaaatcttctgtttaccggccatctcaaatgcagactgcggatggataaacttcaactgaaagggatgtcttacagcatgtgtaccggaaagttcaagatcgtcaaagaaattgcggagacacagcacggcacgatcgtgatcagagtccagtatgagggggacggatccccctgcaagattcccttcgaaatcaccgatctcgagaaacgccatgtgctgggccggctgattacagttaaccctatcgtgaccgaaaaggacagcccggtcaacattgaggccgaacccccttttggggattcttacatcattatcggcgtggagcccggacagctcaaactgaattggttcaagaagggctccagcatcgggcaaatgtttgagacaaccatgagaggagctaaacgcatggccattcttggcgacacggcctgggatttcgggtctctgggaggcgtttttacaagcatcgggaaggctctccaccaggtgttcggcgccatttacggagcggctttttccggcgtctcttggaccatgaaaatcctgattggggtgatcatcacctggattggaatgaacagccggtccacaagcctgtctgtgtcccttgttctcgtcggcgtggtgaccctgtatctgggggccgtcgtgcaggccgacagcggatgtgttgtgtcttggaagaataaagaactcaagtgcggctccgggatcttcattacagataacgtccacacgtggaccgagcagtacaagtttcaacctgaaagcccctccaaactggcttctgccatccagaaggctcatgaggaaggcatttgtggaatcagaagcgtgacacgccttgagaatctgatgtggaaacagatcaccccggagctcaaccacattctgtccgaaaatgaggttaagctgacaatcatgaccggcgacattaaagggatcatgcaggccggaaagcggtctcttagacctcaacccacggaactcaaatatagctggaagacctggggcaaggcgaaaatgctgtccacagagagccataaccagaccttcctgattgatgggcctgaaacagccgagtgccccaataccaaccgcgcttggaactctctcgaggtggaagactacggatttggcgtcttcacaaccaacatctggctgaaacttcgggagaaacaggacgtgttttgtgattccaagctgatgagcgccgctatcaaagacaatagagccgttcacgcggatatgggctattggattgaatctgccctcaacgacacgtggaagatggagaaggcttccttcatcgaggtgaaaagctgccactggcctaagtctcatacactgtggagcaatggggtcctggaatccgagatgattatccccaaaaacttcgccggaccggtgagccagcacaactaccgccctggctatcatacccaaaccgctgggccctggcaccttggaaagctcgaaatggattttgacttctgtgagggcacaaccgtggtcgttacggaagattgcgggaatcggggaccctctctgagaacaaccacagcctccggcaaactgattaccgagtggtgctgtcggagctgcacactccctccgctgcgctacagaggcgaggacgggtgttggtacggaatggaaatccggccccttaaggagaaggaagagaacctggtgaatagcctcgtgaccgccggcaacgggcagattgataatttttctctgggagtcctgggcatggctcttttcctcgaagagatgctgagaacgcgcatcgggaccaaacatgcgatcctgctcgtggccgttagctttgtgacactgattaccggaaacatgtccttccgggaccttggcagagtcatggtgatggttggcgctacaatgaccgatgacatcgggatgggagtgacgtatctggccctcctggccgcttttaaggtccgccctacattcgccgcgggcctgcttctgagaaaactcacctctaaggagctgatgatggctacaattgggatcgccctcctgagccagtccaccattcccgaaaccatccttgagctgacagatgccctcgctctgggaatgatggtgctgaaaatcgttcggaatatggaaaagtaccaacttgccgtgacgattatggcgatctcttgcgtccctaacgctgtgattctgcagaatgcctggaaggtgagctgtaccatcctcgccgctgtctccgttagccccctgctcctgacatcttcccagcagaaagccgactggattcctcttgctctgaccatcaagggcctcaaccccacagccatctttctgaccacgctgagccgcacatctaaaaagagatcctggccgcttaatgaggcgattatggccgtggggatggtgagcatcctggcttcttccctcctgaaaaacgacattcctatgaccggacccctcgtcgccggcggcctgcttaccgtgtgctatgttctgacagggcggagcgctgatctggaactcgagcgcgccgccgacgtgaagtgggaggatcaagctgaaatctccggaagctctcctattctgagcatcaccatttccgaggacggctctatgagcatcaaaaatgaagaggaggaacagacacttacgatcctgattagaaccgggctcctggtcatctccggagtgttccccgtttctattccgatcacagcggccgcttggtacctctgggaggtgaagaagcagcgggccggcgtcctgtgggatgtgccttctccccctcccgtcgaaaaagccgagcttgaagacggggcttatcgcattaagcagagaggaatcctgggctactcccaaatcggcgccggggtgtataaagagggaacctttcacacaatgtggcacgttacccggggcgcggtgctgatgcatcgcgggaagagaattgagccctcctgggctgatgtcaaaaaggacctcatcagctacggaggcgggtggaagctggaaggagagtggaaagaaggcgaggaagtgcaggttcttgccctggagcctggcaagaacccgcgggccgtgcagacgaaacccgggattttcaagaccaatacaggaaccatcggcgctgtctccctcgattttagccctgggacatctggatcccccattgtggacagaaaaggcaaggtggttgggctgtacggaaacggcgtcgtgacccgcagcggcgcctatgtgtctgcgatcgctcagacagagaagtccatcgaagataaccctgagattgaagacgatatcttccggaaaaagagactcacgattatggacctgcaccccggggccggaaaaaccaagcgctaccttcctgccatcgtccgggaggctattaaaagaggcctgcgcacactgatcctcgccccgacccgggtggttgctgccgaaatggaggaggcgctgagagggcttcccattcgctatcaaacccctgccatcaagacagaacatacgggacgggagatcgtggacctgatgtgtcacgctaccttcacaatgagactcctgagccccgtccgggtgcctaattacaacctcattatcatggatgaagcccattttaccgaccccgcttccattgccgcccgcggctatatctctacaagagttgagatgggggaggctgcgggcattttcatgaccgccacgccgcctggaagccgggatccctttccccagtccaatgctcctatcatggacgaagaaagagaaatccccgagagaagctggaactctggccacgaatgggtgacagatttcaaggggaaaaccgtctggtttgtgccttccattaaggccggaaatgacatcgccgcttgcctgcggaaaaacggcaagaaagttattcagcttagcagaaagaccttcgattctgagtacgtgaagacacgcgccaatgactgggattttgtcgtgaccacagacatcagcgagatgggggcgaacttcaaagctgaacgggtgattgatccgagacgctgtatgaagcccgtcatcctgaccgacggagaggaacgggttatcctggccggccctatgcccgtgacgcactcctctgccgctcaaagacgcgggcggattggcagaaatcctaaaaacgagaatgaccagtatatctacatgggagaacccctcgagaacgatgaggactgcgcccattggaaggaagcgaaaatgctgcttgataatattaacacaccggagggcatcattcctagcatgtttgaacccgagcgcgaaaaggtggacgccatcgatggggagtacagactgcggggagaggctcgcaaaaccttcgtcgacctcatgagacggggcgatctgcctgtgtggctggcctataaggttgctgccgaagggattaattacgctgaccgcaagtggtgttttgatggaatcaaaaacaaccagatcctcgaggaaaatatggaggtggagatttggacaaaggaaggcgagcgcaagaaacttaaaccccggtggctggacgccagaatctattccgatcctctggcgctcaaggagttcaaggagttcgccgctgggcgcaaatctctgacccttaacctgattacggaaatgggccggctccccacctttatgacacagaaggccagaaatgctctggacaacctggccgtcctccacaccgccgaggctggaggccgcgcgtacaatcatgcccttagcgagctgccggaaacactggagaccctcctgcttctgacactcctggctaccgtgacagggggaatcttcctgtttctcatgtccggcaaagggattggaaagatgacacttggcatgtgctgcatcatcaccgccagcattctgctgtggtatgcccaaatccagcctcactggattgctgcctctatcattctcgagttctttctgatcgttcttctgatccccgagcccgaaaaacagcggacccctcaggataaccaactcacatacgtggtcattgcgatcctgaccgtggtcgccgctacaatggccaatgagatgggcttcctggagaagacgaagaaagacctcgggcttggatccattaccacacaggaaagcgagtccaacatcctggacattgatctgagaccggcttctgcctggaccctctatgcggtggccacaacctttgttacgcccatgctgcggcacagcatcgaaaattcctctgtgaacgtgagccttaccgctattgccaatcaggctacagtcctgatgggcctcgggaagggatggcctctgtccaaaatggacatcggcgttcccctgctcgccatcgggtgttacagccaggtgaaccctattacccttacagctgccctgctgctcctggtggcgcattacgccatcattggacccggccttcaagctaaggccacccgcgaggctcagaaaagagccgccgcgggcatcatgaagaatcctacggtcgatgggattacagtgatcgacctggaaccgatcccctatgatcctaagttcgagaaacagctcggacaggttatgctgctgattctctgcgtgacccaagtccttatgatgcggacaacctgggctctgtgtgaggccctgaccctcgctacaggccccatctctacgctgtgggaagggaaccctggacgcttttggaataccacaattgccgtgtccatggccaacatcttcagaggcagctaccttgctggggccggactgctcttttctattatgaagaataccacatccacccggcgcggcacgggcaacatcggggagacactgggagaaaaatggaaaagcagactgaacgcgctcggcaaatctgagttccagatctataagaaaagcgggattcaggaggtcgaccggacccttgccaaggaaggaatcaagcgcggcgagaccgatcaccatgctgtgtccagagggtctgccaaactgcggtggtttgttgaaagaaatatggtgacacccgagggaaaggtcgtggacctgggctgcggccgcgggggatggagctactattgtggcgggctcaaaaacgttcggcaagtgaagggactgaccaaaggcgggccgggacacgaagaacctattcccatgtccacatacggctggaatcttgtcagactgcagagcggcgtggatgtgttcttcacgccccctgagaagtgcgacaccctcctgtgtgatatcggggaatcctctcccaaccctacaattgaggctggacgcaccctgcgggttctcaatcttgtcgaaaactggctgaataacaatacacagttttgcatcaaggtgctgaacccgtatatgcccagcgtgatcgagaaaatggaagccctccagagacaatacggcggggcgctggtccgcaatcctctttcccggaactctacccatgagatgtactgggttagcaatgccacgggaaacattgtgtcctctgtgaatatgatcagcagaatgctgattaaccgcttcaccatgaagcacaaaaaggctacatatgagcccgacgtcgatctcggctccgggacccggaacatcggaattgaaagcgagatccctaatctggacattatcggcaaaagaatcgaaaagattaagcaggagcacgaaatctcttggcattacgaccaggatcacccctataaaacatgggcctaccatggctcctatgagaccaagcagacagggagcgcttcttccatggtgaacggagttgtgcgcctgctcaccaaaccgtgggacgtcgtgcctatggttacgcaaatggccatgacagataccaccccctttggccagcagcgggtgttcaaggagaaagtcgacacaagaacgcaggaacctaaggaggggaccaagaaacttatgaagattacagctgaatggctgtggaaagagctgggaaagaaaaagacaccccgcatgtgtacaagagaggaatttaccaaaaaggtgcggagcaatgccgcgctcggcgccatcttcacagatgagaacaagtggaaatctgctcgcgaagccgtggaggacgggagattttgggaactggtcgatcgggagagaaatcttcacctggagggaaagtgcgaaacctgtgtttacaacatgatgggcaaacgggagaagaaactcggcgagttcgggaaggctaagggatcccgcgccatttggtatatgtggctgggcgccagatttctggagttcgaagcgctcgggtttctgaatgaggaccactggttcagccggggaaactcccttagcggcgtggagggggaaggcctgcatcgcctcggatacatcctgagagatgtgggcaaaaaggaagggggagctatgtacgccgacgatacggccggctgggacacccggatcacacttgaagacctgaaaaatgaggaaatggtcaccaaccacatgaagggggagcataaaaagctcgctgaggccatttttaagctgacatatcaaaataaagtggttcgcgtgcagagacctacaccccggggaacggtcatggatatcatttctcgcagagaccagcggggcagcgggcaagtgggcacatacggactgaacaccttcacaaatatggaagctcagctcatccgccagatggagggcgaagggattttcaagtccatccagcacctgaccgccacggaggagatcgcggttcaaaactggcttgccagagtgggacgggaacgcctgtctagaatggctattagcggcgatgactgcgtcgtgaaaccgatcgatgaccggtttgcctccgctctcaccgccctgaatgatatggggaaggttagaaaagacattcagcagtgggagccttctcgcggatggaacgattggacacaggtgcccttctgcagccatcactttcacgaacttgtcatgaaggacggccgggtgctggtcgtgccctgtagaaaccaagatgagctcatcgggcgcgcgcggatttcccagggcgccggatggtctctgaaggaaaccgcttgcctgggcaaaagctatgcccagatgtggacactcatgtacttccatagacgcgacctgcggcttgctgccaatgctatctgttccgccgttcctagccactgggtgccgacctctagaacaacctggtccattcatgcgaagcacgagtggatgacgacagaggatatgctggccgtctggaaccgcgtgtggatccaggaaaatccctggatggaggacaaaacccctgtggaaagctgggaggaagttccctatctcgggaagcgggaggaccaatggtgcggatctctgatcggccttacctccagagctacatgggccaaaaacattcagaccgccatcaatcaggtgcgcagcctgattgggaacgaggaatacacagattatatgccttccatgaagcggtttagacgggaggaagaggaagctggagtcctctggtga

SEQ ID NO: 19821 - RNA, 9876 nt, synthetic construct
  misc_feature 1..9876: note = derived and/or modified CDS sequence (opt5) from DENV-2__EU482687__SS-prME
  source 1..9876: mol_type = other RNA
accgccggcgtgatcgtcatgctgattcccaccgctatggccttccacctcacgacccggaatggggaacctcatatgatcgttggacggcaggaaaagggcaagagcctgctttttaagaccgaagacggggtgaatatgtgcaccctgatggcgattgatctcggagaactgtgtgaagacacgatcacctacaaatgcccgcttctgcgccaaaatgaacccgaggatattgactgttggtgcaatagcacatctacctgggtgacgtatggcacctgtacaaccacaggggagcacagacgggaaaagcgcagcgtcgctctcgtgcctcatgttggaatgggcctggagaccagaacggaaacatggatgtcctctgagggcgcctggaaacacgtgcagcggatcgagacctggatcctgcgccatcccgggttcacaattatggccgctgtcctcgcctacaccatcggaaccacacactttcagagagctctgattttcgtgcttctgacggccgttgcgcctagcatgaccatgcggtgcatcggcatttccaaccgcgattttgtggaaggggtctctggaggcagctgggtggacatcgtgctcgagcacgggtcctgtgtcacaaccatggccaagaataagcccacactggatttcgaacttattaaaaccgaggctaagcagcctgccacgctgagaaaatattgcatcgaagctaagctcacaaacaccaccacagagagccggtgtccgacccaaggagagccctctctgaatgaagaacaggacaaacgctttatctgcaagcattccatggttgatagaggctggggcaacgggtgtggactgttcggcaaaggcgggattgtgacatgcgccatgtttacgtgcaaaaagaatatggaagggaaagtggtccagcctgagaacctcgaatacaccatcgtgattacaccccacagcggggaggagcatgcggttggaaatgacaccggcaagcacggcaaagaaatcaagattacacctcagtcttccatcaccgaggccgaactgacggggtatggaaccgtgacaatggagtgtagcccccggaccggccttgatttcaacgaaatggtcctgctccaaatggaggacaaggcttggctggtgcaccgccagtggtttcttgatctgccgctcccttggctgcccggggccgacacacagggatctaattggatccagaaggagaccctggttacgttcaagaaccctcatgctaaaaagcaagacgtggtcgtgctcggctcccaggaaggggccatgcacacagccctgaccggcgctacagagattcagatgagctccggaaatcttctgtttaccggccatctcaaatgcagactgcggatggataaacttcaactgaaagggatgtcttacagcatgtgtaccggaaagttcaagatcgtcaaagaaattgcggagacacagcacggcacgatcgtgattagagttcagtatgagggggacggatccccctgcaagatccccttcgaaatcaccgatctcgagaaacgccatgtgctgggccggctgattacagtcaaccctatcgtgaccgaaaaggacagcccggttaacattgaggccgaacccccttttggggattcttacatcattatcggcgtggagcccggacagctcaaactgaattggttcaagaagggctccagcattgggcaaatgtttgagacaaccatgagaggagctaaacgcatggccatccttggcgacacggcctgggatttcgggtctctgggaggcgtctttacaagcatcgggaaggctctccaccaggtgttcggcgccatttacggagcggctttttccggcgtgtcttggaccatgaaaatcctgattggggttatcattacctggatcggaatgaacagccggtccacaagcctgtctgtctcccttgtgctcgtgggcgtcgtgaccctgtatctgggggccgttgtgcaggccgacagcggatgtgtcgtgtcttggaagaataaagaactcaagtgcggctccgggatcttcattacagataacgttcacacgtggaccgagcagtacaagtttcaacctgaaagcccctccaaactggcttctgccatccagaaggctcatgaggaaggcatttgtggaatcagaagcgtgacacgccttgagaatctgatgtggaaacagattaccccggagctcaaccacatcctgtccgaaaatgaggtcaagctgacaatcatgaccggcgacattaaagggatcatgcaggccggaaagcggtctcttagacctcaacccacggaactcaaatatagctggaagacctggggcaaggcgaaaatgctgtccacagagagccataaccagaccttcctgattgatgggcctgaaacagccgagtgccccaataccaaccgcgcttggaactctctcgaggtggaagactacggatttggcgttttcacaaccaacatctggctgaaacttcgggagaaacaggacgtgttttgtgattccaagctgatgagcgccgctattaaagacaatagagccgtccacgcggatatgggctattggatcgaatctgccctcaacgacacgtggaagatggagaaggcttccttcatcgaggtgaaaagctgccactggcctaagtctcatacactgtggagcaatggggtgctggaatccgagatgattatccccaaaaacttcgccggaccggtcagccagcacaactaccgccctggctatcatacccaaaccgctgggccctggcaccttggaaagctcgaaatggattttgacttctgtgagggcacaaccgttgtggtgacggaagattgcgggaatcggggaccctctctgagaacaaccacagcctccggcaaactgattaccgagtggtgctgtcggagctgcacactccctccgctgcgctacagaggcgaggacgggtgttggtacggaatggaaatccggccccttaaggagaaggaagagaacctggtcaattccctcgtgaccgccggccatgggcagattgataacttttctctgggagttctgggcatggctcttttcctcgaagagatgctgagaacgcgcatcgggaccaaacacgcgattctgctcgtggccgtcagctttgtgacactgatcaccggaaatatgtccttccgggaccttggcagagttatggtgatggtcggcgctacaatgaccgatgacatcgggatgggagtgacgtatctggccctcctggccgcttttaaggttcgccctacattcgccgcgggcctgcttctgagaaaactcacctctaaggagctgatgatggctacaattgggatcgccctcctgagccagtccaccattcccgaaaccatccttgagctgacagatgccctcgctctgggaatgatggtgctgaaaattgtccggaacatggaaaagtaccaacttgccgtgacgatcatggcgatctcttgcgtgcctaatgctgtcattctgcagaacgcctggaaggttagctgtaccatcctcgccgctgtgtccgtgagccccctgctcctgacatcttcccagcagaaagccgactggattcctcttgctctgaccatcaagggcctcaatcccacagccatttttctgaccacgctgagccgcacatctaaaaagagatcctggccgcttaacgaggcgatcatggccgtcgggatggtgagcatcctggcttcttccctcctgaaaaatgacattcctatgaccggacccctcgttgccggcggcctgcttaccgtgtgctatgtcctgacagggcggagcgctgatctggaactcgagcgcgccgccgacgtgaagtgggaggatcaagctgaaatctccggaagctctcctattctgagcatcaccatttccgaggacggctctatgagcatcaaaaacgaagaggaggaacagacacttacgattctgatcagaaccgggctcctggttatctccggagtgttccccgtctctattccgatcacagcggccgcttggtacctctgggaggtgaagaagcagcgggccggcgtcctgtgggatgtgccttctccccctcccgttgaaaaagccgagcttgaagacggggcttatcgcattaagcagagaggaatcctgggctactcccaaattggcgccggggtgtataaagagggaacctttcacacaatgtggcatgtcacccggggcgcggtgctgatgcaccgcgggaagagaatcgagccctcctgggctgatgttaaaaaggacctcatcagctacggaggcgggtggaagctggaaggagagtggaaagaaggcgaggaagtgcaggtccttgccctggagcctggcaagaatccgcgggccgtgcagacgaaacccgggattttcaagaccaacacaggaaccatcggcgctgtgtccctcgattttagccctgggacatctggatcccccattgttgacagaaaaggcaaggtcgtggggctgtacggaaatggcgtggtcacccgcagcggcgcctatgtgtctgcgatcgctcagacagagaagtccattgaagataaccctgagatcgaagacgatatcttccggaaaaagagactcacgattatggacctgcatcccggggccggaaaaaccaagcgctaccttcctgccatcgttcgggaggctattaaaagaggcctgcgcacactgatcctcgccccgacccgggtggtcgctgccgaaatggaggaggcgctgagagggcttcccattcgctatcaaacccctgccatcaagacagaacacacgggacgggagattgtggacctgatgtgtcatgctaccttcacaatgagactcctgagccccgttcgggtgcctaactacaatctcatcatcatggatgaagcccactttaccgaccccgcttccattgccgcccgcggctatatctctacaagagtcgagatgggggaggctgcgggcattttcatgaccgccacgccgcctggaagccgggatccctttccccagtccaacgctcctatcatggacgaagaaagagaaattcccgagagaagctggaactctggccacgaatgggtgacagatttcaaggggaaaaccgtttggtttgtgccttccatcaaggccggaaacgacatcgccgcttgcctgcggaaaaatggcaagaaagtcattcagcttagcagaaagaccttcgattctgagtacgtgaagacacgcgccaacgactgggattttgtggtcaccacagacatcagcgagatgggggcgaatttcaaagctgaacgggttattgatccgagacgctgtatgaagcccgtgatcctgaccgacggagaggaacgggtgattctggccggccctatgcccgtcacgcattcctctgccgctcaaagacgcgggcggatcggcagaaaccctaaaaatgagaacgaccagtatatctacatgggagaacccctcgagaatgatgaggactgcgcccactggaaggaagcgaaaatgctgcttgataacattaatacaccggagggcatcattcctagcatgtttgaacccgagcgcgaaaaggtggacgccatcgatggggagtacagactgcggggagaggctcgcaaaaccttcgttgacctcatgagacggggcgatctgcctgtgtggctggcctataaggtcgctgccgaagggattaactacgctgaccgcaagtggtgttttgatggaatcaaaaataaccagattctcgaggaaaacatggaggtggagatctggacaaaggaaggcgagcgcaagaaacttaaaccccggtggctggacgccagaatctattccgatcctctggcgctcaaggagttcaaggagttcgccgctgggcgcaaatctctgacccttaatctgattacggaaatgggccggctccccacctttatgacacagaaggccagaaacgctctggacaatctggccgttctccataccgccgaggctggaggccgcgcgtacaaccacgcccttagcgagctgccggaaacactggagaccctcctgcttctgacactcctggctaccgtgacagggggaatcttcctgtttctcatgtccggcaaagggattggaaagatgacacttggcatgtgctgcatcattaccgccagcatcctgctgtggtatgcccaaatccagcctcactggattgctgcctctatcattctcgagttctttctgatcgtccttctgattcccgagcccgaaaaacagcggacccctcaggataatcaactcacatacgtggtcatcgcgatcctgaccgtggttgccgctacaatggccaacgagatgggcttcctggagaagacgaagaaagacctcgggcttggatccattaccacacaggaaagcgagtccaatatcctggacattgatctgagaccggcttctgcctggaccctctatgcggtggccacaacctttgtgacgcccatgctgcggcatagcatcgaaaactcctctgtcaatgttagccttaccgctattgccaaccaggctacagtgctgatgggcctcgggaagggatggcctctgtccaaaatggacatcggcgtgcccctgctcgccattgggtgttacagccaggtcaatcctatcacccttacagctgccctgctgctcctggtggcgcactacgccatcattggacccggccttcaagctaaggccacccgcgaggctcagaaaagagccgccgcgggcatcatgaagaaccctacggttgatgggattacagtgatcgacctggaaccgattccctatgatcctaagttcgagaaacagctcggacaggtcatgctgctgatcctctgcgtgacccaagtccttatgatgcggacaacctgggctctgtgtgaggccctgaccctcgctacaggccccatctctacgctgtgggaagggaatcctggacgcttttggaacaccacaattgccgtgtccatggccaatatcttcagaggcagctaccttgctggggccggactgctcttttctattatgaagaacaccacatccacccggcgcggcacgggcaatatcggggagacactgggagaaaaatggaaaagcagactgaacgcgctcggcaaatctgagttccagatttataagaaaagcgggatccaggaggttgaccggacccttgccaaggaaggaatcaagcgcggcgagaccgatcatcacgctgtgtccagagggtctgccaaactgcggtggtttgtcgaaagaaacatggtgacacccgagggaaaggttgtggacctgggctgcggccgcgggggatggagctactattgtggcgggctcaaaaatgtccgggaagtgaagggactgaccaaaggcgggccgggacatgaggagcctattcccatgtccacatacggctggaaccttgtgagactgcaaagcggcgttgatgtcttcttcacgccccctgaaaagtgcgacaccctcctgtgtgatatcggggagtcctctcccaatcctacaattgaagctggacgcaccctgcgggtgctcaaccttgtggagaattggctgaacaataacacacagttttgcatcaaggtcctgaatccgtatatgcccagcgttattgagaagatggaggccctccagagacagtacggcggggcgctggtgcgcaaccctctttccagaaattctacccacgagatgtactgggtgagcaacgccacgggaaatatcgtctcctctgtgaacatgatcagcagaatgctgattaatcgcttcaccatgaagcacaaaaaggctacatatgaacccgacgttgatctcggctccgggacccggaacatcggaattgagagcgaaatccctaacctggacattatcggcaaaagaattgagaagatgaagcaagaacatgagatctcttggcactacgaccaggatcatccctataaaacatgggcctaccacggctcctatgagaccaagcagacagggagcgcttcttccatggtgaatggagtcgtgcgcctgctcaccaaaccgtgggacgttgtgcctatggtcacgcagatggccatgacagataccaccccctttggccaacagcgggtgttcaaggaaaaagtggacacaagaacgcaggagcctaaggaagggaccaagaaacttatgaagatcacagctgagtggctgtggaaagagctgggaaagaaaaagacaccccgcatgtgtacaagagaagagtttacccggaaagtccgcagcaacgccgcgctcggcgccattttcacagatgaaaataagtggaagtctgctagagaggccgttgaagacgggcggttttgggagctggtggatagagagcggaaccttcacctggaaggaaaatgcgagacctgtgtgtacaatatgatgggcaagcgcgagaagaagctcggcgagttcgggaaagctaagggatccagagccatctggtatatgtggctgggcgcccggtttctggagttcgaggcgctcgggtttctgaacgaggaccattggttcagccgcggaaattcccttagcggcgtcgaaggggagggcctgcacagactcggatacattctgcgggatgtgggcaagaaagaagggggagctatgtacgccgacgatacggccggctgggacacccgcatcacacttgaggacctgaagaacgaagagatggttaccaatcatatgaaaggggagcacaagaaactcgctgaagccatttttaagctgacatatcagaacaaggtggtcagagtgcaacggcctacaccccgcggaacggttatggatatcatctctagacgggaccagcgcggcagcggacaggtgggcacatacggactgaataccttcacaaacatggaggctcaactcattagacagatggaaggcgaggggatcttcaaatccattcagcatctgaccgccacggaggaaatcgcggtccagaattggcttgcccgggtgggacgcgagagactgtctcggatggctattagcggcgatgactgcgttgtgaagccgatcgatgacagatttgcctccgctctcaccgccctgaacgatatggggaaagtccgcaaggacatccaacagtgggaaccttctcggggatggaatgattggacacaggtgcccttctgcagccaccactttcatgagcttgtcatgaaagacggcagagtgctggttgtgccctgtcgcaaccaggatgaactcattgggcgggcgagaatctcccaaggcgccggatggtctctgaaggagaccgcttgcctgggcaagagctatgcccagatgtggacactcatgtacttccaccgccgggacctgagacttgctgccaacgctatttgttccgccgtccctagccattgggtgccgacctctcgcacaacctggtccatccacgcgaaacacgagtggatgacgacagaagatatgctggccgtgtggaatcgggtttggattcaggagaacccctggatggaagacaagacccctgtggagagctgggaagaggtcccctatctcgggaaaagagaggaccagtggtgcggatctctgatcggccttacctcccgcgctacatgggccaagaatattcaagccgctatcaaccaggtgcggagcctgatcgggaatgaagagtacaccgattatatgccttccatgaaaagatttcggagagaagaggaagaggccggagttctctggtga

SEQ ID NO: 19822 - RNA, 9876 nt, synthetic construct
  misc_feature 1..9876: note = derived and/or modified CDS sequence (opt5) from DENV-2__EU482688__SS-prME
  source 1..9876: mol_type = other RNA
accgccggcgtgatcgtcatgctgattcccaccgctatggccttccacctcacgaccagaaatggggaacctcatatgatcgttggacggcaggaaaagggcaagagcctgctttttaagacggaagacggggtgaatatgtgcaccctgatggcgattgatctcggagaactgtgtgaagacacaatcacctacaaatgcccccttctgcgccaaaatgaacccgaggatattgactgttggtgcaatagcacatctacctgggtgacgtatggcacctgtacaaccacaggggagcacagacgggaaaagcgcagcgtcgctctcgtgcctcatgttggaatgggcctggagaccagaacggaaacatggatgtcctctgagggcgcctggaaacacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaagaacaggacaaacgctttatctgcaagcattccatggtggatagaggctggggcaacgggtgtggactgttcggcaaaggcgggattgtcacatgcgccatgtttacgtgcaaaaagaatatggaagggaaagttgtgcagcctgagaacctcgaatacaccatcgtgattacaccccacagcggggaggagcatgcggtcggaaatgacaccggcaagcacggcaaagaaatcaagatcacacctcagtcttccattaccgaggccgaactgacggggtatggaaccgtgacaatggagtgtagcccccggaccggccttgatttcaacgaaatggttctgctccaaatggaggacaaggcttggctggtgcaccgccagtggtttcttgatctgccgctcccttggctgcccggggccgacacacagggatctaattggatccagaaggagaccctggtcacgttcaagaaccctcatgctaaaaagcaagacgtggttgtgctcggctcccaggaaggggccatgcacacagccctgaccggcgctacagagattcagatgagctccggaaatcttctgtttaccggccatctcaaatgcagactgcggatggataaacttcaactgaaagggatgtcttacagcatgtgtaccggaaagttcaagatcgtcaaagaaattgcggagacacagcacggcacgatcgtgatcagagtccagtatgagggggacggatccccctgcaagattcccttcgaaatcaccgatctcgagaaacgccatgtgctgggccggctgattacagttaaccctatcgtgattgaaaaggacagcccggtcaacatcgaggccgaacccccttttggggattcttacattatcatcggcgtggagcccggacagctcaaactgaattggttcaagaagggctccagcattgggcaaatgtttgagaccacaatgagaggagctaaacgcatggccatccttggcgacaccgcctgggatttcgggtctctgggaggcgtttttacgagcattgggaaggctctccaccaggtgttcggcgccatctacggagcggctttttccggcgtctcttggacaatgaaaattctgatcggggtgatcattacctggatcggaatgaacagccggtccaccagcctgtctgtgtcccttgttctcgtcggcgtggtgacactgtatctgggggccatggtccaggccgacagcggatgtgtggtttcttggaagaataaagaactcaagtgcggctccgggattttcatcaccgataacgtgcacacatggacggagcagtacaagtttcaacctgaaagcccctccaaactggcttctgccattcagaaggctcatgaggaaggcatctgtggaatcagaagcgtcacccgccttgagaatctgatgtggaaacagattacaccggagctcaaccacatcctgtccgaaaatgaggtgaagctgaccattatgacaggcgacatccgggggattatgcaggccggaaaaagatctcttcgccctcaacccaccgaactcaagtatagctggaaaacgtggggcaaggcgaagatgctgtccaccgagagccataaccagacattcctgatcgatgggcctgaaaccgccgagtgccccaatacaaaccgggcttggaactctctcgaggttgaagactacggatttggcgtgttcaccacaaacatctggctgaaacttagagagaagcaggacgtcttttgtgattccaaactgatgagcgccgctattaaggacaatcgcgccgtgcacgcggatatgggctattggatcgaatctgccctcaacgacacctggaaaatggagaaggcttccttcattgaggttaagagctgccactggcctaaatctcatacgctgtggagcaatggggtgctggaatccgagatgatcattcccaagaacttcgccggaccggtcagccagcacaactaccggcctggctatcatacacaaaccgctgggccctggcaccttggaaaactcgaaatggattttgacctgtgtgagggcaccacagtggtggtcaccgaagattgcgggaatagaggaccctctctgcggacgacaaccgcctccggcaagctcatcacagagtggtgctgtcgcagctgcaccctgcctccgcttagataccggggcgaggacgggtgttggtacggaatggaaattagacccctgaaagagaaggaagagaacctcgttaattccctggtgacagccggccatgggcagatcgataacttctctctgggagtgcttggcatggctctctttctggaagagatgctgcgcacccggatcgggacgaagcacgcgattctcctggtcgccgtgagccttgttaccctgatcacaggaaatatgtccttcagagacctcggccgcgtgatggtcatggtgggcgctaccatgacagatgacattgggatgggagttacctatctggccctgcttgccgcttttaaagtgagacctacgttcgccgcgggcctgctcctgcggaagctcacatctaaagagctgatgatggctaccatcgggattgcccttctgagccagtccacaatccccgaaaccatcctcgagctgaccgatgccctggctcttggaatgatggtcctgaagattgtgcgcaacatggaaaaataccaactcgccgttacaatcatggcgatttcttgcgtgcctaatgctgtcatcctgcagaacgcctggaaggtgagctgtacgattctcgccgctgtgtccgtcagccccctgcttctgacctcttcccagcagaaggccgactggatccctctcgctctgacaatcaaaggcctgaatcccaccgccatttttcttacaaccctgagcagaacgtctaagaaacggtcctggccgctcaacgaggcgatcatggccgttgggatggtgagcattctggcttcttccctcctgaagaatgacatccctatgacaggaccccttgtggccggcggcctgctgaccgtctgctatgtgctcaccgggcgcagcgctgatctggaacttgagagagccgccgacgttaaatgggaggatcaagctgaaatttccggaagctctcctatcctgagcattacaatctccgaggacggctctatgagcatcaagaacgaagaggaggaacagaccctcacaattctgatccggacggggctcctggtgatttccggagtcttccccgtgtctatcccgattaccgcggccgcttggtacctttgggaggttaaaaagcagcgcgccggcgtgctgtgggatgtcccttctccccctcccgtggaaaaggccgagctggaagacggggcttatagaatcaaacagcggggaatcctcggctactcccaaattggcgccggggtctataaggagggaacatttcacaccatgtggcatgtgacacgcggcgcggttctgatgcacagagggaaacggatcgagccctcctgggctgatgtgaagaaagaccttattagctacggaggcgggtggaagctggaaggagagtggaaggaaggcgaggaagtccaggtgctcgccctggagcctggcaaaaatccgagagccgttcagaccaagcccgggatcttcaaaacgaacaccggaacaattggcgctgtgtccctcgattttagccctgggacctctggatcccccatcgtcgaccgcaagggcaaagtggtggggctgtacggaaatggcgttgtcacacggagcggcgcctatgtgtctgcgatcgctcagaccgagaagtccattgaagataaccctgagatcgaagacgatattttcagaaagaaacgccttacaatcatggacctgcatcccggggccggaaagacgaaacggtacctgcctgccattgtgagagaggctatcaagcgcggcctccggaccctgattcttgccccgacaagagtcgtggctgccgaaatggaggaggcgctgcgcgggctccccatccggtatcaaaccaccgccatcaaaacagaacacacgggaagagagattgttgacctgatgtgtcatgctacctttacaatgcggctcctgagccctgtgcgcgtccccaactacaatcttatcattatggatgaagcccacttcaccgaccctgcttccatcgccgccagaggctatatttctacacgggtggagatgggggaggctgcgggcatcttcatgaccgccacgcccccgggaagccgcgatccttttccccagtccaacgctcccatcatggacgaagagagagaaattcctgagcggagctggaactctggccacgaatgggttacagatttcaaggggaagaccgtgtggtttgtcccctccatcaaagccggaaacgacattgccgcttgcctgagaaagaatggcaaaaaggtgatccagctgagccgcaaaaccttcgattctgagtacgttaagacacgggccaacgactgggattttgtggtcaccacagacattagcgagatgggggcgaatttcaaggctgaaagagtgatcgatcctcgccggtgtatgaaaccggtgatcctcaccgacggagaggaaagagtcattctggccggccccatgcctgttacgcattcctctgccgctcaacgccgggggagaatcggccgcaaccccaagaatgagaacgaccagtatatttacatgggagaacctcttgagaatgatgaggactgcgcccactggaaagaagcgaagatgctgctcgataacatcaatacacccgagggcattatcccgagcatgtttgaacctgagagagaaaaagtggacgccattgatggggagtaccggctgcgcggagaggctagaaagaccttcgtggacctgatgcggcgcggcgatctccccgtctggcttgcctataaagtggctgccgaagggatcaactacgctgacagaaagtggtgttttgatggaatcaagaataaccagattctggaggaaaacatggaggttgagatctggacaaaagaaggcgagcggaagaaactgaagcctagatggctcgacgcccgcatttattccgatcccctggcgcttaaagagttcaaggagtttgccgctgggcggaagtctctgaccctcaatctgatcacggaaatgggcagactgcctaccttcatgacacagaaagcccgcaacgctctcgacaatcttgccgtgctgcataccgccgaggctggaggccgggcgtacaaccacgccctgagcgagctccccgaaacactggagacccttctgctcctgacactgctcgctaccgtcacagggggaattttcctttttctgatgtccggcaaggggatcggaaaaatgacactgggcatgtgctgcatcattaccgccagcatcctcctgtggtatgcccaaattcagccgcactggatcgctgcctctattatccttgagttctttctgatcgtgctcctgattcctgagcccgaaaagcagagaacaccccaggataatcaactgacatacgttgtgatcgcgattctcaccgtcgtggccgctacaatggccaacgagatgggcttccttgagaaaacgaagaaggacctggggctgggatccatcaccacacaggaaagcgagtccaatattctcgacatcgatctgcggcctgcttctgcctggaccctttatgcggtcgccacaacctttgtgacgccgatgctgcgccatagcattgaaaactcctctgttaatgtgagcctcaccgctatcgccaaccaggctacagtgctgatgggcctggggaaaggatggcccctctccaagatggacatcggcgtccctcttctggccattgggtgttacagccaggttaatcccatcaccctgacagctgccctcctgcttctggtggcgcactacgccattatcggacctggcctccaagctaaagccaccagagaggctcagaagcgggccgccgcgggcattatgaaaaaccccacggtggatgggatcacagtcatcgacctggaacctattccgtatgatcccaagttcgagaagcagctgggacaggtgatgctccttatcctgtgcgttacccaagtgctgatgatgcgcacaacctgggctctctgtgaggccctgacccttgctacaggccctatttctacgctgtgggaagggaatcccggaagattttggaacaccacaatcgccgtctccatggccaatattttccggggcagctacctcgctggggccggactgctgttttctatcatgaaaaacaccacaaatacccgcagaggcacgggcaacatcggggagacactcggagaaaagtggaaatcccggcttaacgcgctgggcaagagcgagttccagatttataaaaagtctgggatccaggaggtggaccgcaccctggccaaagaaggaattaagagaggcgagaccgatcatcacgctgtcagccgggggtccgccaagctcagatggtttgtggaacgcaatatggttacacctgagggaaaagtggtcgacctgggctgcggcagagggggatggtcttactattgtggcgggcttaagaacgtgcgggaagttaaaggactgaccaagggcgggcccggacatgaggagccgatccctatgagcacatacggctggaatctcgtgcgcctgcaatccggcattgatgtcttctttacgccgcccgaaaaatgcgacaccctgctctgtgatatcggggagagctcccctaaccccacaatcgaagctggacggacccttagagtgctgaatctggtggagaactggctcaataacaatacacagttctgcattaaggttctgaacccttatatgccgtctgtcatcgaaaagatggaggcccttcagcgcaaatacggcggggcgctggtgcggaatcccctcagcagaaactccacccacgagatgtactgggtgtctaatgccacgggaaacattgtcagctccgttaatatgatctctcgcatgctgattaaccggttcaccatgaagcacaaaaaggctacatatgaacctgacgtggatctgggcagcgggaccagaaacatcggaattgagtccgaaatccccaatctcgacatcattggcaaacgcatcgagaagattaagcaggaacatgagacaagctggcactacgaccaagatcatccttataaaacctgggcctaccacggctcttatgagacaaagcagaccgggtccgctagctctatggtgaacggagtcgtgcggcttctgacgaaaccctgggacgttgtgccgatggtcacacagatggccatgaccgataccacaccttttggccagcaaagagtgttcaaggaaaaagttgacacgcgcacccaggagcccaaggaagggacaaagaaactgatgaagatcaccgctgagtggctctggaaagagctgggaaagaaaaagacacctagaatgtgtacccgggaagagtttacacgcaaagtgagatccaatgccgcgcttggcgccattttcaccgatgaaaacaagtggaaaagcgctcgggaggccgtcgaagacgggagattttgggagctggtggatcgggagcgcaatctccacctggaaggaaaatgcgagacgtgtgtgtacaacatgatgggcaagagagagaagaagctgggcgagttcgggaaagctaagggatctcgggccatctggtatatgtggctcggcgcccgctttctggagttcgaggcgcttgggtttctgaatgaggaccattggttctccagaggaaacagcctctccggcgtcgaaggggagggcctgcaccggcttggatacatcctgcgcgatgttggcaagaaagaagggggagctatgtacgccgacgataccgccggctgggacacaagaattaccctcgaggacctgaagaatgaagagatggtgacaaaccatatgaaaggggagcacaagaaactggctgaagccatctttaagctcacctatcagaataaggtggtccgggtgcagcgccccacgcctagaggaacagttatggatattatcagccggcgcgaccaaagaggctctggacaggtgggcacctacggactgaacacattcaccaatatggaggctcagcttattcggcaaatggaaggcgaggggatctttaaaagcatccagcatctgacggccaccgaggaaattgcggtccagaactggctcgcccgcgtgggaagagagcggctgtccagaatggctatctctggcgatgactgcgttgtgaagcccattgatgaccgcttcgccagcgctcttacagccctgaatgatatggggaaagtccggaaggacatccagcaatgggaaccgtccagaggatggaacgattggacccaggtgcctttctgctctcaccactttcatgagctcgttatgaaagacggccgcgtgctggtcgtgccctgtcggaaccaggatgaactgattgggagagcgcgcatcagccagggcgccggatggtccctcaaggagacagcttgcctgggcaagtcttatgcccaaatgtggacccttatgtacttccaccggagagacctgcgcctcgctgccaatgctatttgtagcgccgtcccctcccattgggtgcctacaagccggaccacgtggtctatccacgcgaaacacgagtggatgacaaccgaagatatgctggccgtttggaacagagtgtggatccaggagaatccgtggatggaagacaagacccccgtcgagtcctgggaagaggtgccttatcttgggaaacgcgaggaccagtggtgcggaagcatgattggcctgacatctcgggctacctgggccaagaacatccagacagccattaatcaagtgagatccctcatcgggaacgaagagtacacggattatatgcccagcatgaaacggtttagacgcgaagaggaagaggctggagttctgtggtga

SEQ ID NO: 19823 - RNA, 9876 nt, synthetic construct
  misc_feature 1..9876: note = derived and/or modified CDS sequence (opt5) from DENV-2__EU482691__SS-prME
  source 1..9876: mol_type = other RNA
accgccggagtgatcgtcatgctgattcccacggctatggccttccacctcacgaccagaaatggggaacctcatatgatcgttggacggcaggaaaagggcaagagcctgctttttaagacagaagacggggtgaatatgtgcaccctgatggcgattgatctcggagaactgtgtgaggacacaatcacctacaagtgcccgcttctgcgccaaaatgaacccgaggatattgactgttggtgcaattccacatctacctgggtgacgtatggcacctgtacaaccacaggggagcacagacgggaaaagcgcagcgtcgctctcgtgcctcatgttggaatgggcctggagaccagaacggaaacatggatgtcctctgagggcgcctggaaacacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaagaacaggacaaacgctttatctgcaagcattccatggtggatagaggctggggcaacgggtgtggactgttcggcaaagggggaattgtcacatgcgccatgtttacgtgcaaaaagaatatggaaggcaaagttgtgcagcctgagaacctcgaatacaccatcgtgattacaccccacagcggggaggagcatgcggtcggaaatgacaccggcaagcacggcaaagaaatcaagatcacacctcagtcttccattaccgaggccgaactgacggggtatggaaccgtgacaatggagtgtagcccccggaccggccttgatttcaacgaaatggttctgctccaaatggaggacaaggcttggctggtgcaccgccagtggtttcttgatctgccgctcccttggctgcccggggccgacacacagggatctaattggatccagaaggagaccctggtcacgttcaagaaccctcatgctaaaaagcaagacgtggttgtgctcggctcccaggaaggggccatgcacacagccctgaccggcgctacagagattcagatgagctccggaaatcttctgtttaccggccatctcaaatgcagactgcggatggataaacttcaactgaaagggatgtcttacagcatgtgtaccggaaagttcaagatcgtcaaagaaattgcggagacacagcacggcacgatcgtgatcagagtccagtatgagggggacggatccccctgcaagattcccttcgaaatcaccgatctcgagaaacgccatgtgctgggccggctgattacagttaaccctatcgtgaccgaaaaggacagcccggtcaacattgaggccgaacccccttttggggattcttacatcattatcggcgtggagcccggacagctcaaactgaattggttcaagaagggctccagcatcgggcaaatgtttgagacaaccatgagaggagctaaacgcatggccattcttggcgacacggcctgggatttcgggtctctgggaggcgtttttacaagcatcgggaaggctctccaccaggtgttcggcgccatttacggagcggctttttccggcgtctcttggaccatgaaaatcctgattggggtgatcatcacctggattggaatgaacagccggtccacaagcctgtctgtgtcccttgttctcgtcggcgtggtgaccctgtatctgggggccgtcgtgcaggccgacagcggatgtgttgtgtcttggaagaataaagaactcaagtgcggctccgggatcttcattacagataacgtccacacgtggaccgagcagtacaagtttcaacctgaaagcccctccaaactggcttctgccatccagaaggctcatgaggaaggcatttgtggaatcagaagcgtgacacgccttgagaatctgatgtggaaacagatcaccccggagctcaaccacattctgtccgaaaatgaggttaagctgacaatcatgaccggcgacattaaagggatcatgcaggccggaaagcggtctcttagacctcaacccacggaactcaaatatagctggaagacctggggcaaggcgaaaatgctgtccacagagagccataaccagaccttcctgattgatgggcctgaaacagccgagtgccccaatatcaaccgcgcttggaactctctcgaggtggaagactacggatttggcgtcttcaccacaaacatctggctgaaacttcgggagaaacaggacgtgttttgtgattccaagctgatgagcgccgctattaaagacaatagagccgttcacgcggatatgggctattggatcgaatctgccctcaacgacacctggaagatggagaaggcttccttcattgaggtgaaaagctgccactggcctaagtctcatacgctgtggagcaatggggtcctggaatccgagatgatcattcccaaaaacttcgccggaccggtgagccagcacaactaccgccctggctatcatacacaaaccgctgggccctggcaccttggaaagctcgaaatggattttgacttctgtgagggcaccacagtggtcgttaccgaagattgcgggaatcggggaccctctctgagaacgacaaccgcctccggcaaactgatcacagagtggtgctgtcggagctgcaccctccctccgctgcgctacagaggcgaggacgggtgttggtacggaatggaaattcggccccttaaggagaaggaagagaacctggtgaatagcctcgtgacagccggccatgggcagatcgataacttttctctgggagtcctgggcatggctcttttcctcgaagagatgctgagaacccgcatcgggacgaaacacgcgattctgctcgtggccgttagctttgtgaccctgatcacaggaaatatgtccttccgggaccttggcagagtcatggtgatggttggcgctaccatgacagatgacattgggatgggagtgacctatctggccctcctggccgcttttaaggtccgccctacgttcgccgcgggcctgcttctgagaaaactcacatctaaggagctgatgatggctaccatcgggattgccctcctgagccagtccacaatccccgaaaccatccttgagctgaccgatgccctcgctctgggaatgatggtgctgaaaattgttcggaacatggaaaagtaccaacttgccgtgacaatcatggcgatttcttgcgtccctaatgctgtgatcctgcagaacgcctggaaggtgagctgtacgattctcgccgctgtctccgttagccccctgctcctgacctcttcccagcagaaagccgactggatccctcttgctctgacaatcaagggcctcaatcccaccgccatttttctgacaaccctgagccgcacgtctaaaaagagatcctggccgcttaacgaggcgatcatggccgtggggatggtgagcattctggcttcttccctcctgaaaaatgacatccctatgacaggacccctcgtcgccggcggcctgcttaccgtgtgctatgttctgaccgggcggagcgctgatctggaactcgagcgcgccgccgacgtgagatgggaggatcaagctgaaatttccggaagctctcctatcctgagcattacaatctccgaggacggctctatgagcatcaagaacgaagaggaggaacagacccttacaattctgatccggacggggctcctggtcatttccggagtgttccccgtttctatcccgattaccgcggccgcttggtacctctgggaggtgaaaaagcagcgcgccggcgtcctgtgggatgtgccttctccccctcccgtcgaaaaggccgagcttgaagacggggcttatagaatcaaacagcggggaatcctgggctactcccaaattggcgccggggtgtataaggagggaacatttcacaccatgtggcatgttacacgcggcgcggtgctgatgcacagagggaaacggatcgagccctcctgggctgatgtcaagaaagacctcattagctacggaggcgggtggaagctggaaggagagtggaaggaaggcgaggaagtgcaggttcttgccctggagcctggcaaaaatccgagagccgtgcagaccaagcccgggatcttcaaaacgaacaccggaacaattggcgctgtctccctcgattttagccctgggacctctggatcccccatcgtggaccgcaagggcaaagtggttgggctgtacggaaatggcgtcgtgacacggagcggcgcctatgtgtctgcgatcgctcagaccgagaagtccattgaagataaccctgagatcgaagacgatattttcagaaagaaacgcctcacaatcatggacctgcatcccggggccggaaagacgaaacggtaccttcctgccattgtcagagaggctatcaagcgcggcctgcggaccctgattctcgccccgacaagagtggttgctgccgaaatggaggaggcgctgcgcgggcttcccatccggtatcaaacccctgccatcaaaaccgaacacacaggaagagagattgtggacctgatgtgtcatgctacgttcaccatgcggctcctgagccccgtccgcgtgcctaactacaatctcatcattatggatgaagcccactttacagaccccgcttccatcgccgccagaggctatatttctacccgggttgagatgggggaggctgcgggcatcttcatgacagccaccccgcctggaagccgcgatccctttccccagtccaacgctcctatcatggacgaagagagagaaattcccgagcggagctggaactctggccacgaatgggtgacggatttcaaggggaagacagtctggtttgtgccttccatcaaagccggaaacgacattgccgcttgcctgagaaagaatggcaaaaaggttatccagcttagccgcaaaaccttcgattctgagtacgtgaagacccgggccaacgactgggattttgtcgtgacaaccgacattagcgagatgggggcgaatttcaaggctgaaagagtgatcgatccgcgccggtgtatgaaacccgtcatcctgacagacggagaggaaagagttattctggccggccctatgcccgtgacccattcctctgccgctcaacgccgggggagaatcggccgcaaccctaagaatgagaacgaccagtatatttacatgggagaacccctcgagaatgatgaggactgcgcccactggaaagaagcgaagatgctgcttgataacatcaatacgccggagggcattatccctagcatgtttgaacccgagagagaaaaagtggacgccattgatggggagtaccggctgcgcggagaggctagaaagacattcgtcgacctcatgcggcgcggcgatctgcctgtgtggctggcctataaagttgctgccgaagggatcaactacaccgacagaaagtggtgttttgatggaatcaagaataaccagattctcgaggaaaacatggaggtggagatctggacaaaagaaggcgagcggaagaaacttaagcccagatggctggacgctcgcatttattccgatcctctggccctcaaagagttcaaggagttcgcggccgggcggaagtctctgacccttaatctgatcacggaaatgggcagactccccacctttatgacacagaaagctcgcaacgccctggacaatctggctgtcctccataccgccgaggccggaggccgggcttacaaccacgcgcttagcgagctgccggaaacactggagaccctcctgcttctgacactcctggccaccgtgacagggggaattttcctgtttctcatgtccggcaaggggatcggaaaaatgacacttggcatgtgctgcatcattaccgctagcatcctgctgtggtatgcccaaattcagcctcactggatcgccgcttctattatcctcgagttctttctgatcgttcttctgattcccgagcccgaaaagcagagaacccctcaggataatcaactcacatacgtggtcatcgccattctgaccgtggtcgcggccacaatggctaacgagatgggcttcctggagaaaacgaagaaggacctcgggcttggatccatcaccacacaggaaagcgagtccaatattctggacatcgatctgcggccggcctctgcttggaccctctatgccgtggcgacaacctttgttacgcccatgctgcgccatagcattgaaaactcctctgtgaatgtgagccttaccgccatcgctaaccaggccacagtcctgatgggcctcgggaaaggatggcctctgtccaagatggacatcggcgttcccctgctcgctattgggtgttacagccaggtgaatcctatcacccttacagccgctctgctgctcctggtggcccactacgcgattatcggacccggccttcaagccaaagctaccagagaggcccagaagcgggctgccgccggcattatgaaaaaccctacggtcgatgggatcacagtgatcgacctggaaccgattccctatgatcctaagttcgagaagcagctcggacaggttatgctgctgatcctctgcgtgacccaagtccttatgatgcgcacaacctgggcgctgtgtgaggctctgaccctcgccacaggccccatttctacgctgtgggaagggaatcctggaagattttggaacaccacaatcgctgtgtccatggccaatattttccggggcagctaccttgccggggctggactgctcttttctatcatgaaaaacaccacatccacccgcagaggcacgggcaatatcggggagacactgggagaaaagtggaaaagccggctgaacgccctcggcaagtctgagttccagatttataaaaagagcgggatccaggaggtcgaccgcacccttgcgaaagaaggaattaagagaggcgagaccgatcatcacgccgtgtcccgggggtctgctaagctgagatggtttgttgaacgcaacatggtgacacccgagggaaaagtcgtggacctgggctgcggcagagggggatggagctactattgtggcgggctcaagaatgttcgggaagtgaaaggactgaccaagggcgggccgggacatgaggagcctatccccatgtccacatacggctggaaccttgtccgcctgcaaagcggcgtggatgtgttcttcacgccccctgaaaaatgcgacaccctcctgtgtgatattggggagtcctctcccaatcctacaatcgaagccggacggaccctgagagttctcaaccttgtcgagaattggctgaacaataacacacagttttgcgtgaaggtgctgaatccgtatatgcccagcgtcatcgaaaagatggaggctctccagcgccagtacggcggggccctggttcggaaccctctttccagaaattctacccacgagatgtactgggtgagcaacgcgacgggaaatattgtgtcctctgtcaacatgatcagccgcatgctgattaatcggttcaccatgaaacacaagaaagccacatatgaacccgacgtggatctcggctccgggaccagaaacatcggaattgagagcgaaatccctaacctggacattatcggcaagcgcatcgagaaaattaagcaagaacatgagatctcttggcactacgaccaggatcatccctataagacatgggcttaccacggctcctatgagaccaaacagacagggagcgcctcttccatggttaatggagtggtccggctgctcaccaagccgtgggacgtggttcctatggtgacgcagatggctatgacagataccaccccctttggccaacagagagtcttcaaagaaaaggtggacacacgcacgcaggagcctaaagaagggaccaagaaacttatgaaaattacagccgagtggctgtggaaggagctgggcaagaagaaaacccccagaatgtgtacacgggaagagtttacccgcaaggtgagaagcaacgctgccctcggcgcgatcttcacagatgaaaataaatggaagtctgcccgggaggctgtcgaagacgggagattttgggagctggttgatcgggagcgcaaccttcacctggaaggaaagtgcgagacctgtgtgtacaatatgatgggcaaaagagaaaagaaactcggcgagttcgggaaggccaaaggatcccgggctatttggtatatgtggctgggcgcccgctttctggagttcgaggccctcgggtttctgaacgaggaccattggttcagcagaggaaattcccttagcggcgtggaaggggagggcctgcaccggctcggatacatcctgcgcgatgtcggcaagaaggaagggggagcgatgtacgctgacgatacggccggctgggacaccagaatcacacttgaggacctgaaaaacgaagagatggtgaccaatcatatgaagggggagcacaaaaagctcgccgaagctatttttaaactgacatatcagaacaaggttgtgcgggtccaacgccctacccccagaggaacggtgatggatatcatttctcggcgcgaccagagaggcagcgggcaggttggcacatacggactgaataccttcacaaacatggaggcccaactcatccggcagatggaaggcgaggggattttcaagtccatccagcatctgaccgctacggaggaaatcgccgtgcagaattggcttgcgcgcgtcggaagagagcggctgtctagaatggccattagcggcgatgactgcgtggttaaaccgatcgatgaccgctttgcttccgccctcaccgctctgaacgatatggggaaggtgcggaaagacattcaacagtgggaaccttctagaggatggaatgattggacacaggtccccttctgcagccaccactttcatgagcttgtgatgaaggacggccgcgtcctggtggttccctgtcggaaccaggatgaactcatcgggagagcccgcatttcccaaggcgcgggatggtctctgaaagagaccgcctgcctgggcaagagctatgctcagatgtggacactcatgtacttccaccggagagacctgcgccttgccgctaacgccatctgttccgctgtgcctagccattgggtcccgacctctcggacaacctggtccattcacgccaagcacgagtggatgacgacagaagatatgctggcggtgtggaatagagtgtggatccaggagaacccctggatggaagacaaaacccctgttgagagctgggaagaggtgccctatctcgggaagcgcgaggaccagtggtgcggatctctgatcggccttacctcccgggccacatgggctaaaaatattcaaaccgccatcaaccaggtcagaagcctgattgggaatgaagagtacacagattatatgccttccatgaagcggtttagacgcgaagaggaagaggccggagtgctctggtga

SEQ ID NO: 19824 - RNA, 9876 nt, synthetic construct
  misc_feature 1..9876: note = derived and/or modified CDS sequence (opt5) from DENV-2__EU482693__SS-prME
  source 1..9876: mol_type = other RNA
accgccggagtgatcgtcatgctgattcccacagctatggccttccacctcacgacccggaatggggagcctcatatgatcgttggacggcaggaaaagggcaagagcctgctttttaagacagaggacggggtgaatatgtgcaccctgatggcgattgatctcggagaactgtgtgaggacacaatcacctacaaatgcccgcttctgcgccaaaatgaacccgaggatattgactgttggtgcaattccacatctacctgggtgacgtatggcacctgtacaaccacaggggagcacagacgggaaaagcgcagcgtcgctctcgtgcctcatgttggaatgggcctggagaccagaacggaaacatggatgtcctctgagggcgcctggaaacacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaagaacaggacaaacgctttatctgcaagcattccatggtggatagaggctggggcaacgggtgtggactgttcggcaaagggggaattgtcacatgcgccatgtttacgtgcaaaaagaatatggaaggcaaagttgtgcagcctgagaacctcgaatacaccatcgtgattacaccccacagcggggaggagcatgcggtcggaaatgacaccggcaagcacggcaaagaaatcaagatcacacctcagtcttccattaccgaggccgaactgacggggtatggaaccgtgacaatggagtgtagcccccggaccggccttgatttcaacgaaatggttctgctccaaatggaggacaaggcttggctggtgcaccgccagtggtttcttgatctgccgctcccttggctgcccggggccgacacacagggatctaattggatccagaaggagaccctggtcacgttcaagaaccctcatgctaaaaagcaagacgtggttgtgctcggctcccaggaaggggccatgcacacagccctgaccggcgctacagagattcagatgagctccggaaatcttctgtttaccggccatctcaaatgcagactgcggatggataaacttcaactgaaagggatgtcttacagcatgtgtaccggaaagttcaagatcgtcaaagaaattgcggagacacagcacggcacgatcgtgatcagagtccagtatgagggggacggatccccctgcaagattcccttcgaaatcaccgatctcgagaaacgccatgtgctgggccggctgattacagttaaccctatcgtgaccgaaaaggacagcccggtcaacattgaggccgaacccccttttggggattcttacatcattatcggcgtggagcccggacagctcaaactgaattggttcaagaagggctccagcatcgggcaaatgtttgagacaaccatgagaggagctaaacgcatggccattcttggcgacacggcctgggatttcgggtctctgggaggcgtttttacaagcatcgggaaggctctccaccaggtgttcggcgccatttacggagcggctttttccggcgtctcttggaccatgaaaatcctgattggggtgatcatcacctggattggaatgaacagccggtccacaagcctgtctgtgtcccttgttctcgtcggcgtggtgaccctgtatctgggggccgtcgtgcaggccgacagcggatgtgttgtgtcttggaagaataaagaactcaagtgcggctccgggatcttcattacagataacgtccacacgtggaccgagcagtacaagtttcaacctgaaagcccctccaaactggcttctgccatccagaaggctcatgaggaaggcatttgtggaatcagaagcgtgacacgccttgagaatctgatgtggaaacagatcaccccggagctcaaccacattctgtccgaaaatgaggttaagctgacaatcatgaccggcgacattaaagggatcatgcaggccggaaagcggtctcttagacctcaacccacggaactcaaatatagctggaagacctggggcaaggcgaaaatgctgtccacagagagccataaccagaccttcctgattgatgggcctgaaacagccgagtgccccaataccaaccgcgcttggaactctctcgaggtggaagactacggatttggcgtcttcacaaccaacatctggctgaaacttcgggagaaacaggacgtgttttgtgattccaagctgatgagcgccgctatcaaagacaatagagccgttcacgcggatatgggctattggattgaatctgccctcaacgacacgtggaagatggagaaggcttccttcatcgaggtgaaaagctgccactggcctaagtctcatacactgtggagcaatggggtcctggaatccgagatgattatccccaaaaacttcgccggaccggtgagccagcacaactaccgccctggctatcatacccaaaccgctgggccctggcaccttggaaagctcgaaatggattttgacctgtgtgagggcacaaccgtggtcgttacggaagattgcgggaatcggggaccctctctgagaacaaccacagcctccggcaaactcattaccgagtggtgctgtcggagctgcacactgcctccgcttcgctacagaggcgaggacgggtgttggtacggaatggaaatccggcccctgaaggagaaggaagagaacctcgtgaatagcctggtgaccgccggccatgggcagattgataacttctctctgggagtccttggcatggctctctttctggaagagatgctgagaacgcgcatcgggaccaaacacgcgacactcctggtggccgttagcttcgtgacccttatcacaggaaatatgtcctttcgggacctgggcagagtcatggtgatggttggcgctaccatgacggatgacattgggatgggagtgacatatctcgccctgctggccgctttcaaggtccgccctacctttgccgcgggccttctgctcagaaaactgacatctaaggagctcatgatggctaccatcgggattgccctgcttagccagtccaccatccccgaaacaattctggagctcacggatgccctggctctgggaatgatggtgcttaaaatcgttcggaacatggaaaagtaccaactggccgtgaccatcatggcgatttcttgcgtccctaatgctgtgatcctccagaacgcctggaaggtgagctgtacaattctggccgctgtctccgttagccccctcctgcttacctcttcccagcagaaagccgactggatccctctggctctcacaattaagggcctgaatcccaccgccatcttcctgacgacacttagccgcacctctaaaaagagatcctggccgctgaacgaggcgatcatggccgtggggatggtgagcattctcgcttcttccctgctcaaaaatgacatccctatgaccggacccctggtcgccggcggccttctgacagtgtgctatgttctgaccgggcggagcgctgatctcgaactggagcgcgccgccgacgtgaagtgggaggatcaagctgaaatttccggaagctctcctatccttagcattacaatctccgaggacggctctatgagcattaaaaacgaagaggaggaacagacgctgaccatcctcatcagaacagggctgctcgtcatttccggagtgtttcccgtttctatcccgattaccgcggccgcttggtacctgtgggaggtgaagaagcagcgggccggcgtcctttgggatgtgccttctccccctcccgtcgaaaaagccgagctggaagacggggcttatcgcatcaagcagagaggcattctgggatactcccaaatcggcgccggggtgtataaagagggaacattccacaccatgtggcatgttacgcggggcgcggtgctcatgcaccgcgggaagagaatcgagccctcctgggctgatgtcaaaaaggacctgattagctacggaggcgggtggaaacttgaaggagagtggaaagaaggcgaggaagtgcaggttctggccctcgagcctggcaagaatccgcgggccgtgcagaccaaacccgggatctttaagacaaacaccggaacaattggcgctgtctccctggatttcagccctgggacctctggatcccccatcgtggacagaaaaggcaaggtggttgggctctacggaaatggcgtcgtgacacgcagcggcgcctatgtgtctgcgattgctcagacggagaagtccatcgaagataaccctgagatcgaagacgatatttttcggaaaaagagactgaccatcatggaccttcatcccggggccggaaaaacaaagcgctacctgcctgccattgtccgggaggctatcaaaagaggcctgcgcaccctcattctggccccgacccgggtggttgctgccgaaatggaggaggcgcttagagggctgcccatccgctatcaaacccctgccattaagacggaacacaccggacgggagatcgtggacctcatgtgtcatgctacattcaccatgagactgctcagccccgtccgggtgcctaactacaatctgatcattatggatgaagcccacttcacagaccccgcttccatcgccgcccgcggctatatttctaccagagttgagatgggggaggctgcgggcatctttatgacggccacaccgcctggaagccgggatcccttcccccagtccaacgctcctattatggacgaagagagagaaatccccgagagaagctggaactctggccacgaatgggtgaccgattttaaggggaaaaccgtctggttcgtgccttccatcaaggccggaaacgacattgccgcttgccttcggaaaaatggcaagaaagttatccagctgagcagaaagacatttgattctgagtacgtgaagacccgcgccaacgactgggatttcgtcgtgacaaccgacattagcgagatgggggcgaattttaaagctgaacgggtgatcgatccgagacgctgtatgaagcccgtcattctgacggacggagaggaacgggttatcctcgccggccctatgcccgtgacacattcctctgccgctcaaagacgcgggcggatcggcagaaaccctaaaaatgagaacgaccagtatatttacatgggagaacccctggagaatgatgaggactgcgcccactggaaggaagcgaaaatgcttctggataacatcaataccccggagggcattatccctagcatgttcgaacccgagcgcgaaaaggtggacgccattgatggggagtacagactccggggagaggctcgcaaaacatttgtcgacctgatgagacggggcgatctgcctgtgtggctcgcctataaggttgctgccgaagggatcaactacgctgaccgcaagtggtgtttcgatggaattaaaaataaccagatccttgaggaaaacatggaggtggagatctggaccaaggaaggcgagcgcaagaagctgaaaccccggtggctggacgccagaatttattccgatcctctcgcgctgaaggaatttaaggagttcgccgctgggcgcaaatctcttacgctgaatctcatcaccgaaatgggccggctgcccacattcatgacccagaaggccagaaacgctctggacaatctcgccgtccttcatacagccgaggctggaggccgcgcgtacaaccacgccctgagcgagctgccggaaaccctcgagacactgcttctgctcaccctgctggctacggtgacagggggaatttttctcttccttatgtccggcaaagggatcggaaagatgaccctgggcatgtgctgcattatcaccgccagcatcctgctctggtatgcccaaattcagcctcactggatcgctgcctctattatcctggaatttttccttattgttctgctcatccccgagcccgaaaaacagcggacacctcaggataatcaactgacctacgtggtcatcgcgattctgacagtggtcgccgctacgatggccaacgagatgggctttctcgagaagaccaagaaagaccttgggctgggatccatcacaacccaggaaagcgagtccaatattctggacatcgatctcagaccggcttctgcctggacactgtatgcggtggccaccacgttcgttacccccatgcttcggcatagcattgaaaactcctctgtgaatgtgagcctgacagctatcgccaaccaggctaccgtcctcatgggcctggggaagggatggcctctgtccaaaatggacattggcgttcccctccttgccatcgggtgttacagccaggtgaatcctatcacactgaccgctgccctgctcctgcttgtggcgcactacgccattatcggacccggcctgcaagctaaggccacgcgcgaggctcagaaaagagccgccgcgggcattatgaagaaccctacagtcgatgggatcaccgtgattgacctcgaaccgatcccctatgatcctaagtttgagaaacagctgggacaggttatgctgctcatcctttgcgtgacacaagtcctgatgatgcggaccacctgggctctgtgtgaggccctcacactggctacgggccccatttctaccctttgggaagggaatcctggacgcttctggaacacaaccatcgccgtgtccatggccaatatttttagaggcagctacctggctggggccggactcctgttctctatcatgaagaacacaacctccacgcggcgcggcacaggcaatattggggagaccctgggagaaaaatggaaaagcagactcaacgcgcttggcaaatctgagtttcagatctataagaaaagcgggatccaggaggtcgaccggaccctggccaaggaaggaattaagcgcggcgagacagatcatcacgctgtgtccagagggtctgccaaactgcggtggttcgttgaaagaaacatggtgacccccgagggaaaggtcgtggacctcggctgcggccgcgggggatggagctactattgtggcgggctgaaaaatgttcgggaagtgaagggacttacaaaaggcgggccgggacatgaggagcctatccccatgtccacgtacggctggaacctggtcagactccaaagcggcgtggatgtgtttttcacaccccctgaaaagtgcgacaccctgctgtgtgatattggggagtcctctcccaatcctaccatcgaagctggacgcacactccgggttcttaacctggtcgagaattggctgaacaataacacccagttctgcattaaggtgctcaatccgtatatgcccagcgtgatcgagaagatggaggccctgcagagaaagtacggcggggcgcttgtccgcaaccctctgtccagaaattctacgcacgagatgtactgggttagcaacgccaccggaaatatcgtgtcctctgtgaacatgattagcagaatgctcatcaatcgctttacaatgaaacacaagaaagctacctatgaacccgacgtcgatctgggctccgggacacggaacattggaatcgagagcgaaattcctaacctggacatcattggcaagagaatcgagaagatcaaacaggaacatgagacctcttggcactacgaccaagatcatccctataagacatgggcctaccacggctcctatgagaccaaacagacggggagcgcttcttccatggtgaatggagttgtgcgcctccttacaaagccgtgggacgtcgtgcctatggttacccagatggccatgaccgatacaacgcccttcggccagcaacgggtgtttaaagaaaaggtcgacaccagaacacaggagcctaaggaagggaccaaaaagctgatgaaaattacagctgagtggctgtggaaggagctcggcaagaagaaaacaccccgcatgtgtacaagagaagagttcacccggaaggtgcgcagcaacgccgcgctgggcgccatctttacggatgaaaataagtggaaatctgctagagaggccgtggaagacgggcggttctgggagcttgtcgatagagagcggaacctgcacctcgaaggaaagtgcgagacctgtgtttacaatatgatgggcaaacgcgaaaagaaactgggcgagtttgggaaggctaagggatccagagccatttggtatatgtggctgggcgcccggttcctcgaatttgaggcgctggggttccttaacgaggaccattggtttagccgcggaaattccctgagcggcgtggaaggggagggcctccacagactgggatacatccttcgggatgtgtctaaaaaggaaggcggggctatgtacgccgacgatacagccggatgggacacccgcattacactggaggacctcaaaaacgaagagatggtcaccaatcatatgaagggcgagcacaaaaagctggctgaagccatcttcaagctgacgtatcagaacaaagtggttagagtgcagcggcctacaccccgcgggaccgtcatggatatcattagcagacgggaccaacgcggatccggccaggtggggacatacggcctcaatacctttacgaacatggaggctcagctgatcagacaaatggaaggagagggcattttcaagtctatccagcatcttaccgccgcggaggaaaatgttgtgcagaactggctggcccgggtcgggcgcgagagactcagccggatggctatttccggagatgactgcgtggttaaaccgatcgatgacagattcgcctctgctctgacagcccttaatgatatgggcaaggtgcgcaaagacatccagcaatgggaacctagccgggggtggaacgattggacccaggtccccttttgctcccaccacttccatgagctggtgatgaaggacggaagagtcctcgtggttccctgtcgcaaccaggatgaactgattggccgggcgagaatctctcagggggccggctggagcctgaaggagacagcttgcctcggaaaatcctatgcccaaatgtggaccctgatgtactttcaccgccgggaccttagactggctgccaatgctatttgtagcgccgtgccttctcattgggtcccgacatcccgcaccacgtggagcatccacgcgaagcacgagtggatgacaaccgaagatatgctcgccgtgtggaaccgggtgtggattcaggagaatccctggatggaagacaaaacccctgttgagtcttgggaagaggtgccctatctgggcaagagagaggaccagtggtgcgggtcccttatcggactgacaagccgcgctacctgggccaaaaacattcagacagccatcaatcaagtccggtccctcatcggcaacgaagagtacacggattatatgccttctatgaagagattccggagagaagaggaagaggctggggtgctgtggtga

SEQ ID NO: 19825 - RNA, 9876 nt, synthetic construct
  misc_feature 1..9876: note = derived and/or modified CDS sequence (opt5) from DENV-2__EU596483__SS-prME
  source 1..9876: mol_type = other RNA
accgccggcgtgatcgtcatgctgattcccacagctatggccttccacctcacgacccggaatggggaacctcatatgatcgttggacggcaggaaaagggcaagagcctgctttttaagacagaagacggggtgaatatgtgcaccctgatggcgattgatctcggagaactgtgtgaagacacaatcacctacaaatgcccgcttctgcgccaaaatgaacccgaggatattgactgttggtgcaattccacatctacctgggtgacgtatggcacctgtacaaccacaggggagcacagacgggaaaagcgcagcgtcgctctcgtgcctcatgttggaatgggcctggagaccagaacggaaacatggatgtcctctgagggcgcctggaaacacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaagaacaggacaaacgctttatctgcaagcattccatggtggatagaggctggggcaacgggtgtggactgttcggcaaaggagggattgtcacatgcgccatgtttacgtgcaaaaagaatatggaaggcaaagttgtgcagcctgagaacctcgaatacaccatcgtgattacaccccacagcggggaggagcatgcggtcggaaatgacaccggcaagcacggcaaagaaatcaagatcacacctcagtcttccattaccgaggccgaactgacggggtatggaaccgtgacaatggagtgtagcccccggaccggccttgatttcaacgaaatggttctgctccaaatggaggacaaggcttggctggtgcaccgccagtggtttcttgatctgccgctcccttggctgcccggggccgacacacagggatctaattggatccagaaggagaccctggtcacgttcaagaaccctcatgctaaaaagcaagacgtggttgtgctcggctcccaggaaggggccatgcacacagccctgaccggcgctacagagattcagatgagctccggaaatcttctgtttaccggccatctcaaatgcagactgcggatggataaacttcaactgaaagggatgtcttacagcatgtgtaccggaaagttcaagatcgtcaaagaaattgcggagacacagcacggcacgatcgtgatcagagtccagtatgagggggacggatccccctgcaagattcccttcgaaatcaccgatctcgagaaacgccatgtgctgggccggctgattacagttaaccctatcgtgaccgaaaaggacagcccggtcaacattgaggccgaacccccttttggggattcttacatcattatcggcgtggagcccggacagctcaaactgaattggttcaagaagggctccagcatcgggcaaatgtttgagacaaccatgagaggagctaaacgcatggccattcttggcgacacggcctgggatttcgggtctctgggaggcgtttttacaagcatcgggaaggctctccaccaggtgttcggcgccatttacggagcggctttttccggcgtctcttggaccatgaaaatcctgattggggtgatcatcacctggattggaatgaacagccggtccacaagcctgtctgtgtcccttgttctcgtcggcgtggtgaccctgtatctgggggccgtcgtgcaggccgacagcggatgtgttgtgtcttggaagaataaagaactcaagtgcggctccgggatcttcattacagataacgtccacacgtggaccgagcagtacaagtttcaacctgaaagcccctccaaactggcttctgccatccagaaggctcatgaggaaggcatttgtggaatcagaagcgtgacacgccttgagaatctgatgtggaaacagatcaccccggagctcaaccacattctgtccgaaaatgaggttaagctgacaatcatgaccggcgacattaaagggatcatgcaggccggaaagcggtctcttagacctcaacccacggaactcaaatatagctggaagacctggggcaaggcgaaaatgctgtccacagagagccataaccagaccttcctgattgatgggcctgaaacagccgagtgccccaataccaaccgcgcttggaactctctcgaggtggaagactacggatttggcgtcttcacaaccaacatctggctgaaacttcgggagaaacaggacgtgttttgtgattccaagctgatgagcgccgctatcaaagacaatagagccgttcacgcggatatgggctattggatggaatctgccctcaacgacacgtggaagatggagaaggcttccttcattgaggtgaaaagctgccactggcctaagtctcatacactgtggagcaatggggtcctggaatccgagatgatcattcccaaaaacttcgccggaccggtgagccagcacaactaccgccctggctatcatacccaaaccgctgggccctggcaccttggaaagctcgaaatggattttgacttctgtgagggcacaaccgtggtcgttacggaagattgcgggaatcggggaccctctctgagaacaaccacagcctccggcaaactgatcaccgagtggtgctgtcggagctgcacactccctccgctgcgctacagaggcgaggacgggtgttggtacggaatggaaattcggccccttaaggagaaggaagagaacctggtgaatagcctcgtgaccgccggccatgggcagatcgataacttttctctgggagtcctgggcatggctcttttcctcgaagagatgctgagaacgcgcattgggaccaaacacgcgatcctgctcgtggccgttagctttgtgacactgatcaccggaaatatgtccttccgggaccttggcagagtcatggtgatggttggcgctacaatgaccgatgacattgggatgggagtgacgtatctggccctcctggccgcttttaaggtccgccctacattcgccgcgggcctgcttctgagaaaactcacctctaaggagctgatgatggctacaatcgggattgccctcctgagccagtccaccatccccgaaaccattcttgagctgacagatgccctcgctctgggaatgatggtgctgaaaatcgttcggaacatggaaaagtaccaacttgccgtgacgatcatggcgatttcttgcgtccctaatgctgtgatcctgcagaacgcctggaaggtgagctgtaccattctcgccgctgtctccgttagccccctgctcctgacatcttcccagcagaaagccgactggatccctcttgctctgaccattaagggcctcaatcccacagccatctttctgaccacgctgagccgcacatctaaaaagagatcctggccgcttaacgaggcgatcatggccgtggggatggtgagcattctggcttcttccctcctgaaaaatgacatccctatgaccggacccctcgtcgccggcggcctgcttaccgtgtgctatgttctgacagggcggagcgctgatctggaactcgagcgcgccgccgacgtgaagtgggaggatcaagctgaaatttccggaagctctcctatcctgagcattaccatctccgaggacggctctatgagcattaaaaacgaagaggaggaacagacacttacgatcctgatcagaaccgggctcctggtcatttccggagtgttccccgtttctatcccgattacagcggccgcttggtacctctgggaggtgaagaagcagcgggccggcgtcctgtgggatgtgccttctccccctcccgtcgaaaaagccgagcttgaagacggggcttatcgcatcaagcagagagggattctgggctactcccaaatcggcgccggggtgtataaagagggaacctttcacacaatgtggcatgttacccggggcgcggtgctgatgcaccgcgggaagagaatcgagccctcctgggctgatgtcaaaaaggacctcattagctacggaggcgggtggaagctggaaggagagtggaaagaaggcgaggaagtgcaggttcttgccctggagcctggcaagaatccgcgggccgtgcagacgaaacccgggatcttcaagaccaacacaggaaccattggcgctgtctccctcgattttagccctgggacatctggatcccccatcgtggacagaaaaggcaaggtggttgggctgtacggaaatggcgtcgtgacccgcagcggcgcctatgtgtctgcgattgctcagacagagaagtccatcgaagataaccctgagatcgaagacgatattttccggaaaaagagactcacgatcatggacctgcatcccggggccggaaaaaccaagcgctaccttcctgccattgtccgggaggctatcaaaagaggcctgcgcacactgattctcgccccgacccgggtggttgctgccgaaatggaggaggcgctgagagggcttcccatccgctatcaaacccctgccattaagacagaacacacgggacgggagatcgtggacctgatgtgtcatgctaccttcacaatgagactcctgagccccgtccgggtgcctaactacaatctcatcattatggatgaagcccactttaccgaccccgcttccatcgccgcccgcggctatatttctacaagagttgagatgggggaggctgcgggcatcttcatgaccgccacgccgcctggaagccgggatccctttccccagtccaacgctcctattatggacgaagaaagagaaatccccgagagaagctggaactctggccacgaatgggtgacagatttcaaggggaaaaccgtctggtttgtgccttccatcaaggccggaaacgacattgccgcttgcctgcggaaaaatggcaagaaagttatccagcttagcagaaagaccttcgattctgagtacgtgaagacacgcgccaacgactgggattttgtcgtgaccacagacattagcgagatgggggcgaatttcaaagctgaacgggtgatcgatccgagacgctgtatgaagcccgtcattctgaccgacggagaggaacgggttatcctggccggccctatgcccgtgacgcattcctctgccgctcaaagacgcgggcggatcggcagaaaccctaaaaatgagaacgaccagtatatttacatgggagaacccctcgagaatgatgaggactgcgcccactggaaggaagcgaaaatgctgcttgataacatcaatacaccggagggcattatccctagcatgtttgaacccgagcgcgaaaaggtggacgccattgatggggagtacagactgcggggagaggctcgcaaaaccttcgtcgacctcatgagacggggcgatctgcctgtgtggctggcctataaggttgctgccgaagggatcaactacacagaccgcaagtggtgttttgatggaattaaaaataaccagatcctcgaggaaaacatggaggtggagatctggaccaaggaaggcgagcgcaagaaacttaaaccccggtggctggacgctagaatttattccgatcctctggccctcaaggagttcaaggagttcgcggccgggcgcaaatctctgacgcttaatctgatcaccgaaatgggccggctccccacatttatgacccagaaggctagaaacgccctggacaatctggctgtcctccatacagccgaggccggaggccgcgcttacaaccacgcgcttagcgagctgccggaaaccctggagacactcctgcttctgaccctcctggccacggtgacagggggaattttcctgtttctcatgtccggcaaagggatcggaaagatgacccttggcatgtgctgcattatcaccgctagcatcctgctgtggtatgcccaaattcagcctcactggatcgccgcttctattatcctcgagttctttctgattgttcttctgatccccgagcccgaaaaacagcggacacctcaggataatcaactcacctacgtggtcatcgccattctgacagtggtcgcggccacgatggctaacgagatgggcttcctggagaagaccaagaaagacctcgggcttggatccatcacaacccaggaaagcgagtccaatattctggacatcgatctgagaccggcctctgcttggacactctatgccgtggcgaccacgtttgttacccccatgctgcggcatagcattgaaaactcctctgtgaatgtgagccttacagccatcgctaaccaggccaccgtcctgatgggcctcgggaagggatggcctctgtccaaaatggacattggcgttcccctgctcgctatcgggtgttacagccaggtgaatcctatcacacttaccgccgctctgctgctcctggtggcccactacgcgattatcggacccggccttcaagccaaggctacgcgcgaggcccagaaaagagctgccgccggcattatgaagaaccctacagtcgatgggatcaccgtgattgacctggaaccgatcccctatgatcctaagttcgagaaacagctcggacaggttatgctgctgatcctctgcgtgacacaagtccttatgatgcggaccacctgggcgctgtgtgaggctctgacactcgccacgggccccatttctaccctgtgggaagggaatcctggacgcttttggaacacaaccatcgctgtgtccatggccaatattttcagaggcagctaccttgccggggctggactgctcttttctatcatgaagaacacaacctccacgcggcgcggcacaggcaatattggggagaccctgggagaaaaatggaaaagcagactgaacgccctcggcaaatctgagttccagatctataagaaaagcgggatccaggaggtcgaccggacccttgcgaaggaaggaattaagcgcggcgagacagatcatcacgccgtgtccagagggtctgctaaactgcggtggtttgttgaaagaaacatggtgacccccgagggaaaggtcgtggacctgggctgcggccgcgggggatggagctactattgtggcgggctcaaaaatgttcgggaagtgaagggactgacaaaaggcgggccgggacatgaggagcctatccccatgtccacgtacggctggaaccttgtcagactgcaaagcggcgtggatgtgttcttcacaccccctgaaaagtgcgacaccctcctgtgtgatattggggagtcctctcccaatcctaccatcgaagccggacgcacactgcgggttctcaaccttgtcgagaattggctgaacaataacacccagttttgcattaaggtgctgaatccgtatatgcccagcgtgatcgagaagatggaggctctccagagacagtacggcggggccctggtccgcaaccctctttccagaaattctacgcacgagatgtactgggttagcaacgcgaccggaaatatcgtgtcctctgtgaacatgattagcagaatgctgatcaatcgcttcacaatgaagcacaaaaaggccacctatgaacccgacgtcgatctcggctccgggacacggaacattggaatcgagagcgaaattcctaacctggacatcattggcaaaagaatcgagaagatcaagcaagaacatgagatttcttggcactacgaccaggatcatccctataaaacctgggcttaccacggctcctatgagacaaagcagaccgggagcgcctcttccatggtgaatggagttgtgcgcctgctcacgaaaccgtgggacgtcgtgcctatggttacacagatggctatgaccgataccacaccctttggccaacagcgggtgttcaaggaaaaagtcgacacgagaacccaggagcctaaggaagggacaaagaaacttatgaagatcaccgccgagtggctgtggaaagagctgggaaagaaaaagacaccccgcatgtgtaccagagaagagtttacacggaaagtgcgcagcaacgctgccctcggcgcgattttcaccgatgaaaataagtggaagtctgccagagaggctgtggaagacgggcggttttgggagctggtcgatagagagcggaaccttcacctggaaggaaaatgcgagacgtgtgtttacaatatgatgggcaagcgcgagaagaagctcggcgagttcgggaaagccaagggatccagagctatctggtatatgtggctgggcgcccggtttctggagttcgaggccctcgggtttctgaacgaggaccattggttcagccgcggaaattcccttagcggcgtggaaggggagggcctgcacagactcggatacattctgcgggatgtgggcaagaaagaagggggagcgatgtacgctgacgataccgccggctgggacacacgcatcacccttgaggacctgaagaacgaagagatggtcacaaatcatatgaaaggggagcacaagaaactcgccgaagctatctttaagctgacctatcagaacaaggtggttagagtgcaacggcctacgccccgcggaacagtcatggatattatctctagacgggaccagcgcggcagcggacaggtgggcacctacggactgaatacattcaccaacatggaggcccaactcattagacagatggaaggcgaggggatcttcaaatccattcagcatctgacggctaccgaggaaatcgccgttcagaattggcttgcgcgggtgggacgcgagagactgtctcggatggccatcagcggcgatgactgcgtcgtgaagccgattgatgacagatttgcttccgccctcacagctctgaacgatatggggaaagttcgcaaggacatccaacagtgggaaccttctcggggatggaatgattggacccaggtgcccttctgcagccaccactttcatgagcttgtcatgaaagacggcagagtgctggtcgtgccctgtcgcaaccaggatgaactcattgggcgggccagaatctcccaaggcgcgggatggtctctgaaggagacagcctgcctgggcaagagctatgctcagatgtggaccctcatgtacttccaccgccgggacctgagacttgccgctaacgccatttgttccgctgttcctagccattgggtgccgacatctcgcaccacgtggtccatccacgccaaacacgagtggatgacaaccgaagatatgctggcggtctggaatcgggtgtggattcaggagaacccctggatggaagacaagacccctgtggagagctgggaagaggttccctatctcgggaaaagagaggaccagtggtgcggatctctgatcggccttacatcccgcgccacctgggctaagaatatccaaacagccattaaccaggtgcggagcctgatcgggaatgaagagtacacggattatatgccttccatgaaaagatttcggagagaagaggaagagaccggagtcctctggtga

SEQ ID NO: 19826 - RNA, 9876 nt, synthetic construct
  misc_feature 1..9876: note = derived and/or modified CDS sequence (opt5) from DENV-2__EU482597__SS-prME
  source 1..9876: mol_type = other RNA
accgccggcgtgatcgtcatgctgattcccacagctatggccttccacctcacgaccagaaatggggagcctcatatgatcgttggacggcaggaaaagggcaagagcctgctttttaagaccgaggacggggtgaatatgtgcaccctgatggcgattgatctcggagaactgtgtgaggacacaatcacctacaaatgcccccttctgcgccaaaacgaacccgaggatattgactgttggtgcaattccacatctacctgggtgacgtatggcacctgtacaaccacaggggagcaccggcgggaaaagcgcagcgtcgctctcgtgcctcatgttggaatgggcctggagaccagaacggaaacatggatgtcctctgagggcgcctggaaacacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgtccgaggaacaggacaaacgctttatctgcaagcatagcatggtggatagaggctggggcaatgggtgtggactgttcggcaaagggggaattgtcacatgcgccatgtttacgtgcaaaaagaacatggaaggcaaagttgtgcagcctgagaatctcgaatacaccatcgtgattacaccccactctggggaggagcatgcggtcggaaacgacaccggcaagcacggcaaagaaatcaagatcacacctcagtccagcattaccgaggccgaactgacggggtatggaaccgtgacaatggagtgttctccccggaccggccttgatttcaatgaaatggttctgctccaaatggaggacaaggcttggctggtgcaccgccagtggtttcttgatctgccgctcccttggctgcccggggccgacacacagggatccaactggatccagaaggagaccctggtcacgttcaagaatcctcatgctaaaaagcaagacgtggttgtgctcggcagccaggaaggggccatgcacacagccctgaccggcgctacagagattcagatgtcctctggaaaccttctgtttaccggccatctcaaatgcagactgcggatggataaacttcaactgaaagggatgagctactccatgtgtaccggaaagttcaagatcgtcaaagaaattgcggagacacagcacggcacgatcgtgatcagagtccagtatgagggggacggaagcccctgcaagattcccttcgaaatcaccgatctcgagaaacgccatgtgctgggccggctgattacagttaatcctatcgtgaccgaaaaggactctccggtcaacattgaggccgaacccccttttggggattcctacatcattatcggcgtggagcccggacagctcaaactgaactggttcaagaagggcagctctatcgggcaaatgtttgagacaaccatgagaggagctaaacgcatggccattcttggcgacacggcctgggatttcgggagcctgggaggcgtttttacatccatcgggaaggctctccaccaggtgttcggcgccatttacggagcggctttttctggcgtcagctggaccatgaaaatcctgattggggtgatcatcacctggattggaatgaactcccggagcacatctctgtccgtgagccttgttctcgtcggcgtggtgaccctgtatctgggggccatggtccaggccgactctggatgtgtggtttcctggaagaacaaagaactcaagtgcggcagcgggatcttcattacagataatgtgcacacgtggaccgagcagtacaagtttcaacctgaatccccctctaaactggctagcgccatccagaaggctcatgaggaaggcatttgtggaatcagatccgtcacacgccttgagaacctgatgtggaaacagatcaccccggagctcaatcacattctgtctgaaaacgaggtgaagctgacaatcatgaccggcgacattcgggggatcatgcaggccggaaaaagaagccttcgccctcaacccacggaactcaagtattcctggaaaacctggggcaaggcgaagatgctgagcacagagtctcataatcagaccttcctgattgatgggcctgaaacagccgagtgccccaacaccaatcgggcttggaactccctcgaggttgaagactacggatttggcgtgttcacaaccaatatctggctgaaacttagagagaagcaggacgtcttttgtgatagcaaactgatgtctgccgctatcaaggacaaccgcgccgtgcacgcggatatgggctattggattgaatccgccctcaatgacacgtggaaaatggagaaggctagcttcatcgaggttaagtcttgccactggcctaaaagccatacactgtggtccaacggggtgctggaaagcgagatgattatccccaagaatttcgccggaccggtctctcagcacaactaccggcctggctatcatacccaaaccgctgggccctggcaccttggaaaactcgaaatggattttgacctgtgtgagggcacaaccgtggtggtcacggaagattgcgggaacagaggaccctccctgcggacaaccacagccagcggcaagctcattaccgagtggtgctgtcgctcctgcacactgcctccgcttagataccggggcgaggacgggtgttggtacggaatggaaatcagacccctgaaagagaaggaagagaatctcgttaactctctggtgaccgccggccatgggcagattgataatttcagcctgggagtgcttggcatggctctctttctggaagagatgctgcgcacgcggatcgggaccaagcacgcgatcctcctggtcgccgtgtccttcgttacacttattaccggaaacatgtcttttagagacctgggccgcgtgatggtcatggtgggcgctacaatgaccgatgacatcgggatgggagttacgtatctcgccctgctggccgctttcaaagtgagacctacatttgccgcgggccttctgctccggaagctgaccagcaaagagctcatgatggctacaattgggatcgccctgctttcccagtctaccattcccgaaaccatcctggagctcacagatgccctggctctgggaatgatggtccttaagatcgtgcgcaatatggaaaaataccaactggccgttacgattatggcgatcagctgcgtgcctaacgctgtcattctccagaatgcctggaaggtgtcctgtaccatcctggccgctgtgagcgtctctcccctcctgcttacatccagccagcagaaggccgactggattcctctggctctcaccatcaaaggcctgaaccccacagccatcttcctgaccacgctttctagaacatccaagaaacggagctggccgctgaatgaggcgattatggccgttgggatggtgtctatcctcgcttccagcctgctcaagaacgacattcctatgaccggacccctggtggccggcggccttctgaccgtctgctatgtgctgacagggcgctccgctgatctcgaactggagagagccgccgacgttaaatgggaggatcaagctgaaatcagcggatctagccctattctttccatcaccatttctgaggacggcagcatgtccatcaagaatgaagaggaggaacagacactgacgatcctcattcggaccgggctgctcgtgatctctggagtctttcccgtgagcattccgatcacagcggccgcttggtacctgtgggaggttaaaaagcagcgcgccggcgtgctttgggatgtcccttctccccctcccgtggaaaaggccgagctggaagacggggcttatagaattaaacagcggggaatcctgggctacagccaaatcggcgccggggtctataaggagggaaccttccacacaatgtggcatgtgacccgcggcgcggttctcatgcacagagggaaacggattgagcccagctgggctgatgtgaagaaagacctgatctcctacggaggcgggtggaaacttgaaggagagtggaaggaaggcgaggaagtccaggtgctggccctcgagcctggcaaaaacccgagagccgttcagacgaagcccgggatttttaaaaccaatacaggaaccatcggcgctgtgagcctggatttctctcctgggacatccggaagccccattgtcgaccgcaagggcaaagtggtggggctctacggaaacggcgttgtcacccggtctggcgcctatgtgtccgcgatcgctcagacagaaaagagcatcgaagataatcctgagattgaagacgatatctttagaaagaaacgcctgacgattatggaccttcatcccggggccggaaagaccaaacggtacctgcctgccatcgtgagagaggctattaagcgcggcctgcggacactcatcctggccccgaccagagtcgtggctgccgaaatggaggaggcgcttcgcgggctgcccattcggtatcaaaccacagccatcaaaacggaacacaccggaagagagatcgttgacctcatgtgtcatgctacattcaccatgcggctgctctcccctgtgcgcgtccccaactacaacctgattatcatggatgaagcccacttcacagaccctgcttctattgccgccagaggctatatcagcacccgggtggagatgggggaggctgcgggcatttttatgacggccacacccccgggatcccgcgatcctttcccccagagcaatgctcccatcatggacgaagagagagaaatccctgagcggtcttggaactccggccacgaatgggttaccgattttaaggggaagaccgtgtggttcgtccccagcattaaagccggaaatgacatcgccgcttgccttagaaagaacggcaaaaaggtgattcagctgtctcgcaaaacatttgatagcgagtacgttaagacccgggccaatgactgggatttcgtggtcacaaccgacatctccgagatgggggcgaactttaaggctgaaagagtgattgatcctcgccggtgtatgaaaccggtgatcctgacggacggagaggaaagagtcatcctcgccggccccatgcctgttacacattctagcgccgctcaacgccgggggagaattggccgcaatcccaagaacgagaatgaccagtatatctacatgggagaacctctggagaacgatgaggactgcgcccactggaaagaagcgaagatgcttctggataatattaacacccccgagggcatcattccgtccatgttcgaacctgagagagaaaaagtggacgccatcgatggggagtaccggctccgcggagaggctagaaagacatttgtggacctgatgcggcgcggcgatctgcccgtctggctcgcctataaagtggctgccgaagggattaattacgctgacagaaagtggtgtttcgatggaatcaagaacaatcagatccttgaggaaaacatggaggttgagatttggaccaaagaaggcgagcggaagaaactgaagcctagatggctggacgcccgcatctattctgatcccctcgcgctgaaagaatttaaggagttcgccgctgggcggaagtcccttacgctgaacctcattaccgaaatgggcagactgcctacattcatgacccagaaagcccgcaatgctctggacaacctcgccgtgcttcatacagccgaggctggaggccgggcgtacaatcacgccctgtccgagctgcccgaaaccctcgagacactgcttctgctcaccctgctggctacggtcacagggggaatctttctcttccttatgagcggcaaggggattggaaaaatgaccctgggcatgtgctgcatcatcaccgcctctattctgctctggtatgcccaaatccagccgcactggattgctgcctccatcattctggaatttttccttatcgtgctgctcatccctgagcccgaaaagcagagaacaccccaggataaccaactgacctacgttgtgattgcgatcctgacagtcgtggccgctacgatggccaatgagatgggctttctcgagaaaaccaagaaggaccttgggctgggaagcattacaacccaggaatccgagtctaacatcctggacattgatctccggcctgctagcgcctggacactgtatgcggtcgccaccacgttcgtgaccccgatgcttcgccattccatcgaaaattctagcgttaacgtgtccctgacagctattgccaatcaggctaccgtgctcatgggcctggggaaaggatggcccctgagcaagatggacatcggcgtccctctccttgccatcgggtgttactctcaggttaaccccattacactgaccgctgccctgctcctgcttgtggcgcactacgccatcattggacctggcctgcaagctaaagccacgagagaggctcagaagcgggccgccgcgggcatcatgaaaaatcccacagtggatgggattaccgtcatcgacctcgaacctatcccgtatgatcccaagtttgagaagcagctgggacaggtgatgctgctcattctttgcgttacacaagtgctgatgatgcgcaccacctgggctctgtgtgaggccctcacactggctacgggccctatctccaccctttgggaagggaaccccggaagattctggaatacaaccattgccgtcagcatggccaacatctttcggggctcttacctggctggggccggactcctgttctccattatgaaaaatacaaccaacacgcgcagaggcacaggcaatatcggggagaccctgggagaaaagtggaaaagccggctcaacgcgcttggcaagtctgagtttcagatctataaaaagagcgggattcaggaggtggaccgcaccctggccaaagaaggaatcaagagaggcgagacagatcatcacgctgtctcccgggggtctgccaagctgagatggttcgtggaacgcaacatggttacccctgagggaaaagtggtcgacctcggctgcggcagagggggatggagctactattgtggcgggctgaagaatgtgagagaagttaaaggacttacaaagggcgggcccggacatgaggagccgattcctatgtccacgtacggctggaacctggtgcgcctccaaagcggcgtcgatgtgtttttcacaccgcccgaaaaatgcgacacactgctgtgtgatatcggggagtcctctcctaatcccaccattgaagctggacggacactcagagtgcttaacctggttgagaattggctgaacaataacacccagttctgcatcaaggtcctcaatccttatatgccgagcgtgatcgaaaagatggaggccctgcagcgcaaatacggcggggcgcttgtgcggaaccccctgtccagaaattctacgcacgagatgtactgggtcagcaacgccaccggaaatattgtttcctctgtgaacatgatcagccgcatgctcattaatcggtttacaatgaagcacaaaaaggctacctatgaacctgacgtggatctgggctccgggacaagaaacatcggaattgagagcgaaatccccaacctggacattatcggcaaacgcatcgagaagattaagcaggaacatgagacctcttggcactacgaccaagatcatccttataaaacatgggcctaccacggctcctatgagaccaagcagacggggagcgcttcttccatggtcaatggagtggttcggctccttacaaaaccctgggacgtggtcccgatggtgacccagatggccatgaccgatacaacgcctttcggccagcaaagagtttttaaggaaaaagtggacacccgcacacaggagcccaaggaagggaccaagaaactgatgaagatcacagctgagtggctgtggaaagagctcggaaagaaaaagacccctagaatgtgtacacgggaagagttcacccgcaaagtcagaagcaacgccgcgctgggcgccatttttacggatgaaaataagtggaagtctgctcgggaggccgtggaagacgggagattctgggagcttgtggatcgggagcgcaacctgcacctcgaaggaaaatgcgagacctgtgtctacaatatgatgggcaagagagagaagaagctgggcgagtttgggaaagctaagggatcccgggccatctggtatatgtggctgggcgcccgcttcctcgaatttgaggcgctggggttccttaacgaggaccattggtttagcagaggaaattccctgagcggcgttgaaggggagggcctccaccggctgggatacattcttcgcgatgtgggcaagaaagaagggggagctatgtacgccgacgatacagccggctgggacaccagaatcacactggaggacctcaagaacgaagagatggtgaccaatcatatgaaaggggagcacaagaaactggctgaagccatcttcaagctgacgtatcagaacaaggtcgtgcgggttcagcgccccacacctagaggaaccgtgatggatattatctctcggcgcgaccaaagaggcagcgggcaggtcggcacatacggactcaatacctttacgaacatggaggctcagctgattcggcaaatggaaggcgaggggatcttcaaatccattcagcatcttaccgccacagaggaaatcgcggtgcagaattggctggcccgcgttggaagagagcggctctctagaatggctatcagcggcgatgactgcgtggtcaagcccattgatgaccgcttcgcctccgctctgaccgcccttaacgatatggggaaaatccggaaggacattcagcaatgggaaccgtctagaggatggaatgattggacacaggtgcctttttgcagccaccacttccatgagctggttatgaaagacggccgcgtgctcgtcgtgccctgtcggaaccaggatgaactgatcgggagagcgcgcatttcccagggcgccggatggtctctgaaggagaccgcttgcctcggcaagagctatgcccaaatgtggacactgatgtactttcaccggagagaccttcgcctggctgccaacgctatctgttccgccgtccccagccattgggtgcctacctctcggacgacatggtccattcacgcgaaacacgagtggatgaccaccgaagatatgctcgccgtttggaatagagtgtggatccaggagaacccgtggatggaagacaagacacccgtcgagagctgggaagaggtgccttatctggggaaacgcgaggaccagtggtgcggatctcttatcggcctgacctcccgggctacatgggccaagaatattcagacggccatcaaccaagtgagaagcctcattgggaatgaagagtacaccgattatatgccctccatgaaacggttcagacgcgaagaggaagaggctggagttctgtggtga

SEQ ID NO: 19827 - RNA, 9876 nt, synthetic construct
  misc_feature 1..9876: note = derived and/or modified CDS sequence (opt5) from DENV-2__EU482598__SS-prME
  source 1..9876: mol_type = other RNA
accgccggcgtgatcgtgatgctgattcccacagctatggccttccacctcacgaccagaaatggggaacctcatatgatcgttggacggcaggaaaagggcaagagcctgctttttaagaccgaggacggggtgaatatgtgcaccctgatggcgattgatctcggagaactgtgtgaggacacaatcacctacaagtgcccccttctgcgccaaaatgaacccgaggatattgactgttggtgcaatagcacatctacctgggtgacgtatggcacctgtacaaccacaggggagcacagacgggaaaagcgcagcgtcgctctcgtgcctcatgttggaatgggcctggagaccagaacggaaacatggatgtcctctgagggcgcctggaaacacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaggaacaggacaaacgctttatctgcaagcattccatggtggatagaggctggggcaacgggtgtggactgttcggcaaaggcgggattgtcacatgcgccatgtttacgtgcaaaaagaatatggaagggaaaatcgttcagcctgagaacctcgaatacaccattgtgatcacaccccacagcggggaggagcatgcggtgggaaatgacaccggcaagcacggcaaagaaatcaagattacacctcagtcttccatcaccgaggccgaactgacggggtatggaaccgtcacaatggagtgtagcccccggaccggccttgatttcaacgaaatggtgctgctccaaatggaggacaaggcttggctggttcaccgccagtggtttcttgatctgccgctcccttggctgcccggggccgacacacagggatctaattggattcagaaggagaccctggtgacgttcaagaaccctcatgctaaaaagcaagacgtcgtggttctcggctcccaggaaggggccatgcacacagccctgaccggcgctacagagatccagatgagctccggaaatcttctgtttaccggccatctcaaatgcagactgcggatggataaacttcaactgaaagggatgtcttacagcatgtgtaccggaaagttcaagattgtgaaagaaatcgcggagacacagcacggcacgatcgtcattagagtgcagtatgagggggacggatccccctgcaagatccccttcgaaattaccgatctcgagaaacgccatgtcctgggccggctgatcacagtgaaccctattgttaccgaaaaggacagcccggtgaacatcgaggccgaacccccttttggggattcttacattatcatcggcgtcgagcccggacagctcaaactgaattggttcaagaagggctccagcattgggcaaatgtttgagacaaccatgagaggagctaaacgcatggccatccttggcgacacggcctgggatttcgggtctctgggaggcgtgtttacaagcattgggaaggctctccaccaggttttcggcgccatctacggagcggctttttccggcgtgtcttggaccatgaaaattctgatcggggtcatcattacctggatcggaatgaacagccggtccacaagcctgtctgtgtcccttgtgctcgttggcgtcgtgaccctgtatctgggggccatggtgcaggccgacagcggatgtgtcgtgtcttggaagaataaagaactcaagtgcggctccgggattttcatcacagataacgttcacacgtggaccgagcagtacaagtttcaacctgaaagcccctccaaactggcttctgccattcagaaggctcatgaggaaggcatctgtggaatcagaagcgtgacacgccttgagaatctgatgtggaaacagattaccccggagctcaaccacatcctgtccgaaaatgaggtcaagctgacaattatgaccggcgacatccgggggattatgcaggccggaaaaagatctcttcgccctcaacccacggaactcaagtatagctggaaaacctggggcaaggcgaagatgctgtccacagagagccataaccagaccttcctgatcgatgggcctgaaacagccgagtgccccaataccaaccgggcttggaactctctcgaggtggaagactacggatttggcgttttcacaaccaacatctggctgaaacttagagagaagcaggacgtgttttgtgattccaaactgatgagcgccgctattaaggacaatcgcgccgtccacgcggatatgggctattggatcgaatctgccctcaacgacacgtggaaaatggagaaggcttccttcattgaggtcaagagctgccactggcctaaatctcatacactgtggagcaatggggttctggaatccgagatgatcattcccaagaacttcgccggaccggtgagccagcacaactaccggcctggctatcatacccaaaccgctgggccctggcaccttggaaaactcgaaatggattttgacctgtgtgagggcacaaccgtcgtggtgacggaagattgcgggaatagaggaccctctctgcggacaaccacagcctccggcaagctcatcaccgagtggtgctgtcgcagctgcacactgcctccgcttagataccggggcgaggacgggtgttggtacggaatggaaattagacccctgaaagagaaggaagagaacctcgtcaattccctggttaccgccggccatgggcagatcgataacttctctctgggagtgcttggcatggctctctttctggaagagatgctgcgcacgcggatcgggaccaagcacgcgattctcctggtggccgtcagcttcgtgacacttatcaccggaaatatgtcctttagagacctgggccgcgttatggtgatggtcggcgctacaatgaccgatgacattgggatgggagtgacgtatctcgccctgctggccgctttcaaagttagacctacatttgccgcgggccttctgctccggaagctgacctctaaagagctcatgatggctacaatcgggattgccctgcttagccagtccaccatccccgaaaccatcctggagctcacagatgccctggctctgggaatgatggtgcttaagattgtccgcaacatggaaaaataccaactggccgtgacgatcatggcgatttcttgcgttcctaatgctgtgatcctccagaacgcctggaaggtcagctgtaccattctggccgctgtgtccgtgagccccctcctgcttacatcttcccagcagaaggccgactggatccctctggctctcaccatcaaaggcctgaatcccacagccattttcctgaccacgcttagcagaacatctaagaaacggtcctggccgctgaacgaggcgatcatggccgtcgggatggttagcattctcgcttcttccctgctcaagaatgacatccctatgaccggacccctggtggccggcggccttctgaccgtgtgctatgtcctgacagggcgcagcgctgatctcgaactggagagagccgccgacgtgaaatgggaggatcaagctgaaatttccggaagctctcctatccttagcattaccatctccgaggacggctctatgagcatcaagaacgaagaggaggaacagacactgacgattctcatccggaccgggctgctcgttatttccggagtgtttcccgtctctatcccgattacagcggccgcttggtacctgtgggaggtgaaaaagcagcgcgccggcgttctttgggatgtgccttctccccctcccgtcgaaaaggccgagctggaagacggggcttatagaatcaaacagcggggaatcctgggctactcccaaattggcgccggggtgtataaggagggaaccttccacacaatgtggcatgtcacccgcggcgcggtgctcatgcacagagggaaacggatcgagccctcctgggctgatgttaagaaagacctgattagctacggaggcgggtggaaacttgaaggagagtggaaggaaggcgaggaagtgcaggtcctggccctcgagcctggcaaaaatccgagagccgtgcagacgaagcccgggatctttaaaaccaacacaggaaccattggcgctgtttccctggatttcagccctgggacatctggatcccccatcgtggaccgcaagggcaaagtcgtggggctctacggaaatggcgtggttacccggagcggcgcctatgtctctgcgatcgctcagacagagaagtccattgaagataaccctgagatcgaagacgatatttttagaaagaaacgcctgacgatcatggaccttcatcccggggccggaaagaccaaacggtacctgcctgccattgtgagagaggctatcaagcgcggcctgcggacactcattctggccccgaccagagtggtcgctgccgaaatggaggaggcgcttcgcgggctgcccatccggtatcaaaccacagccatcaaaacggaacacaccggaagagagattgtggacctcatgtgtcatgctacattcaccatgcggctgctcagccctgttcgcgtgcccaactacaatctgatcattatggatgaagcccacttcacagaccctgcttccatcgccgccagaggctatatttctacccgggtcgagatgggggaggctgcgggcatctttatgacggccacacccccgggaagccgcgatcctttcccccagtccaacgctcccatcatggacgaagagagagaaattcctgagcggagctggaactctggccacgaatgggtgaccgattttaaggggaagaccgtttggttcgtgccctccatcaaagccggaaacgacattgccgcttgccttagaaagaatggcaaaaaggtcatccagctgagccgcaaaacatttgattctgagtacgtgaagacccgggccaacgactgggatttcgttgtgacaaccgacattagcgagatgggggcgaattttaaggctgaaagagtcatcgatcctcgccggtgtatgaaaccggtgatcctgacggacggagaggaaagagtgattctcgccggccccatgcctgtcacacattcctctgccgctcaacgccgggggagaatcggccgcaaccccaagaatgagaacgaccagtatatttacatgggagaacctctggagaatgatgaggactgcgcccactggaaagaagcgaagatgcttctggataacatcaatacccccgagggcattatcccgagcatgttcgaacctgagagagaaaaagttgacgccattgatggggagtaccggctccgcggagaggctagaaagacatttgtggacctgatgcggcgcggcgatctgcccgtgtggctcgcctataaagtcgctgccgaagggatcaactacgctgacagaaagtggtgtttcgatggaatcaagaataaccagattcttgaggaaaacatggaggtggagatctggaccaaagaaggcgagcggaagaaactgaagcctagatggctggacgcccgcatttattccgatcccctcgcgctgaaagaatttaaggagttcgccgctgggcggaagtctcttacgctgaatctcatcaccgaaatgggcagactgcctacattcatgacccagaaagcccgcaacgctctggacaatctcgccgttcttcatacagccgaggctggaggccgggcgtacaaccacgccctgagcgagctgcccgaaaccctcgagacactgcttctgctcaccctgctggctacggtgacagggggaatttttctcttccttatgtccggcaaggggatcggaaaaatgaccctgggcatgtgctgcatcattaccgccagcatcctgctctggtatgcccaaattcagccgcactggatcgctgcctctattatcctggaatttttccttatcgtcctgctcattcctgagcccgaaaagcagagaacaccccaggataatcaactgacctacgtggttatcgcgattctgacagtggtcgccgctacgatggccaacgagatgggctttctcgagaaaaccaagaaggaccttgggctgggatccatcacaacccaggaaagcgagtccaatattctggacatcgatctccggcctgcttctgcctggacactgtatgcggtggccaccacgttcgtcaccccgatgcttcgccatagcattgaaaactcctctgtgaatgttagcctgacagctatcgccaaccaggctaccgtgctcatgggcctggggaaaggatggcccctgtccaagatggacatcggcgtgcctctccttgccattgggtgttacagccaggtcaatcccatcacactgaccgctgccctgctcctgcttgttgcgcactacgccattatcggacctggcctgcaagctaaagccacgagagaggctcagaagcgggccgccgcgggcattatgaaaaaccccacagtggatgggatcaccgtgatcgacctcgaacctattccgtatgatcccaagtttgagaagcagctgggacaggtcatgctgctcatcctttgcgtgacacaagttctgatgatgcgcaccacctgggctctgtgtgaggccctcacactggctacgggccctatttctaccctttgggaagggaatcccggaagattctggaacacaaccatcgccgtgtccatggccaatatttttcggggcagctacctggctggggccggactcctgttctctatcatgaaaaacacaaccaatacgcgcagaggcacaggcaacatcggggagaccctgggagaaaagtggaaatcccggctcaacgcgcttggcaagagcgagtttcagatttataaaaagtctgggatccaggaggtcgaccgcaccctggccaaagaaggaattaagagaggcgagacagatcatcacgctgtgagccgggggtccgccaagctgagatggttcgtcgaacgcaatatggtgacccctgagggaaaagttgtggacctcggctgcggcagagggggatggtcttactattgtggcgggctgaagaacgtccgggaagtgaaaggacttacaaagggcgggcccggacatgaggagccgatccctatgagcacgtacggctggaatctggttcgcctccaatccggcgtggatgtctttttcacaccgcccgaaaaatgcgacacactgctgtgtgatattggggagagctcccctaaccccaccatcgaagctggacggacactcagagtgcttaatctggtggagaactggctgaataacaatacccagttctgcatcaaggttctcaacccttatatgccgtctgtcattgaaaagatggaggccctgcagcgcaaatacggcggggcgcttgtgcggaatcccctgagcagaaactccacgcacgagatgtactgggtgtctaatgccaccggaaacatcgtcagctccgttaatatgatttctcgcatgctcatcaaccggtttacaatgaagcacaaaaaggctacctatgaacctgacgtggatctgggcagcgggacaagaaacattggaatcgagtccgaaattcccaatctggacatcatcggcaaacgcattgagaagatcaagcaggaacatgagaccagctggcactacgaccaagatcatccttataaaacatgggcctaccacggctcttatgagaccaagcagacggggtccgctagctctatggtgaacggagtcgtgcggctccttacaaaaccctgggacgttgtgccgatggtcacccagatggccatgaccgatacaacgcctttcggccagcaaagagtgtttaaggaaaaagttgacacccgcacacaggagcccaaggaagggaccaagaaactgatgaagattacagctgagtggctgtggaaagagctcggaaagaaaaagacccctagaatgtgtacacgggaagagttcacccgcaaagtgagatccaatgccgcgctgggcgccatctttacggatgaaaacaagtggaaaagcgctcgggaggccgtcgaagacgggagattctgggagcttgtggatcgggagcgcaatctgcacctcgaaggaaaatgcgagacctgtgtgtacaacatgatgggcaagagagagaagaagctgggcgagtttgggaaagctaagggatctcgggccatttggtatatgtggctgggcgcccgcttcctcgaatttgaggcgctggggttccttaatgaggaccattggttttccagaggaaacagcctgtccggcgtcgaaggggagggcctccaccggctgggatacatccttcgcgatgttggcaagaaagaagggggagctatgtacgccgacgatacagccggctgggacaccagaatcacactggaggacctcaagaatgaagagatggtgaccaaccatatgaaaggggagcacaagaaactggctgaagccattttcaagctgacgtatcagaataaggtggtccgggtgcagcgccccacacctagaggaaccgttatggatatcattagccggcgcgaccaaagaggctctggacaggtgggcacatacggactcaacacctttacgaatatggaggctcagctgatccggcaaatggaaggcgaggggattttcaaaagcatccagcatcttaccgccacagaggaaatcgcggtccagaactggctggcccgcgtgggaagagagcggctctccagaatggctatttctggcgatgactgcgttgtgaagcccatcgatgaccgcttcgccagcgctctgaccgcccttaatgatatggggaaagtccggaaggacattcagcaatgggaaccgtccagaggatggaacgattggacacaggtgcctttttgctctcaccacttccatgagctggttatgaaagacggccgcgtgctcgtcgtgccctgtcggaaccaggatgaactgatcgggagagcgcgcattagccagggcgccggatggtccctgaaggagaccgcttgcctcggcaagtcttatgcccaaatgtggacactgatgtactttcaccggagagaccttcgcctggctgccaatgctatctgtagcgccgtcccctcccattgggtgcctaccagccggacgacatggtctattcacgcgaaacacgagtggatgaccaccgaagatatgctcgccgtttggaacagagtgtggatccaggagaatccgtggatggaagacaagacacccgtcgagtcctgggaagaggtgccttatctggggaaacgcgaggaccagtggtgcggaagccttatcggcctgacctctcgggctacatgggccaagaacattcagacggccatcaatcaagtgagatccctcattgggaacgaagagtacaccgattatatgcccagcatgaaacggttcagacgcgaagaggaagaggctggagttctgtggtga

SEQ ID NO: 19828 - RNA, 9876 nt, synthetic construct
  misc_feature 1..9876: note = derived and/or modified CDS sequence (opt5) from DENV-2__EU482603__SS-prME
  source 1..9876: mol_type = other RNA
accgccggagtgatcgtcatgctgattcccacggctatggccttccacctcacgaccagaaatggggagcctcatatgatcgttggacggcaggaaaagggcaagagcctgctttttaagacagaggacggggtgaatatgtgcaccctgatggcgattgatctcggagaactgtgtgaggacacaatcacctacaagtgcccgcttctgcgccaaaacgaacccgaggatattgactgttggtgcaattccacatctacctgggtgacgtatggcacctgtacaaccacaggggagcacagacgggaaaagcgcagcgtcgctctcgtgcctcatgttggaatgggcctggagaccagaacggaaacatggatgtcctctgagggcgcctggaaacacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaagaacaggacaaacgctttatctgcaagcattccatggtggatagaggctggggcaacgggtgtggactgttcggcaaagggggaattgtcacatgcgccatgtttacgtgcaaaaagaatatggaaggcaaagttgtgcagcctgagaacctcgaatacaccatcgtgattacaccccacagcggggaggagcatgcggtcggaaatgacaccggcaagcacggcaaagaaatcaagatcacacctcagtcttccattaccgaggccgaactgacggggtatggaaccgtgacaatggagtgtagcccccggaccggccttgatttcaacgaaatggttctgctccaaatggaggacaaggcttggctggtgcaccgccagtggtttcttgatctgccgctcccttggctgcccggggccgacacacagggatctaattggatccagaaggagaccctggtcacgttcaagaaccctcatgctaaaaagcaagacgtggttgtgctcggctcccaggaaggggccatgcacacagccctgaccggcgctacagagattcagatgagctccggaaatcttctgtttaccggccatctcaaatgcagactgcggatggataaacttcaactgaaagggatgtcttacagcatgtgtaccggaaagttcaagatcgtcaaagaaattgcggagacacagcacggcacgatcgtgatcagagtccagtatgagggggacggatccccctgcaagattcccttcgaaatcaccgatctcgagaaacgccatgtgctgggccggctgattacagttaaccctatcgtgaccgaaaaggacagcccggtcaacattgaggccgaacccccttttggggattcttacatcattatcggcgtggagcccggacagctcaaactgaattggttcaagaagggctccagcatcgggcaaatgtttgagacaaccatgagaggagctaaacgcatggccattcttggcgacacggcctgggatttcgggtctctgggaggcgtttttacaagcatcgggaaggctctccaccaggtgttcggcgccatttacggagcggctttttccggcgtctcttggaccatgaaaatcctgattggggtgatcatcacctggattggaatgaacagccggtccacaagcctgtctgtgtcccttgttctcgtcggcgtggtgaccctgtatctgggggccatggtccaggccgacagcggatgtgtggtttcttggaagaataaagaactcaagtgcggctccgggatcttcattacagataacgtgcacacgtggaccgagcagtacaagtttcaacctgaaagcccctccaaactggcttctgccatccagaaggctcatgccgagggcatttgtggaatcagaagcgtcacacgccttgaaaatctgatgtggaaacagatcaccccggagctcaaccacattctgtccgagaatgaagtgaagctgacaatcatgaccggcgacattaaagggatcatgcaggcgggaaagcggtctcttagacctcaacccacggagctcaaatatagctggaagacctggggcaaggccaaaatgctgtccacagaaagccataaccagaccttcctgattgatgggcctgagacagctgaatgccccaataccaaccgcgcctggaactctctcgaggttgaggactacggatttggcgtgttcacaaccaacatctggctgaaacttcgggaaaaacaggacgtcttttgtgattccaagctgatgagcgctgccatcaaagacaatagagcggtgcacgccgatatgggctattggattgagtctgctctcaacgacacgtggaagatggaaaaggcctccttcatcgaggttaaaagctgccactggcctaagtctcatacactgtggagcaatggggtgctggagtccgaaatgattatccccaaaaacttcgctggaccggtcagccagcacaactaccgccctggctatcatacccaaaccgccgggccctggcaccttggaaagctcgagatggattttgacctgtgtgaaggcacaaccgtggtggtcacggaggattgcgggaatcggggaccctctctgagaacaaccacagcctccggcaaactcattaccgaatggtgctgtcggagctgcacactgcctccgcttcgctacagaggcgaggacgggtgttggtacggaatggagatccggcccctgaaggaaaaggaggaaaacctcgttaattccctggtgaccgctggccatgggcagattgataacttctctctgggagtgcttggcatggcgctctttctggaggaaatgctgagaacgcgcatcgggaccaaacacgccatcctcctggtcgctgtgagcttcgttacacttattaccggaaatatgtcctttcgggacctgggcagagtgatggtcatggtgggcgccacaatgaccgatgacatcgggatgggagttacgtatctcgccctgctggctgccttcaaggtgcgccctacatttgcggctggccttctgctcagaaaactgacctctaaggagctcatgatggccacaattgggatcgccctgcttagccagtccaccattcccgagaccatcctggaactcacagatgctctggccctgggaatgatggtccttaaaatcgtgcgggacatggagaagtaccaactggcggttacgattatggctatctcttgcgtgcctaacgccgtcattctccagaatgcctggaaggtgagctgtaccatcctggctgccgtgtccgtcagccccctcctgcttacatcttcccagcagaaagctgactggattcctctggccctcaccatcaagggcctgaaccccacagcgatcttcctgaccacgcttagccgcacatctaaaaagagatcctggccgctgaatgaagccattatggctgttgggatggtgagcatcctcgcctcttccctgctcaaaaacgatattcctatgaccggacccctggtggctggcggccttctgaccgtctgctatgtgctgacagggcggagcgccgacctcgagctggaacgcgccgctgatgttaagtgggaggaccaagcggagatctccggaagctctcctattcttagcatcaccatttccgaagatggctctatgagcatcaaaaatgaggaagaggagcagacactgacgatcctcattagaaccgggctgctcgtgatctccggagtctttcccgtgtctattccgatcacagccgctgcctggtacctgtgggaagttaagaagcagcgggccggcgtgctttgggacgtcccttctccccctcccgtggagaaagctgaactggaggatggggcctatcgcattaagcagagaggaatcctgggctactcccaaatcggcgcgggggtctataaagaaggaaccttccacacaatgtggcatgtgacccggggcgctgttctcatgcaccgcgggaagagaattgagccctcctgggccgacgtgaaaaaggatctgatcagctacggaggcgggtggaaacttgagggagaatggaaagagggcgaagaggtccaggtgctggccctcgaacctggcaagaacccgcgggctgttcagacgaaacccgggatttttaagaccaatacaggaaccatcggcgccgtgtccctggacttcagccctgggacatctggatcccccattgtcgatagaaaaggcaaggtggtggggctctacggaaacggcgttgtcacccgcagcggcgcgtatgtgtctgctatcgcccagacagagaagtccatcgaggacaatcctgaaattgaggatgacatctttcggaaaaagagactgacgattatggaccttcatcccggggccggaaaaaccaagcgctacctgcctgctatcgtgcgggaagccattaaaagaggcctgcgcacactcatcctggctccgacccgggtcgtggccgcggagatggaagaggcccttagagggctgcccattcgctatcaaacccctgctatcaagacagagcacacgggacgggaaatcgttgatctcatgtgtcatgccaccttcacaatgagactgctcagccccgtgcgggtccctaactacaacctgattatcatggacgaggctcacttcaccgatcccgcctccattgccgctcgcggctatatctctacaagagtggaaatgggggaggcggccggcatttttatgaccgctacgccgcctggaagccgggaccccttcccccagtccaatgcccctatcatggatgaggaacgcgagatccccgaaagaagctggaactctggccacgagtgggttacagactttaaggggaaaaccgtgtggttcgtcccttccattaaggccggaaatgatatcgctgcctgccttcggaaaaacggcaagaaagtgattcagctgagcagaaagacctttgactctgaatacgttaagacacgcgcgaatgattgggacttcgtggtcaccacagatatcagcgagatgggggctaactttaaagccgagcgggtgattgacccgagacgctgtatgaagcccgtgatcctgaccgacggagaagaacgggtcatcctcgccggccctatgcccgttacgcattcctctgctgcccaaagacgcgggcggattggcagaaatcctaaaaacgaaaatgatcagtatatctacatgggagagcccctggaaaacgacgaggattgcgcgcactggaaggaggccaaaatgcttctggacaatattaacacaccggaaggcatcattcctagcatgttcgagcccgaacgcgagaaggtggatgctatcgacggggaatacagactccggggagaggcccgcaaaacctttgtggatctgatgagacggggcgacctgcctgtctggctcgcttataaggtggccgctgaggggattaattacgccgatcgcaagtggtgtttcgacggaatcaaaaacaatcagatccttgaagagaacatggaagttgagatttggacaaaggagggcgaacgcaagaagctgaaaccccggtggctggatgcgagaatctattccgaccctctcgccctgaaggagtttaaggagttcgctgccgggcgcaaatctcttaccctgaacctcattacggagatgggccggctgcccaccttcatgacacagaaggctagaaatgccctggataacctcgccgtgcttcataccgctgaagcgggaggccgcgcctacaatcacgctctgagcgagctgccggagacactcgaaaccctgcttctgctcacactgctggccaccgtcacagggggaatctttctcttccttatgtccggcaaagggattggaaagatgacactgggcatgtgctgcatcatcaccgccagcattctgctctggtatgctcaaatccagcctcactggattgccgcgtctatcattctggagtttttccttatcgtgctgctcatccccgaacccgagaaacagcggacccctcaggacaaccaactgacatacgttgtgattgccatcctgaccgtcgtggctgccacaatggctaatgaaatgggctttctcgagaagacgaagaaagaccttgggctgggatccattaccacacaggagagcgaatccaacatcctggatattgacctcagaccggcctctgcgtggaccctgtatgccgtcgctacaaccttcgtgacgcccatgcttcggcatagcatcgaaaatagctctgttaacgtgagcctgaccgccattgctaatcaggccacagtgctcatgggcctggggaagggatggcctctgtccaaaatggatatcggcgtccccctccttgctatcgggtgttacagccaggttaaccctattaccctgacagccgcgctgctcctgcttgtggcccactacgctatcattggacccggcctgcaagccaaggctacccgcgaagcccagaaaagagccgcggctggcatcatgaagaatcctacggtggacgggattacagtcatcgatctcgagccgatcccctatgaccctaagtttgaaaaacagctgggacaggtgatgctgctcattctttgcgttacccaagtgctgatgatgcggacaacctgggccctgtgtgaggctctcaccctggccacaggccccatctctacgctttgggaggggaaccctggacgcttctggaataccacaattgccgtctccatggctaacatctttagaggcagctacctggccggggcgggactcctgttctctattatgaagaataccacatccacccggcgcggcacgggcaacatcggggaaacactgggagagaaatggaaaagcagactcaatgcccttggcaaatctgaatttcagatctataagaaaagcgggattcaggaggtggatcggaccctggctaaggagggaatcaagcgcggcgaaaccgaccatcacgccgtctccagagggtctgctaaactgcggtggttcgtggagagaaacatggttacacccgaaggaaaggtggtcgatctcggctgcggccgcgggggatggagctactattgtggcgggctgaaaaacgtgcgggaggttaagggacttaccaaaggcgggccgggacatgaggagcctattcccatgtccacatacggctggaatctggtgagactccaaagcggcgtcgacgtgtttttcacgccccctgagaagtgcgataccctgctgtgtgacatcggggaatcctctcccaaccctacaattgaggccggacgcaccctccgggtgcttaatctggttgaaaactggctgaataacaatacacagttctgcatcaaggtcctcaacccgtatatgcccagcgtgatcgagaaaatggaagcgctgcagagaaagtacggcggggcccttgtgcgcaatcctctgtcccggaactctacccacgagatgtactgggtcagcaatgctacgggaaacattgtttcctctgtgaatatgatcagcagaatgctcattaaccgctttaccatgaaacacaagaaaacaacctatgagcccgatgtggacctgggctccgggacacggaatatcggaattgaaagcgagatccctaacctggacattatcggcaagagaatcgaaaagattaaacaggagcatgaaacctcttggcactacgatcaagaccatccctataagacatgggcctaccacggctcctatgagaccaaacagacggggagcgcttcttccatggtcaacggagtggttcgcctccttacaaagccgtgggatgtggtccctatggtgacccagatggccatgaccgacacaacgcccttcggccagcaacgggtttttaaagagaaggtggataccagaacacaggaacctaaggaggggaccaaaaagctgatgaaaatcacagctgaatggctgtggaaggagctcggcaagaagaaaacccccagaatgtgtacaagagaggagttcacccggaaggtccgcagcaatgccgcgctgggcgccatttttacggacgagaacaagtggaaatctgctagagaagccgtggaggatgggcggttctgggaacttgtggacagagagcggaatctgcacctcgagggaaagtgcgaaacctgtgtctacaacatgatgggcaaacgcgagaagaaactgggcgaatttgggaaggctaagggatccagagccatctggtatatgtggctgggcgcccggttcctcgagtttgaagcgctggggttccttaatgaggatcattggtttagccgcggaaactccctgagcggcgttgagggggaaggcctccacagactgggatacattcttcgggacgtgtctaaaaaggagggcggggctatgtacgccgatgacacagccggatgggacacccgcatcacactggaagatctcaaaaatgaggaaatggtgaccaaccatatgaagggcgagcacaaaaagctggctgaggccatcttcaagctgacgtatcagaataaagtcgtgagagttcagcggcctacaccccgcgggaccgtgatggacattatcagcagacgggatcaacgcggatccggccaggtcgggacatacggcctcaacacctttacgaatatggaagctcagctgattagacaaatggagggagaaggcatcttcaagtctattcagcatcttaccgccacagaggagatcgtggttcagaactggctggcgcgggtggggcgcgaaagactcagccggatggccatctccggagacgattgcgtcgtgaaaccgattgacgatagattcgcttctgccctgaccgctcttaatgacatgggcaaggttcgcaaagatatccagcaatgggagcctagccgggggtggaacgactggacacaggtgcccttttgctcccaccacttccatgaactggtcatgaaggatggaagagtgctcgtcgtgccctgtcgcaatcaggacgagctgattggccgggccagaatctctcagggggcgggctggagcctgaaggaaaccgcctgcctcggaaaatcctatgctcaaatgtggacactgatgtactttcaccgccgggatcttagactggccgctaacgccatttgtagcgctgttccttctcattgggtgccgacctcccgcacgacatggagcatccacgccaagcacgagtggatgaccaccgaggacatgctcgcggtctggaaccgggtgtggattcaggaaaatccctggatggaggacaaaacacctgtggaatcttgggaggaagttccctatctgggcaagagagaggatcagtggtgcgggtcccttatcggactgaccagccgcgccacatgggctaaaaacatccagacggccattaatcaagtgcggtccctcatcggcaacgaggaatacaccgactatatgccttctatgaagagattccggagagaggaagaggaagccggggtcctgtggtga

SEQ ID NO: 19829 - RNA, 9876 nt, synthetic construct
  misc_feature 1..9876: note = derived and/or modified CDS sequence (opt5) from DENV-2__EU482599__SS-prME
  source 1..9876: mol_type = other RNA
accgccggcgtgatcgtcatgctgattcccacagctatggccttccacctcacgaccagaaatggggaacctcatatgatcgttggacggcaggaaaagggcaagagcctgctttttaagaccgaggacggggtgaatatgtgcaccctgatggcgattgatctcggagaactgtgtgaggacacaatcacctacaagtgcccccttctgcgccaaaatgaacccgaggatattgactgttggtgcaatagcacatctacctgggtgacgtatggcacctgtacaaccacaggggagcacagacgggaaaagcgcagcgtcgctctcgtgcctcatgttggaatgggcctggagaccagaacggaaacatggatgtcctctgagggcgcctggaaacacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaggaacaggacaaacgctttatctgcaagcattccatggtggatagaggctggggcaacgggtgtggactgttcggcaaaggcgggattgtcacatgcgccatgtttacgtgcaaaaagaatatggaagggaaagttgtgcagcctgagaacctcgaatacaccatcgtgattacaccccacagcggggaggagcatgcggtcggaaatgacaccggcaagcacggcaaagaaatcaagatcacacctcagtcttccattaccgaggccgaactgacggggtatggaaccgtgacaatggagtgtagcccccggaccggccttgatttcaacgaaatggttctgctccaaatggaggacaaggcttggctggtgcaccgccagtggtttcttgatctgccgctcccttggctgcccggggccgacacacagggatctaattggatccagaaggagaccctggtcacgttcaagaaccctcatgctaaaaagcaagacgtggttgtgctcggctcccaggaaggggccatgcacacagccctgaccggcgctacagagattcagatgagctccggaaatcttctgtttaccggccatctcaaatgcagactgcggatggataaacttcaactgaaagggatgtcttacagcatgtgtaccggaaagttcaagatcgtcaaagaaattgcggagacacagcacggcacgatcgtgatcagagtccagtatgagggggacggatccccctgcaagattcccttcgaaatcaccgatctcgagaaacgccatgtgctgggccggctgattacagttaaccctatcgtgaccgaaaaggacagcccggtcaacattgaggccgaacccccttttggggattcttacatcattatcggcgtggagcccggacagctcaaactgaattggttcaagaagggctccagcatcgggcaaatgtttgagacaaccatgagaggagctaaacgcatggccattcttggcgacacggcctgggatttcgggtctctgggaggcgtttttacaagcatcgggaaggctctccaccaggtgttcggcgccatttacggagcggctttttccggcgtctcttggaccatgaaaatcctgattggggtgatcatcacctggattggaatgaacagccggtccacaagcctgtctgtgtcccttgttctcgtcggcgtggtgaccctgtatctgggggccatggtccaggccgacagcggatgtgtggtttcttggaagaataaagaactcaagtgcggctccgggatcttcattacagataacgtgcacacgtggaccgagcagtacaagtttcaacctgaaagcccctccaaactggcttctgccatccagaaggctcatgaggaaggcatttgtggaatcagaagcgtcacacgccttgagaatctgatgtggaaacagatcaccccggagctcaaccacattctgtccgaaaatgaggtgaagctgacaatcatgaccggcgacattcgggggatcatgcaggccggaaaaagatctcttcgccctcaacccacggaactcaagtatagctggaaaacctggggcaaggcgaagatgctgtccacagagagccataaccagaccttcctgattgatgggcctgaaacagccgagtgccccaataccaaccgggcttggaactctctcgaggttgaagactacggatttggcgtgttcacaaccaacatctggctgaaacttagagagaagcaggacgtcttttgtgattccaaactgatgagcgccgctatcaaggacaatcgcgccgtgcacgcggatatgggctattggattgaatctgccctcaacgacacgtggaaaatggagaaggcttccttcatcgaggttaagagctgccactggcctaaatctcatacactgtggagcaatggggtgctggaatccgagatgattatccccaagaacttcgccggaccggtcagccagcacaactaccggcctggctatcatacccaaaccgctgggccctggcaccttggaaaactcgaaatggattttgacctgtgtgagggcacaaccgtggtggtcacggaagattgcgggaatagaggaccctctctgcggacaaccacagcctccggcaagctcattaccgagtggtgctgtcgcagctgcacactgcctccgcttagataccggggcgaggacgggtgttggtacggaatggaaatcagacccctgaaagagaaggaagagaacctcgttaattccctggtgaccgccggccatgggcagattgataacttctctctgggagtgcttggcatggctctctttctggaagagatgctgcgcacgcggatcgggaccaagcacgcgatcctcctggtcgccgtgagcttcgttacacttattaccggaaatatgtcctttagagacctgggccgcgtgatggtcatggtgggcgctacaatgaccgatgacatcgggatgggagttacgtatctcgccctgctggccgctttcaaagtgagacctacatttgccgcgggccttctgctccggaagctgacctctaaagagctcatgatggctacaattgggatcgccctgcttagccagtccaccattcccgaaaccatcctggagctcacagatgccctggctctgggaatgatggtccttaagatcgtgcgcaacatggaaaaataccaactggccgttacgattatggtgatctcttgcgtccctaatgcggtgattctccagaacgcttggaaggtgagctgtaccatcctggccgccgtctccgttagccccctcctgcttacatcttcccagcagaaggctgactggattcctctggccctcaccatcaaaggcctgaatcccacagctatcttcctgaccacgcttagcagaacatctaagaaacggtcctggccgctgaacgaggccattatggcggtggggatggtgagcatcctcgcctcttccctgctcaagaatgacattcctatgaccggacccctggtcgctggcggccttctgaccgtgtgctatgttctgacagggcgcagcgccgatctcgaactggagagagctgccgacgtgaaatgggaggatcaagccgaaatctccggaagctctcctattcttagcatcaccatttccgaggacggctctatgagcatcaagaacgaagaggaggaacagacactgacgatcctcattcggaccgggctgctcgtcatctccggagtgtttcccgtttctattccgatcacagctgcggcctggtacctgtgggaggtgaaaaagcagcgcgctggcgtcctttgggatgtgccttctccccctcccgtcgaaaaggccgagctggaagacggggcctatagaattaaacagcggggaatcctgggctactcccaaatcggcgctggggtgtataaggagggaaccttccacacaatgtggcatgttacccgcggcgccgtgctcatgcacagagggaaacggattgagccctcctgggcggatgtcaagaaagacctgatcagctacggaggcgggtggaaacttgaaggagagtggaaggaaggcgaggaagtgcaggttctggctctcgagcctggcaaaaatccgagagccgtgcagacgaagcccgggatttttaaaaccaacacaggaaccatcggcgccgtctccctggatttcagccctgggacatctggatcccccattgtggaccgcaagggcaaagtggttgggctctacggaaatggcgtcgtgacccggagcggcgcttatgtgtctgccatcgcgcagacagagaagtccatcgaagataaccctgagattgaagacgatatctttagaaagaaacgcctgacgattatggaccttcatcccggggctggaaagaccaaacggtacctgcctgccatcgtcagagaggccattaagcgcggcctgcggacactcatcctggctccgaccagagtggttgccgctgaaatggaggaggcccttcgcgggctgcccattcggtatcaaaccacagcgatcaaaacggaacacaccggaagagagatcgtggacctcatgtgtcatgccacattcaccatgcggctgctcagccctgtccgcgtgcccaactacaatctgattatcatggatgaagctcacttcacagaccctgcctccattgctgccagaggctatatctctacccgggttgagatgggggaggccgctggcatttttatgacggcgacacccccgggaagccgcgatcctttcccccagtccaacgcccccatcatggacgaagagagagaaatccctgagcggagctggaactctggccacgaatgggtgaccgattttaaggggaagaccgtctggttcgtgccctccattaaagctggaaacgacatcgccgcctgccttagaaagaatggcaaaaaggttattcagctgagccgcaaaacatttgattctgagtacgtgaagacccgggctaacgactgggatttcgtcgtgacaaccgacatcagcgagatgggggccaattttaaggcggaaagagtgattgatcctcgccggtgtatgaaaccggtcatcctgacggacggagaggaaagagttatcctcgctggccccatgcctgtgacacattcctctgccgcccaacgccgggggagaattggccgcaaccccaagaatgagaacgaccagtatatctacatgggagaacctctggagaatgatgaggactgcgctcactggaaagaagccaagatgcttctggataacattaatacccccgagggcatcattccgagcatgttcgaacctgagagagaaaaagtggacgcgatcgatggggagtaccggctccgcggagaggccagaaagacatttgtcgacctgatgcggcgcggcgatctgcccgtgtggctcgcttataaagttgccgctgaagggattaactacgccgacagaaagtggtgtttcgatggaatcaagaataaccagatccttgaggaaaacatggaggtggagatttggaccaaagaaggcgagcggaagaaactgaagcctagatggctggacgctcgcatctattccgatcccctcgccctgaaagaatttaaggagttcgcggccgggcggaagtctcttacgctgaatctcattaccgaaatgggcagactgcctacattcatgacccagaaagctcgcaacgccctggacaatctcgctgtccttcatacagccgaggccggaggccgggcttacaaccacgcgctgagcgagctgcccgaaaccctcgagacactgcttctgctcaccctgctggccacggtgacagggggaatctttctcttccttatgtccggcaaggggattggaaaaatgaccctgggcatgtgctgcatcatcaccgctagcattctgctctggtatgcccaaatccagccgcactggattgccgcttctatcattctggaatttttccttatcgttctgctcatccctgagcccgaaaagcagagaacaccccaggataatcaactgacctacgtggtcattgccatcctgacagtggtcgcggccacgatggctaacgagatgggctttctcgagaaaaccaagaaggaccttgggctgggatccattacaacccaggaaagcgagtccaatatcctggacattgatctccggcctgcctctgcttggacactgtatgccgtggcgaccacgttcgttaccccgatgcttcgccatagcatcgaaaactcctctgtgaatgtgagcctgacagccattgctaaccaggccaccgtcctcatgggcctggggaaaggatggcccctgtccaagatggacatcggcgttcctctccttgctatcgggtgttacagccaggtgaatcccattacactgaccgccgctctgctcctgcttgtggcccactacgcgatcattggacctggcctgcaagccaaagctacgagagaggcccagaagcgggctgccgccggcatcatgaaaaaccccacagtcgatgggattaccgtgatcgacctcgaacctatcccgtatgatcccaagtttgagaagcagctgggacaggttatgctgctcattctttgcgtgacacaagtcctgatgatgcgcaccacctgggcgctgtgtgaggctctcacactggccacgggccctatctctaccctttgggaagggaatcccggaagattctggaacacaaccattgctgtgtccatggccaatatctttcggggcagctacctggccggggctggactcctgttctctattatgaaaaacacaaccaatacgcgcagaggcacaggcaacatcggggagaccctgggagaaaagtggaaatcccggctcaacgcccttggcaagagcgagtttcagatctataaaaagtctgggattcaggaggtcgaccgcaccctggcgaaagaaggaatcaagagaggcgagacagatcatcacgccgtgagccgggggtccgctaagctgagatggttcgttgaacgcaatatggtgacccctgagggaaaagtcgtggacctcggctgcggcagagggggatggtcttactattgtggcgggctgaagaacgttcgggaagtgaaaggacttacaaagggcgggcccggacatgaggagccgattcctatgagcacgtacggctggaatctggtccgcctccaatccggcgtggatgtgtttttcacaccgcccgaaaaatgcgacacactgctgtgtgatatcggggagagctcccctaaccccaccattgaagccggacggacactcagagttcttaatctggtcgagaactggctgaataacaatacccagttctgcatcaaggtgctcaacccttatatgccgtctgtgatcgaaaagatggaggctctgcagcgcaaatacggcggggcccttgtccggaatcccctgagcagaaactccacgcacgagatgtactgggtttctaatgcgaccggaaacattgtgagctccgtgaatatgatctctcgcatgctcattaaccggtttacaatgaagcacaaaaaggccacctatgaacctgacgtcgatctgggcagcgggacaagaaacatcggaattgagtccgaaatccccaatctggacattatcggcaaacgcatcgagaagattaagcaggaacatgagaccagctggcactacgaccaagatcatccttataaaacatgggcttaccacggctcttatgagaccaagcagacggggtccgccagctctatggtgaacggagttgtgcggctccttacaaaaccctgggacgtcgtgccgatggttacccagatggctatgaccgatacaacgcctttcggccagcaaagagtgtttaaggaaaaagtcgacacccgcacacaggagcccaaggaagggaccaagaaactgatgaagatcacagccgagtggctgtggaaagagctcggaaagaaaaagacccctagaatgtgtacacgggaagagttcacccgcaaagtgagatccaatgctgccctgggcgcgatttttacggatgaaaacaagtggaaaagcgcccgggaggctgtggaagacgggagattctgggagcttgtcgatcgggagcgcaatctgcacctcgaaggaaaatgcgagacctgtgtttacaacatgatgggcaagagagagaagaagctgggcgagtttgggaaagccaagggatctcgggctatctggtatatgtggctgggcgcccgcttcctcgaatttgaggccctggggttccttaatgaggaccattggttttccagaggaaacagcctgtccggcgtggaaggggagggcctccaccggctgggatacattcttcgcgatgtgggcaagaaagaagggggagcgatgtacgctgacgatacagccggctgggacaccagaatcacactggaggacctcaagaatgaagagatggtcaccaaccatatgaaaggggagcacaagaaactggccgaagctatcttcaagctgacgtatcagaataaggtggttcgggtgcagcgccccacacctagaggaaccgtcatggatattatcagccggcgcgaccaaagaggctctggacaggtgggcacatacggactcaacacctttacgaatatggaggcccagctgattcggcaaatggaaggcgaggggatcttcaaaagcattcagcatcttaccgctacagaggaaatcgccgttcagaactggctggcgcgcgtgggaagagagcggctctccagaatggccatctctggcgatgactgcgtcgtgaagcccattgatgaccgcttcgctagcgccctgaccgctcttaatgatatggggaaagttcggaaggacatccagcaatgggaaccgtccagaggatggaacgattggacacaggtgcctttttgctctcaccacttccatgagctggtcatgaaagacggccgcgtgctcgtcgtgccctgtcggaaccaggatgaactgattgggagagcccgcatcagccagggcgcgggatggtccctgaaggagaccgcctgcctcggcaagtcttatgctcaaatgtggacactgatgtactttcaccggagagaccttcgcctggccgctaatgccatttgtagcgctgttccctcccattgggtgcctaccagccggacgacatggtctatccacgccaaacacgagtggatgaccaccgaagatatgctcgcggtctggaacagagtgtggattcaggagaatccgtggatggaagacaagacacccgtggagtcctgggaagaggttccttatctggggaaacgcgaggaccagtggtgcggaagccttatcggcctgacctctcgggccacatgggctaagaacatccagacggccattaatcaagtgagatccctcatcgggaacgaagagtacaccgattatatgcccagcatgaaacggttcagacgcgaagaggaagaggccggagtcctgtggtga

SEQ ID NO: 19830 - RNA, 9876 nt, synthetic construct
  misc_feature 1..9876: note = derived and/or modified CDS sequence (opt5) from DENV-2__FJ898436__SS-prME
  source 1..9876: mol_type = other RNA
accgccggcgtgatcgtcatgctgattcccacagctatggccttccacctcacgaccagaaatggggagcctcatatgatcgttggacggcaggaaaagggcaagagcctgctttttaagaccgaggacggggtgaatatgtgcaccctgatggcgattgatctcggagaactgtgtgaggacacaatcacctacaagtgcccccttctgcgccaaaatgaacccgaggatattgactgttggtgcaatagcacatctacctgggtgacgtatggcacctgtacaaccacaggggagcacagacgggaaaagcgcagcgtcgctctcgtgcctcatgttggaatgggcctggagaccagaacggaaacatggatgtcctctgagggcgcctggaagcacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaggaacaggacaaacgctttatctgcaagcattccatggtggatagaggctggggcaacgggtgtggactgttcggcaaagggggaattgtcacatgcgccatgtttacgtgcaaaaagaatatggaaggcaaagttgtgcagcctgagaacctcgaatacaccatcgtgattacaccccacagcggggaggagcatgcggtcggaaatgacaccggcaagcacggcaaagaaatcaagatcacacctcagtcttccattaccgaggccgaactgacggggtatggaaccgtgacaatggagtgtagcccccggaccggccttgatttcaacgaaatggttctgctccaaatggaggacaaggcttggctggtgcaccgccagtggtttcttgatctgccgctcccttggctgcccggggccgacacacagggatctaattggatccagaaggagaccctggtcacgttcaagaaccctcatgctaaaaagcaagacgtggttgtgctcggctcccaggaaggggccatgcacacagccctgaccggcgctacagagattcagatgagctccggaaatcttctgtttaccggccatctcaaatgcagactgcggatggataaacttcaactgaaagggatgtcttacagcatgtgtaccggaaagttcaagatcgtcaaagaaattgcggagacacagcacggcacgatcgtgatcagagtccagtatgagggggacggatccccctgcaagattcccttcgaaatcaccgatctcgagaaacgccatgtgctgggccggctgattacagttaaccctatcgtgaccgaaaaggacagcccggtcaacattgaggccgaacccccttttggggattcttacatcattatcggcgtggagcccggacagctcaaactgaattggttcaagaagggctccagcatcgggcaaatgtttgagacaaccatgagaggagctaaacgcatggccattcttggcgacacggcctgggatttcgggtctctgggaggcgtttttacaagcatcgggaaggctctccaccaggtgttcggcgccatttacggagcggctttttccggcgtctcttggaccatgaaaatcctgattggggtgatcatcacctggattggaatgaacagccggtccacaagcctgtctgtgtcccttgttctcgtcggcgtggtgaccctgtatctgggggccatggtccaggccgacagcggatgtgtggtttcttggaagaataaagaactcaagtgcggctccgggatcttcattacagataacgtgcacacgtggaccgagcagtacaagtttcaacctgaaagcccctccaaactggcttctgccatccagaaggctcatgaggaaggcatttgtggaatcagaagcgtcacacgccttgagaatctgatgtggaaacagatcaccccggagctcaaccacattctgtccgaaaatgaggtgaagctgacaatcatgaccggcgacattcgggggatcatgcaggccggaaaaagatctcttcgccctcaacccacggaactcaagtatagctggaaaacctggggcaaggcgaagatgctgtccacagagagccataaccagaccttcctgattgatgggcctgaaacagccgagtgccccaataccaaccgggcttggaactctctcgaggttgaagactacggatttggcgtgttcacaaccaacatctggctgaaacttagagagaagcaggacgtcttttgtgattccaaactgatgagcgccgctatcaaggacaatcgcgccgtgcacgcggatatgggctattggattgaatctgccctcaacgacacgtggaaaatggagaaggcttccttcatcgaggttaagagctgccactggcctaaatctcatacactgtggagcaatggggtgctggaatccgagatgattatccccaagaacttcgccggaccggtcagccagcacaactaccggcctggctatcatacccaaaccgctgggccctggcaccttggaaaactcgaaatggattttgacctgtgtgagggcacaaccgtggtggtcacggaagattgcgggaatagaggaccctctctgcggacaaccacagcctccggcaagctcattaccgagtggtgctgtcgcagctgcacactgcctccgcttagataccggggcgaggacgggtgttggtacggaatggaaatcagacccctgaaagagaaggaagagaacctcgttaattccctggtgaccgccggccatgggcagattgataacttctctctgggagtgcttggcatggctctctttctggaagagatgctgcgcacgcggatcgggaccaagcacgcgatcctcctggtcgccgtgagcttcgttacacttattaccggaaatatgtcctttagagacctgggccgcgtgatggtcatggtgggcgctacaatgaccgatgacatcgggatgggagttacgtatctcgccctgctggccgctttcaaagtgagacctacatttgccgcgggccttctgctccggaagctgacctctaaagagctcatgatggctacaattgggatcgccctgcttagccagtccaccattcccgaaaccatcctggagctcacagatgccctggctctgggaatgatggtccttaagatcgtgcgcaacatggaaaaataccaactggccgttacgattatggcgatctcttgcgtgcctaatgctgtcattctccagaacgcctggaaggtgagctgtaccatcctggccgctgtgtccgtcagccccctcctgcttacatcttcccagcagaaggccgactggattcctctggctctcaccatcaaaggcctgaatcccacagccatcttcctgaccacgcttagcagaacatctaagaaacggtcctggccgctgaacgaggcgattatggccgttgggatggtgagcatcctcgcttcttccctgctcaagaatgacattcctatgaccggacccctggtggccggcggccttctgaccgtctgctatgtgctgacagggcgcagcgctgatctcgaactggagagagccgccgacgttaaatgggaggatcaagctgaaatctccggaagctctcctattcttagcatcaccatttccgaggacggctctatgagcatcaagaacgaagaggaggaacagacactgacgatcctcattcggaccgggctgctcgtgatctccggagtctttcccgtgtctattccgatcacagcggccgcttggtacctgtgggaggttaaaaagcagcgcgccggcgtgctttgggatgtcccttctccccctcccgtggaaaaggccgagctggaagacggggcttatagaattaaacagcggggaatcctgggctactcccaaatcggcgccggggtctataaggagggaaccttccacacaatgtggcatgtgacccgcggcgcggttctcatgcacagagggaaacggattgagccctcctgggctgatgtgaagaaagacctgatcagctacggaggcgggtggaaacttgaaggagagtggaaggaaggcgaggaagtccaggtgctggccctcgagcctggcaaaaatccgagagccgttcagacgaagcccgggatttttaaaaccaacacaggaaccatcggcgctgtgtccctggatttcagccctgggacatctggatcccccattgtcgaccgcaagggcaaagtggtggggctctacggaaatggcgttgtcacccggagcggcgcctatgtgtctgcgatcgctcagacagagaagtccatcgaagataaccctgagattgaagacgatatctttagaaagaaacgcctgacgattatggaccttcatcccggggccggaaagaccaaacggtacctgcctgccatcgtgagagaggctattaagcgcggcctgcggacactcatcctggccccgaccagagtcgtggctgccgaaatggaggaggcgcttcgcgggctgcccattcggtatcaaaccacagccatcaaaacggaacacaccggaagagagatcgttgacctcatgtgtcatgctacattcaccatgcggctgctcagccctgtgcgcgtccccaactacaatctgattatcatggatgaagcccacttcacagaccctgcttccattgccgccagaggctatatctctacccgggtggagatgggggaggctgcgggcatttttatgacggccacacccccgggaagccgcgatcctttcccccagtccaacgctcccatcatggacgaagagagagaaatccctgagcggagctggaactctggccacgaatgggttaccgattttaaggggaagaccgtgtggttcgtcccctccattaaagccggaaacgacatcgccgcttgccttagaaagaatggcaaaaaggtgattcagctgagccgcaaaacatttgattctgagtacgttaagacccgggccaacgactgggatttcgtggtcacaaccgacatcagcgagatgggggcgaattttaaggctgaaagagtgattgatcctcgccggtgtatgaaaccggtgatcctgacggacggagaggaaagagtcatcctcgccggccccatgcctgttacacattcctctgccgctcaacgccgggggagaattggccgcaaccccaagaatgagaacgaccagtatatctacatgggagaacctctggagaatgatgaggactgcgcccactggaaagaagcgaagatgcttctggataacattaatacccccgagggcatcattccgagcatgttcgaacctgagagagaaaaagtggacgccatcgatggggagtaccggctccgcggagaggctagaaagacatttgtggacctgatgcggcgcggcgatctgcccgtctggctcgcctataaagtggctgccgaagggattaactacgctgacagaaagtggtgtttcgatggaatcaagaataaccagatccttgaggaaaacatggaggttgagatttggaccaaagaaggcgagcggaagaaactgaagcctagatggctggacgcccgcatctattccgatcccctcgcgctgaaagaatttaaggagttcgccgctgggcggaagtctcttacgctgaatctcattaccgaaatgggcagactgcctacattcatgacccagaaagcccgcaacgctctggacaatctcgccgtgcttcatacagccgaggctggaggccgggcgtacaaccacgccctgagcgagctgcccgaaaccctcgagacactgcttctgctcaccctgctggctacggtcacagggggaatctttctcttccttatgtccggcaaggggattggaaaaatgaccctgggcatgtgctgcatcatcaccgccagcattctgctctggtatgcccaaatccagccgcactggattgctgcctctatcattctggaatttttccttatcgtgctgctcatccctgagcccgaaaagcagagaacaccccaggataatcaactgacctacgttgtgattgcgatcctgacagtcgtggccgctacgatggccaacgagatgggctttctcgagaaaaccaagaaggaccttgggctgggatccattacaacccaggaaagcgagtccaatatcctggacattgatctccggcctgcttctgcctggacactgtatgcggtcgccaccacgttcgtgaccccgatgcttcgccatagcatcgaaaactcctctgttaatgtgagcctgacagctattgccaaccaggctaccgtgctcatgggcctggggaaaggatggcccctgtccaagatggacatcggcgtccctctccttgccatcgggtgttacagccaggttaatcccattacactgaccgctgccctgctcctgcttgtggcgcactacgccatcattggacctggcctgcaagctaaagccacgagagaggctcagaagcgggccgccgcgggcatcatgaaaaaccccacagtggatgggattaccgtcatcgacctcgaacctatcccgtatgatcccaagtttgagaagcagctgggacaggtgatgctgctcattctttgcgttacacaagtgctgatgatgcgcaccacctgggctctgtgtgaggccctcacactggctacgggccctatctctaccctttgggaagggaatcccggaagattctggaacacaaccattgccgtctccatggccaatatctttcggggcagctacctggctggggccggactcctgttctctattatgaaaaacacaaccaatacgcgcagaggcacaggcaacatcggggagaccctgggagaaaagtggaaatcccggctcaacgcgcttggcaagagcgagtttcagatctataaaaagtctgggattcaggaggtggaccgcaccctggccaaagaaggaatcaagagaggcgagacagatcatcacgctgtcagccgggggtccgccaagctgagatggttcgtggaacgcaatatggttacccctgagggaaaagtggtcgacctcggctgcggcagagggggatggtcttactattgtggcgggctgaagaacgtgcgggaagttaaaggacttacaaagggcgggcccggacatgaggagccgattcctatgagcacgtacggctggaatctggtgcgcctccaatccggcgtcgatgtgtttttcacaccgcccgaaaaatgcgacacactgctgtgtgatatcggggagagctcccctaaccccaccattgaagctggacggacactcagagtgcttaatctggttgagaactggctgaataacaatacccagttctgcatcaaggtcctcaacccttatatgccgtctgtgatcgaaaagatggaggccctgcagcgcaaatacggcggggcgcttgtgcggaatcccctgagcagaaactccacgcacgagatgtactgggtctctaatgccaccggaaacattgttagctccgtgaatatgatctctcgcatgctcattaaccggtttacaatgaagcacaaaaaggctacctatgaacctgacgtggatctgggcagcgggacaagaaacatcggaattgagtccgaaatccccaatctggacattatcggcaaacgcatcgagaagattaagcaggaacatgagaccagctggcactacgaccaagatcatccttataaaacatgggcctaccacggctcttatgagaccaagcagacggggtccgctagctctatggtcaacggagtggttcggctccttacaaaaccctgggacgtggtcccgatggtgacccagatggccatgaccgatacaacgcctttcggccagcaaagagtttttaaggaaaaagtggacacccgcacacaggagcccaaggaagggaccaagaaactgatgaagatcacagctgcctggctgtggaaagagctcggaaagaaaaagacccctagaatgtgtacacgggaggagttcacccgcaaagtcagatccaatgcggccctgggcgctatttttacggatgagaacaagtggaaaagcgcccgggaagctgtggaggacgggagattctgggaacttgtggatcgggagcgcaatctgcacctcgagggaaaatgcgaaacctgtgtctacaacatgatgggcaagagagagaaaaagctgggcgaatttgggaaagccaagggatctcgggccatctggtatatgtggctgggcgcgcgcttcctcgagtttgaagctctggggttccttaatgaggaccattggttttccagaggaaacagcctgtccggcgttgagggggaaggcctccaccggctgggatacattcttcgcgatgtgggcaagaaagaagggggagccatgtacgccgacgatacagctggctgggacaccagaatcacactggaagacctcaagaatgaggaaatggtgaccaaccatatgaaaggggagcacaagaaactggccgaggctatcttcaagctgacgtatcagaataaggtcgtgcgggttcagcgccccacacctagaggaaccgtgatggatattatcagccggcgcgaccaaagaggctctgggcaggtcggcacatacggactcaacacctttacgaatatggaagcccagctgattcggcaaatggagggcgaagggatcttcaaaagcattcagcatcttaccgcgacagaggagatcgccgtgcagaactggctggctcgcgttggaagagaacggctctccagaatggccatctctggcgatgactgcgtggtcaagcccattgatgaccgcttcgctagcgccctgaccgcgcttaatgatatggggaaagtgcggaaggacatccagcaatgggagccgtccagaggatggaacgattggacacaggttcctttttgctctcaccacttccatgaactggtgatgaaagacggccgcgtcctcgtggtcccctgtcggaaccaggatgagctgattgggagagcccgcatcagccagggcgctggatggtccctgaaggaaaccgcctgcctcggcaagtcttatgctcaaatgtggacactgatgtactttcaccggagagaccttcgcctggccgctaatgccatttgtagcgcggtgccctcccattgggttcctaccagccggacgacatggtctatccacgccaaacacgagtggatgaccaccgaggatatgctcgctgtgtggaacagagtctggattcaggaaaatccgtggatggaggacaagacacccgtggaatcctgggaggaagtgccttatctggggaaacgcgaggaccagtggtgcggaagccttatcggcctgacctctcgggccacatgggccaagaacatccagacggctattaatcaagttagatccctcatcgggaacgaggaatacaccgattatatgcccagcatgaaacggttcagacgcgaggaagaggaagccggagtgctgtggtga

SEQ ID NO: 19831 - RNA, 9876 nt, synthetic construct
  misc_feature 1..9876: note = derived and/or modified CDS sequence (opt5) from DENV-2__EU482634__SS-prME
  source 1..9876: mol_type = other RNA
accgccggcgtgatcgtcatgctgattcccacggctatggccttccacctcacgaccagaaacggggagcctcatatgatcgttggacggcaggaaaagggcaagagcctgctttttaagacagaggacggggtgaatatgtgcaccctgatggcgattgatctcggagaactgtgtgaggacacaatcacctacaaatgcccgcttctgcgccaaaacgaacccgaggatattgactgttggtgcaattccacatctacctgggtgacgtatggcacctgtacaaccacaggggagcacagacgggaaaagcgctccgtcgctctcgtgcctcatgttggaatgggcctggagaccagaacggaaacatggatgtcctctgagggcgcctggaaacacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaggaacaggacaaacgctttatctgcaagcattccatggtggatagaggctggggcaacgggtgtggactgttcggcaaagggggaattgtcacatgcgccatgtttacgtgcaaaaagaatatggaaggcaaagttgtgcagcctgagaacctcgaatacaccatcgtgattacaccccacagcggggaggagcatgcggtcggaaatgacaccggcaagcacggcaaagaaatcaagatcacacctcagtcttccattaccgaggccgaactgacggggtatggaaccgtgacaatggagtgtagcccccggaccggccttgatttcaacgaaatggttctgctccaaatggaggacaaggcttggctggtgcaccgccagtggtttcttgatctgccgctcccttggctgcccggggccgacacacagggatctaattggatccagaaggagaccctggtcacgttcaagaaccctcatgctaaaaagcaagacgtggttgtgctcggctcccaggaaggggccatgcacacagccctgaccggcgctacagagattcagatgagctccggaaatcttctgtttaccggccatctcaaatgcagactgcggatggataaacttcaactgaaagggatgtcttacagcatgtgtaccggaaagttcaagatcgtcaaagaaattgcggagacacagcacggcacgatcgtgatcagagtccagtatgagggggacggatccccctgcaagattcccttcgaaatcaccgatctcgagaaacgccatgtgctgggccggctgattacagttaaccctatcgtgaccgaaaaggacagcccggtcaacattgaggccgaacccccttttggggattcttacatcattatcggcgtggagcccggacagctcaaactgaattggttcaagaagggctccagcatcgggcaaatgtttgagacaaccatgagaggagctaaacgcatggccattcttggcgacacggcctgggatttcgggtctctgggaggcgtttttacaagcatcgggaaggctctccaccaggtgttcggcgccatttacggagcggctttttccggcgtctcttggaccatgaaaatcctgattggggtgatcatcacctggattggaatgaacagccggtccacaagcctgtctgtgtcccttgttctcgtcggcgtggtgaccctgtatctgggggccatggtccaggccgacagcggatgtgtggtttcttggaagaataaagaactcaagtgcggctccgggatcttcattacagataacgtgcacacgtggaccgagcagtacaagtttcaacctgaaagcccctccaaactggcttctgccatccagaaggctcatgaggaaggcatttgtggaatcagaagcgtcacacgccttgagaatctgatgtggaaacagatcaccccggagctcaaccacattctggccgaaaatgaggtgaagctgacaatcatgaccggcgacattaaagggatcatgcaggcgggaaagcggtcccttagacctcaacccacggaactcaaatattcttggaagacctggggcaaggccaaaatgctgagcacagagtcccataaccagaccttcctgattgatgggcctgaaacagctgagtgccccaataccaaccgcgcctggaatagcctcgaggttgaagactacggatttggcgtgttcacaaccaacatctggctgaaacttcgggagaaacaggacgtcttttgtgattctaagctgatgtccgctgccatcaaagacaatagagcggtgcacgccgatatgggctattggattgaaagcgctctcaacgacacgtggaagatggagaaggcctctttcatcgaggttaaatcctgccactggcctaagagccatacactgtggtctaatggggtgctggaaagcgagatgattatccccaaaaacttcgctggaccggtctcccagcacaactaccgccctggctatcatacccaaaccgccgggccctggcaccttggaaagctcgaaatggattttgacctgtgtgagggcacaaccgtggtggtcacggaagattgcgggaatcggggacccagcctgagaacaaccacagcctctggcaaactcattaccgagtggtgctgtcggtcctgcacactgcctccgcttcgctacagaggcgaggacgggtgttggtacggaatggaaatccggcccctgaaggagaaggaagagaacctcgttaatagcctggtgaccgctggccatgggcagattgataacttctccctgggagtgcttggcatggcgctctttctggaagagatgctgagaacgcgcatcgggaccaaacacgccatcctcctggtcgctgtgtctttcgttacacttattaccggaaatatgagctttcgggacctgggcagagtgatggtcatggtgggcgccacaatgaccgatgacatcgggatgggagttacgtatctcgccctgctggctgccttcaaggtgcgccctacatttgcggctggccttctgctcagaaaactgacctccaaggagctcatgatggccacaattgggatcgccctgctttctcagagcaccattcccgaaaccatcctggagctcacagatgctctggccctgggaatgatggtccttaaaatcgtgcggaacatggaaaagtaccaactggcggttacgattatggctatctcctgcgtgcctaatgccgtcattctccagaacgcctggaaggtgtcttgtaccatcctggctgccgtgagcgtcagccccctcctgcttacaagctctcagcagaaagctgactggattcctctggccctcaccatcaagggcctgaatcccacagcgatcttcctgaccacgctttcccgcacaaacaaaaagagaagctggccgctgaatgaggccattatggctgttgggatggtgtctatcctcgcctccagcctgctcaaaaacgacattcctatgaccggacccctggtggctggcggccttctgaccgtctgctatgtgctgacagggcggtctgccgatctcgaactggagcgcgccgctgacgttaagtgggaggatcaagcggaaatctccggaagctcccctattcttagcatcaccatttctgaggacggcagcatgtccatcaaaaatgaagaggaggaacagacactgacgatcctcattagaaccgggctgctcgtgatctctggagtctttcccgtgagcattccgatcacagccgctgcctggtacctgtgggaggttaagaagcagcgggccggcgtgctttgggatgtcccttctccccctcccgtggaaaaagctgagctggaagacggggcctatcgcattaagcagagaggaatcctgggctacagccaaatcggcgcgggggtctataaagagggaaccttccacacaatgtggcatgtgacccggggcgctgttctcatgcaccgcgggaagagaattgagcccagctgggccgatgtgaaaaaggacctgatctcctacggaggcgggtggaaacttgaaggagagtggaaagaaggcgaggaagtccaggtgctggccctcgagcctggcaagaacccgcgggctgttcagacgaaacccgggatttttaagaccaatacaggaaccatcggcgccgtgtctctggatttcagccctgggacatccggaagccccattgtcgacagaaaaggcaaggtggtggggctctacggaaacggcgttgtcacccgctctggcgcgtatgtgtccgctatcgcccagacagaaaagtccatcgaagataaccctgagattgaagacgatatctttcggaaaaagagactgacgattatggaccttcatcccggggccggaaaaaccaagcgctacctgcctgctatcgtgcgggaggccattaaaagaggcctgcgcacactcatcctggctccgacccgggtcgtggccgcggaaatggaggaggcccttagagggctgcccattcgctatcaaacccctgctatcaagacagaacacacgggacgggagatcgttgacctcatgtgtcatgccaccttcacaatgagactgctctctcccgtgcgggtccctaattacaacctgattatcatggatgaagctcacttcaccgaccccgcctccattgccgctcgcggctatatcagcacaagagtggagatgggggaggcggccggcatttttatgaccgctacgccgcctggatcccgggatcccttcccccagtctaatgcccctatcatggacgaagagagagaaatccccgagagaagctggaactccggccacgaatgggttacagattttaaggggaaaaccgtgtggttcgtccctagcattaaggccggaaatgacatcgctgcctgccttcggaaaaacggcaagaaagtgattcagctgtctagaaagacctttgattccgagtacgttaagacacgcgcgaatgactgggatttcgtggtcaccacagacatcagcgagatgggggctaactttaaagccgaacgggtgattgatccgagacgctgtatgaagcccgtgatcctgaccgacggagaggaacgggtcatcctcgccggccctatgcccgttacgcattctagcgctgcccaaagacgcgggcggattggcagaaatcctaaaaacgagaatgaccagtatatctacatgggagaacccctggagaacgatgaggactgcgcgcactggaaggaagccaaaatgcttctggataatattaacacaccggagggcatcattccttccatgttcgaacccgagcgcgaaaaggtggacgctatcgatggggagtacagactccggggagaggcccgcaaaacctttgtggacctgatgagacggggcgatctgcctgtctggctcgcttataaggtggccgctgaagggattaattacgccgaccgcaagtggtgtttcgatggaatcaaaaacaaccagatccttgaggaaaatatggaggttgagatttggacaaaggaaggcgagcgcaagaagctgaaaccccggtggctggacgcgagaatctattctgatcctctcgccctgaaggaatttaaggagttcgctgccgggcgcaaaagccttaccctgaacctcattacggaaatgggccggctgcccaccttcatgacacagaaggctagaaatgccctggacaacctcgccgtgcttcataccgctgaggcgggaggccgcgcctacaatcacgctctgtccgagctgccggaaacactcgagaccctgcttctgctcacactgctggccaccgtcacagggggaatctttctcttccttatgtctggcaaagggattggaaagatgacactgggcatgtgctgcatcatcaccgccagcattctgctctggtatgctcaaatccagcctcactggattgccgcgtccatcattctggaatttttccttatcgtgctgctcatccccgagcccgaaaaacagcggacccctcaggataaccaactgacatacgttgtgattgccatcctgaccgtcgtggctgccacaatggctaatgagatgggctttctcgagaagacgaagaaagaccttgggctgggaagcattaccacacaggaatctgagtccaacatcctggacattgatctcagaccggccagcgcgtggaccctgtatgccgtcgctacaaccttcgtgacgcccatgcttcggcattccatcgaaaattctagcgttaacgtgtccctgaccgccattgctaatcaggccacagtgctcatgggcctggggaagggatggcctctgtctaaaatggacatcggcgtccccctccttgctatcgggtgttacagccaggttaaccctattaccctgacagccgcgctgctcctgcttgtggcccactacgctatcattggacccggcctgcaagccaaggctacccgcgaggcccagaaaagagccgcggctggcatcatgaagaatcctacggtggatgggattacagtcatcgacctcgaaccgatcccctatgatcctaagtttgagaaacagctgggacaggtgatgctgctcattctttgcgttacccaagtgctgatgatgcggacaacctgggccctgtgtgaggctctcaccctggccacaggccccatctccacgctttgggaagggaaccctggacgcttctggaataccacaattgccgtcagcatggctaacatctttagaggctcttacctggccggggcgggactcctgttctccattatgaagaataccacaagcacccggcgcggcacgggcaacatcggggagacactgggagaaaaatggaagtctagactcaacgcccttggcaaatccgagtttcagatctataagaaaagcgggattcaggaggtggaccggaccctggctaaggaaggaatcaagcgcggcgagaccgatcatcacgccgtctctagagggagcgctaaactgcggtggttcgtggaaagaaatatggttacacccgagggaaaggtggtcgacctcggctgcggccgcgggggatggtcctactattgtggcgggctgaaaaacgtgcgggaagttaagggacttaccaaaggcgggccgggacatgaggagcctattcccatgtctacatacggctggaatctggtgagactccaaagcggcgtcgatgtgtttttcacgccccctgaaaagtgcgacaccctgctgtgtgatatcggggagtccagccccaaccctacaattgaagccggacgcaccctccgggtgcttaatctggttgagaactggctgaataacaatacaaagttctgcatcaaagtcctcaacccgtatatgccctccgtgatcgaaaagatggaggcgctgcagagaaaatacggcggggcccttgtgcgcaatcctctgtctcggaacagcacccacgagatgtactgggtctccaatgctacgggaaacattgtttctagcgtgaatatgatctccagaatgctcattaaccgctttaccatgaagcacaaaaaggccacatatgaacccgacgtggatctgggctctgggacccggaacatcggaattgagagcgaaatccctaatctggacattatcggcaagagaatcgagaaaattaagcaggaacatgagacatcctggcactacgaccaggatcatccctataaaacctgggcttaccacggcagctatgagacaaagcaaaccgggtctgcctccagcatggtcaacggagtggttcgcctccttacgaaaccgtgggacgtggtccctatggtgacacagatggctatgaccgataccacacccttcggccagcagcgggtttttaaggaaaaggtggacacgagaacccaagagcctaaagaagggacaaagaaactgatgaagatcaccgccgagtggctgtggaaagagctcggaaagaaaaagacaccccgcatgtgtaccagagaagagttcacacggaaggtccgctctaatgcggccctgggcgctatttttaccgatgaaaacaaatggaagtccgccagagaggctgtggaagacgggcggttctgggagcttgtggatagagagcggaatctgcacctcgaaggaaaatgcgagacgtgtgtctacaacatgatgggcaagcgcgagaagaagctgggcgagtttgggaaggccaaaggaagcagagccatctggtatatgtggctgggcgcgcggttcctcgaatttgaggctctggggttccttaatgaggaccattggttttctcgcggaaactccctgagcggcgttgaaggggagggcctccacagactgggatacattcttcgggatgtgtccaagaaagaaggcggggccatgtacgccgacgataccgctggatgggacacacgcatcaccctggaggacctcaagaatgaagagatggtgacaaaccatatgaaaggcgagcacaagaagctggccgaagctatcttcaaactgacctatcagaataaggtcgtgagagttcagcggcctacgccccgcgggacagtgatggatattatcagcagacgggaccagcgcggatctggccaagtcgggacctacggcctcaacacatttaccaatatggaggcccagctgattagacagatggaaggagagggcatcttcaaaagcattcaacatcttacggcgaccgaggaaatcgtggttcagaactggctggcccgggtggggcgcgagagactctcccggatggctatctctggagatgactgcgtcgtgaagccgattgatgacagattcgccagcgctctgacagcccttaatgatatgggcaaagttcgcaaggacatccagcagtgggaaccttcccgggggtggaacgattggacccaagtgcccttttgctctcaccacttccatgagctggtcatgaaggacggaagagtgctcgtcgtgccctgtcgcaaccaggatgaactgattggccgggcgagaatcagccagggggccggctggtccctgaaagagacagcttgcctcggaaagtcttatgcccagatgtggaccctgatgtactttcaccgccgggaccttagactggctgccaatgctatttgtagcgccgttccttcccattgggtgccgacaagccgcaccacgtggtctatccacgcgaaacacgagtggatgacaaccgaagatatgctcgccgtctggaaccgggtgtggattcaagagaatccctggatggaagacaagacccctgtggagtcctgggaagaggttccctatctgggcaaaagagaggaccagtggtgcgggagccttatcggactgacatctcgcgctacctgggccaagaacatccagacagccattaatcaggtgcggtccctcatcggcaacgaagagtacacggattatatgcctagcatgaagagattccggagagaagaggaagaggctggggtcctgtggtga

SEQ ID NO: 19832 - RNA, 9876 nt, synthetic construct
  misc_feature 1..9876: note = derived and/or modified CDS sequence (opt5) from DENV-2__EU482635__SS-prME
  source 1..9876: mol_type = other RNA
accgccggcgtgatcgtcatgctgattcccacagctatggccttccacctcacgaccagaaatggggagcctcatatgatcgttggacggcaggaaaagggcaagagcctgctttttaagaccgaggacggggtgaatatgtgcaccctgatggcgattgatctcggagaactgtgtgaggacacaatcacctacaaatgcccccttctgcgccaaaacgaacccgaggatattgactgttggtgcaattccacatctacctgggtgacgtatggcacctgtacaaccacaggggagcaccggcgggaaaagcgcagcgtcgctctcgtgcctcatgttggaatgggcctggagaccagaacggaaacatggatgtcctctgagggcgcctggaaacacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgtccgaggaacaggacaaacgctttatctgcaagcatagcatggtggatagaggctggggcaatgggtgtggactgttcggcaaagggggaattgtcacatgcgccatgtttacgtgcaaaaagaacatggaaggcaaagttgtgcagcctgagaatctcgaatacaccatcgtgattacaccccactctggggaggagcatgcggtcggaaacgacaccggcaagcacggcaaagaaatcaagatcacacctcagtccagcattaccgaggccgaactgacggggtatggaaccgtgacaatggagtgttctccccggaccggccttgatttcaatgaaatggttctgctccaaatggaggacaaggcttggctggtgcaccgccagtggtttcttgatctgccgctcccttggctgcccggggccgacacacagggatccaactggatccagaaggagaccctggtcacgttcaagaatcctcatgctaaaaagcaagacgtggttgtgctcggcagccaggaaggggccatgcacacagccctgaccggcgctacagagattcagatgtcctctggaaaccttctgtttaccggccatctcaaatgcagactgcggatggataaacttcaactgaaagggatgagctactccatgtgtaccggaaagttcaagatcgtcaaagaaattgcggagacacagcacggcacgatcgtgatcagagtccagtatgagggggacggaagcccctgcaagattcccttcgaaatcaccgatctcgagaaacgccatgtgctgggccggctgattacagttaatcctatcgtgaccgaaaaggactctccggtcaacattgaggccgaacccccttttggggattcctacatcattatcggcgtggagcccggacagctcaaactgaactggttcaagaagggcagctctatcgggcaaatgtttgagacaaccatgagaggagctaaacgcatggccattcttggcgacacggcctgggatttcgggagcctgggaggcgtttttacatccatcgggaaggctctccaccaggtgttcggcgccatttacggagcggctttttctggcgtcagctggaccatgaaaatcctgattggggtgatcatcacctggattggaatgaactcccggagcacatctctgtccgtgagccttgttctcgtcggcgtggtgaccctgtatctgggggccatggtccaggccgactctggatgtgtggtttcctggaagaacaaagaactcaagtgcggcagcgggatcttcattacagataatgtgcacacgtggaccgagcagtacaagtttcaacctgaatccccctctaaactggctagcgccatccagaaggctcatgaggaaggcatttgtggaatcagatccgtcacacgccttgagaacctgatgtggaaacagatcaccccggagctcaatcacattctgtctgaaaacgaggtgaagctgacaatcatgaccggcgacattcgggggatcatgcaggccggaaaaagaagccttcgccctcaacccacggaactcaagtattcctggaaaacctggggcaaggcgaagatgctgagcacagagtctcataatcagaccttcctgattgatgggcctgaaacagccgagtgccccaacaccaatcgggcttggaactccctcgaggttgaagactacggatttggcgtgttcacaaccaatatctggctgaaacttagagagaagcaggacgtcttttgtgatagcaaactgatgtctgccgctatcaaggacaaccgcgccgtgcacgcggatatgggctattggattgaatccgccctcaatgacacgtggaaaatggagaaggctagcttcatcgaggttaagtcttgccactggcctaaaagccatacactgtggtccaacggggtgctggaaagcgagatgattatccccaagaatttcgccggaccggtctctcagcacaactaccggcctggctatcatacccaaaccgctgggccctggcaccttggaaaactcgaaatggattttgacctgtgtgagggcacaaccgtggtggtcacggaagattgcgggaacagaggaccctccctgcggacaaccacagccagcggcaagctcattaccgagtggtgctgtcgctcctgcacactgcctccgcttagataccggggcgaggacgggtgttggtacggaatggaaatcagacccctgaaagagaaggaagagaatctcgttaactctctggtgaccgccggccatgggcagattgataatttcagcctgggagtgcttggcatggctctctttctggaagagatgctgcgcacgcggatcgggaccaagcacgcgatcctcctggtcgccgtgtccttcgttacacttattaccggaaacatgtcttttagagacctgggccgcgtgatggtcatggtgggcgctacaatgaccgatgacatcgggatgggagttacgtatctcgccctgctggccgctttcaaagtgagacctacatttgccgcgggccttctgctccggaagctgaccagcaaagagctcatgatggctacaattgggatcgccctgctttcccagtctaccattcccgaaaccatcctggagctcacagatgccctggctctgggaatgatggtccttaagatcgtgcgcaatatggaaaaataccaactggccgttacgattatggcgatcagctgcgtgcctaacgctgtcattctccagaatgcctggaaggtgtcctgtaccatcctggccgctgtgagcgtctctcccctcctgcttacatccagccagcagaaggccgactggattcctctggctctcaccatcaaaggcctgaaccccacagccatcttcctgaccacgctttctagaacatccaagaaacggagctggccgctgaatgaggcgattatggccgttgggatggtgtctatcctcgcttccagcctgctcaagaacgacattcctatgaccggacccctggtggccggcggccttctgaccgtctgctatgtgctgacagggcgctccgctgatctcgaactggagagagccgccgacgttaaatgggaggatcaagctgaaatcagcggatctagccctattctttccatcaccatttctgaggacggcagcatgtccatcaagaatgaagaggaggaacagacactgacgatcctcattcggaccgggctgctcgtgatctctggagtctttcccgtgagcattccgatcacagcggccgcttggtacctgtgggaggttaaaaagcagcgcgccggcgtgctttgggatgtcccttctccccctcccgtggaaaaggccgagctggaagacggggcttatagaattaaacagcggggaatcctgggctacagccaaatcggcgccggggtctataaggagggaaccttccacacaatgtggcatgtgacccgcggcgcggttctcatgcacagagggaaacggattgagcccagctgggctgatgtgaagaaagacctgatctcctacggaggcgggtggaaacttgaaggagagtggaaggaaggcgaggaagtccaggtgctggccctcgagcctggcaaaaacccgagagccgttcagacgaagcccgggatttttaaaaccaatacaggaaccatcggcgctgtgagcctggatttctctcctgggacatccggaagccccattgtcgaccgcaagggcaaagtggtggggctctacggaaacggcgttgtcacccggtctggcgcctatgtgtccgcgatcgctcagacagaaaagagcatcgaagataatcctgagattgaagacgatatctttagaaagaaacgcctgacgattatggaccttcatcccggggccggaaagaccaaacggtacctgcctgccatcgtgagagaggctattaagcgcggcctgcggacactcatcctggccccgaccagagtcgtggctgccgaaatggaggaggcgcttcgcgggctgcccattcggtatcaaaccacagccatcaaaacggaacacaccggaagagagatcgttgacctcatgtgtcatgctacattcaccatgcggctgctctcccctgtgcgcgtccccaactacaacctgattatcatggatgaagcccacttcacagaccctgcttctattgccgccagaggctatatcagcacccgggtggagatgggggaggctgcgggcatttttatgacggccacacccccgggatcccgcgatcctttcccccagagcaatgctcccatcatggacgaagagagagaaatccctgagcggtcttggaactccggccacgaatgggttaccgattttaaggggaagaccgtgtggttcgtccccagcattaaagccggaaatgacatcgccgcttgccttagaaagaacggcaaaaaggtgattcagctgtctcgcaaaacatttgatagcgagtacgttaagacccgggccaatgactgggatttcgtggtcacaaccgacatctccgagatgggggcgaactttaaggctgaaagagtgattgatcctcgccggtgtatgaaaccggtgatcctgacggacggagaggaaagagtcatcctcgccggccccatgcctgttacacattctagcgccgctcaacgccgggggagaattggccgcaatcccaagaacgagaatgaccagtatatctacatgggagaacctctggagaacgatgaggactgcgcccactggaaagaagcgaagatgcttctggataatattaacacccccgagggcatcattccgtccatgttcgaacctgagagagaaaaagtggacgccatcgatggggagtaccggctccgcggagaggctagaaagacatttgtggacctgatgcggcgcggcgatctgcccgtctggctcgcctataaagtggctgccgaagggattaattacgctgacagaaagtggtgtttcgatggaatcaagaacaatcagatccttgaggaaaacatggaggttgagatttggaccaaagaaggcgagcggaagaaactgaagcctagatggctggacgcccgcatctattctgatcccctcgcgctgaaagaatttaaggagttcgccgctgggcggaagtcccttacgctgaacctcattaccgaaatgggcagactgcctacattcatgacccagaaagcccgcaatgctctggacaacctcgccgtgcttcatacagccgaggctggaggccgggcgtacaatcacgccctgtccgagctgcccgaaaccctcgagacactgcttctgctcaccctgctggctacggtcacagggggaatctttctcttccttatgagcggcaaggggattggaaaaatgaccctgggcatgtgctgcatcatcaccgcctctattctgctctggtatgcccaaatccagccgcactggattgctgcctccatcattctggaatttttccttatcgtgctgctcatccctgagcccgaaaagcagagaacaccccaggataaccaactgacctacgttgtgattgcgatcctgacagtcgtggccgctacgatggccaatgagatgggctttctcgagaaaaccaagaaggaccttgggctgggaagcattacaacccaggaatccgagtctaacatcctggacattgatctccggcctgctagcgcctggacactgtatgcggtcgccaccacgttcgtgaccccgatgcttcgccattccatcgaaaattctagcgttaacgtgtccctgacagctattgccaatcaggctaccgtgctcatgggcctggggaaaggatggcccctgagcaagatggacatcggcgtccctctccttgccatcgggtgttactctcaggttaaccccattacactgaccgctgccctgctcctgcttgtggcgcactacgccatcattggacctggcctgcaagctaaagccacgagagaggctcagaagcgggccgccgcgggcatcatgaaaaatcccacagtggatgggattaccgtcatcgacctcgaacctatcccgtatgatcccaagtttgagaagcagctgggacaggtgatgctgctcattctttgcgttacacaagtgctgatgatgcgcaccacctgggctctgtgtgaggccctcacactggctacgggccctatctccaccctttgggaagggaaccccggaagattctggaatacaaccattgccgtcagcatggccaacatctttcggggctcttacctggctggggccggactcctgttctccattatgaaaaatacaaccagcacgcgcagaggcacaggcaacatcggggagaccctgggagaaaagtggaaatctcggctcaatgcgcttggcaagagcgagtttcagatctataaaaagtccgggattcaggaggtggaccgcaccctggccaaagaaggaatcaagagaggcgagacagatcatcacgctgtctctcgggggagcgccaagctgagatggttcgtggaacgcaacatggttacccctgagggaaaagtggtcgacctcggctgcggcagagggggatggtcctactattgtggcgggctgaagaacgtgagagaagttaaaggacttacaaagggcgggcccggacatgaggagccgattcctatgagcacgtacggctggaatctggtgcgcctccaatccggcgtcgatgtgtttttcacaccgcccgaaaaatgcgacacactgctgtgtgatatcggggagtctagccctaaccccaccattgaagctggacggacactcagagtgcttaatctggttgagaactggctgaataacaatacccagttctgcatcaaggtcctcaacccttatatgccgtccgtgatcgaaaagatggaggccctgcagcgcaaatacggcggggcgcttgtgcggaatcccctgtctagaaacagcacgcacgagatgtactgggtctccaatgccaccggaaacattgtttctagcgtgaatatgatctcccgcatgctcattaaccggtttacaatgaagcacaaaaaggctacctatgaacctgacgtggatctgggcagcgggacaagaaatatcggaattgagtctgaaatccccaacctggacattatcggcaaacgcatcgagaagattaagcaggaacatgagacctcctggcactacgaccaagatcatccttataaaacatgggcctaccacggcagctatgagaccaagcagacggggtctgcttccagcatggtcaacggagtggttcggctccttacaaaaccctgggacgtggtcccgatggtgacccagatggccatgaccgatacaacgcctttcggccagcaaagagtttttaaggaaaaagtggacacccgcacacaggagcccaaggaagggaccaagaaactgatgaagatcacagctgagtggctgtggaaagagctcggaaagaaaaagacccctagaatgtgtacacgggaagagttcacccgcaaagtcagatctaatgccgcgctgggcgccatttttacggatgaaaacaagtggaagtccgctcgggaggccgtggaagacgggagattctgggagcttgtggatcgggagcgcaatctgcacctcgaaggaaaatgcgagacctgtgtctacaacatgatgggcaagagagagaagaagctgggcgagtttgggaaagctaagggaagccgggccatctggtatatgtggctgggcgcccgcttcctcgaatttgaggcgctggggttccttaatgaggaccattggttttccagaggaaacagcctgtctggcgttgaaggggagggcctccaccggctgggatacattcttcgcgatgtgagcaagaaagaaggcggggctatgtacgccgacgatacagccggatgggacaccagaatcacactggaggacctcaagaatgaagagatggtgaccaaccatatgaaaggcgagcacaagaaactggctgaagccatcttcaagctgacgtatcagaataaggtcgtgcgggttcagcgccccacacctagagggaccgtgatggatattatctcccggcgcgaccaaagaggatctggccaggtcgggacatacggcctcaacacctttacgaatatggaggctcagctgattcggcaaatggaaggagagggcatcttcaaaagcattcagcatcttaccgccacagaggaaatcgcggtgcagaactggctggcccgcgttgggagagagcggctctccagaatggctatctctggagatgactgcgtggtcaagcccattgatgaccgcttcgccagcgctctgaccgcccttaatgatatgggcaaagtgcggaaggacatccagcaatgggaaccgtccagagggtggaacgattggacacaggttcctttttgctctcaccacttccatgagctggtgatgaaagacggacgcgtcctcgtggtcccctgtcggaatcaggatgaactgattggcagagcgcgcatcagccagggggccggctggtccctgaaggagaccgcttgcctcggaaagagctatgcccaaatgtggacactgatgtactttcaccggagagaccttcgcctggctgccaacgctatttgttctgccgtgccctcccattgggttcctaccagccggacgacatggtctatccacgcgaaacacgagtggatgaccaccgaagatatgctcgccgtgtggaacagagtctggattcaggagaatccgtggatggaagacaagacacccgtggagtcctgggaagaggtgccttatctgggcaaacgcgaggaccagtggtgcgggagccttatcggactgacctcccgggctacatgggccaagaacatccagacggccattaatcaagttagatctctcatcggcaacgaagagtacaccgattatatgcccagcatgaaacggttcagacgcgaagaggaagaggctggggtgctgtggtga

SEQ ID NO: 19833 - RNA, 9876 nt, synthetic construct
  misc_feature 1..9876: note = derived and/or modified CDS sequence (opt5) from DENV-2__GQ199874__SS-prME
  source 1..9876: mol_type = other RNA
accgccggcgtgatcgtcatgctgattcccacagctatggccttccacctcacgaccagaaatggggaacctcatatgatcgttggacggcaggaaaagggcaagagcctgctttttaagaccgaggacggggtgaatatgtgcaccctgatggcgatggatctcggagaactgtgtgaggacacaattacctacaagtgcccccttctgcgccaaaatgaacccgaggatatcgactgttggtgcaatagcacatctacctgggtgacgtatggcacctgtacaaccacaggggagcacagacgggaaaagcgcagcgtcgctctcgtgcctcatgttggaatgggcctggagaccagaacggaaacatggatgtcctctgagggcgcctggaaacacgtgcagcggattgagacctggatcctgcgccatcccgggttcacaatcatggccgctattctcgcctacaccatcggaaccacacactttcagagagctctgattttcatccttctgacggccgtcgcgcctagcatgaccatgcggtgcattggcatctccaaccgcgattttgtggaaggggtttctggaggcagctgggtggacattgtcctcgagcacgggtcctgtgtgacaaccatggccaagaataagcccacactggatttcgaacttatcaaaaccgaggctaagcagcctgccacgctgagaaaatattgcatcgaagctaagctcacaaacaccaccacagagagccggtgtccgacccaaggagagccctctctgaatgaggaacaggacaaacgctttatttgcaagcattccatggtggatagaggctggggcaacgggtgtggactgttcggcaaagggggaatcgtcacatgcgccatgtttacgtgcaaaaagaatatggaaggcaaagttgtgcagcctgagaacctcgaatacaccattgtgatcacaccccacagcggggaggagcatgcggtcggaaatgacaccggcaagcacggcaaagaaattaagatcacacctcagtcttccatcaccgaggccgaactgacggggtatggaaccgtgacaatggagtgtagcccccggaccggccttgatttcaacgaaatggttctgctccaaatggaggacaaggcttggctggtgcaccgccagtggtttcttgatctgccgctcccttggctgcccggggccgacacacagggatctaattggattcagaaggagaccctggtcacgttcaagaaccctcatgctaaaaagcaagacgtggttgtgctcggctcccaggaaggggccatgcacacagccctgaccggcgctacagagatccagatgagctccggaaatcttctgtttaccggccatctcaaatgcagactgcggatggataaacttcaactgaaagggatgtcttacagcatgtgtaccggaaagttcaagattgtcaaagaaatcgcggagacacagcacggcacgattgtgatcagagtccagtatgagggggacggatccccctgcaagatccccttcgaaattaccgatctcgagaaacgccatgtgctgggccggctgatcacagttaaccctattgtgaccgaaaaggacagcccggtcaacatcgaggccgaacccccttttggggattcttacattatcattggcgtggagcccggacagctcaaactgaattggttcaagaagggctccagcatcgggcaaatgtttgagacaaccatgagaggagctaaacgcatggccatccttggcgacacggcctgggatttcgggtctctgggaggcgtttttacaagcattgggaaggctctccaccaggtgttcggcgccatctacggagcggctttttccggcgtctcttggaccatgaaaattctgatcggggtgattatcacctggatcggaatgaacagccggtccacaagcctgtctgtgtcccttgttctcgtcggcgtggtgaccctgtatctgggggccatggtccaggccgacagcggatgtgtggtttcttggaagaataaagaactcaagtgcggctccgggattttcatcacagataacgtgcacacgtggaccgagcagtacaagtttcaacctgaaagcccctccaaactggcttctgccattcagaaggctcatgaggaaggcatctgtggaattagaagcgtcacacgccttgagaatctgatgtggaaacagatcaccccggagctcaaccacatcctgtccgaaaatgaggtgaagctgacaattatgaccggcgacatccgggggattatgcaggccggaaaaagatctcttcgccctcaacccacggaactcaagtatagctggaaaacctggggcaaggcgaagatgctgtccacagagagccataaccagaccttcctgatcgatgggcctgaaacagccgagtgccccaataccaaccgggcttggaactctctcgaggttgaagactacggatttggcgtgttcacaaccaacatttggctgaaacttagagagaagcaggacgtcttttgtgattccaaactgatgagcgccgctatcaaggacaatcgcgccgtgcacgcggatatgggctattggatcgaatctgccctcaacgacacgtggaaaatggagaaggcttccttcattgaggttaagagctgccactggcctaaatctcatacactgtggagcaatggggtgctggaatccgagatgatcattcccaagaacttcgccggaccggtcagccagcacaactaccggcctggctatcatacccaaaccgctgggccctggcaccttggaaaactcgaaatggattttgacctgtgtgagggcacaaccgtggtggtcacggaagattgcgggaatagaggaccctctctgcggacaaccacagcctccggcaagctcatcaccgagtggtgctgtcgcagctgcacactgcctccgcttagataccggggcgaggacgggtgttggtacggaatggaaattagacccctgaaagagaaggaagagaacctcgttaattccctggtgaccgccggccatgggcagatcgataacttctctctgggagtgcttggcatggctctctttctggaagagatgctgcgcacgcggattgggaccaagcacgcgatcctcctggtcgccgtgagcttcgttacacttatcaccggaaatatgtcctttagagacctgggccgcgtgatggtcatggtgggcgctacaatgaccgatgacattgggatgggagttacgtatctcgccctgctggccgctttcaaagtgagacctacatttgccgcgggccttctgctccggaagctgacctctaaagagctcatgatggctacaatcgggattgccctgcttagccagtccaccatccccgaaaccattctggagctcacagatgccctggctctgggaatgatggtccttaagatcgtgcgcaacatggaaaaataccaactggccgttacgatcatggcgatttcttgcgtgcctaatgctgtcatcctccagaacgcctggaaggtgagctgtaccattctggccgctgtgtccgtcagccccctcctgcttacatcttcccagcagaaggccgactggatccctctggctctcaccattaaaggcctgaatcccacagccatcttcctgaccacgcttagcagaacatctaagaaacggtcctggccgctgaacgaggcgatcatggccgttgggatggtgagcattctcgcttcttccctgctcaagaatgacatccctatgaccggacccctggtggccggcggccttctgaccgtctgctatgtgctgacagggcgcagcgctgatctcgaactggagagagccgccgacgttaaatgggaggatcaagctgaaatttccggaagctctcctatccttagcattaccatctccgaggacggctctatgagcattaagaacgaagaggaggaacagacactgacgatcctcatccggaccgggctgctcgtgatttccggagtctttcccgtgtctatcccgattacagcggccgcttggtacctgtgggaggttaaaaagcagcgcgccggcgtgctttgggatgtcccttctccccctcccgtggaaaaggccgagctggaagacggggcttatagaatcaaacagcgggggattctgggctactcccaaatcggcgccggggtctataaggagggaaccttccacacaatgtggcatgtgacccgcggcgcggttctcatgcacagagggaaacggatcgagccctcctgggctgatgtgaagaaagacctgattagctacggaggcgggtggaaacttgaaggagagtggaaggaaggcgaggaagtccaggtgctggccctcgagcctggcaaaaatccgagagccgttcagacgaagcccgggatctttaaaaccaacacaggaaccattggcgctgtgtccctggatttcagccctgggacatctggatcccccatcgtcgaccgcaagggcaaagtggtggggctctacggaaatggcgttgtcacccggagcggcgcctatgtgtctgcgattgctcagacagagaagtccatcgaagataaccctgagatcgaagacgatatttttagaaagaaacgcctgacgatcatggaccttcatcccggggccggaaagaccaaacggtacctgcctgccattgtgagagaggctatcaagcgcggcctgcggacactcattctggccccgaccagagtcgtggctgccgaaatggaggaggcgcttcgcgggctgcccatccggtatcaaaccacagccattaaaacggaacacaccggaagagagatcgttgacctcatgtgtcatgctacattcaccatgcggctgctcagccctgtgcgcgtccccaactacaatctgatcattatggatgaagcccacttcacagaccctgcttccatcgccgccagaggctatatttctacccgggtggagatgggggaggctgcgggcatctttatgacggccacacccccgggaagccgcgatcctttcccccagtccaacgctcccattatggacgaagagagagaaatccctgagcggagctggaactctggccacgaatgggttaccgattttaaggggaagaccgtgtggttcgtcccctccatcaaagccggaaacgacattgccgcttgccttagaaagaatggcaaaaaggtgatccagctgagccgcaaaacatttgattctgagtacgttaagacccgggccaacgactgggatttcgtggtcacaaccgacattagcgagatgggggcgaattttaaggctgaaagagtgatcgatcctcgccggtgtatgaaaccggtgattctgacggacggagaggaaagagtcatcctcgccggccccatgcctgttacacattcctctgccgctcaacgccgggggagaatcggccgcaaccccaagaatgagaacgaccagtatatttacatgggagaacctctggagaatgatgaggactgcgcccactggaaagaagcgaagatgcttctggataacatcaatacccccgagggcattatcccgagcatgttcgaacctgagagagaaaaagtggacgccattgatggggagtaccggctccgcggagaggctagaaagacatttgtggacctgatgcggcgcggcgatctgcccgtctggctcgcctataaagtggctgccgaagggatcaactacgctgacagaaagtggtgtttcgatggaattaagaataaccagatccttgaggaaaacatggaggttgagatctggaccaaagaaggcgagcggaagaaactgaagcctagatggctggacgcccgcatttattccgatcccctcgcgctgaaagaatttaaggagttcgccgctgggcggaagtctcttacgctgaatctcatcaccgaaatgggcagactgcctacattcatgacccagaaagcccgcaacgctctggacaatctcgccgtgcttcatacagccgaggctggaggccgggcgtacaaccacgccctgagcgagctgcccgaaaccctcgagacactgcttctgctcaccctgctggctacggtcacagggggaatttttctcttccttatgtccggcaaggggatcggaaaaatgaccctgggcatgtgctgcattatcaccgccagcatcctgctctggtatgcccaaattcagccgcactggatcgctgcctctattatcctggaatttttccttattgtgctgctcatccctgagcccgaaaagcagagaacaccccaggataatcaactgacctacgttgtgatcgcgattctgacagtcgtggccgctacgatggccaacgagatgggctttctcgagaaaaccaagaaggaccttgggctgggatccatcacaacccaggaaagcgagtccaatattctggacatcgatctccggcctgcttctgcctggacactgtatgcggtcgccaccacgttcgtgaccccgatgcttcgccatagcattgaaaactcctctgttaatgtgagcctgacagctatcgccaaccaggctaccgtgctcatgggcctggggaaaggatggcccctgtccaagatggacattggcgtccctctccttgccatcgggtgttacagccaggttaatcccatcacactgaccgctgccctgctcctgcttgtggcgcactacgccattatcggacctggcctgcaagctaaagccacgagagaggctcagaagcgggccgccgcgggcattatgaaaaaccccacagtggatgggatcaccgtcattgacctcgaacctatcccgtatgatcccaagtttgagaagcagctgggacaggtgatgctgctcatcctttgcgttacacaagtgctgatgatgcgcaccacctgggctctgtgtgaggccctcacactggctacgggccctatttctaccctttgggaagggaatcccggaagattctggaacacaaccatcgccgtctccatggccaatatttttcggggcagctacctggctggggccggactcctgttctctatcatgaaaaacacaaccaatacgcgcagaggcacaggcaacattggggagaccctgggagaaaagtggaaatcccggctcaacgcgcttggcaagagcgagtttcagatctataaaaagtctgggatccaggaggtggaccgcaccctggccaaagaaggaattaagagaggcgagacagatcatcacgctgtcagccgggggtccgccaagctgagatggttcgtggaacgcaatatggttacccctgagggaaaagtggtcgacctcggctgcggccggggaggatggtcttactattgtggcgggctgaagaacgtgagagaagttaaaggacttacaaagggcgggcccggacatgaggagccgatccctatgagcacgtacggctggaatctggtgcgcctccaatccggcgtcgatgtgtttttcacaccgcccgaaaaatgcgacacactgctgtgtgatattggggagagctcccctaaccccaccatcgaagctggacggacactcagagtgcttaatctggttgagaactggctgaataacaatacccagttctgcattaaggtcctcaacccttatatgccgtctgtgatcgaaaagatggaggccctgcagcgcaaatacggcggggcgcttgtgcggaatcccctgagcagaaactccacgcacgagatgtactgggtctctaatgccaccggaaacatcgttagctccgtgaatatgatttctcgcatgctcatcaaccggtttacaatgaagcacaaaaaggctacctatgaacctgacgtggatctgggcagcgggacaagaaacattggaatcgagtccgaaattcccaatctggacatcattggcaaacgcatcgagaagatcaagcaggaacatgagaccagctggcactacgaccaagatcatccttataaaacatgggcctaccacggctcttatgagaccaagcagacggggtccgctagctctatggtcaacggagtggttcggctccttacaaaaccctgggacgtggtcccgatggtgacccagatggccatgaccgatacaacgcctttcggccagcaaagagtttttaaggaaaaagtggacacccgcacacaggagcccaaggaagggaccaagaaactgatgaagattacagctgagtggctgtggaaagagctcggaaagaaaaagacccctagaatgtgtacacgggaagagttcacccgcaaagtcagatccaatgccgcgctgggcgccatctttacggatgaaaacaagtggaaaagcgctcgggaggccgtggaagacgggagattctgggagcttgtggatcgggagcgcaatctgcacctcgaaggaaaatgcgagacctgtgtctacaacatgatgggcaagagagagaagaagctgggcgagtttgggaaagctaagggatctcgggccatttggtatatgtggctgggcgcccgcttcctcgaatttgaggcgctggggttccttaatgaggaccattggttttccagaggaaacagcctgtccggcgttgaaggggagggcctccaccggctgggatacatccttcgcgatgtgggcaagaaagaagggggagctatgtacgccgacgatacagccggctgggacaccagaattacactggaggacctcaagaatgaagagatggtgaccaaccatatgaaaggggagcacaagaaactggctgaagccatcttcaagctgacgtatcagaataaggtcgtgcgggttcagcgccccacacctagaggaaccgtgatggatatcattagccggcgcgaccaaagaggctctgggcaggtcggcacatacggactcaacacctttacgaatatggaggctcagctgatccggcaaatggaaggcgaggggattttcaaaagcatccagcatcttaccgccacagaggaaattgcggtgcagaactggctggcccgcgttggaagagagcggctctccagaatggctatctctggcgatgactgcgtggtcaagcccatcgatgaccgcttcgccagcgctctgaccgcccttaatgatatggggaaagtgcggaaggacattcagcaatgggaaccgtccagaggatggaacgattggacacaggttcctttttgctctcaccacttccatgagctggtgatgaaagacggccgcgtcctcgtggtcccctgtcggaaccaggatgaactgatcgggagagcgcgcattagccagggcgccggatggtccctgaaggagaccgcttgcctcggcaagtcttatgcccaaatgtggacactgatgtactttcaccggagagaccttcgcctggctgccaatgctatctgtagcgccgtgccctcccattgggttcctaccagccggacgacatggtctattcacgcgaaacacgagtggatgaccaccgaagatatgctcgccgtgtggaacagagtctggatccaggagaatccgtggatggaagacaagacacccgtggagtcctgggaagaggtgccttatctggggaaacgcgaggaccagtggtgcggaagccttattggcctgacctctcgggctacatgggccaagaacatccagacggccatcaatcaagttagatccctcattgggaacgaagagtacaccgattatatgcccagcatgaaacggttcagacgcgaagaggaagaggctggagtgctgtggtga

SEQ ID NO: 19834 - RNA, 9876 nt, synthetic construct
  misc_feature 1..9876: note = derived and/or modified CDS sequence (opt5) from DENV-2__EU482639__SS-prME
  source 1..9876: mol_type = other RNA
accgccggcgtgatcgtcatgctgattcccacagctatggccttccacctcacgaccagaaatggggagcctcatatgatcgttggacggcaggaaaagggcaagagcctgctttttaagaccgaggacggggtgaatatgtgcaccctgatggcgattgatctcggagaactgtgtgaggacacaatcacctacaagtgcccccttctgcgccaaaatgaacccgaggatattgactgttggtgcaatagcacatctacctgggtgacgtatggcacctgtacaaccacaggggagcacagacgggaaaagcgcagcgtcgctctcgtgcctcatgttggaatgggcctggagaccagaacggaaacatggatgtcctctgagggcgcctggaagcacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaggaacaggacaaacgctttatctgcaagcattccatggtggatagaggctggggcaacgggtgtggactgttcggcaaagggggaattgtcacatgcgccatgtttacgtgcaaaaagaatatggaaggcaaagttgtgcagcctgagaacctcgaatacaccatcgtgattacaccccacagcggggaggagcatgcggtcggaaatgacaccggcaagcacggcaaagaaatcaagatcacacctcagtcttccattaccgaggccgaactgacggggtatggaaccgtgacaatggagtgtagcccccggaccggccttgatttcaacgaaatggttctgctccaaatggaggacaaggcttggctggtgcaccgccagtggtttcttgatctgccgctcccttggctgcccggggccgacacacagggatctaattggatccagaaggagaccctggtcacgttcaagaaccctcatgctaaaaagcaagacgtggttgtgctcggctcccaggaaggggccatgcacacagccctgaccggcgctacagagattcagatgagctccggaaatcttctgtttaccggccatctcaaatgcagactgcggatggataaacttcaactgaaagggatgtcttacagcatgtgtaccggaaagttcaagatcgtcaaagaaattgcggagacacagcacggcacgatcgtgatcagagtccagtatgagggggacggatccccctgcaagattcccttcgaaatcaccgatctcgagaaacgccatgtgctgggccggctgattacagttaaccctatcgtgaccgaaaaggacagcccggtcaacattgaggccgaacccccttttggggattcttacatcattatcggcgtggagcccggacagctcaaactgaattggttcaagaagggctccagcatcgggcaaatgtttgagacaaccatgagaggagctaaacgcatggccattcttggcgacacggcctgggatttcgggtctctgggaggcgtttttacaagcatcgggaaggctctccaccaggtgttcggcgccatttacggagcggctttttccggcgtctcttggaccatgaaaatcctgattggggtgatcatcacctggattggaatgaacagccggtccacaagcctgtctgtgtcccttgttctcgtcggcgtggtgaccctgtatctgggggccatggtccaggccgacagcggatgtgtggtttcttggaagaataaagaactcaagtgcggctccgggatcttcattacagataacgtgcacacgtggaccgagcagtacaagtttcaacctgaaagcccctccaaactggcttctgccatccagaaggctcatgaggaaggcatttgtggaatcagaagcgtcacacgccttgagaatctgatgtggaaacagatcaccccggagctcaaccacattctgtccgaaaatgaggtgaagctgacaatcatgaccggcgacattcgggggatcatgcaggccggaaaaagatctcttcgccctcaacccacggaactcaagtatagctggaaaacctggggcaaggcgaagatgctgtccacagagagccataaccagaccttcctgattgatgggcctgaaacagccgagtgccccaataccaaccgggcttggaactctctcgaggttgaagactacggatttggcgtgttcacaaccaacatctggctgaaacttagagagaagcaggacgtcttttgtgattccaaactgatgagcgccgctatcaaggacaatcgcgccgtgcacgcggatatgggctattggattgaatctgccctcaacgacacgtggaaaatggagaaggcttccttcatcgaggttaagagctgccactggcctaaatctcatacactgtggagcaatggggtgctggaatccgagatgattatccccaagaacttcgccggaccggtcagccagcacaactaccggcctggctatcatacccaaaccgctgggccctggcaccttggaaaactcgaaatggattttgacctgtgtgagggcacaaccgtggtggtcacggaagattgcgggaatagaggaccctctctgcggacaaccacagcctccggcaagctcattaccgagtggtgctgtcgcagctgcacactgcctccgcttagataccggggcgaggacgggtgttggtacggaatggaaatcagacccctgaaagagaaggaagagaacctcgttaattccctggtgaccgccggccatgggcagattgataacttctctctgggagtgcttggcatggctctctttctggaagagatgctgcgcacgcggatcgggaccaagcacgcgatcctcctggtcgccgtgagcttcgttacacttattaccggaaatatgtcctttagagacctgggccgcgtgatggtcatggtgggcgctacaatgaccgatgacatcgggatgggagttacgtatctcgccctgctggccgctttcaaagtgagacctacatttgccgcgggccttctgctccggaagctgacctctaaagagctcatgatggctacaattgggatcgccctgcttagccagtccaccattcccgaaaccatcctggagctcacagatgccctggctctgggaatgatggtccttaagatcgtgcgcaacatggaaaaataccaactggccgttacgattatggcgatctcttgcgtgcctaatgctgtcattctccagaacgcctggaaggtgagctgtaccatcctggccgctgtgtccgtcagccccctcctgcttacatcttcccagcagaaggccgactggattcctctggctctcaccatcaaaggcctgaatcccacagccatcttcctgaccacgcttagcagaacatctaagaaacggtcctggccgctgaacgaggcgattatggccgttgggatggtgagcatcctcgcttcttccctgctcaagaatgacattcctatgaccggacccctggtggccggcggccttctgaccgtctgctatgtgctgacagggcgcagcgctgatctcgaactggagagagccgccgacgttaaatgggaggatcaagctgaaatctccggaagctctcctattcttagcatcaccatttccgaggacggctctatgagcatcaagaacgaagaggaggaacagacactgacgatcctcattcggaccgggctgctcgtgatctccggagtctttcccgtgtctattccgatcacagcggccgcttggtacctgtgggaggttaaaaagcagcgcgccggcgtgctttgggatgtcccttctccccctcccgtggaaaaggccgagctggaagacggggcttatagaattaaacagcggggaatcctgggctactcccaaatcggcgccggggtctataaggagggaaccttccacacaatgtggcatgtgacccgcggcgcggttctcatgcacagagggaaacggattgagccctcctgggctgatgtgaagaaagacctgatcagctacggaggcgggtggaaacttgaaggagagtggaaggaaggcgaggaagtccaggtgctggccctcgagcctggcaaaaatccgagagccgttcagacgaagcccgggatttttaaaaccaacacaggaaccatcggcgctgtgtccctggatttcagccctgggacatctggatcccccattgtcgaccgcaagggcaaagtggtggggctctacggaaatggcgttgtcacccggagcggcgcctatgtgtctgcgatcgctcagacagagaagtccatcgaagataaccctgagattgaagacgatatctttagaaagaaacgcctgacgattatggaccttcatcccggggccggaaagaccaaacggtacctgcctgccatcgtgagagaggctattaagcgcggcctgcggacactcatcctggccccgaccagagtcgtggctgccgaaatggaggaggcgcttcgcgggctgcccattcggtatcaaaccacagccatcaaaacggaacacaccggaagagagatcgttgacctcatgtgtcatgctacattcaccatgcggctgctcagccctgtgcgcgtccccaactacaatctgattatcatggatgaagcccacttcacagaccctgcttccattgccgccagaggctatatctctacccgggtggagatgggggaggctgcgggcatttttatgacggccacacccccgggaagccgcgatcctttcccccagtccaacgctcccatcatggacgaagagagagaaatccctgagcggagctggaactctggccacgaatgggttaccgattttaaggggaagaccgtgtggttcgtcccctccattaaagccggaaacgacatcgccgcttgccttagaaagaatggcaaaaaggtgattcagctgagccgcaaaacatttgattctgagtacgttaagacccgggccaacgactgggatttcgtggtcacaaccgacatcagcgagatgggggcgaattttaaggctgaaagagtgattgatcctcgccggtgtatgaaaccggtgatcctgacggacggagaggaaagagtcatcctcgccggccccatgcctgttacacattcctctgccgctcaacgccgggggagaattggccgcaaccccaagaatgagaacgaccagtatatctacatgggagaacctctggagaatgatgaggactgcgcccactggaaagaagcgaagatgcttctggataacattaatacccccgagggcatcattccgagcatgttcgaacctgagagagaaaaagtggacgccatcgatggggagtaccggctccgcggagaggctagaaagacatttgtggacctgatgcggcgcggcgatctgcccgtctggctcgcctataaagtggctgccgaagggattaactacgctgacagaaagtggtgtttcgatggaatcaagaataaccagatccttgaggaaaacatggaggttgagatttggaccaaagaaggcgagcggaagaaactgaagcctagatggctggacgcccgcatctattccgatcccctcgcgctgaaagaatttaaggagttcgccgctgggcggaagtctcttacgctgaatctcattaccgaaatgggcagactgcctacattcatgacccagaaagcccgcaacgctctggacaatctcgccgtgcttcatacagccgaggctggaggccgggcgtacaaccacgccctgagcgagctgcccgaaaccctcgagacactgcttctgctcaccctgctggctacggtcacagggggaatctttctcttccttatgtccggcaaggggattggaaaaatgaccctgggcatgtgctgcatcatcaccgccagcattctgctctggtatgcccaaatccagccgcactggattgctgcctctatcattctggaatttttccttatcgtgctgctcatccctgagcccgaaaagcagagaacaccccaggataatcaactgacctacgttgtgattgcgatcctgacagtcgtggccgctacgatggccaacgagatgggctttctcgagaaaaccaagaaggaccttgggctgggatccattacaacccaggaaagcgagtccaatatcctggacattgatctccggcctgcttctgcctggacactgtatgcggtcgccaccacgcttgtgaccccgatgctgcgccatagcatcgaaaactcctctgttaatgtgagcctcacagctattgccaaccaggctaccgtgctgatgggcctggggaaaggatggcccctctccaagatggacatcggcgtccctcttctggccatcgggtgttacagccaggttaatcccattacactgaccgctgccctcctgcttctggtggcgcactacgccatcattggacctggcctccaagctaaagccacgagagaggctcagaagcgggccgccgcgggcatcatgaaaaaccccacagtggatgggattaccgtcatcgacctggaacctatcccgtatgatcccaagttcgagaagcagctgggacaggtgatgctccttattctgtgcgttacacaagtgctgatgatgcgcaccacctgggctctctgtgaggccctgacacttgctacgggccctatctctaccctgtgggaagggaatcccggaagattttggaacacaaccattgccgtctccatggccaatatcttccggggcagctacctcgctggggccggactgctgttttctattatgaaaaacacaaccaatacgcgcagaggcacaggcaacatcggggagaccctcggagaaaagtggaaatcccggcttaacgcgctgggcaagagcgagttccagatctataaaaagtctgggattcaggaggtggaccgcaccctggccaaagaaggaatcaagagaggcgagacagatcatcacgctgtcagccgggggtccgccaagctcagatggtttgtggaacgcaatatggttacccctgagggaaaagtggtcgacctgggctgcggcagagggggatggtcttactattgtggcgggcttaagaacgtgcgggaagttaaaggactgacaaagggcgggcccggacatgaggagccgattcctatgagcacgtacggctggaatctcgtgcgcctgcaatccggcgtcgatgtgttctttacaccgcccgaaaaatgcgagacactgctctgtgacatcggggaaagctcccctaaccccaccattgaggctggacggacacttagagtgctgaatctggttgaaaactggctcaataacaatacccagttctgcatcaaggtcctgaacccttatatgccgtctgtgatcgagaagatggaggcccttcagcgcaaatacggcggggcgctggtgcggaatcccctcagcagaaactccacgcacgaaatgtactgggtctctaatgccaccggaaacattgttagctccgtgaatatgatctctcgcatgctgattaaccggttcacaatgaagcacaaaaaggctacctatgagcctgatgtggacctgggcagcgggacaagaaacatcggaattgaatccgagatccccaatctcgatattatcggcaaacgcatcgaaaagattaagcaggagcatgagaccagctggcactacgaccaagaccatccttataaaacatgggcctaccacggctcttatgaaaccaagcagacggggtccgctagctctatggtcaacggagtggttcggcttctgacaaaaccctgggatgtggtcccgatggtgacccagatggccatgaccgacacaacgccttttggccagcaaagagttttcaaggagaaagtggatacccgcacacaggaacccaaggaggggaccaagaaactgatgaagatcacagctgagtggctctggaaagaactgggaaagaaaaagacccctagaatgtgtacacgggaggaatttacccgcaaagtcagatccaatgccgcgcttggcgccattttcacggacgagaacaagtggaaaagcgctcgggaagccgtggaggatgggagattttgggagctggtggaccgggaacgcaatctccacctggagggaaaatgcgaaacctgtgtctacaacatgatgggcaagagagagaaaaagctgggcgagttcgggaaagctaagggatctcgggccatctggtatatgtggctcggcgcccgctttctggagttcgaggcgcttgggtttctgaatgaagatcattggttctccagaggaaacagcctctccggcgttgagggggaaggcctgcaccggcttggatacattctgcgcgacgtgggcaagaaagaagggggagctatgtacgccgatgacacagccggctgggataccagaatcacactcgaagacctgaagaatgaggagatggtgaccaaccatatgaaaggggaacacaagaaactggctgaggccatctttaagctcacgtatcagaataaggtcgtgcgggttcagcgccccacacctagaggaaccgtgatggacattatcagccggcgcgatcaaagaggctctgggcaggtcggcacatacggactgaacaccttcacgaatatggaagctcagcttattcggcaaatggagggcgaggggatctttaaaagcattcagcatctgaccgccacagaagagatcgcggtgcagaactggctcgcccgcgttggaagagaacggctgtccagaatggctatctctggcgacgattgcgtggtcaagcccattgacgatcgcttcgccagcgctcttaccgccctgaatgacatggggaaaatccggaaggatattcagcaatgggagccgtccagaggatggaacgactggacacaggtgcctttctgctctcaccactttcatgaactcgttatgaaagatggccgcgtgctggtcgtgccctgtcggaaccaggacgagctgatcgggagagcgcgcattagccagggcgccggatggtccctcaaggagaccgcttgcctgggcaagtcttatgcccaaatgtggacacttatgtacttccaccggagagatctgcgcctcgctgccaatgctatctgtagcgccgtcccctcccattgggtgcctaccagccggacgacatggtctattcacgcgaaacacgaatggatgaccaccgaggacatgctggccgtttggaacagagtgtggatccaggaaaatccgtggatggaggataagacacccgtcgaatcctgggaggaggtgccttatcttgggaaacgcgaagaccagtggtgcggaagcctgatcggcctcacctctcgggctacatgggccaagaacattcagacggccatcaatcaagtgagatccctgattgggaacgaggaatacaccgactatatgcccagcatgaaacggtttagacgcgaggaagaggaggctggagttctgtggtga

SEQ ID NO: 19835 - RNA, 9876 nt, synthetic construct
  misc_feature 1..9876: note = derived and/or modified CDS sequence (opt5) from DENV-2__EU482766__SS-prME
  source 1..9876: mol_type = other RNA
accgccggcgtgatcgtgatgctcattcccaccgctatggccttccacctcacgaccagaaatggggaacctcatatgatcgttggacggcaggaaaagggcaaaagcctgctttttaagacggaagacggggtgaatatgtgcaccctgatggcgattgatctcggagaactgtgtgaggacacaatcacctacaaatgcccgcttctgcgccaaaatgaacccgaggatattgactgttggtgcaattccacatctacctgggtgacgtatggcacctgtacaaccacaggggagcacagacgggaaaagcgcagcgtcgctctcgtgcctcatgttggaatgggcctggagaccagaacggaaacatggatgtcctctgagggcgcctggaaacacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaagaacaggacaaacgctttatctgcaagcattccatggtggatagaggctggggcaacgggtgtggactgttcggcaaaggcgggattgtcacatgcgccatgtttacgtgcaaaaagaatatggaagggaaagttgtgcagcctgagaacctcgaatacaccatcgtgattacaccccacagcggggaggagcatgcggtcggaaatgacaccggcaagcacggcaaagaaatcaagatcacacctcagtcttccattaccgaggccgaactgacggggtatggaaccgtgacaatggagtgtagctctcggaccggccttgatttcaacgaaatggttctgctccaaatggaggacaaggcttggctggtgcaccgccagtggtttcttgatctgcccctcccgtggctgcctggggccgacacacagggatccaattggatccagaaggagaccctggtcacgttcaagaacccccatgctaaaaagcaagacgtggttgtgctcggcagccaggaaggggccatgcacacagccctgaccggcgctacagagattcagatgtcctctggaaatcttctgtttaccggccatctcaaatgcagactgcggatggataaacttcaactgaaagggatgagctactccatgtgtaccggaaagttcaagatcgtcaaagaaattgcggagacacagcacggcacgatcgtgatcagagtccagtatgagggggacggaagcccttgcaagattcccttcgaaatcaccgatctcgagaaacgccatgtgctgggccggctgattacagttaaccccatcgtgaccgaaaaggactctcctgtcaacattgaggccgaaccgccctttggggattcctacatcattatcggcgtggagcctggacagctcaaactgaattggttcaagaagggcagctctatcgggcaaatgtttgagacaaccatgagaggagctaaacgcatggccattcttggcgacacggcctgggatttcgggagcctgggaggcgtttttacatccatcgggaaggctctccaccaggtgttcggcgccatttacggagcggctttttctggcgtcagctggaccatgaaaatcctgattggggtgatcatcacctggattggaatgaactcccggagcacatctctgtccgtgagccttgttctcgtcggcgtggtgaccctgtatctgggggccgtcgtgcaggccgactctggatgtgttgtgtcctggaagaataaagaactcaagtgcggcagcgggatcttcattacagataacgtccacacgtggaccgagcagtacaagtttcaacccgaatccccttctaaactggctagcgccatccagaaggctcatgaggaaggcatttgtggaatcagatccgtgacacgccttgagaatctgatgtggaaacagatcacccccgagctcaaccacattctgtctgaaaatgaggttaagctgacaatcatgaccggcgacattaaagggatcatgcaggccggaaagcggagccttagaccgcaacctacggaactcaaatattcctggaagacctggggcaaggcgaaaatgctgagcacagagtctcataaccagaccttcctgattgatgggcccgaaacagccgagtgccctaataccaaccgcgcttggaactccctcgaggtggaagactacggatttggcgtcttcacaaccaacatctggctgaaacttcgggagaaacaggacgtgttttgtgatagcaagctgatgtctgccgctatcaaagacaatagagccgttcacgcggatatgggctattggattgaatccgccctcaacgacacgtggaagatggagaaggctagcttcatcgaggtgaaatcttgccactggcccaagagccatacactgtggtccaatggggtcctggaaagcgagatgattatccctaaaaacttcgccggacccgtgtctcagcacaactaccgcccgggctatcatacccaaaccgctgggccttggcaccttggaaagctcgaaatggattttgacttctgtgagggcacaaccgtggtcgttacggaagattgcgggaatcggggaccctccctgagaacaaccacagccagcggcaaactgattaccgagtggtgctgtcggtcctgcacactgccccctctgcgctacagaggcgaggacgggtgttggtacggaatggaaatccggccgcttaaggagaaggaagagaacctggtcaattctctcgtgaccgccggccatgggcagattgataactttagcctgggagtcctgggcatggctcttttcctcgaagagatgctgagaacgcgcatcgggaccaaacacgcgatcctgctcgtggccgtttcctttgtgacactgattaccggaaatatgtctttccgggaccttggcagagtcatggtgatggttggcgctacaatgaccgatgacatcgggatgggagtgacgtatctggccctcctggccgcttttaaggtccgccccacattcgccgcgggcctgcttctgagaaaactcaccagcaaggagctgatgatggctacaattgggatcgccctcctgtcccagtctaccattcctgaaaccatccttgagctgacagatgccctcgctctgggaatgatggtgctgaaaatcgttcggaacatggaaaagtaccaacttgccgtgacgattatggcgatcagctgcgtccccaatgctgtgattctgcagaacgcctggaaggtgtcctgtaccatcctcgccgctgtcagcgtttctcctctgctcctgacatccagccagcagaaagccgactggattccccttgctctgaccatcaagggcctcaatcctacagccatctttctgaccacgctgtctcgcacatccaaaaagagaagctggccccttaacgaggcgattatggccgtggggatggtgtctatcctggcttccagcctcctgaaaaatgacattccgatgaccggacctctcgtcgccggcggcctgcttaccgtgtgctatgttctgacagggcggtccgctgatctggaactcgagcgcgccgccgacgtgaagtgggaggatcaagctgaaatcagcggatctagccccattctgtccatcaccatttctgaggacggcagcatgtccatcaaaaacgaagaggaggaacagacacttacgatcctgattagaaccgggctcctggtcatctctggagtgttccctgttagcattcccatcacagcggccgcttggtacctctgggaggtgaagaagcagcgggccggcgtcctgtgggatgtgccgtcccctccccctgtcgaaaaagccgagcttgaagacggggcttatcgcattaagcagagaggaatcctgggctactctcaaatcggcgccggggtgtataaagagggaacctttcacacaatgtggcatgttacccggggcgcggtgctgatgcaccgcgggaagagaattgagcccagctgggctgatgtcaaaaaggacctcatctcctacggaggcgggtggaagctggaaggagagtggaaagaaggcgaggaagtgcaggttcttgccctggagcccggcaagaatcctcgggccgtgcagacgaaaccggggattttcaagaccaacacaggaaccatcggcgctgtcagcctcgatttttctcccgggacatccggaagccctattgtggacagaaaaggcaaggtggttgggctgtacggaaatggcgtcgtgacccgctctggcgcctatgtgtccgcgatcgctcagacagaaaagagcatcgaagataaccccgagattgaagacgatatcttccggaaaaagagactcacgattatggacctgcatcctggggccggaaaaaccaagcgctaccttcccgccatcgtccgggaggctattaaaagaggcctgcgcacactgatcctcgcccctacccgggtggttgctgccgaaatggaggaggcgctgagagggcttccgattcgctatcaaacccccgccatcaagacagaacacacgggacgggagatcgtggacctgatgtgtcatgctaccttcacaatgagactcctgtcccctgtccgggtgcccaactacaatctcattatcatggatgaagcccactttaccgaccctgcttctattgccgcccgcggctatatcagcacaagagttgagatgggggaggctgcgggcattttcatgaccgccacgcccccgggatcccgggatccttttccccagagcaacgctcccatcatggacgaagaaagagaaatccctgagagatcttggaactccggccacgaatgggtgacagatttcaaggggaaaaccgtctggtttgtgcccagcattaaggccggaaacgacatcgccgcttgcctgcggaaaaatggcaagaaagttattcagctttctagaaagaccttcgatagcgagtacgtgaagacacgcgccaacgactgggattttgtcgtgaccacagacatctccgagatgggggcgaatttcaaagctgaacgggtgattgatcctagacgctgtatgaagccggtcatcctgaccgacggagaggaacgggttatcctggccggccccatgcctgtgacgcattctagcgccgctcaaagacgcgggcggattggcagaaaccccaaaaatgagaacgaccagtatatctacatgggagaacctctcgagaatgatgaggactgcgcccactggaaggaagcgaaaatgctgcttgataacattaatacacccgagggcatcattccgtccatgtttgaacctgagcgcgaaaaggtggacgccatcgatggggagtacagactgcggggagaggctcgcaaaaccttcgtcgacctcatgagacggggcgatctgcccgtgtggctggcctataaggttgctgccgaagggattaactacgctgaccgcaagtggtgttttgatggaatcaaaaataaccagatcctcgaggaaaacatggaggtggagatttggacaaaggaaggcgagcgcaagaaacttaaacctcggtggctggacgccagaatctattctgatcccctggcgctcaaggagttcaaggagttcgccgctgggcgcaaaagcctgacccttaatctgattacggaaatgggccggctccctacctttatgacacagaaggccagaaacgctctggacaatctggccgtcctccataccgccgaggctggaggccgcgcgtacaaccacgccctttccgagctgcccgaaacactggagaccctcctgcttctgacactcctggctaccgtgacagggggaatcttcctgtttctcatgagcggcaaagggattggaaagatgacacttggcatgtgctgcatcatcaccgcctctattctgctgtggtatgcccaaatccagccgcactggattgctgcctccatcattctcgagttctttctgatcgttcttctgatccctgagcccgaaaaacagcggacaccccaggataatcaactcacatacgtggtcattgcgatcctgaccgtggtcgccgctacaatggccaacgagatgggcttcctggagaagacgaagaaagacctcgggcttggaagcattaccacacaggaatccgagtctaatatcctggacattgatctgagacctgctagcgcctggaccctctatgcggtggccacaacctttgttacgccgatgctgcggcattccatcgaaaactctagcgtgaatgtgtcccttaccgctattgccaaccaggctacagtcctgatgggcctcgggaagggatggcccctgagcaaaatggacatcggcgttcctctgctcgccatcgggtgttactctcaggtgaatcccattacccttacagctgccctgctgctcctggtggcgcactacgccatcattggacctggccttcaagctaaggccacccgcgaggctcagaaaagagccgccgcgggcatcatgaagaaccccacggtcgatgggattacagtgatcgacctggaacctatcccgtatgatcccaagttcgagaaacagctcggacaggttatgctgctgattctctgcgtgacccaagtccttatgatgcggacaacctgggctctgtgtgaggccctgaccctcgctacaggccctatctccacgctgtgggaagggaatcccggacgcttttggaacaccacaattgccgtgagcatggccaatatcttcagaggctcttaccttgctggggccggactgctcttttccattatgaagaacaccacaagcacccggcgcggcacgggcaatatcggggagacactgggagaaaaatggaagtctagactgaacgcgctcggcaaaagcgagttccagatctataagaaatccgggattcaggaggtcgaccggacccttgccaaggaaggaatcaagcgcggcgagaccgatcatcacgctgtgtctagagggagcgccaaactgcggtggtttgttgaaagaaacatggtgacacctgagggaaaggtcgtggacctgggctgcggccgcgggggatggtcctactattgtggcgggctcaaaaatgttcgggaagtgaagggactgaccaaaggcgggcccggacatgaggagccgattcctatgagcacatacggctggaaccttgtcagactgcaatccggcgtggatgtgttcttcacgcctcccgaaaagtgcgacaccctcctgtgtgatatcggggagtctagccccaatcccacaattgaagctggacgcaccctgcgggttctcaaccttgtcgagaattggctgaacaataacacacagttttgcatcaaggtgctgaatccttatatgccgtccgtgatcgagaagatggaggccctccagagacagtacggcggggcgctggtccgcaaccccctttctcggaatagcacccacgagatgtactgggtttccaacgccacgggaaatattgtgtctagcgtgaacatgatctccagaatgctgattaatcgcttcaccatgaagcacaaaaaggctacatatgaacctgacgtcgatctcggcagcgggacccggaacatcggaattgagtctgaaatccccaacctggacattatcggcaaaagaatcgagaagattaagcaagaacatgagatctcctggcactacgaccaggatcatccttataaaacatgggcctaccacggcagctatgagaccaagcagacagggtctgcttccagcatggtgaatggagttgtgcgcctgctcaccaaaccctgggacgtcgtgccgatggttacgcagatggccatgacagataccaccccttttggccaacagcgggtgttcaaggaaaaagtcgacacaagaacgcaggagcccaaggaagggaccaagaaacttatgaagattacagctgagtggctgtggaaagagctgggaaagaaaaagacccctcgcatgtgtacaagagaagagtttacccggaaagtgcgctctaacgccgcgctcggcgccatcttcacagatgaaaataagtggaagtccgctagagaggccgtggaagacgggcggttttgggagctggtcgatagagagcggaaccttcacctggaaggaaaatgcgagacctgtgtttacaatatgatgggcaagcgcgagaagaagctcggcgagttcgggaaagctaagggaagcagagccatttggtatatgtggctgggcgcccggtttctggagttcgaggcgctcgggtttctgaacgaggaccattggttctcccgcggaaatagcctttctggcgtggaaggggagggcctgcacagactcggatacatcctgcgggatgtgggcaagaaagaagggggagctatgtacgccgacgatacggccggctgggacacccgcatcacacttgaggacctgaagaacgaagagatggtcaccaatcatatgaaaggggagcacaagaaactcgctgaagccatttttaagctgacatatcagaacaaggtggttagagtgcaacggcccacccctcgcggaacggtcatggatatcattagcagacgggaccagcgcggctccggacaggtgggcacatacggactgaataccttcacaaacatggaggctcaactcatcagacagatggaaggcgaggggattttcaaatctatccagcatctgaccgccacggaggaaatcgcggttcagaattggcttgcccgggtgggacgcgagagactgagccggatggctatttccggcgatgactgcgtcgtgaagcccatcgatgacagatttgcctctgctctcaccgccctgaacgatatggggaaagttcgcaaggacattcaacagtgggaaccgagccggggatggaatgattggacacaggtgcctttctgctcccaccactttcatgagcttgtcatgaaagacggcagagtgctggtcgtgccctgtcgcaaccaggatgaactcatcgggcgggcgagaatttctcaaggcgccggatggagcctgaaggagaccgcttgcctgggcaagtcctatgcccagatgtggacactcatgtacttccaccgccgggacctgagacttgctgccaacgctatctgtagcgccgttccctctcattgggtgcctacctcccgcacaacctggagcattcacgcgaaacacgagtggatgacgacagaagatatgctggccgtctggaatcgggtgtggatccaggagaacccgtggatggaagacaagacccccgtggagtcttgggaagaggttccttatctcgggaaaagagaggaccagtggtgcggatccctgatcggccttaccagccgcgctacatgggccaagaatattcaaaccgccatcaaccaggtgcggtccctgattgggaatgaagagtacacagattatatgccctctatgaaaagatttcggagagaagaggaagaggctggagtcctctggtga

SEQ ID NO: 19836 - RNA, 9876 nt, synthetic construct
  misc_feature 1..9876: note = derived and/or modified CDS sequence (opt5) from DENV-2__EU482695__SS-prME
  source 1..9876: mol_type = other RNA
accgccggcgtgatcgtcatgctgattcccacagctatggccttccacctcacgaccagaaatggggaacctcatatgatcgttggacggcaggaaaagggcaagagcctgctttttaagaccgaggacggggtgaatatgtgcaccctgatggcgattgatctcggagaactgtgtgaggacacaatcacctacaagtgcccccttctgcgccaaaatgaacccgaggatattgactgttggtgcaatagcacatctacctgggtgacgtatggcacctgtacaaccacaggggagcacagacgggaaaagcgcagcgtcgctctcgtgcctcatgttggaatgggcctggagaccagaacggaaacatggatgtcctctgagggcgcctggaaacacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaggaacaggacaaacgctttatctgcaagcattccatggtggatagaggctggggcaacgggtgtggactgttcggcaaagggggaattgtcacatgcgccatgtttacgtgcaaaaagaatatggaaggcaaagttgtgcagcctgagaacctcgaatacaccatcgtgattacaccccacagcggggaggagcatgcggtcggaaatgacaccggcaagcacggcaaagaaatcaagatcacacctcagtcttccattaccgaggccgaactgacggggtatggaaccgtgacaatggagtgtagcccccggaccggccttgatttcaacgaaatggttctgctccaaatggaggacaaggcttggctggtgcaccgccagtggtttcttgatctgccgctcccttggctgcccggggccgacacacagggatctaattggatccagaaggagaccctggtcacgttcaagaaccctcatgctaaaaagcaagacgtggttgtgctcggctcccaggaaggggccatgcacacagccctgaccggcgctacagagattcagatgagctccggaaatcttctgtttaccggccatctcaaatgcagactgcggatggataaacttcaactgaaagggatgtcttacagcatgtgtaccggaaagttcaagatcgtcaaagaaattgcggagacacagcacggcacgatcgtgatcagagtccagtatgagggggacggatccccctgcaagattcccttcgaaatcaccgatctcgagaaacgccatgtgctgggccggctgattacagttaaccctatcgtgaccgaaaaggacagcccggtcaacattgaggccgaacccccttttggggattcttacatcattatcggcgtggagcccggacagctcaaactgaattggttcaagaagggctccagcatcgggcaaatgtttgagacaaccatgagaggagctaaacgcatggccattcttggcgacacggcctgggatttcgggtctctgggaggcgtttttacaagcatcgggaaggctctccaccaggtgttcggcgccatttacggagcggctttttccggcgtctcttggaccatgaaaatcctgattggggtgatcatcacctggattggaatgaacagccggtccacaagcctgtctgtgtcccttgttctcgtcggcgtggtgaccctgtatctgggggccatggtccaggccgacagcggatgtgtggtttcttggaagaataaagaactcaagtgcggctccgggatcttcattacagataacgtgcacacgtggaccgagcagtacaagtttcaacctgaaagcccctccaaactggcttctgccatccagaaggctcatgaggaaggcatttgtggaatcagaagcgtcacacgccttgagaatctgatgtggaaacagatcaccccggagctcaaccacattctgtccgaaaatgaggtgaagctgacaatcatgaccggcgacattcgggggatcatgcaggccggaaaaagatctcttcgccctcaacccacggaactcaagtatagctggaaaacctggggcaaggcgaagatgctgtccacagagagccataaccagaccttcctgattgatgggcctgaaacagccgagtgccccaataccaaccgggcttggaactctctcgaggttgaagactacggatttggcgtgttcacaaccaacatctggctgaaacttagagagaagcaggacgtcttttgtgattccaaactgatgagcgccgctatcaaggacaatcgcgccgtgcacgcggatatgggctattggattgaatctgccctcaacgacacgtggaaaatggagaaggcttccttcatcgaggttaagagctgccactggcctaaatctcatacactgtggagcaatggggtgctggaatccgagatgattatccccaagaacttcgccggaccggtcagccagcacaactaccggcctggctatcatacccaaaccgctgggccctggcaccttggaaaactcgaaatggattttgacctgtgtgagggcacaaccgtggtggtcacggaagattgcgggaatagaggaccctctctgcggacaaccacagcctccggcaagctcattaccgagtggtgctgtcgcagctgcacactgcctccgcttagataccggggcgaggacgggtgttggtacggaatggaaatcagacccctgaaagagaaggaagagaacctcgttaattccctggtgaccgccggccatgggcagattgataacttctctctgggagtgcttggcatggctctctttctggaagagatgctgcgcacgcggatcgggaccaagcacgcgatcctcctggtcgccgtgagcttcgttacacttattaccggaaatatgtcctttagagacctgggccgcgtgatggtcatggtgggcgctacaatgaccgatgacatcgggatgggagttacgtatctcgccctgctggccgctttcaaagtgagacctacatttgccgcgggccttctgctccggaagctgacctctaaagagctcatgatggctacaattgggatcgccctgcttagccagtccaccattcccgaaaccatcctggagctcacagatgccctggctctgggaatgatggtccttaagatcgtgcgcaacatggaaaaataccaactggccgttacgattatggcgatctcttgcgtgcctaatgctgtcattctccagaacgcctggaaggtgagctgtaccatcctggccgctgtgtccgtcagccccctcctgcttacatcttcccagcagaaggccgactggattcctctggctctcaccatcaaaggcctgaatcccacagccatcttcctgaccacgcttagcagaacatctaagaaacggtcctggccgctgaacgaggcgattatggccgttgggatggtgagcatcctcgcttcttccctgctcaagaatgacattcctatgaccggacccctggtggccggcggccttctgaccgtctgctatgtgctgacagggcgcagcgctgatctcgaactggagagagccgccgacgttaaatgggaggatcaagctgaaatctccggaagctctcctattcttagcatcaccatttccgaggacggctctatgagcatcaagaacgaagaggaggaacagacactgacgatcctcattcggaccgggctgctcgtgatctccggagtctttcccgtgtctattccgatcacagcggccgcttggtacctgtgggaggttaaaaagcagcgcgccggcgtgctttgggatgtcccttctccccctcccgtggaaaaggccgagctggaagacggggcttatagaattaaacagcggggaatcctgggctactcccaaatcggcgccggggtctataaggagggaaccttccacacaatgtggcatgtgacccgcggcgcggttctcatgcacagagggaaacggattgagccctcctgggctgatgtgaagaaagacctgatcagctacggaggcgggtggaaacttgaaggagagtggaaggaaggcgaggaagtccaggtgctggccctcgagcctggcaaaaatccgagagccgttcagacgaagcccgggatttttaaaaccaacacaggaaccatcggcgctgtgtccctggatttcagccctgggacatctggatcccccattgtcgaccgcaagggcaaagtggtggggctctacggaaatggcgttgtcacccggagcggcgcctatgtgtctgcgatcgctcagacagagaagtccatcgaagataaccctgagattgaagacgatatctttagaaagaaacgcctgacgattatggaccttcatcccggggccggaaagaccaaacggtacctgcctgccatcgtgagagaggctattaagcgcggcctgcggacactcatcctggccccgaccagagtcgtggctgccgaaatggaggaggcgcttcgcgggctgcccattcggtatcaaaccacagccatcaaaacggaacacaccggaagagagatcgttgacctcatgtgtcatgctacattcaccatgcggctgctcagccctgtgcgcgtccccaactacaatctgattatcatggatgaagcccacttcacagaccctgcttccattgccgccagaggctatatctctacccgggtggagatgggggaggctgcgggcatttttatgacggccacacccccgggaagccgcgatcctttcccccagtccaacgctcccatcatggacgaagagagagaaatccctgagcggagctggaactctggccacgaatgggttaccgattttaaggggaagaccgtgtggttcgtcccctccattaaagccggaaacgacatcgccgcttgccttagaaagaatggcaaaaaggtgattcagctgagccgcaaaacatttgattctgagtacgttaagacccgggccaacgactgggatttcgtggtcacaaccgacatcagcgagatgggggcgaattttaaggctgaaagagtgattgatcctcgccggtgtatgaaaccggtgatcctgacggacggagaggaaagagtcatcctcgccggccccatgcctgttacacattcctctgccgctcaacgccgggggagaattggccgcaaccccaagaatgagaacgaccagtatatctacatgggagaacctctggagaatgatgaggactgcgcccactggaaagaagcgaagatgcttctggataacattaatacccccgagggcatcattccgagcatgttcgaacctgagagagaaaaagtggacgccatcgatggggagtaccggctccgcggagaggctagaaagacatttgtggacctgatgcggcgcggcgatctgcccgtctggctcgcctataaagtggctgccgaagggattaactacgctgacagaaagtggtgtttcgatggaatcaagaataaccagatccttgaggaaaacatggaggttgagatttggaccaaagaaggcgagcggaagaaactgaagcctagatggctggacgcccgcatctattccgatcccctcgcgctgaaagaatttaaggagttcgccgctgggcggaagtctcttacgctgaatctcattaccgaaatgggcagactgcctacattcatgacccagaaagcccgcaacgctctggacaatctcgccgtgcttcatacagccgaggctggaggccgggcgtacaaccacgccctgagcgagctgcccgaaaccctcgagacactgcttctgctcaccctgctggctacggtcacagggggaatctttctcttccttatgtccggcaaggggattggaaaaatgaccctgggcatgtgctgcatcatcaccgccagcattctgctctggtatgcccaaatccagccgcactggattgctgcctctatcattctggaatttttccttatcgtgctgctcatccctgagcccgaaaagcagagaacaccccaggataatcaactgacctacgttgtgattgcgatcctgacagtcgtggccgctacgatggccaacgagatgggctttctcgagaaaaccaagaaggaccttgggctgggatccattacaacccaggaaagcgagtccaatatcctggacattgatctccggcctgcttctgcctggacactgtatgcggtcgccaccacgttcgtgaccccgatgcttcgccatagcatcgaaaactcctctgttaatgtgagcctgacagctattgccaaccaggctaccgtgctcatgggcctggggaaaggatggcccctgtccaagatggacatcggcgtccctctccttgccatcgggtgttacagccaggttaatcccattacactgaccgctgccctgctcctgcttgtggcgcactacgccatcattggacctggcctgcaagctaaagccacgagagaggctcagaagcgggccgccgcgggcatcatgaaaaaccccacagtggatgggattaccgtcatcgacctcgaacctatcccgtatgatcccaagtttgagaagcagctgggacaggtgatgctgctcattctttgcgttacacaagtgctgatgatgcgcaccacctgggctctgtgtgaggccctcacactggctacgggccctatctctaccctttgggaagggaatcccggaagattctggaacacaaccattgccgtctccatggccaatatctttcggggcagctacctggctggggccggactcctgttctctattatgaaaaacacaaccaatacgcgcagaggcacaggcaacatcggggagaccctgggagaaaagtggaaatcccggctcaacgcgcttggcaagagcgagtttcagatctataaaaagtctgggattcaggaggtggaccgcaccctggccaaagaaggaatcaagagaggcgagacagatcatcacgctgtcagccgggggtccgccaagctgagatggttcgtggaacgcaatatggttacccctgagggaaaagtggtcgacctcggctgcggcagagggggatggtcttactattgtggcgggctgaagaacgtgcgggaagttaaaggacttacaaagggcgggcccggacatgaggagccgattcctatgagcacgtacggctggaatctggtgcgcctccaatccggcgtcgatgtgtttttcacaccgcccgaaaaatgcgacacactgctgtgtgatatcggggagagctcccctaaccccaccattgaagctggacggacactcagagtgcttaatctggttgagaactggctgaataacaatacccagttctgcatcaaggtcctcaacccttatatgccgtctgtgatcgaaaagatggaggccctgcagcgcaaatacggcggggcgcttgtgcggaatcccctgagcagaaactccacgcacgagatgtactgggtctctaatgccaccggaaacattgttagctccgtgaatatgatctctcgcatgctcattaaccggtttacaatgaagcacaaaaaggctacctatgaacctgacgtggatctgggcagcgggacaagaaacatcggaattgagtccgaaatccccaatctggacattatcggcaaacgcatcgagaagattaagcaggaacatgagaccagctggcactacgaccaagatcatccttataaaacatgggcctaccacggctcttatgagaccaagcagacggggtccgctagctctatggtcaacggagtggttcggctccttacaaaaccctgggacgtggtcccgatggtgacccagatggccatgaccgatacaacgcctttcggccagcaaagagtttttaaggaaaaagtggacacccgcacacaggagcccaaggaagggaccaagaaactgatgaagatcacagctgagtggctgtggaaagagctcggaaagaaaaagacccctagaatgtgtacacgggaagagttcacccgcaaagtcagatccaatgccgcgctgggcgccatttttacggatgaaaacaagtggaaaagcgctcgggaggccgtggaagacgggagattctgggagcttgtggatcgggagcgcaatctgcacctcgaaggaaaatgcgagacctgtgtctacaacatgatgggcaagagagagaagaagctgggcgagtttgggaaagctaagggatctcgggccatctggtatatgtggctgggcgcccgcttcctcgaatttgaggcgctggggttccttaatgaggaccattggttttccagaggaaacagcctgtccggcgttgaaggggagggcctccaccggctgggatacattcttcgcgatgtgggcaagaaagaagggggagctatgtacgccgacgatacagccggctgggacaccagaatcacactggaggacctcaagaatgaagagatggtgaccaaccatatgaaaggggagcacaagaaactggctgaagccatcttcaagctgacgtatcagaataaggtcgtgcgggttcagcgccccacacctagaggaaccgtgatggatattatcagccggcgcgaccaaagaggctctgggcaggtcggcacatacggactcaacacctttacgaatatggaggctcagctgattcggcaaatggaaggcgaggggatcttcaaaagcattcagcatcttaccgccacagaggaaatcgcggtgcagaactggctggcccgcgttggaagagagcggctctccagaatggctatctctggcgatgactgcgtggtcaagcccattgatgaccgcttcgccagcgctctgaccgcccttaatgatatggggaaagtgcggaaggacatccagcaatgggaaccgtccagaggatggaacgattggacacaggttcctttttgctctcaccacttccatgagctggtgatgaaagacggccgcgtcctcgtggtcccctgtcggaaccaggatgaactgattgggagagcgcgcatcagccagggcgccggatggtccctgaaggagaccgcttgcctcggcaagtcttatgcccaaatgtggacactgatgtactttcaccggagagaccttcgcctggctgccaatgctatttgtagcgccgtgccctcccattgggttcctaccagccggacgacatggtctatccacgcgaaacacgagtggatgaccaccgaagatatgctcgccgtgtggaacagagtctggattcaggagaatccgtggatggaagacaagacacccgtggagtcctgggaagaggtgccttatctggggaaacgcgaggaccagtggtgcggaagccttatcggcctgacctctcgggctacatgggccaagaacatccagacggccattaatcaagttagatccctcatcgggaacgaagagtacaccgattatatgcccagcatgaaacggttcagacgcgaagaggaagaggctggagtgctgtggtga

SEQ ID NO: 19837 - RNA, 9876 nt, synthetic construct
  misc_feature 1..9876: note = derived and/or modified CDS sequence (opt5) from DENV-2__EU482769__SS-prME
  source 1..9876: mol_type = other RNA
accgccggcgtgatcgtcatgctgattcccacagctatggccttccacctcacgaccagaaatggggaacctcatatgatcgttggacggcaggaaaagggcaagagcctgctttttaagaccgaggacggggtgaatatgtgcaccctgatggcgattgatctcggagaactgtgtgaggacacaatcacctacaagtgcccccttctgcgccaaaatgaacccgaggatattgactgttggtgcaatagcacatctacctgggtgacgtatggcacctgtacaaccacaggggagcacagacgggaaaagcgcagcgtcgctctcgtgcctcatgttggaatgggcctggagaccagaacggaaacatggatgtcctctgagggcgcctggaaacacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaggaacaggacaaacgctttatctgcaagcattccatggtggatagaggctggggcaacgggtgtggactgttcggcaaagggggaattgtcacatgcgccatgtttacgtgcaaaaagaatatggaaggcaaagttgtgcagcctgagaacctcgaatacaccatcgtgattacaccccacagcggggaggagcatgcggtcggaaatgacaccggcaagcacggcaaagaaatcaagatcacacctcagtcttccattaccgaggccgaactgacggggtatggaaccgtgacaatggagtgtagcccccggaccggccttgatttcaacgaaatggttctgctccaaatggaggacaaggcttggctggtgcaccgccagtggtttcttgatctgccgctcccttggctgcccggggccgacacacagggatctaattggatccagaaggagaccctggtcacgttcaagaaccctcatgctaaaaagcaagacgtggttgtgctcggctcccaggaaggggccatgcacacagccctgaccggcgctacagagattcagatgagctccggaaatcttctgtttaccggccatctcaaatgcagactgcggatggataaacttcaactgaaagggatgtcttacagcatgtgtaccggaaagttcaagatcgtcaaagaaattgcggagacacagcacggcacgatcgtgatcagagtccagtatgagggggacggatccccctgcaagattcccttcgaaatcaccgatctcgagaaacgccatgtgctgggccggctgattacagttaaccctatcgtgaccgaaaaggacagcccggtcaacattgaggccgaacccccttttggggattcttacatcattatcggcgtggagcccggacagctcaaactgaattggttcaagaagggctccagcatcgggcaaatgtttgagacaaccatgagaggagctaaacgcatggccattcttggcgacacggcctgggatttcgggtctctgggaggcgtttttacaagcatcgggaaggctctccaccaggtgttcggcgccatttacggagcggctttttccggcgtctcttggaccatgaaaatcctgattggggtgatcatcacctggattggaatgaacagccggtccacaagcctgtctgtgtcccttgttctcgtcggcgtggtgaccctgtatctgggggccatggtccaggccgacagcggatgtgtggtttcttggaagaataaagaactcaagtgcggctccgggatcttcattacagataacgtgcacacgtggaccgagcagtacaagtttcaacctgaaagcccctccaaactggcttctgccatccagaaggctcatgaggaaggcatttgtggaatcagaagcgtcacacgccttgagaatctgatgtggaaacagatcaccccggagctcaaccacattctgtccgaaaatgaggtgaagctgacaatcatgaccggcgacattcgggggatcatgcaggccggaaaaagatctcttcgccctcaacccacggaactcaagtatagctggaaaacctggggcaaggcgaagatgctgtccacagagagccataaccagaccttcctgattgatgggcctgaaacagccgagtgccccaataccaaccgggcttggaactctctcgaggttgaagactacggatttggcgtgttcacaaccaacatctggctgaaacttagagagaagcaggacgtcttttgtgattccaaactgatgagcgccgctatcaaggacaatcgcgccgtgcacgcggatatgggctattggattgaatctgccctcaacgacacgtggaaaatggagaaggcttccttcatcgaggttaagagctgccactggcctaaatctcatacactgtggagcaatggggtgctggaatccgagatgattatccccaagaacttcgccggaccggtcagccagcacaactaccggcctggctatcatacccaaaccgctgggccctggcaccttggaaaactcgaaatggattttgacctgtgtgagggcacaaccgtggtggtcacggaagattgcgggaatagaggaccctctctgcggacaaccacagcctccggcaagctcattaccgagtggtgctgtcgcagctgcacactgcctccgcttagataccggggcgaggacgggtgttggtacggaatggaaatcagacccctgaaagagaaggaagagaacctcgttaattccctggtgaccgccggccatgggcagattgataacttctctctgggagtgcttggcatggctctctttctggaagagatgctgcgcacgcggatcgggaccaagcacgcgatcctcctggtcgccgtgagcttcgttacacttattaccggaaatatgtcctttagagacctgggccgcgtgatggtcatggtgggcgctacaatgaccgatgacatcgggatgggagttacgtatctcgccctgctggccgctttcaaagtgagacctacatttgccgcgggccttctgctccggaagctgacctctaaagagctcatgatggctacaattgggatcgccctgcttagccagtccaccattcccgaaaccatcctggagctcacagatgccctggctctgggaatgatggtccttaagatcgtgcgcaacatggaaaaataccaactggccgttacgattatggcgatctcttgcgtgcctaatgctgtcattctccagaacgcctggaaggtgagctgtaccatcctggccgctgtgtccgtcagccccctcctgcttacatcttcccagcagaaggccgactggattcctctggctctcaccatcaaaggcctgaatcccacagccatcttcctgaccacgcttagcagaacatctaagaaacggtcctggccgctgaacgaggcgattatggccgttgggatggtgagcatcctcgcttcttccctgctcaagaatgacattcctatgaccggacccctggtggccggcggccttctgaccgtctgctatgtgctgacagggcgcagcgctgatctcgaactggagagagccgccgacgttaaatgggaggatcaagctgaaatctccggaagctctcctattcttagcatcaccatttccgaggacggctctatgagcatcaagaacgaagaggaggaacagacactgacgatcctcattcggaccgggctgctcgtgatctccggagtctttcccgtgtctattccgatcacagcggccgcttggtacctgtgggaggttaaaaagcagcgcgccggcgtgctttgggatgtcccttctccccctcccgtggaaaaggccgagctggaagacggggcttatagaattaaacagcggggaatcctgggctactcccaaatcggcgccggggtctataaggagggaaccttccacacaatgtggcatgtgacccgcggcgcggttctcatgcacagagggaaacggattgagccctcctgggctgatgtgaagaaagacctgatcagctacggaggcgggtggaaacttgaaggagagtggaaggaaggcgaggaagtccaggtgctggccctcgagcctggcaaaaatccgagagccgttcagacgaagcccgggatttttaaaaccaacacaggaaccatcggcgctgtgtccctggatttcagccctgggacatctggatcccccattgtcgaccgcaagggcaaagtggtggggctctacggaaatggcgttgtcacccggagcggcgcctatgtgtctgcgatcgctcagacagagaagtccatcgaagataaccctgagattgaagacgatatctttagaaagaaacgcctgacgattatggaccttcatcccggggccggaaagaccaaacggtacctgcctgccatcgtgagagaggctattaagcgcggcctgcggacactcatcctggccccgaccagagtcgtggctgccgaaatggaggaggcgcttcgcgggctgcccattcggtatcaaaccacagccatcaaaacggaacacaccggaagagagatcgttgacctcatgtgtcatgctacattcaccatgcggctgctcagccctgtgcgcgtccccaactacaatctgattatcatggatgaagcccacttcacagaccctgcttccattgccgccagaggctatatctctacccgggtggagatgggggaggctgcgggcatttttatgacggccacacccccgggaagccgcgatcctttcccccagtccaacgctcccatcatggacgaagagagagaaatccctgagcggagctggaactctggccacgaatgggttaccgattttaaggggaagaccgtgtggttcgtcccctccattaaagccggaaacgacatcgccgcttgccttagaaagaatggcaaaaaggtgattcagctgagccgcaaaacatttgattctgagtacgttaagacccgggccaacgactgggatttcgtggtcacaaccgacatcagcgagatgggggcgaattttaaggctgaaagagtgattgatcctcgccggtgtatgaaaccggtgatcctgacggacggagaggaaagagtcatcctcgccggccccatgcctgttacacattcctctgccgctcaacgccgggggagaattggccgcaaccccaagaatgagaacgaccagtatatctacatgggagaacctctggagaatgatgaggactgcgcccactggaaagaagcgaagatgcttctggataacattaatacccccgagggcatcattccgagcatgttcgaacctgagagagaaaaagtggacgccatcgatggggagtaccggctccgcggagaggctagaaagacatttgtggacctgatgcggcgcggcgatctgcccgtctggctcgcctataaagtggctgccgaagggattaactacgctgacagaaagtggtgtttcgatggaatcaagaataaccagatccttgaggaaaacatggaggttgagatttggaccaaagaaggcgagcggaagaaactgaagcctagatggctggacgcccgcatctattccgatcccctcgcgctgaaagaatttaaggagttcgccgctgggcggaagtctcttacgctgaatctcattaccgaaatgggcagactgcctacattcatgacccagaaagcccgcaacgctctggacaatctcgccgtgcttcatacagccgaggctggaggccgggcgtacaaccacgccctgagcgagctgcccgaaaccctcgagacactgcttctgctcaccctgctggctacggtcacagggggaatctttctcttccttatgtccggcaaggggattggaaaaatgaccctgggcatgtgctgcatcatcaccgccagcattctgctctggtatgcccaaatccagccgcactggattgctgcctctatcattctggaatttttccttatcgtgctgctcatccctgagcccgaaaagcagagaacaccccaggataatcaactgacctacgttgtgattgcgatcctgacagtcgtggccgctacgatggccaacgagatgggctttctcgagaaaaccaagaaggaccttgggctgggatccattacaacccaggaaagcgagtccaatatcctggacattgatctccggcctgcttctgcctggacactgtatgcggtcgccaccacgttcgtgaccccgatgcttcgccatagcatcgaaaactcctctgttaatgtgagcctgacagctattgccaaccaggctaccgtgctcatgggcctggggaaaggatggcccctgtccaagatggacatcggcgtccctctccttgccatcgggtgttacagccaggttaatcccattacactgaccgctgccctgctcctgcttgtggcgcactacgccatcattggacctggcctgcaagctaaagccacgagagaggctcagaagcgggccgccgcgggcatcatgaaaaaccccacagtggatgggattaccgtcatcgacctcgaacctatcccgtatgatcccaagtttgagaagcagctgggacaggtgatgctgctcattctttgcgttacacaagtgctgatgatgcgcaccacctgggctctgtgtgaggccctcacactggctacgggccctatctctaccctttgggaagggaatcccggaagattctggaacacaaccattgccgtctccatggccaatatctttcggggcagctacctggctggggccggactcctgttctctattatgaaaaacacaaccaatacgcgcagaggcacaggcaacatcggggagaccctgggagaaaagtggaaatcccggctcaacgcgcttggcaagagcgagtttcagatctataaaaagtctgggattcaggaggtggaccgcaccctggccaaagaaggaatcaagagaggcgagacagatcatcacgctgtcagccgggggtccgccaagctgagatggttcgtggaacgcaatatggttacccctgagggaaaagtggtcgacctcggctgcggcagagggggatggtcttactattgtggcgggctgaagaacgtgcgggaagttaaaggacttacaaagggcgggcccggacatgaggagccgattcctatgagcacgtacggctggaatctggtgcgcctccaatccggcgtcgatgtgtttttcacaccgcccgaaaaatgcgacacactgctgtgtgatatcggggagagctcccctaaccccaccattgaagctggacggacactcagagtgcttaatctggttgagaactggctgaataacaatacccagttctgcatcaaggtcctcaacccttatatgccgtctgtgatcgaaaagatggaggccctgcagcgcaaatacggcggggcgcttgtgcggaatcccctgagcagaaactccacgcacgagatgtactgggtctctaatgccaccggaaacattgttagctccgtgaatatgatctctcgcatgctcattaaccggtttacaatgaagcacaaaaaggctacctatgaacctgacgtggatctgggcagcgggacaagaaacatcggaattgagtccgaaatccccaatctggacattatcggcaaacgcatcgagaagattaagcaggaacatgagaccagctggcactacgaccaagatcatccttataaaacatgggcctaccacggctcttatgagaccaagcagacggggtccgctagctctatggtcaacggagtggttcggctccttacaaaaccctgggacgtggtcccgatggtgacccagatggccatgaccgatacaacgcctttcggccagcaaagagtttttaaggaaaaagtggacacccgcacacaggagcccaaggaagggaccaagaaactgatgaagatcacagctgagtggctgtggaaagagctcggaaagaaaaagacccctagaatgtgtacacgggaagagttcacccgcaaagtcagatccaatgccgcgctgggcgccatttttacggatgaaaacaagtggaaaagcgctcgggaggccgtggaagacgggagattctgggagcttgtggatcgggagcgcaatctgcacctcgaaggaaaatgcgagacctgtgtctacaacatgatgggcaagagagagaagaagctgggcgagtttgggaaagctaagggatctcgggccatctggtatatgtggctgggcgcccgcttcctcgaatttgaggcgctggggttccttaatgaggaccattggttttccagaggaaacagcctgtccggcgttgaaggggagggcctccaccggctgggatacattcttcgcgatgtgggcaagaaagaagggggagctatgtacgccgacgatacagccggctgggacaccagaatcacactggaggacctcaagaatgaagagatggtgaccaaccatatgaaaggggagcacaagaaactggctgaagccatcttcaagctgacgtatcagaataaggtcgtgcgggttcagcgccccacacctagaggaaccgtgatggatattatcagccggcgcgaccaaagaggctctgggcaggtcggcacatacggactcaacacctttacgaatatggaggctcagctgattcggcaaatggaaggcgaggggatcttcaaaagcattcagcatcttaccgccacagaggaaatcgcggtgcagaactggctggcccgcgttggaagagagcggctctccagaatggctatctctggcgatgactgcgtggtcaagcccattgatgaccgcttcgccagcgctctgaccgcccttaatgatatggggaaagtgcggaaggacatccagcaatgggaaccgtccagaggatggaacgattggacacaggttcctttttgctctcaccacttccatgagctggtgatgaaagacggccgcgtcctcgtggtcccctgtcggaaccaggatgaactgattgggagagcgcgcatcagccagggcgccggatggtccctgaaggagaccgcttgcctcggcaagtcttatgcccaaatgtggacactgatgtactttcaccggagagaccttcgcctggctgccaatgctatttgtagcgccgtgccctcccattgggttcctaccagccggacgacatggtctatccacgcgaaacacgagtggatgaccaccgaagatatgctcgccgtgtggaacagagtctggattcaggagaatccgtggatggaagacaagacacccgtggagtcctgggaagaggtgccttatctggggaaacgcgaggaccagtggtgcggaagcatgatcggccttacctctcgggctacatgggccaagaacatccagacggccattaatcaagttagatccctgatcgggaacgaagagtacattgattatatgcccagcatgaaacggttcagacgcgaagaggaagaggctggagtgctctggtga

SEQ ID NO: 19838 - RNA, 9876 nt, synthetic construct
  misc_feature 1..9876: note = derived and/or modified CDS sequence (opt5) from DENV-2__EU482696__SS-prME
  source 1..9876: mol_type = other RNA
accgccggagtgatcgtcatgctgattcccacagctatggccttccacctcacgacccggaatggggagcctcatatgatcgttggacggcaggaaaagggcaaaagcctgctttttaagacagaggacggggtgaatatgtgcaccctgatggcgattgatctcggagaactgtgtgaggacacaatcacctacaaatgcccgcttctgcgccaaaatgaacccgaggatattgactgttggtgcaatagcacatctacctgggtgacgtatggcacctgtacaaccacaggggagcacagacgggaaaagcgcagcgtcgctctcgtgcctcatgttggaatgggcctggagaccagaacggaaacatggatgtcctctgagggcgcctggaaacacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaagaacaggacaaacgctttatctgcaagcattccatggtggatagaggctggggcaacgggtgtggactgttcggcaaagggggaattgtcacatgcgccatgtttacgtgcaaaaagaatatggaaggcaaagttgtgcagcctgagaacctcgaatacaccatcgtgattacaccccacagcggggaggagcatgcggtcggaaatgacaccggcaagcacggcaaagaaatcaagatcacacctcagtcttccattaccgaggccgaactgacggggtatggaaccgtgacaatggagtgtagcccccggaccggccttgatttcaacgaaatggttctgctccaaatggaggacaaggcttggctggtgcaccgccagtggtttcttgatctgccgctcccttggctgcccggggccgacacacagggatctaattggatccagaaggagaccctggtcacgttcaagaaccctcatgctaaaaagcaagacgtggttgtgctcggctcccaggaaggggccatgcacacagccctgaccggcgctacagagattcagatgagctccggaaatcttctgtttaccggccatctcaaatgcagactgcggatggataaacttcaactgaaagggatgtcttacagcatgtgtaccggaaagttcaagatcgtcaaagaaattgcggagacacagcacggcacgatcgtgatcagagtccagtatgagggggacggatccccctgcaagattcccttcgaaatcaccgatctcgagaaacgccatgtgctgggccggctgattacagttaaccctatcgtgaccgaaaaggacagcccggtcaacattgaggccgaacccccttttggggattcttacatcattatcggcgtggagcccggacagctcaaactgaattggttcaagaagggctccagcatcgggcaaatgtttgagacaaccatgagaggagctaaacgcatggccattcttggcgacacggcctgggatttcgggtctctgggaggcgtttttacaagcatcgggaaggctctccaccaggtgttcggcgccatttacggagcggctttttccggcgtctcttggaccatgaaaatcctgattggggtgatcatcacctggattggaatgaacagccggtccacaagcctgtctgtgtcccttgttctcgtcggcgtggtgaccctgtatctgggggccatggtccaggccgacagcggatgtgtggcttcttggaagaataaagaactcaagtgcggctccgggatcttcattacagataacgttcacacgtggaccgagcagtacaagtttcaacctgaaagcccctccaaactggcctctgctatccagaaggcccatgaggaaggcatttgtggaatcagaagcgtgacacgccttgagaatctgatgtggaaacagatcaccccggagctcaaccacattctgtccgaaaatgaggtcaagctgacaatcatgaccggcgacattaaagggatcatgcaggcgggaaagcggtctcttagacctcaacccacggaactcaaatatagctggaagacctggggcaaggccaaaatgctgtccacagagagccataaccagaccttcctgattgatgggcctgaaacagctgagtgccccaataccaaccgcgcctggaactctctcgaggtggaagactacggatttggcgttttcacaaccaacatctggctgaaacttcgggagaaacaggacgtgttttgtgattccaagctgatgagcgctgccatcaaagacaatagagcggtccacgccgatatgggctattggattgaatctgctctcaacgacacgtggaagatggagaaggcctccttcatcgaggtgaaaagctgccactggcctaagtctcatacactgtggagcaatggggttctggaatccgagatgattatccccaaaaacttcgctggaccggtgagccagcacaactaccgccctggctatcatacccaaaccgccgggccctggcaccttggaaagctcgaaatggattttgacctgtgtgagggcacaaccgtcgtggtgacggaagattgcgggaatcggggaccctctctgagaacaaccacagcctccggcaaactcattaccgagtggtgctgtcggagctgcacactgcctccgcttcgctacagaggcgaggacgggtgttggtacggaatggaaatccggcccctgaaggagaaggaagagaacctcgtcaattccctggttaccgctggccatgggcagattgataacttctctctgggagtgcttggcatggcgctctttctggaagagatgctgagaacgcgcatcgggaccaaacacgccacactcctggtggctgtcagcttcgtgacccttatcacaggaaatatgtcctttcgggacctgggcagagttatggtgatggtcggcgccaccatgacggatgacattgggatgggagtgacatatctcgccctgctggctgccttcaaggttcgccctacctttgcggctggccttctgctcagaaaactgacatctaaggagctcatgatggccaccatcgggattgccctgcttagccagtccaccatccccgaaacaattctggagctcacggatgctctggccctgggaatgatggtgcttaaaatcgtccggaacatggaaaagtaccaactggcggtgaccatcatggctatttcttgcgttcctaatgccgtgatcctccagaacgcctggaaggtcagctgtacaattctggctgccgtgtccgtgagccccctcctgcttacctcttcccagcagaaagctgactggatccctctggccctcacaattaagggcctgaatcccaccgcgatcttcctgacgacacttagccgcacctctaaaaagagatcctggccgctgaacgaggccatcatggctgtcgggatggttagcattctcgcctcttccctgctcaaaaatgacatccctatgaccggacccctggtggctggcggccttctgacagtgtgctatgtcctgaccgggcggagcgccgatctcgaactggagcgcgccgctgacgtgaagtgggaggatcaagcggaaatttccggaagctctcctatccttagcattacaatctccgaggacggctctatgagcattaaaaacgaagaggaggaacagacgctgaccatcctcatcagaacagggctgctcgttatttccggagtgtttcccgtctctatcccgattaccgccgctgcctggtacctgtgggaggtgaagaagcagcgggccggcgttctttgggatgtgccttctccccctcccgtcgaaaaagctgagctggaagacggggcctatcgcatcaagcagagaggcattctgggatactcccaaatcggcgcgggggtgtataaagagggaacattccacaccatgtggcatgtcacgcggggcgctgtgctcatgcaccgcgggaagagaatcgagccctcctgggccgatgttaaaaaggacctgattagctacggaggcgggtggaaacttgaaggagagtggaaagaaggcgaggaagtgcaggtcctggccctcgagcctggcaagaatccgcgggctgtgcagaccaaacccgggacatttaagaccaacacaggaaccatcggcgccgtttccctggatttcagccctgggacatctggatcccccattgtggacagaaaaggcaaggtcgtggggctctacggaaatggcgtggttacgcgcagcggcgcgtatgtctctgctatcgcccagaccgagaagtccattgaagataaccctgagatcgaagacgatatctttcggaaaaagagactgacaattatggaccttcatcccggggccggaaaaaccaagcgctacctgcctgctatcgtgcgggaggccattaaaagaggcctgcgcaccctcatcctggctccgacacgggtggtcgccgcggaaatggaggaggcccttagagggctgcccattcgctatcaaacgcctgctatcaagaccgaacacacaggacgggagattgtggacctcatgtgtcatgccaccttcacaatgagactgctcagccccgttcgggtgcctaactacaatctgatcatcatggatgaagctcacttcaccgaccccgcctccattgccgctcgcggctatatctctacgagagtcgagatgggggaggcggccggcatttttatgacagctaccccgcctggaagccgggatcccttcccccagtccaacgcccctatcatggacgaagagagagaaattcccgagagaagctggaactctggccacgaatgggtgaccgattttaaggggaaaacagtttggttcgtgccttccatcaaggccggaaacgacatcgctgcctgccttcggaaaaatggcaagaaagtcattcagctgagcagaaagacctttgattctgagtacgtgaagacacgcgcgaacgactgggatttcgttgtgaccacggacatcagcgagatgggggctaattttaaagccgaacgggtcattgatccgagacgctgtatgaagcccgtgatcctgacagacggagaggaacgggtgattctcgccggccctatgcccgtcacccattcctctgctgcccaaagacgcgggcggatcggcagaaaccctaaaaatgagaacgaccagtatatctacatgggagaacccctggagaatgatgaggactgcgcgcactggaaggaagccaaaatgcttctggataacattaatacaccggagggcatcattcctagcatgttcgaacccgagcgcgaaaaggttgacgctatcgatggggagtacagactccggggagaggcccgcaaaacctttgtggacctgatgagacggggcgatctgcctgtgtggctcgcttataaggtcgccgctgaagggattaactacgccgaccgcaagtggtgtttcgatggaatcaaaaataaccagattcttgaggaaaacatggaggtggagatctggacgaaggaaggcgagcgcaagaagctgaaaccccggtggctggacgcgagaatctattccgatcctctcgccctgaaggaatttaaggagttcgctgccgggcgcaaatctcttaccctgaatctcattacagaaatgggccggctgcccaccttcatgacacagaaggctagaaacgccctggacaatctcgccgttcttcataccgctgaggcgggaggccgcgcctacaaccacgctctgagcgagctgccggaaacactcgagaccctgcttctgctcacgctgctggccacagtgaccgggggaatctttctcttccttatgtccggcaaagggattggaaagatgaccctgggcatgtgctgcatcattacagccagcatcctgctctggtatgctcaaatccagcctcactggattgccgcgtctatcattctggaatttttccttatcgtcctgctcattcccgagcccgaaaaacagcggacccctcaggataatcaactgacatacgtggttatcgccatcctgacggtggtcgctgccaccatggctaacgagatgggctttctcgagaagacaaagaaagaccttgggctgggatccattaccacacaggaaagcgagtccaatatcctggacattgatctcagaccggcctctgcgtggaccctgtatgccgtggctacgaccttcgtcacacccatgcttcggcatagcatcgaaaactcctctgtgaatgttagcctgaccgccattgctaaccaggccacagtgctcatgggcctggggaagggatggcctctgtccaaaatggacatcggcgtgcccctccttgctattgggtgttacagccaggtcaatcctatcaccctgacggccgcgctgctcctgcttgttgcccactacgctatcattggacccggcctgcaagccaaggctacacgcgaggcccagaaaagagccgcggctggcatcatgaagaaccctaccgtggatgggattacagtgatcgacctcgaaccgattccctatgatcctaagtttgagaaacagctgggacaggtcatgctgctcatcctttgcgtgacccaagttctgatgatgcggaccacatgggccctgtgtgaggctctcacgctggccaccggccccatctctacactttgggaagggaatcctggacgcttctggaacaccacaattgccgtgtccatggctaatatctttagaggcagctacctggccggggcgggactcctgttctctattatgaagaacaccacgtccacacggcgcggcaccggcaatatcggggagaccctgggagaaaaatggaaaagcagactcaacgcccttggcaaatctgagtttcagatttataagaaaagcgggatccaggaggtcgaccggacactggctaaggaaggaatcaagcgcggcgagaccgatcatcacgccgtgtccagagggtctgctaaactgcggtggttcgtcgaaagaaacatggtgacacccgagggaaaggttgtggacctcggctgcggccgcgggggatggagctactattgtggcgggctgaaaaatgtccgggaagtgaagggacttacgaaaggcgggccgggacatgaggagcctattcccatgtccacctacggctggaacctggttagactccaaagcggcgtggatgtctttttcacaccccctgaaaagtgcgacaccctgctgtgtgatatcggggagtcctctcccaatcctacaattgaagccggacgcaccctccgggtgcttaacctggtggagaattggctgaacaataacacgcagttctgcatcaaggttctcaatccgtatatgcccagcgtcattgagaagatggaggcgctgcagagaaagtacggcggggcccttgtgcgcaaccctctgtccagaaattctacccacgagatgtactgggtgagcaacgctacaggaaatatcgtctcctctgttaacatgatcagcagaatgctcattaatcgctttaccatgaaacacaagaaagccacatatgaacccgacgtggatctgggctccgggacccggaacatcggaattgagagcgaaatccctaacctggacattatcggcaagagaattgagaagatcaaacaggaacatgagacatcttggcactacgaccaagatcatccctataagacctgggcttaccacggctcctatgagacgaaacagacagggagcgcctcttccatggtgaatggagtcgtgcgcctccttaccaagccgtgggacgttgtgcctatggtcacccagatggctatgacagatacgacccccttcggccagcaacgggtgtttaaagaaaaggttgacacaagaacccaggagcctaaggaagggaccaagaagctgatgaaaatcaccgccgagtggctgtggaaggagctcggcaagaagaaaacaccccgcatgtgtaccagagaagagttcacgcggaaggtgcgcagcaacgcggccctgggcgctatttttaccgatgaaaataagtggaaatctgccagagaggctgtcgaagacgggcggttctgggagcttgtggatagagagcggaacctgcacctcgaaggaaagtgcgagacatgtgtgtacaatatgatgggcaaacgcgaaaagaaactgggcgagtttgggaaggccaagggatccagagccatctggtatatgtggctgggcgcgcggttcctcgaatttgaggctctggggttccttaacgaggaccattggtttagccgcggaaattccctgagcggcgtcgaaggggagggcctccacagactgggatacattcttcgggatgtttctaaaaaggaaggcggggccatgtacgccgacgataccgctggatgggacacacgcatcaccctggaggacctcaaaaacgaagagatggtgacgaatcatatgaagggcgagcacaaaaagctggccgaagctattttcaagctgacatatcagaacaaagtggtcagagtgcagcggcctacaccccgcgggatcgttatggatatcattagcagacgggaccaacgcggatccggccaggtggggacatacggcctcaatacctttacgaacatggaggcccagctgatcagacaaatggaaggagagggcattttcaagtctatccagcatcttaccgcggccgaggaaattgtcgtgcagaattggctggctcgggttgggcgcgagagactcagccggatggccatctccggagatgactgcgtggtcaaaccgatcgatgacagattcgcttctgccctgacagcgcttaacgatatgggcaaggtgcgcaaagacattcagcaatgggaacctagccgggggtggaatgattggacccaggttcccttttgctcccaccacttccatgagctggtgatgaaggacggaagagtcctcgtggtcccctgtcgcaaccaggatgaactgatcggccgggccagaatttctcagggggctggctggagcctgaaggagacagcctgcctcggaaaatcctatgctcaaatgtggaccctgatgtactttcaccgccgggaccttagactggccgctaacgccatctgtagcgcggtgccttctcattgggttccgacatcccgcaccacgtggagcattcacgccaagcacgagtggatgacaaccgaagatatgctcgctgtgtggaatcgggtctggatccaggagaacccctggatggaagacaaaacccctgtggagtcttgggaagaggtgccctatctgggcaagagagaggaccagtggtgcgggtcccttattggactgacaagccgcgccacctgggccaaaaatatccagacagctatcaaccaagttcggtccctcattggcaatgaagagtacacggattatatgccttctatgaagagattccggagagaagaggaagaggccggggtgctgtggtga

SEQ ID NO: 19839 - RNA, 9876 nt, synthetic construct
  misc_feature 1..9876: note = derived and/or modified CDS sequence (opt5) from DENV-2__KC294207__SS-prME
  source 1..9876: mol_type = other RNA
accgccggcgtgatcgtgatgctgattcccacagctatggccttccacctcacgaccagaaacggggaacctcatatgatcgttggacggcaggaaaagggcaaatccctgctttttaagacagaagacggggtgaatatgtgcaccctgatggcgattgatctcggagaactgtgtgaggacacaatcacctacaaatgcccgcttctgcgccaaaacgaacccgaggatattgactgttggtgcaattccacatctacctgggtgacgtatggcacctgtacaaccacaggggagcacagacgggaaaagcgcagcgtcgctctcgtgcctcatgttggaatgggcctggagaccagaacggaaacatggatgtcctctgagggcgcctggaaacacgtgcagcggatcgagacctggatcctgcgccatcccgggttcacaattatggccgctatcctcgcctacaccattggaaccacacactttcagagagctctgatcttcattcttctgacggccgtcgcgcctagcatgaccatgcggtgcatcggcatttccaaccgcgattttgtggaaggggtttctggaggcagctgggtggacatcgtcctcgagcacgggtcctgtgtgacaaccatggccaagaataagcccacactggatttcgaacttatcaaaaccgaggctaagcagcctgccacgctgagaaaatattgcattgaagctaagctcacaaacaccaccacagagagccggtgtccgacccaaggagagccctctctgaatgaagaacaggacaaacgctttatctgcaagcattccatggtggatagaggctggggcaacgggtgtggactgttcggcaaaggcgggattgtcacatgcgccatgtttacgtgcaaaaagaatatggaagggaaaatcgttcagcctgagaacctcgaatacaccattgtgatcacaccccacagcggggaggagcatgcggtgggaaatgacaccggcaagcacggcaaagaaatcaagattacacctcagtcttccaccacggaggccgaactgaccgggtatggaacagtcaccatggagtgtagcccccggacaggccttgatttcaacgaaatggtgctgctccaaatggaggacaaggcttggctggttcaccgccagtggtttcttgatctgccgctcccttggctgcccggggccgacacccagggatctaattggatccagaaggagacgctggtgacattcaagaaccctcatgctaaaaagcaagacgtcgtggttctcggctcccaggaaggggccatgcacaccgccctgacaggcgctaccgagattcagatgagctccggaaatcttctgtttaccggccatctcaaatgcagactgcggatggataaacttcaactgaaagggatgtcttactgtatgtgcacaggaaagttcaagatcgtgaaagaaattgcggagacgcagcacggcaccatcgtcatcagagtgcagtatgagggggacggaagcccctgtaagattcccttcgaaatcacagatctcgagaaacgccatgtcctgggccggctgattaccgtgaaccctatcgttacagaaaaggactccccggtgaacattgaggccgaacccccttttggggatagctacatcattgtcggcgtggagcccggacagctcaaactgaattggttcaagaagggatcttccatcgggcaaatgtttgagaccacgatgagaggagctaaacgcatggccatccttggcgacacagcctgggatttcgggagcctgggaggcgtttttacctctattgggaaggctctccaccaggtgttcggcgccatctacggagcggcttttagcggcgtctcctggaccatgaaaattctgatcggggtgattatcacatggatcggaatgaactctcggagcacctccctgagcgtgtctcttgttctcgtcggcgtggtgacactgtatctgggggccatggtccaggccgactccggatgcattgtgagctggaagaataaagaactcaagtgtggctctgggatcttcattacggataacgttcacacctggacagagcagtacaagtttcaacctgaatcccccagcaaactggcttccgccatccagaaggctcatgaggaaggcatttgcggaatcagatctgtgacccgccttgagaatctgatgtggaaacagatcacaccggagctcaaccacattctgagcgaaaatgaggtcaagctgaccatcatgacgggcgacattaaagggatcatgcaggccggaaagcggtcccttagacctcaacccaccgaactcaaatattcttggaagacatggggcaaggcgaaaatgctgagcaccgagtcccataaccagacattcctgattgatgggcctgaaaccgccgagtgtcccaatacaaaccgcgcttggaatagcctcgaggtggaagactacggatttggcgttttcaccacgaacatctggctgaaacttcgggagaaacaggacgtgttttgcgattctaagctgatgtccgccgctatcaaagacaatagagccgtccacgcggatatgggctattggattgaaagcgccctcaacgacacatggaagatggagaaggcttctttcatcgaggtgaaatcctgtcactggcctaagagccataccctgtggtctaatggggttctggaaagcgagatgattatccccaaaaacttcgccggaccggtgtcccagcacaactaccgccctggctatcatacccaaacagctgggcccggacaccttggcaagctcgaaatggattttgacctgtgcgaggggaccacggtcgtggtgacagaagattgcggaaatcggggccccagcctgagaaccacaaccgcctctggcaaactcattacagagtggtgttgccggtcctgtaccctgcctccgcttcgctacagaggggaggacggatgctggtacggcatggaaatccggcccctgaaggagaaggaagagaacctcgtcaatagcctggttacggccgggcatggacagattgataacttctccctgggcgtgcttgggatggctctctttctggaagagatgctgagaacccgcgtgggaacaaaacacgcgatcctcctggtcgccctttctttcgtgaccctgatcacaggcaatatgagctttcgggacctcggcagagttatggtgatggtcggggctaccatgacggatgacattggaatgggcgtgacatatctggccctgcttgccgctttcaaggttcgccctacctttgccgcggggctgctcctgagaaaactcacatccaaggagctgatgatggctaccatcggaattgcccttctgtctcagagcaccctccccgaaacaatcctggagctgacggatgcccttgctctgggcatgatggccctcaaaattgtgcggaacatggaaaagtaccaactggcggtcaccatcatggctatctcctgtgtgcctaatgccgttattctccagaacgcctggaaggtgtcttgcacaatcctggctgccgtcagcgtgagcccccttctgctcaccagctctcagcagaaagctgactggattcctctggccctgacaatcaaggggcttaatcccaccgcgattttcctgacgacactctcccgcaccagcaaaaagagatcttggccgctgaacgaggccatcatggctgtgggaatggtctccatcctcgccagctctctgcttaaaaatgacattcctatgaccggccccctggttgctggcgggctgctcacagtgtgttatgtgctgaccggacggtccgccgatcttgaactggagcgcgccgctgacgtcaagtgggaggatcaagcggaaatcagcggctccagccctattctctctatcacaattagcgaggacgggtccatgtctatcaaaaacgaagaggaggaacagacgctgaccattctcatcagaacaggactgcttgtgatcagcggcgtttttcccgtgtccattccgatcaccgccgctgcctggtacctgtgggaggtcaagaagcagcgggccggggtgctgtgggatgttccttctccccctcccgtgggaaaagctgaactcgaggacggcgcctatcgcattaagcagagaggcatcctggggtacagccaaattggagcgggcgtctataaagaagggacattccacaccatgtggcatgtgacgcggggagctgtccttatgcaccgcggcaagagaatcgagccctcctgggccgatgtgaaaaaggacctgatctcttacgggggaggctggaagctcgagggcgaatggaaagagggggaagaggttcaggtgctggccctcgaacctggaaagaatccgcgggctgtccagaccaaacccggcatttttaagacaaacaccgggacaatcggagccgtgagcctggatttctcccctggcaccagcgggtctcccattgttgacagaaaaggaaaggtggtcggcctttacggcaatggggtggtgacacgctccggagcgtatgttagcgctatcgcccagacggagaagtctattgaggataaccctgaaatcgaggacgatatctttcggaaaaagagactgaccattatggacctgcatcccggcgccgggaaaacaaagcgctacctccctgctatcgtccgggaagccattaaaagaggactgcgcacccttatcctggctccgacccgggtggtggccgcggagatggaagaggccctcagaggcctgcccattcgctatcaaacccctgctatccgggccgagcacacggggagagaaattgtcgacctcatgtgccatgctaccttcacaatgcggctgctttcccccgtgcgcgttcctaactacaatctgatcatcatggatgaggcccacttcaccgaccccgccagcattgctgcgagaggctatatctccacacgggtggaaatgggagaggccgctggcatttttatgaccgccacgccgcctgggtctcgcgatcccttcccccagagcaacgcccctatcatggacgaggaaagagagattcccgaacggtcctggaatagcggacacgagtgggtcacagattttaagggcaagaccgtgtggttcgttccttctatcaaagctgggaacgacatcgccgcgtgtctgagaaagaatggcaagaaggtgattcagctctcccgcaaaacctttgatagcgaatacgtcaagacacgggctaacgactgggatttcgtggttaccacagacatctctgagatgggcgccaattttaaggccgagagagtgattgatccgcgccggtgcatgaaacccgtcatcctgaccgacggggaagagagagtgattcttgctggccctatgcccgtgacgcatagctccgccgcgcaacgccggggaagaatcggccgcaaccctaagaatgaaaacgaccagtatatctacatgggggagcccctggaaaatgatgaggactgtgcccactggaaagaggctaagatgctcctggataacattaatacaccggaaggaatcattccttctatgttcgagcccgaaagagagaaagtcgacgccatcgatggcgaataccggctgcgcggggaggctagaaagacctttgttgacctcatgcggcgcggagatcttcctgtgtggctggcctataaagtggctgccgagggcattaactacgcggacagaaagtggtgcttcgatgggatcaagaataaccagattctggaagagaacgtcgaagtggagatctggacaaaagagggcgaacggaagaaactcaagcccagatggctggacgcccgcatctatagcgatcctcttgctctgaaagagtttaaggagttcgccgctggacggaagtccctcaccctgaatctgattacggagatgggcagactccccaccttcatgacacagaaagcccgcaacgcccttgacaatctggctgttctgcataccgcggaagtcgggggaaaggcctacacacacgctctctctgagctgccggagacccttgaaacactgctcctgctgaccctccttgccgccgtcacgggcgggatctttctgttcctgatgagcggaaaaggcgtgggcaagatgacactcgggatgtgctgtattatcaccgcttccattctgctttggtatgcccaaatccagcctcactggatcgcggccagcattatcctggagtttttcctcattgttctgctgatccccgaacccgagaaacagcggacccctcaggataaccaactcacatacgtggtcattgctatccttaccgtggtcgccgctacaatggccaatgaaatgggatttctggagaagacgaagaaagacctgggcttcgggtctatcaccacacaggagtccgaaagcaacattctcgacatcgatctgagaccggcgtccgcctggaccctttatgctgtggccacaacctttgttacgcccatgctgcggcattctattgagaatagctccgtgaacgtgtctctcaccgctatcgccaatcaggctacagtcctgatgggactgggcaaggggtggcctctcagcaaaatggacattggagttccccttctggccatcggctgctactcccaggtgaaccctattaccctgacagcggccctcctgcttctggtggctcactacgccatcatcggccccgggctccaagctaaggccacccgcgaagcccagaaaagagcggctgccggaattatgaagaatcctacggtcgatggcatcacagtgattgacctggagccgatcccctatgatcctaagttcgaaaaacagctggggcaggttatgctccttattctgtgtgtgacccaagtcctgatgatgcggacaacctgggctctctgcgaggccctgacccttgccacaggacccatcagcacgctgtgggagggcaaccctgggcgcttttggaataccacaatcgctgtgtctatggccaacattttcagaggatcctacctcgcgggcgccggcctgctgtttagcatcatgaagaataccacaaacacccggcgcgggacgggaaatgtcggcgaaacactcggggagaaatggaagtctagacttaacgctctgggaaaatccgagttccagatttataagaaaagcggcatccaggaggtggaccggaccctggccaaggaggggattaagcgcggagaaaccgatcatcacgctgtttctagaggcagcgccaaactccggtggtttgtggagagaaacatggtcacacccgaaggcaaggtggttgacctggggtgtggacgcggcgggtggtcctactattgcggaggccttaaaaatgtgcgggaggtcaaggggctgaccaaaggaggcccgggccatgaagaacctatccccatgtctacatacgggtggaacctcgtgagactgcaaagcggagtggatgttttcttcacgccccctgagaagtgtgacaccctgctctgcgatatcggcgaatccagccccaatcctacaattgaggcggggcgcacccttcgggtcctgaacctggtggaaaattggctcaacaataacacacagttttgtatcaaggtgctgaatccgtatatgccctccgtcattgagaaaatggaaacccttcagagaaagtacggaggcgccctggttcgcaaccctctctctcggaatagcacgcacgagatgtactgggtgtccaacgctaccgggaatatcgtgtctagcgtcaacatgatttccagaatgctgatcaatcgcttcacaatgaaacacaagaaagccacctatgagcccgacgtggatctgggatctggcacacggaacatcggcattgaaagcgagatccctaacctcgacattgttgggaagagaatcgaaaagattaaacaggagcatgaaacctcctggcactacgaccaagatcatccctataagacatgggcttaccacggaagctatgagaccaaacagacgggctctgcctccagcatggtgaatggggtcgtgcgccttctgacaaagccgtgggacgttgtgcctatggtcacccagatggctatgaccgatacaacgccctttggacagcaacgggtgttcaaagagaaggtggacaccagaacacaggaacctaaggagggcaccaaaaagctgatgaaaatcacagccgaatggctctggaaggagctggggaaagagaagacaccccgcatgtgcacaagagaagagtttacccggaaagtccgctctaacgcggcccttggagctgttttcacggatgaaaataagtggaagtccgccagagaggctgtggaagacggccggttttgggagctggtggatagagagcggaacctccacctggaaggcaaatgtgagacctgcgtctacaatatgatggggaagcgcgagaagaagctgggagagttcggcaaagccaaggggagcagagccatttggtatatgtggctcggagcgcggtttctggagttcgaggctcttggctttctgaacgaggaccattggttctctcgcggaaattccctcagcggcgtggaaggagagggcctgcacagacttgggtacatcctgcgggaagttggaaagaaagagggcggggccatgtacgccgatgacacagctggatgggatacccgcatcacactcgaagacctgaagaacgaggagatggtgaccaatcatatgaaaggcgaacacaagaaactggccgaggctatttttaagctcacgtatcagaacaaggtcgtgagagttcagcggcctacaccccgcgggaccgtgatggacatcatttccagaaaagatcaacggggcagcggacaggtcggcacatacgggctgaataccttcacgaacatggaagcccagcttatccgccaaatggagggagagggcattttcaagtctatccagcatctgaccgcgacagaagagatcgccgtgcagaattggctcgctagagttgggcgggaacgcctgagcagaatggccatttccggagacgattgcgtggtcaaaccgatcgacgatcggtttgcttctgcccttaccgcgctgaacgacatgggcaaggtgagaaaagatattcagcaatgggagcctagccgcgggtggaatgactggacacaggtccccttctgttcccaccactttcatgaactcgtgatgaaggatggccgggttctggtggtcccctgcagaaaccaggacgagctgatcggacgcgcccggatttctcagggcgctgggtggagcctcaaggagaccgcctgtctgggaaaatcctatgctcaaatgtggacacttatgtacttccacagacgcgatctgcggctcgccgctaacgccatctgctctgcggtgcctagccattgggtgccgacctccagaacgacatggagcatccacgccaagcacgaatggatgaccaccgaggacatgctggttgtgtggaatcgcgtctggattcaggaaaacccctggatggaggataaaacacctgtggaatcttgggaggaggttccctatcttggcaagcgggaagaccagtggtgtgggtccctgatcggactcaccagcagagctacatgggccaaaaatattcagacggccatcaaccaagtgcgctctctgattggcaatgaggggtacaccgactatatgccttccatgaagcggtttagacgggaagaggaagaggctggcgtcctgtggtga
